United States Patent 9,675,668 (MODIFIED POLYNUCLEOTIDES ENCODING HEPATITIS A VIRUS CELLULAR RECEPTOR 2) - sequence listing, part 11

SEQ ID NO: 20549 - DNA, 957 bp, Artificial Sequence
  Description of Artificial Sequence: Synthetic coding sequence
atgagcgtgctgaacaacagcgaggtgaagctgttcctgctgatcggcatccccggcctggagcacgcccacatctggttcagcatccccatctgcctgatgtacctgctggccatcatgggcaactgcaccatcctgttcatcatcaagaccgagcccagcctgcacgagcccatgtactacttcctggccatgctggccgtgagcgacatgggcctgagcctgagcagcctgcccaccatgctgagagtgttcctgttcaacgccatgggcatcagccccaacgcctgcttcgcccaggagttcttcatccacggcttcaccgtgatggagagcagcgtgctgctgatcatgagcctggacagattcctggccatccacaaccccctgagatacagcagcatcctgaccagcaacagagtggccaagatgggcctgatcctggccatcagaagcatcctgctggtgatccccttccccttcaccctgagaagactgaagtactgccagaagaacctgctgagccacagctactgcctgcaccaggacaccatgaagctggcctgcagcgacaacaagaccaacgtgatctacggcttcttcatcgccctgtgcaccatgctggacctggccctgatcgtgctgagctacgtgctgatcctgaagaccatcctgagcatcgccagcctggccgagagactgaaggccctgaacacctgcgtgagccacatctgcgccgtgctgaccttctacgtgcccatcatcaccctggccgccatgcaccacttcgccaagcacaagagccccctggtggtgatcctgatcgccgacatgttcctgctggtgccccccctgatgaaccccatcgtgtactgcgtgaagaccagacagatctgggagaagatcctggtgaccttcagattcatcaagaccgtgaagaagttctggaagagatag

SEQ ID NO: 20550 - DNA, 939 bp, Artificial Sequence
  Description of Artificial Sequence: Synthetic coding sequence
atgtggcccaacatcaccgccgcccccttcctgctgaccggcttccccggcctggaggccgcccaccactggatcagcatccccttcttcgccgtgtacgtgtgcatcctgctgggcaacggcatgctgctgtacctgatcaagcacgaccacagcctgcacgagcccatgtactacttcctgaccatgctggccggcaccgacctgatggtgaccctgaccaccatgcccaccgtgatgggcatcctgtgggtgaaccacagagagatcagcagcgtgggctgcttcctgcaggcctacttcatccacagcctgagcgtggtggagagcggcagcctgctggccatggcctacgactgcttcatcgccatcagaaaccccctgagatacgccagcatcctgaccaacaccagagtgatcgccctgggcgtgggcgtgttcctgagaggcttcgtgagcatcctgcccgtgatcctgagactgttcagcttcagctactgcaagagccacgtgatcaccagagccttctgcctgcaccaggagatcatgagactggcctgcgccgacatcaccttcaacagactgtaccccgtgatcctgatcagcctgaccatcttcctggactgcctgatcatcctgttcagctacatcctgatcctgaacaccgtgatcggcatcgccagcggcgaggagagagccaaggccctgaacacctgcatcagccacatcagctgcgtgctgatcttctacgtgaccgtgatgggcctgaccttcatctacagattcggcaagaacgtgcccgaggtggtgcacatcatcatgagctacatctacttcctgttcccccccctgatgaaccccgtgatctacagcatcaagaccaagcagatccagtacggcatcatcagactgctgagcaagcacagattcagcagctag

SEQ ID NO: 20551 - DNA, 933 bp, Artificial Sequence
  Description of Artificial Sequence: Synthetic coding sequence
atgtggtacaacaacagcgccggccccttcctgctgaccggcttcctgggcagcgaggccgtgcactacagaatcagcatgagcttcttcgtgatctacttcagcgtgctgttcggcaacggcaccctgctggtgctgatctggaacgaccacagcctgcacgagcccatgtactacttcctggccatgctggccgacaccgacctgggcatgaccttcaccaccatgcccaccgtgctgggcgtgctgctgctggaccagagagagatcgcccacgccgcctgcttcacccagagcttcatccacagcctggccatcgtggagagcggcatcctgctggtgctggcctacgactgcttcatcgccatcagaacccccctgagatacaactgcatcctgaccaacagcagagtgatgaacatcggcctgggcgtgctgatgagaggcttcatgagcatcctgcccatcatcctgagcctgtactgctacccctactgcggcagcagagccctgctgcacaccttctgcctgcaccaggacgtgatcaagctggcctgcgccgacatcaccttcaaccacatctaccccatcatccagaccagcctgaccgtgttcctggacgccctgatcatcatcttcagctacatcctgatcctgaagaccgtgatgggcatcgccagcggccaggaggaggccaagagcctgaacacctgcgtgagccacatcagctgcgtgctggtgttccacatcaccgtgatgggcctgagcttcatccacagattcggcaagcacgccccccacgtggtgcccatcaccatgagctacgtgcacttcctgttcccccccttcgtgaaccccatcatctacagcatcaagaccaagcagatccagagaagcatcatcagactgttcagcggccagagcagagcctag

SEQ ID NO: 20552 - DNA, 939 bp, Artificial Sequence
  Description of Artificial Sequence: Synthetic coding sequence
atgagcagcagcggcagcagccaccccttcctgctgaccggcttccccggcctggaggaggcccaccactggatcagcgtgttcttcctgttcatgtacatcagcatcctgttcggcaacggcaccctgctgctgctgatcaaggaggaccacaacctgcacgagcccatgtacttcttcctggccatgctggccgccaccgacctgggcctggccctgaccaccatgcccaccgtgctgggcgtgctgtggctggaccacagagagatcggcagcgccgcctgcttcagccaggcctacttcatccacagcctgagcttcctggagagcggcatcctgctggccatggcctacgacagattcatcgccatctgcaaccccctgagatacaccagcgtgctgaccaacaccagagtggtgaagatcggcctgggcgtgctgatgagaggcttcgtgagcgtggtgccccccatcagacccctgtacttcttcctgtactgccacagccacgtgctgagccacgccttctgcctgcaccaggacgtgatcaagctggcctgcgccgacaccaccttcaacagactgtaccccgccgtgctggtggtgttcatcttcgtgctggactacctgatcatcttcatcagctacgtgctgatcctgaagaccgtgctgagcatcgccagcagagaggagagagccaaggccctgatcacctgcgtgagccacatctgctgcgtgctggtgttctacgtgaccgtgatcggcctgagcctgatccacagattcggcaagcaggtgccccacatcgtgcacctgatcatgagctacgcctacttcctgttcccccccctgatgaaccccatcacctacagcgtgaagaccaagcagatccagaacgccatcctgcacctgttcaccacccacagaatcggcacctag

SEQ ID NO: 20553 - DNA, 939 bp, Artificial Sequence
  Description of Artificial Sequence: Synthetic coding sequence
atgggcctgaacaagagcgccagcaccttccagctgaccggcttccccggcatggagaaggcccaccactggatcttcatccccctgctggccgcctacatcagcatcctgctgggcaacggcaccctgctgttcctgatcagaaacgaccacaacctgcacgagcccatgtactacttcctggccatgctggccgccaccgacctgggcgtgaccctgaccaccatgcccaccgtgctgggcgtgctgtggctggaccacagagagatcggccacggcgcctgcttcagccaggcctacttcatccacaccctgagcgtgatggagagcggcgtgctgctggccatggcctacgactgcttcatcaccatcagaagccccctgagatacaccagcatcctgaccaacacccaggtgatgaagatcggcgtgagagtgctgaccagagccggcctgagcatcatgcccatcgtggtgagactgcactggttcccctactgcagaagccacgtgctgagccacgccttctgcctgcaccaggacgtgatcaagctggcctgcgccgacatcaccttcaacagactgtaccccgtggtggtgctgttcgccatggtgctgctggacttcctgatcatcttcttcagctacatcctgatcctgaagaccgtgatgggcatcggcagcggcggcgagagagccaaggccctgaacacctgcgtgagccacatctgctgcatcctggtgttctacgtgaccgtggtgtgcctgaccttcatccacagattcggcaagcacgtgccccacgtggtgcacatcaccatgagctacatccacttcctgttcccccccttcatgaaccccttcatctacagcatcaagaccaagcagatccagagcggcatcctgagactgttcagcctgccccacagcagagcctag

SEQ ID NO: 20554 - DNA, 918 bp, Artificial Sequence
  Description of Artificial Sequence: Synthetic coding sequence
gtgagcaccagccagagccacgacttcctgctgaccggcttccccggcatggagaaggcccaccactggatcttcatccccctgctggccgcctacatcagcatcctgctgggcaacggcaccctgctgttcctgatcagaaacgaccacaacctgcacgagcccatgtactacttcctggccatgctggccgccaccgacctgggcgtgaccctgaccaccatgcccaccgtgctgggcgtgctgtggctggaccacagagagatcggccacggcgcctgcttcagccaggcctacttcatccacaccctgagcgtgatggagagcggcgtgctgctggccatggcctacgactgcttcatcaccatcagaagccccctgagatacaccagcatcctgaccaacacccaggtgatgaagatcggcgtgagagtgctgaccagagccggcctgagcatcatgcccatcgtggtgagactgcactggttcccctactgcagaagccacgtgctgagccacgccttctgcctgcaccaggacgtgatcaagctggcctgcgccgacatcaccttcaacagactgtaccccgtggtggtgctgttcgccatggtgctgctggacttcctgatcatcttcttcagctacatcctgatcctgaagaccgtgatgggcatcggcagcggcggcgagagagccaaggccctgaacacctgcgtgagccacatctgctgcatcctggtgttctacgtgaccgtggtgtgcctgaccttcatccacagattcggcaagcacgtgccccacgtggtgcacatcaccatgagctacatccacttcctgttcccccccttcatgaaccccttcatctacagcatcaagaccaagcagatccagagcggcatcctgagactgttcagctag

SEQ ID NO: 20555 - DNA, 939 bp, Artificial Sequence
  Description of Artificial Sequence: Synthetic coding sequence
atgaccaacaacatcaccagcaccagcatcatcttcctgctgaccggcgtgcccggcctggaggccttccacacctggatcagcatccccttctgcttcctgagcgtgaccgccctgctgggcaacagcctgatcctgttcgccaccatcacccagcccagcctgcacgagcccatgtactacttcctgagcatgctgagcgccaccgacctgggcctgagcatcagcaccctggtgaccatgctgagcatcttctggttcaacgtgagagagatcagcttcaacgcctgcctgagccacatgttcttcatcaagttcttcaccgtgatggagagcagcgtgctgctggccatggccttcgacagattcgtggccgtgagcaaccccctgagatacgccatgatcctgaccgacagcagaatcgcccagatcggcgtggccagcgtgatcagaggcctgctgatgctgacccccatggtggccctgctgatcagactgagctactgccacagccaggtgctgcaccacagctactgctaccaccccgacgtgatgaagctgagctgcaccgacaccagaatcaacagcgccgtgggcctgaccgccatgttcagcaccgtgggcgtggacctgctgctgatcctgctgagctacgtgctgatcatcagaaccgtgctgagcgtggccagccccgaggagagaaaggagaccttcagcacctgcgtgagccacatcgtggccttcgccatctactacatccccctgatcagcctgagcatcgtgcacagattcggcaagcaggcccccgcctacgtgcacaccatgatcgccaacacctacctgctgatcagccccctgatgaaccccgtgatctacagcgtgaagaccaagcagatcagaagagccgtgatcaagatcctgcacagcaaggagacctag

SEQ ID NO: 20556 - DNA, 975 bp, Artificial Sequence
  Description of Artificial Sequence: Synthetic coding sequence
atgcagaagccccagctgctggtgcccatcatcgccaccagcaacggcaacctggtgcacgccgcctacttcctgctggtgggcatccccggcctgggccccaccatccacttctggctggccttccccctgtgcttcatgtacgccctggccaccctgggcaacctgaccatcgtgctgatcatcagagtggagagaagactgcacgagcccatgtacctgttcctggccatgctgagcaccatcgacctggtgctgagcagcatcaccatgcccaagatggccagcctgttcctgatgggcatccaggagatcgagttcaacatctgcctggcccagatgttcctgatccacgccctgagcgccgtggagagcgccgtgctgctggccatggccttcgacagattcgtggccatctgccaccccctgagacacgccagcgtgctgaccggctgcaccgtggccaagatcggcctgagcgccctgaccagaggcttcgtgttcttcttccccctgcccttcatcctgaagtggctgagctactgccagacccacaccgtgacccacagcttctgcctgcaccaggacatcatgaagctgagctgcaccgacaccagagtgaacgtggtgtacggcctgttcatcatcctgagcgtgatgggcgtggacagcctgttcatcggcttcagctacatcctgatcctgtgggccgtgctggagctgagcagcagaagagccgccctgaaggccttcaacacctgcatcagccacctgtgcgccgtgctggtgttctacgtgcccctgatcggcctgagcgtggtgcacagactgggcggccccaccagcctgctgcacgtggtgatggccaacacctacctgctgctgccccccgtggtgaaccccctggtgtacggcgccaagaccaaggagatctgcagcagagtgctgtgcatgttcagccagggcggcaagtag

SEQ ID NO: 20557 - DNA, 957 bp, Artificial Sequence
  Description of Artificial Sequence: Synthetic coding sequence
atgatggtggaccccaacggcaacgagagcagcgccacctacttcatcctgatcggcctgcccggcctggaggaggcccagttctggctggccttccccctgtgcagcctgtacctgatcgccgtgctgggcaacctgaccatcatctacatcgtgagaaccgagcacagcctgcacgagcccatgtacatcttcctgtgcatgctgagcggcatcgacatcctgatcagcaccagcagcatgcccaagatgctggccatcttctggttcaacagcaccaccatccagttcgacgcctgcctgctgcagatgttcgccatccacagcctgagcggcatggagagcaccgtgctgctggccatggccttcgacagatacgtggccatctgccaccccctgagacacgccaccgtgctgaccctgcccagagtgaccaagatcggcgtggccgccgtggtgagaggcgccgccctgatggcccccctgcccgtgttcatcaagcagctgcccttctgcagaagcaacatcctgagccacagctactgcctgcaccaggacgtgatgaagctggcctgcgacgacatcagagtgaacgtggtgtacggcctgatcgtgatcatcagcgccatcggcctggacagcctgctgatcagcttcagctacctgctgatcctgaagaccgtgctgggcctgaccagagaggcccaggccaaggccttcggcacctgcgtgagccacgtgtgcgccgtgttcatcttctacgtgcccttcatcggcctgagcatggtgcacagattcagcaagagaagagacagccccctgcccgtgatcctggccaacatctacctgctggtgccccccgtgctgaaccccatcgtgtacggcgtgaagaccaaggagatcagacagagaatcctgagactgttccacgtggccacccacgccagcgagccctag

SEQ ID NO: 20558 - DNA, 963 bp, Artificial Sequence
  Description of Artificial Sequence: Synthetic coding sequence
atgagcagctgcaacttcacccacgccaccttcgtgctgatcggcatccccggcctggagaaggcccacttctgggtgggcttccccctgctgagcatgtacgtggtggccatgttcggcaactgcatcgtggtgttcatcgtgagaaccgagagaagcctgcacgcccccatgtacctgttcctgtgcatgctggccgccatcgacctggccctgagcaccagcaccatgcccaagatcctggccctgttctggttcgacagcagagagatcagcttcgaggcctgcctgacccagatgttcttcatccacgccctgagcgccatcgagagcaccatcctgctggccatggccttcgacagatacgtggccatctgccaccccctgagacacgccgccgtgctgaacaacaccgtgaccgcccagatcggcatcgtggccgtggtgagaggcagcctgttcttcttccccctgcccctgctgatcaagagactggccttctgccacagcaacgtgctgagccacagctactgcgtgcaccaggacgtgatgaagctggcctacgccgacaccctgcccaacgtggtgtacggcctgaccgccatcctgctggtgatgggcgtggacgtgatgttcatcagcctgagctacttcctgatcatcagaaccgtgctgcagctgcccagcaagagcgagagagccaaggccttcggcacctgcgtgagccacatcggcgtggtgctggccttctacgtgcccctgatcggcctgagcgtggtgcacagattcggcaacagcctgcaccccatcgtgagagtggtgatgggcgacatctacctgctgctgccccccgtgatcaaccccatcatctacggcgccaagaccaagcagatcagaaccagagtgctggccatgttcaagatcagctgcgacaaggacctgcaggccgtgggcggcaagtag

SEQ ID NO: 20559 - DNA, 252 bp, Artificial Sequence
  Description of Artificial Sequence: Synthetic coding sequence
atgagcagctgcaacttcacccacgccaccttcgtgctgatcggcatccccggcctggagaaggcccacttctgggtgggcttccccctgctgagcatgtacgtggtggccatgttcggcaactgcatcgtggtgttcatcgtgagaaccgagagaagcctgcacgcccccatgtacctgttcctgtgcatgctggccgccatcgacctggccctgagcaccagcaccatgcccaagatcctggccctgtag

SEQ ID NO: 20560 - DNA, 1029 bp, Artificial Sequence
  Description of Artificial Sequence: Synthetic coding sequence
atgaccgagaccagcctgagcagccagtgcttccccatgagcgtgctgaacaacaccatcgccgagcccctgatcttcctgctgatgggcatccccggcctgaaggccacccagtactggatcagcatccccttctgcctgctgtacgtggtggccgtgagcggcaacagcatgatcctgttcgtggtgctgtgcgagagaagcctgcacaagcccatgtactacttcctgagcatgctgagcgccaccgacctgagcctgagcctgtgcaccctgagcaccaccctgggcgtgttctggttcgaggccagagagatcaacctgaacgcctgcatcgcccagatgttcttcctgcacggcttcaccttcatggagagcggcgtgctgctggccatggccttcgacagattcgtggccatctgctaccccctgagatacaccaccatcctgaccaacgccagaatcgccaagatcggcatgagcatgctgatcagaaacgtggccgtgatgctgcccgtgatgctgttcgtgaagagactgagcttctgcagcagcatggtgctgagccacagctactgctaccacgtggacctgatccagctgagctgcaccgacaacagaatcaacagcatcctgggcctgttcgccctgctgagcaccaccggcttcgactgcccctgcatcctgctgagctacatcctgatcatcagaagcgtgctgagcatcgccagcagcgaggagagaagaaaggccttcaacacctgcaccagccacatcagcgccgtgagcatcttctacctgcccctgatcagcctgagcctggtgcacagatacggccacagcgccccccccttcgtgcacatcatcatggccaacgtgttcctgctgatcccccccgtgctgaaccccatcatctacagcgtgaagatcaagcagatccagaaggccatcatcaaggtgctgatccagaagcacagcaagagcaaccaccagctgttcctgatcagagacaaggccatctacgagtag

SEQ ID NO: 20561 - DNA, 966 bp, Artificial Sequence
  Description of Artificial Sequence: Synthetic coding sequence
atgaccatcctgctgaacagcagcctgcagagagccaccttcttcctgaccggcttccagggcctggagggcctgcacggctggatcagcatccccttctgcttcatctacctgaccgtgatcctgggcaacctgaccatcctgcacgtgatctgcaccgacgccaccctgcacggccccatgtactacttcctgggcatgctggccgtgaccgacctgggcctgtgcctgagcaccctgcccaccgtgctgggcatcttctggttcgacaccagagagatcggcatccccgcctgcttcacccagctgttcttcatccacaccctgagcagcatggagagcagcgtgctgctgagcatgagcatcgacagatacgtggccgtgtgcaaccccctgcacgacagcaccgtgctgacccccgcctgcatcgtgaagatgggcctgagcagcgtgctgagaagcgccctgctgatcctgcccctgcccttcctgctgaagagattccagtactgccacagccacgtgctggcccacgcctactgcctgcacctggagatcatgaagctggcctgcagcagcatcatcgtgaaccacatctacggcctgttcgtggtggcctgcaccgtgggcgtggacagcctgctgatcttcctgagctacgccctgatcctgagaaccgtgctgagcatcgccagccaccaggagagactgagagccctgaacacctgcgtgagccacatctgcgccgtgctgctgttctacatccccatgatcggcctgagcctggtgcacagattcggcgagcacctgcccagagtggtgcacctgttcatgagctacgtgtacctgctggtgccccccctgatgaaccccatcatctacagcatcaagaccaagcagatcagacagagaatcatcaagaagttccagttcatcaagagcctgagatgcttctggaaggactag

SEQ ID NO: 20562 - DNA, 945 bp, Artificial Sequence
  Description of Artificial Sequence: Synthetic coding sequence
atgaccctgggcagcctgggcaacagcagcagcagcgtgagcgccaccttcctgctgagcggcatccccggcctggagagaatgcacatctggatcagcatccccctgtgcttcatgtacctggtgagcatccccggcaactgcaccatcctgttcatcatcaagaccgagagaagcctgcacgagcccatgtacctgttcctgagcatgctggccctgatcgacctgggcctgagcctgtgcaccctgcccaccgtgctgggcatcttctgggtgggcgccagagagatcagccacgacgcctgcttcgcccagctgttcttcatccactgcttcagcttcctggagagcagcgtgctgctgagcatggccttcgacagattcgtggccatctgccaccccctgcactacgtgagcatcctgaccaacaccgtgatcggcagaatcggcctggtgagcctgggcagaagcgtggccctgatcttccccctgcccttcatgctgaagagattcccctactgcggcagccccgtgctgagccacagctactgcctgcaccaggaggtgatgaagctggcctgcgccgacatgaaggccaacagcatctacggcatgttcgtgatcgtgagcaccgtgggcatcgacagcctgctgatcctgttcagctacgccctgatcctgagaaccgtgctgagcatcgccagcagagccgagagattcaaggccctgaacacctgcgtgagccacatctgcgccgtgctgctgttctacacccccatgatcggcctgagcgtgatccacagattcggcaagcaggccccccacctggtgcaggtggtgatgggcttcatgtacctgctgttcccccccgtgatgaaccccatcgtgtacagcgtgaagaccaagcagatcagagacagagtgacccacgccttctgctactag

SEQ ID NO: 20563 - DNA, 909 bp, Artificial Sequence
  Description of Artificial Sequence: Synthetic coding sequence
atgaccaacctgaacgccagccaggccaaccacagaaacttcatcctgaccggcatccccggcacccccgacaagaacccctggctggccttccccctgggcttcctgtacaccctgaccctgctgggcaacggcaccatcctggccgtgatcaaggtggagcccagcctgcacgagcccacctactacttcctgagcatcctggccctgaccgacgtgagcctgagcatgagcaccctgcccagcatgctgagcatctactggttcaacgccccccagatcgtgttcgacgcctgcatcatgcagatgttcttcatccacgtgttcggcatcgtggagagcggcgtgctggtgagcatggccttcgacagattcgtggccatcagaaaccccctgcactacgtgagcatcctgacccacgacgtgatcagaaagaccggcatcgccgtgctgaccagagccgtgtgcgtggtgttccccgtgcccttcctgatcaagtgcctgcccttctgccacagcaacgtgctgagccacagctactgcctgcaccagaacatgatgagactggcctgcgccagcaccagaatcaacagcctgtacggcctgatcgtggtgatcttcaccctgggcctggacgtgctgctgaccctgctgagctacgtgctgaccctgaagaccgtgctgggcatcgtgagcagaggcgagagactgaagaccctgagcacctgcctgagccacatgagcaccgtgctgctgttctacgtgcccttcatgggcgccgccagcatgatccacagattctgggagcacctgagccccgtggtgcacatggtgatggccgacatctacctgctgctgccccccgtgctgaaccccatcgtgtacagcgtgaagaccaagcagatctag

SEQ ID NO: 20564 - DNA, 894 bp, Artificial Sequence
  Description of Artificial Sequence: Synthetic coding sequence
ctgaccggcatccccggcatccagaccggcctgacctgggtggccctgatcttctgcatcctgtacatgatcagcatcgtgggcaacctgagcatcctgaccctggtgttctgggagcccgccctgcaccagcccatgtactacttcctgagcatgctggccctgaacgacctgggcgtgagcttcagcaccctgcccaccgtgatcagcaccttctgcttcaactacaaccacgtggccttcaacgcctgcctggtgcagatgttcttcatccacaccttcagcttcatggagagcggcatcctgctggccatgagcctggacagattcgtggccatctgctaccccctgagatacgtgaccgtgctgacccacaacagaatcctggccatgggcctgggcatcctgaccaagagcttcaccaccctgttccccttccccttcgtggtgaagagactgcccttctgcaagggcaacgtgctgcaccacagctactgcctgcaccccgacctgatgaagctgccctgcgccgacaccaagctgaacagcatcctgggcctggccatcgtgctggccaacttcggcctggacagcctgctgatcgtggtgagctacgtgctgatcctgtacaccgtgatgggcatcgccagcggcgagggcagatggaaggccctgaacacctgcgtgagccacatctgcgccgtgctgatctactacgtgcccatgatcggcgtgagcgtgatgcacagagccgccaagcacgccagccccatcgtgcacaccctgatgagcagcatctgcctgctggtgccccccgtgctgaaccccatcatctacagcgtgaagacccagaccatcagacagggcatcctgaccctgttcagctgcaagtag

SEQ ID NO: 20565 - DNA, 936 bp, Artificial Sequence
  Description of Artificial Sequence: Synthetic coding sequence
ggcctgagacacagcacccaccccgccaccctgcagctgaccggcatccccggcatccagaccggcctgacctgggtggccctgatcttctgcatcctgtacatgatcagcatcgtgggcaacctgagcatcctgaccctggtgttctgggagcccgccctgcaccagcccatgtactacttcctgagcatgctggccctgaacgacctgggcgtgagcttcagcaccctgcccaccgtgatcagcaccttctgcttcaactacaaccacgtggccttcaacgcctgcctggtgcagatgttcttcatccacaccttcagcttcatggagagcggcatcctgctggccatgagcctggacagattcgtggccatctgctaccccctgagatacgtgaccgtgctgacccacaacagaatcctggccatgggcctgggcatcctgaccaagagcttcaccaccctgttccccttccccttcgtggtgaagagactgcccttctgcaagggcaacgtgctgcaccacagctactgcctgcaccccgacctgatgaaggtggcctgcggcgacatccacgtgaacaacatctacggcctgctggtgatcatcttcacctacggcatggacagcaccttcatcctgctgagctacgccctgatcctgagagccatgctggtgatcatcagccaggagcagagactgaaggccctgaacacctgcatgagccacatctgcgccgtgctggccttctacgtgcccatcatcgccgtgagcatgatccacagattctggaagagcgccccccccgtggtgcacgtgatgatgagcaacgtgtacctgttcgtgccccccatgctgaaccccatcatctacagcgtgaagaccaaggagatcagaaagggcatcctgaagttcttccacaagagccaggcctag

SEQ ID NO: 20566 - DNA, 945 bp, Artificial Sequence
  Description of Artificial Sequence: Synthetic coding sequence
atgctgggcctgaacggcacccccttccagcccgccaccctgcagctgaccggcatccccggcatccagaccggcctgacctgggtggccctgatcttctgcatcctgtacatgatcagcatcgtgggcaacctgagcatcctgaccctggtgttctgggagcccgccctgcaccagcccatgtactacttcctgagcatgctggccctgaacgacctgggcgtgagcttcagcaccctgcccaccgtgatcagcaccttctgcttcaactacaaccacgtggccttcaacgcctgcctggtgcagatgttcttcatccacaccttcagcttcatggagagcggcatcctgctggccatgagcctggacagattcgtggccatctgctaccccctgagatacgtgaccgtgctgacccacaacagaatcctggccatgggcctgggcatcctgaccaagagcttcaccaccctgttccccttccccttcgtggtgaagagactgcccttctgcaagggcaacgtgctgcaccacagctactgcctgcaccccgacctgatgaaggtggcctgcggcgacatccacgtgaacaacatctacggcctgctggtgatcatcttcacctacggcatggacagcaccttcatcctgctgagctacgccctgatcctgagagccatgctggtgatcatcagccaggagcagagactgaaggccctgaacacctgcatgagccacatctgcgccgtgctggccttctacgtgcccatcatcgccgtgagcatgatccacagattctggaagagcgccccccccgtggtgcacgtgatgatgagcaacgtgtacctgttcgtgccccccatgctgaaccccatcatctacagcgtgaagaccaaggagatcagaaagggcatcctgaagttcttccacaagagccaggcctag

SEQ ID NO: 20567 - DNA, 939 bp, Artificial Sequence
  Description of Artificial Sequence: Synthetic coding sequence
atgggcctgttcaacgtgacccaccccgccttcttcctgctgaccggcatccccggcctggagagcagccacagctggctgagcggccccctgtgcgtgatgtacgccgtggccctgggcggcaacaccgtgatcctgcaggccgtgagagtggagcccagcctgcacgagcccatgtactacttcctgagcatgctgagcttcagcgacgtggccatcagcatggccaccctgcccaccgtgctgagaaccttctgcctgaacgccagaaacatcaccttcgacgcctgcctgatccagatgttcctgatccacttcttcagcatgatggagagcggcatcctgctggccatgagcttcgacagatacgtggccatctgcgaccccctgagatacgccaccgtgctgaccaccgaggtgatcgccgccatgggcctgggcgccgccgccagaagcttcatcaccctgttccccctgcccttcctgatcaagagactgcccatctgcagaagcaacgtgctgagccacagctactgcctgcaccccgacatgatgagactggcctgcgccgacatcagcatcaacagcatctacggcctgttcgtgctggtgagcaccttcggcatggacctgttcttcatcttcctgagctacgtgctgatcctgagaagcgtgatggccaccgccagcagagaggagagactgaaggccctgaacacctgcgtgagccacatcctggccgtgctggccttctacgtgcccatgatcggcgtgagcaccgtgcacagattcggcaagcacgtgccctgctacatccacgtgctgatgagcaacgtgtacctgttcgtgccccccgtgctgaaccccctgatctacagcgccaagaccaaggagatcagaagagccatcttcagaatgttccaccacatcaagatctag

SEQ ID NO: 20568 - DNA, 951 bp, Artificial Sequence
  Description of Artificial Sequence: Synthetic coding sequence
atgaagatcagcaacaacagcctgggcttcctgcccaccaccttcatcctggtgggcatccccggcctggagagcgagcacctgtggatcagcgtgcccttcagcctgatctacatcatcatcttcctgggcaacggcatcatcctgcacgtgatcagaaccgacatcgccctgcaccagcccatgtacctgttcctggccatgctggccctggccgaggtgagagtgagcgccagcaccctgcccaccgtgctgggcatcttcctgttcggcaacaccgagatcagcctggaggcctgcctgttccccgacgtgctgcaccccttcttcatccacgacggcgccagctgcgccgccggccacgtgttcggccccctgtacagccacctgcagcccaccgagctgcacagctaccccgacaccgcccagggcctgtggcacagaagctactacagaaccgagaagcactacgcccacggcagcgtggcccacagcctgatggccagcgccctgctgtggccccagtgccccctgaccttcctgctgagcgccccccagagctacctgagctgcggcaacatcagcgtgaacaacatctacggcatcttcatcgtgaccagcaccttcggcctggacagcctgctgatcgtgatcagctacggcctgatcctgcacaccgtgctgggcatcgccaccggcgagggcagaaagaaggccctgaacacctgcggcagccacgtgtgcgccgtgctggcctactacgtgcccatgatcggcctgagcatcgtgcacagactgggccacagagtgagccccctgctgcaggccatgatggccaacgcctacctgttcttcccccccgtggtgaaccccatcgtgtacagcatcaagaccaaggagatccacggcgccatcgtgagaatgctgctggagaagagaagaagagtgtag

SEQ ID NO: 20569 - DNA, 948 bp, Artificial Sequence
  Description of Artificial Sequence: Synthetic coding sequence
atgggcgactggaacaacagcgacgccgtggagcccatcttcatcctgagaggcttccccggcctggagtacgtgcacagctggctgagcatcctgttctgcctggcctacctggtggccttcatgggcaacgtgaccatcctgagcgtgatctggatcgagagcagcctgcaccagcccatgtactacttcatcagcatcctggccgtgaacgacctgggcatgagcctgagcaccctgcccaccatgctggccgtgctgtggctggacgcccccgagatccaggccagcgcctgctacgcccagctgttcttcatccacaccttcaccttcctggagagcagcgtgctgctggccatggccttcgacagattcgtggccatctgccaccccctgcactaccccaccatcctgaccaacagcgtgatcggcaagatcggcctggcctgcctgctgagaagcctgggcgtggtgctgcccacccccctgctgctgagacactaccactactgccacggcaacgccctgagccacgccttctgcctgcaccaggacgtgctgagactgagctgcaccgacgccagaaccaacagcatctacggcctgtgcgtggtgatcgccaccctgggcgtggacagcatcttcatcctgctgagctacgtgctgatcctgaacaccgtgctggacatcgccagcagagaggagcagctgaaggccctgaacacctgcgtgagccacatctgcgtggtgctgatcttcttcgtgcccgtgatcggcgtgagcatggtgcacagattcggcaagcacctgagccccatcgtgcacatcctgatggccgacatctacctgctgctgccccccgtgctgaaccccatcgtgtacagcgtgagaaccaagcagatcagactgggcatcctgcacaagttcgtgctgagaagaagattctag

SEQ ID NO: 20570 - DNA, 954 bp, Artificial Sequence
  Description of Artificial Sequence: Synthetic coding sequence
atgagccaggtgaccaacaccacccaggagggcatctacttcatcctgaccgacatccccggcttcgaggccagccacatctggatcagcatccccgtgtgctgcctgtacaccatcagcatcatgggcaacaccaccatcctgaccgtgatcagaaccgagcccagcgtgcaccagagaatgtacctgttcctgagcatgctggccctgaccgacctgggcctgaccctgaccaccctgcccaccgtgatgcagctgctgtggttcaacgtgagaagaatcagcagcgaggcctgcttcgcccagttcttcttcctgcacggcttcagcttcatggagagcagcgtgctgctggccatgagcgtggactgctacgtggccatctgctgccccctgcactacgccagcatcctgaccaacgaggtgatcggcagaaccggcctggccatcatctgctgctgcgtgctggccgtgctgcccagcctgttcctgctgaagagactgcccttctgccacagccacctgctgagcagaagctactgcctgcaccaggacatgatcagactggtgtgcgccgacatcagactgaacagctggtacggcttcgccctggccctgctgatcatcatcgtggaccccctgctgatcgtgatcagctacaccctgatcctgaagaacatcctgggcaccgccacctgggccgagagactgagagccctgaacaactgcctgagccacatcctggccgtgctggtgctgtacatccccatggtgggcgtgagcatgacccacagattcgccaagcacgccagccccctggtgcacgtgatcatggccaacatctacctgctggccccccccgtgatgaaccccatcatctacagcgtgaagaacaagcagatccagtggggcatgctgaacttcctgagcctgaagaacatgcacagcagatag

SEQ ID NO: 20571 - DNA, 972 bp, Artificial Sequence
  Description of Artificial Sequence: Synthetic coding sequence
atgagcaccctgcccacccagatcgcccccaacagcagcaccagcatggcccccaccttcctgctggtgggcatgcccggcctgagcggcgcccccagctggtggaccctgcccctgatcgccgtgtacctgctgagcgccctgggcaacggcaccatcctgtggatcatcgccctgcagcccgccctgcacagacccatgcacttcttcctgttcctgctgagcgtgagcgacatcggcctggtgaccgccctgatgcccaccctgctgggcatcgccctggccggcgcccacaccgtgcccgccagcgcctgcctgctgcagatggtgttcatccacgtgttcagcgtgatggagagcagcgtgctgctggccatgagcatcgacagagccctggccatctgcagacccctgcactaccccgccctgctgaccaacggcgtgatcagcaagatcagcctggccatcagcttcagatgcctgggcctgcacctgcccctgcccttcctgctggcctacatgccctactgcctgccccaggtgctgacccacagctactgcctgcaccccgacgtggccagactggcctgccccgaggcctggggcgccgcctacagcctgttcgtggtgctgagcgccatgggcctggaccccctgctgatcttcttcagctacggcctgatcggcaaggtgctgcagggcgtggagagcagagaggacagatggaaggccggccagacctgcgccgcccacctgagcgccgtgctgctgttctacatccccatgatcctgctggccctgatcaaccaccccgagctgcccatcacccagcacacccacaccctgctgagctacgtgcacttcctgctgccccccctgatcaaccccatcctgtacagcgtgaagatgaaggagatcagaaagagaatcctgaacagactgcagcccagaaaggtgggcggcgcccagtag

SEQ ID NO: 20572 - DNA, 984 bp, Artificial Sequence
  Description of Artificial Sequence: Synthetic coding sequence
atggccatcttcaacaacaccaccagcagcagcagcaacttcctgctgaccgccttccccggcctggagtgcgcccacgtgtggatcagcatccccgtgtgctgcctgtacaccatcgccctgctgggcaacagcatgatcttcctggtgatcatcaccaagagaagactgcacaagcccatgtactacttcctgagcatgctggccgccgtggacctgtgcctgaccatcaccaccctgcccaccgtgctgggcgtgctgtggttccacgccagagagatcagcttcaaggcctgcttcatccagatgttcttcgtgcacgccttcagcctgctggagagcagcgtgctggtggccatggccttcgacagattcgtggccatctgcaaccccctgaactacgccaccatcctgaccgacagaatggtgctggtgatcggcctggtgatctgcatcagacccgccgtgttcctgctgcccctgctggtggccatcaacaccgtgagcttccacggcggccacgagctgagccaccccttctgctaccaccccgaggtgatcaagtacacctacagcaagccctggatcagcagcttctggggcctgttcctgcagctgtacctgaacggcaccgacgtgctgttcatcctgttcagctacgtgctgatcctgagaaccgtgctgggcatcgtggccagaaagaagcagcagaaggccctgagcacctgcgtgtgccacatctgcgccgtgaccatcttctacgtgcccctgatcagcctgagcctggcccacagactgttccacagcacccccagagtgctgtgcagcaccctggccaacatctacctgctgctgccccccgtgctgaaccccatcatctacagcctgaagaccaagaccatcagacaggccatgttccagctgctgcagagcaagggcagctggggcttcaacgtgagaggcctgagaggcagatgggactag

SEQ ID NO: 20573 - DNA, 1065 bp, Artificial Sequence
  Description of Artificial Sequence: Synthetic coding sequence
atgaccaacaagatgtacgccatctacatcaagaacctgaactacttcagcttcctgatcgtgcagtgcctgcagcccaccatggccatcttcaacaacaccaccagcagcagcagcaacttcctgctgaccgccttccccggcctggagtgcgcccacgtgtggatcagcatccccgtgtgctgcctgtacaccatcgccctgctgggcaacagcatgatcttcctggtgatcatcaccaagagaagactgcacaagcccatgtactacttcctgagcatgctggccgccgtggacctgtgcctgaccatcaccaccctgcccaccgtgctgggcgtgctgtggttccacgccagagagatcagcttcaaggcctgcttcatccagatgttcttcgtgcacgccttcagcctgctggagagcagcgtgctggtggccatggccttcgacagattcgtggccatctgcaaccccctgaactacgccaccatcctgaccgacagaatggtgctggtgatcggcctggtgatctgcatcagacccgccgtgttcctgctgcccctgctggtggccatcaacaccgtgagcttccacggcggccacgagctgagccaccccttctgctaccaccccgaggtgatcaagtacacctacagcaagccctggatcagcagcttctggggcctgttcctgcagctgtacctgaacggcaccgacgtgctgttcatcctgttcagctacgtgctgatcctgagaaccgtgctgggcatcgtggccagaaagaagcagcagaaggccctgagcacctgcgtgtgccacatctgcgccgtgaccatcttctacgtgcccctgatcagcctgagcctggcccacagactgttccacagcacccccagagtgctgtgcagcaccctggccaacatctacctgctgctgccccccgtgctgaaccccatcatctacagcctgaagaccaagaccatcagacaggccatgttccagctgctgcagagcaagggcagctggggcttcaacgtgagaggcctgagaggcagatgggactag

SEQ ID NO: 20574 - DNA, 966 bp, Artificial Sequence
  Description of Artificial Sequence: Synthetic coding sequence
atgttcctgagcagcagaatgatcaccagcgtgagccccagcaccagcaccaacagcagcttcctgctgaccggcttcagcggcatggagcagcagtacccctggctgagcatccccttcagcagcatctacgccatggtgctgctgggcaactgcatggtgctgcacgtgatctggaccgagcccagcctgcaccagcccatgttctacttcctgagcatgctggccctgaccgacctgtgcatgggcctgagcaccgtgtacaccgtgctgggcatcctgtggggcatcatcagagagatcagcctggacagctgcatcgcccagagctacttcatccacggcctgagcttcatggagagcagcgtgctgctgaccatggccttcgacagatacatcgccatctgcaaccccctgagatacagcagcatcctgaccaacagcagaatcatcaagatcggcctgaccatcatcggcagaagcttcttcttcatcaccccccccatcatctgcctgaagttcttcaactactgccacttccacatcctgagccacagcttctgcctgcaccaggacctgctgagactggcctgcagcgacatcagattcaacagctactacgccctgatgctggtgatctgcatcctgctgctggacgccatcctgatcctgttcagctacatcctgatcctgaagagcgtgctggccgtggccagccaggaggagagacacaagctgttccagacctgcatcagccacatctgcgccgtgctggtgttctacatccccatcatcagcctgaccatggtgcacagattcggcaagcacctgagccccgtggcccacgtgctgatcggcaacatctacatcctgttcccccccctgatgaaccccatcatctacagcgtgaagacccagcagatccacaccagaatgctgagactgttcagcctgaagagatactag

SEQ ID NO: 20575 - DNA, 939 bp, Artificial Sequence
  Description of Artificial Sequence: Synthetic coding sequence
atgagcatcagcaacatcaccgtgtacatgcccagcgtgctgaccctggtgggcatccccggcctggagagcgtgcagtgctggatcggcatccccttctgcgccatctacctgatcgccatgatcggcaacagcctgctgctgagcatcatcaagagcgagagaagcctgcacgagcccctgtacatcttcctgggcatgctgggcgccaccgacatcgccctggccagcagcatcatgcccaagatgctgggcatcttctggttcaacgtgcccgagatctacttcgacagctgcctgctgcagatgtggttcatccacaccctgcagggcatcgagagcggcatcctggtggccatggccctggacagatacgtggccatctgctaccccctgagacacgccaacatcttcacccaccagctggtgatccagatcggcaccatggtggtgctgagagccgccatcctggtggccccctgcctggtgctgatcaagtgcagattccagttctaccacaccaccgtgatcagccacagctactgcgagcacatggccatcgtgaagctggccgccgccaacgtgcaggtgaacaagatctacggcctgttcgtggccttcaccgtggccggcttcgacctgaccttcatcaccctgagctacatccagatcttcatcaccgtgttcagactgccccagaaggaggccagattcaaggccttcaacacctgcatcgcccacatctgcgtgttcctgcagttctacctgctggccttcttcagcttcttcacccacagattcggcagccacatcagcccctacatccacatcctgttcagcagcatctacctgctggtgccccccttcctgaaccccctggtgtacggcgccaagaccacccagatcagaatccacgtggtgaagatgttctgcagctag

SEQ ID NO: 20576 - DNA, 939 bp, Artificial Sequence; identical to SEQ ID NO: 20575
  Description of Artificial Sequence: Synthetic coding sequence

SEQ ID NO: 20577 - DNA, 951 bp, Artificial Sequence
  Description of Artificial Sequence: Synthetic coding sequence
atgcccaccttcaacggcagcgtgttcatgcccagcgccttcatcctgatcggcatccccggcctggagagcgtgcagtgctggatcggcatccccttcagcgccatgtacctgatcggcgtgatcggcaacagcctgatcctggtgatcatcaagtacgagaacagcctgcacatccccatgtacatcttcctggccatgctggccgccaccgacatcgccctgaacacctgcatcctgcccaagatgctgggcatcttctggttccacctgcccgagatcagcttcgacgcctgcctgttccagatgtggctgatccacagcttccaggccatcgagagcggcatcctgctggccatggccctggacagatacgtggccatctgcatccccctgagacacgccaccatcttcagccagcagttcctgacccacatcggcctgggcgtgaccctgagagccgccatcctgatcatccccagcctgggcctgatcaagtgctgcctgaagcactacagaaccaccgtgatcagccacagctactgcgagcacatggccatcgtgaagctggccaccgaggacatcagagtgaacaagatctacggcctgttcgtggccttcgccatcctgggcttcgacatcatcttcatcaccctgagctacgtgcagatcttcatcaccgtgttccagctgccccagaaggaggccagattcaaggccttcaacacctgcatcgcccacatctgcgtgttcctgcagttctacctgctggccttcttcagcttcttcacccacagattcggcagccacatccccccctacatccacatcctgctgagcaacctgtacctgctggtgccccccttcctgaaccccatcgtgtacggcgtgaagaccaagcagatcagagaccacatcgtgaaggtgttcttcttcaagaaggtgacctag

SEQ ID NO: 20578 - DNA, 972 bp, Artificial Sequence
  Description of Artificial Sequence: Synthetic coding sequence
atgagccacaccaacgtgaccatcttccaccccgccgtgttcgtgctgcccggcatccccggcctggaggcctaccacatctggctgagcatccccctgtgcctgatctacatcaccgccgtgctgggcaacagcatcctgatcgtggtgatcgtgatggagagaaacctgcacgtgcccatgtacttcttcctgagcatgctggccgtgatggacatcctgctgagcaccaccaccgtgcccaaggccctggccatcttctggctgcaggcccacaacatcgccttcgacgcctgcgtgacccagggcttcttcgtgcacatgatgttcgtgggcgagagcgccatcctgctggccatggccttcgacagattcgtggccatctgcgcccccctgagatacaccaccgtgctgacctggcccgtggtgggcagaatcgccctggccgtgatcaccagaagcttctgcatcatcttccccgtgatcttcctgctgaagagactgcccttctgcctgaccaacatcgtgccccacagctactgcgagcacatcggcgtggccagactggcctgcgccgacatcaccgtgaacatctggtacggcttcagcgtgcccatcgtgatggtgatcctggacgtgatcctgatcgccgtgagctacagcctgatcctgagagccgtgttcagactgcccagccaggacgccagacacaaggccctgagcacctgcggcagccacctgtgcgtgatcctgatgttctacgtgcccagcttcttcaccctgctgacccaccacttcggcagaaacatcccccagcacgtgcacatcctgctggccaacctgtacgtggccgtgccccccatgctgaaccccatcgtgtacggcgtgaagaccaagcagatcagagagggcgtggcccacagattcttcgacatcaagacctggtgctgcaccagccccctgggcagctag

SEQ ID NO: 20579 - DNA, 945 bp, Artificial Sequence
  Description of Artificial Sequence: Synthetic coding sequence
atgcccaccgtgaaccacagcggcaccagccacaccgtgttccacctgctgggcatccccggcctgcaggaccagcacatgtggatcagcatccccttcttcatcagctacgtgaccgccctgctgggcaacagcctgctgatcttcatcatcctgaccaagagaagcctgcacgagcccatgtacctgttcctgtgcatgctggccggcgccgacatcgtgctgagcacctgcaccatcccccaggccctggccatcttctggttcagagccggcgacatcagcctggacagatgcatcacccagctgttcttcatccacagcaccttcatcagcgagagcggcatcctgctggtgatggccttcgaccactacatcgccatctgctaccccctgagatacaccaccatcctgaccaacgccctgatcaagaagatctgcgtgaccgtgagcctgagaagctacggcaccatcttccccatcatcttcctgctgaagagactgaccttctgccagaacaacatcatcccccacaccttctgcgagcacatcggcctggccaagtacgcctgcaacgacatcagaatcaacatctggtacggcttcagcatcctgatgagcaccgtggtgctggacgtggtgctgatcttcatcagctacatgctgatcctgcacgccgtgttccacatgcccagccccgacgcctgccacaaggccctgaacaccttcggcagccacgtgtgcatcatcatcctgttctacggcagcggcatcttcaccatcctgacccagagattcggcagacacatccccccctgcatccacatccccctggccaacgtgtgcatcctggccccccccatgctgaaccccatcatctacggcatcaagaccaagcagatccaggagcaggtggtgcagttcctgttcatcaagcagaagtag

SEQ ID NO: 20580 - DNA, 1008 bp, Artificial Sequence
  Description of Artificial Sequence: Synthetic coding sequence
atggcccaggtgagagccctgcacaagatcatggccctgttcagcgccaacagcatcggcgccatgaacaacagcgacaccagaatcgccggctgcttcctgaccggcatccccggcctggagcagctgcacatctggctgagcatccccttctgcatcatgtacatcaccgccctggagggcaacggcatcctgatctgcgtgatcctgagccaggccatcctgcacgagcccatgtacatcttcctgagcatgctggccagcgccgacgtgctgctgagcaccaccaccatgcccaaggccctggccaacctgtggctgggctacagcctgatcagcttcgacggctgcctgacccagatgttcttcatccacttcctgttcatccacagcgccgtgctgctggccatggccttcgacagatacgtggccatctgcagccccctgagatacgtgaccatcctgaccagcaaggtgatcggcaagatcgtgaccgccgccctgagccacagcttcatcatcatgttccccagcatcttcctgctggagcacctgcactactgccagatcaacatcatcgcccacaccttctgcgagcacatgggcatcgcccacctgagctgcagcgacatcagcatcaacgtgtggtacggcctggccgccgccctgctgagcaccggcctggacatcatgctgatcaccgtgagctacatccacatcctgcaggccgtgttcagactgctgagccaggacgccagaagcaaggccctgagcacctgcggcagccacatctgcgtgatcctgctgttctacgtgcccgccctgttcagcgtgttcgcctacagattcggcggcagaagcgtgccctgctacgtgcacatcctgctggccagcctgtacgtggtgatcccccccatgctgaaccccgtgatctacggcgtgagaaccaagcccatcctggagggcgccaagcagatgttcagcaacctggccaagggcagcaagtag

SEQ ID NO: 20581 - DNA, 957 bp, Artificial Sequence
  Description of Artificial Sequence: Synthetic coding sequence
atgagcgacagcaacctgagcgacaaccacctgcccgacaccttcttcctgaccggcatccccggcctggaggccgcccacttctggatcgccatccccttctgcgccatgtacctggtggccctggtgggcaacgccgccctgatcctggtgatcgccatggacaacgccctgcacgcccccatgtacctgttcctgtgcctgctgagcctgaccgacctggccctgagcagcaccaccgtgcccaagatgctggccatcctgtggctgcacgccggcgagatcagcttcggcggctgcctggcccagatgttctgcgtgcacagcatctacgccctggagagcagcatcctgctggccatggccttcgacagatacgtggccatctgcaaccccctgagatacaccaccatcctgaaccacgccgtgatcggcagaatcggcttcgtgggcctgttcagaagcgtggccatcgtgagccccttcatcttcctgctgagaagactgccctactgcggccacagagtgatgacccacacctactgcgagcacatgggcatcgccagactggcctgcgccaacatcaccgtgaacatcgtgtacggcctgaccgtggccctgctggccatgggcctggacagcatcctgatcgccatcagctacggcttcatcctgcacgccgtgttccacctgcccagccacgacgcccagcacaaggccctgagcacctgcggcagccacatcggcatcatcctggtgttctacatccccgccttcttcagcttcctgacccacagattcggccaccacgaggtgcccaagcacgtgcacatcttcctggccaacctgtacgtgctggtgccccccgtgctgaaccccatcctgtacggcgccagaaccaaggagatcagaagcagactgctgaagctgctgcacctgggcaagaccagcatctag

SEQ ID NO: 20582 - DNA, 978 bp, Artificial Sequence
  Description of Artificial Sequence: Synthetic coding sequence
atgttcctgcccaacgacacccagttccaccccagcagcttcctgctgctgggcatccccggcctggagaccctgcacatctggatcggcttccccttctgcgccgtgtacatgatcgccctgatcggcaacttcaccatcctgctggtgatcaagaccgacagcagcctgcaccagcccatgttctacttcctggccatgctggccaccaccgacgtgggcctgagcaccgccaccatccccaagatgctgggcatcttctggatcaacctgagaggcatcatcttcgaggcctgcctgacccagatgttcttcatccacaacttcaccctgatggagagcgccgtgctggtggccatggcctacgacagctacgtggccatctgcaaccccctgcagtacagcgccatcctgaccaacaaggtggtgagcgtgatcggcctgggcgtgttcgtgagagccctgatcttcgtgatccccagcatcctgctgatcctgagactgcccttctgcggcaaccacgtgatcccccacacctactgcgagcacatgggcctggcccacctgagctgcgccagcatcaagatcaacatcatctacggcctgtgcgccatctgcaacctggtgttcgacatcaccgtgatcgccctgagctacgtgcacatcctgtgcgccgtgttcagactgcccacccacgaggccagactgaagagcctgagcacctgcggcagccacgtgtgcgtgatcctggccttctacacccccgccctgttcagcttcatgacccacagattcggcagaaacgtgcccagatacatccacatcctgctggccaacctgtacgtggtggtgccccccatgctgaaccccgtgatctacggcgtgagaaccaagcagatctacaagtgcgtgaagaagatcctgctgcaggagcagggcatggagaaggaggagtacctgatccacaccagattctag

SEQ ID NO: 20583 - DNA, 939 bp, Artificial Sequence
  Description of Artificial Sequence: Synthetic coding sequence
atgcccagcatcaacgacacccacttctacccccccttcttcctgctgctgggcatccccggcctggacaccctgcacatctggatcagcttccccttctgcatcgtgtacctgatcgccatcgtgggcaacatgaccatcctgttcgtgatcaagaccgagcacagcctgcaccagcccatgttctacttcctggccatgctgagcatgatcgacctgggcctgagcaccagcaccatccccaagatgctgggcatcttctggttcaacctgcaggagatcagcttcggcggctgcctgctgcagatgttcttcatccacatgttcaccggcatggagaccgtgctgctggtggtgatggcctacgacagattcgtggccatctgcaaccccctgcagtacaccatgatcctgaccaacaagaccatcagcatcctggccagcgtggtggtgggcagaaacctggtgctggtgacccccttcgtgttcctgatcctgagactgcccttctgcggccacaacatcgtgccccacacctactgcgagcacagaggcctggccggcctggcctgcgcccccatcaagatcaacatcatctacggcctgatggtgatcagctacatcatcgtggacgtgatcctgatcgccagcagctacgtgctgatcctgagagccgtgttcagactgcccagccaggacgtgagactgaaggccttcaacacctgcggcagccacgtgtgcgtgatgctgtgcttctacacccccgccttcttcagcttcatgacccacagattcggccagaacatcccccactacatccacatcctgctggccaacctgtacgtggtggtgccccccgccctgaaccccgtgatctacggcgtgagaaccaagcagatcagagagcagatcgtgaagatcttcgtgcagaaggagtag

SEQ ID NO: 20584 - DNA, 942 bp, Artificial Sequence
  Description of Artificial Sequence: Synthetic coding sequence
atgcccatcgccaacgacacccagttccacaccagcagcttcctgctgctgggcatccccggcctggaggacgtgcacatctggatcggcttccccttcttcagcgtgtacctgatcgccctgctgggcaacgccgccatcttcttcgtgatccagaccgagcagagcctgcacgagcccatgtactactgcctggccatgctggacagcatcgacctgagcctgagcaccgccaccatccccaagatgctgggcatcttctggttcaacatcaaggagatcagcttcggcggctacctgagccagatgttcttcatccacttcttcaccgtgatggagagcatcgtgctggtggccatggccttcgacagatacatcgccatctgcaagcccctgtggtacaccatgatcctgaccagcaagatcatcagcctgatcgccggcatcgccgtgctgagaagcctgtacatggtgatccccctggtgttcctgctgctgagactgcccttctgcggccacagaatcatcccccacacctactgcgagcacatgggcatcgccagactggcctgcgccagcatcaaggtgaacatcatgttcggcctgggcagcatcagcctgctgctgctggacgtgctgctgatcatcctgagccacatcagaatcctgtacgccgtgttctgcctgcccagctgggaggccagactgaaggccctgaacacctgcggcagccacatcggcgtgatcctggccttcagcacccccgccttcttcagcttcttcacccactgcttcggccacgacatcccccagtacatccacatcttcctggccaacctgtacgtggtggtgccccccaccctgaaccccgtgatctacggcgtgagaaccaagcacatcagagagaccgtgctgagaatcttcttcaagaccgaccactag

SEQ ID NO: 20585 - DNA, 954 bp, Artificial Sequence
  Description of Artificial Sequence: Synthetic coding sequence
atggagaagagaatgcccatcgccaacgacacccagttccacaccagcagcttcctgctgctgggcatccccggcctggaggacgtgcacatctggatcggcttccccttcttcagcgtgtacctgatcgccctgctgggcaacgccgccatcttcttcgtgatccagaccgagcagagcctgcacgagcccatgtactactgcctggccatgctggacagcatcgacctgagcctgagcaccgccaccatccccaagatgctgggcatcttctggttcaacatcaaggagatcagcttcggcggctacctgagccagatgttcttcatccacttcttcaccgtgatggagagcatcgtgctggtggccatggccttcgacagatacatcgccatctgcaagcccctgtggtacaccatgatcctgaccagcaagatcatcagcctgatcgccggcatcgccgtgctgagaagcctgtacatggtgatccccctggtgttcctgctgctgagactgcccttctgcggccacagaatcatcccccacacctactgcgagcacatgggcatcgccagactggcctgcgccagcatcaaggtgaacatcatgttcggcctgggcagcatcagcctgctgctgctggacgtgctgctgatcatcctgagccacatcagaatcctgtacgccgtgttctgcctgcccagctgggaggccagactgaaggccctgaacacctgcggcagccacatcggcgtgatcctggccttcagcacccccgccttcttcagcttcttcacccactgcttcggccacgacatcccccagtacatccacatcttcctggccaacctgtacgtggtggtgccccccaccctgaaccccgtgatctacggcgtgagaaccaagcacatcagagagaccgtgctgagaatcttcttcaagaccgaccactag

SEQ ID NO: 20586 - DNA, 954 bp, Artificial Sequence
  Description of Artificial Sequence: Synthetic coding sequence
atggccggcagaatgagcaccagcaaccacacccagttccaccccagcagcttcctgctgctgggcatccccggcctggaggacgtgcacatctggatcggcgtgcccttcttcttcgtgtacctggtggccctgctgggcaacaccgccctgctgttcgtgatccagaccgagcagagcctgcacgagcccatgtactacttcctggccatgctggacagcatcgacctgggcctgagcaccgccaccatccccaagatgctgggcatcttctggttcaacaccaaggagatcagcttcggcggctgcctgagccacatgttcttcatccacttcttcaccgccatggagagcatcgtgctggtggccatggccttcgacagatacatcgccatctgcaagcccctgagatacaccatgatcctgaccagcaagatcatcagcctgatcgccggcatcgccgtgctgagaagcctgtacatggtggtgcccctggtgttcctgctgctgagactgcccttctgcggccacagaatcatcccccacacctactgcgagcacatgggcatcgccagactggcctgcgccagcatcaaggtgaacatcagattcggcctgggcaacatcagcctgctgctgctggacgtgatcctgatcatcctgagctacgtgagaatcctgtacgccgtgttctgcctgcccagctgggaggccagactgaaggccctgaacacctgcggcagccacatcggcgtgatcctggccttcttcacccccgccttcttcagcttcctgacccacagattcggccacaacatcccccagtacatccacatcatcctggccaacctgtacgtggtggtgccccccgccctgaaccccgtgatctacggcgtgagaaccaagcagatcagagagagagtgctgagaatcttcctgaagaccaaccactag

SEQ ID NO: 20587 - DNA, 963 bp, Artificial Sequence
  Description of Artificial Sequence: Synthetic coding sequence
atgcccagcgccagcgccatgatcatcttcaacctgagcagctacaaccccggccccttcatcctggtgggcatccccggcctggagcagttccacgtgtggatcggcatccccttctgcatcatctacatcgtggccgtggtgggcaactgcatcctgctgtacctgatcgtggtggagcacagcctgcacgagcccatgttcttcttcctgagcatgctggccatgaccgacctgatcctgagcaccgccggcgtgcccaaggccctgagcatcttctggctgggcgccagagagatcaccttccccggctgcctgacccagatgttcttcctgcactacaacttcgtgctggacagcgccatcctgatggccatggccttcgaccactacgtggccatctgcagccccctgagatacaccaccatcctgacccccaagaccatcatcaagagcgccatgggcatcagcttcagaagcttctgcatcatcctgcccgacgtgttcctgctgacctgcctgcccttctgcagaaccagaatcatcccccacacctactgcgagcacatcggcgtggcccagctggcctgcgccgacatcagcatcaacttctggtacggcttctgcgtgcccatcatgaccgtgatcagcgacgtgatcctgatcgccgtgagctacgcccacatcctgtgcgccgtgttcggcctgcccagccaggacgcctgccagaaggccctgggcacctgcggcagccacgtgtgcgtgatcctgatgttctacacccccgccttcttcagcatcctggcccacagattcggccacaacgtgagcagaaccttccacatcatgttcgccaacctgtacatcgtgatcccccccgccctgaaccccatggtgtacggcgtgaagaccaagcagatcagagacaaggtgatcctgctgttcagcaagggcaccggctag

SEQ ID NO: 20588 - DNA, 1047 bp, Artificial Sequence
  Description of Artificial Sequence: Synthetic coding sequence
acccaggtgcccaaggactgcaccatcctgctgcaccacctgtacatcaacagacaggaggtgagccccgtgatgctgggccccgcctacaaccacaccatggagacccccgccagcttcctgctggtgggcatccccggcctgcagagcagccacctgtggctggccatcagcctgagcgccatgtacatcaccgccctgctgggcaacaccctgatcgtgaccgccatctggatggacagcaccagacacgagcccatgtactgcttcctgtgcgtgctggccgccgtggacatcgtgatggccagcagcgtggtgcccaagatggtgagcatcttctgcagcggcgacagcagcatcagcttcagcgcctgcttcacccagatgttcttcgtgcacctggccaccgccgtggagaccggcctgctgctgaccatggccttcgacagatacgtggccatctgcaagcccctgcactacaagagaatcctgaccccccaggtgatgctgggcatgagcatggccgtgaccatcagagccgtgaccttcatgacccccctgagctggatgatgaaccacctgcccttctgcggcagcaacgtggtggtgcacagctactgcaagcacatcgccctggccagactggcctgcgccgaccccgtgcccagcagcctgtacagcctgatcggcagcagcctgatggtgggcagcgacgtggccttcatcgccgccagctacatcctgatcctgagagccgtgttcgacctgagcagcaagaccgcccagctgaaggccctgagcacctgcggcagccacgtgggcgtgatggccctgtactacctgcccggcatggccagcatctacgccgcctggctgggccaggacatcgtgcccctgcacacccaggtgctgctggccgacctgtacgtgatcatccccgccaccctgaaccccatcatctacggcatgagaaccaagcagctgctggagggcatctggagctacctgatgcacttcctgttcgaccacagcaacctgggcagctag

SEQ ID NO: 20589 - DNA, 975 bp, Artificial Sequence
  Description of Artificial Sequence: Synthetic coding sequence
atgctgggccccgcctacaaccacaccatggagacccccgccagcttcctgctggtgggcatccccggcctgcagagcagccacctgtggctggccatcagcctgagcgccatgtacatcaccgccctgctgggcaacaccctgatcgtgaccgccatctggatggacagcaccagacacgagcccatgtactgcttcctgtgcgtgctggccgccgtggacatcgtgatggccagcagcgtggtgcccaagatggtgagcatcttctgcagcggcgacagcagcatcagcttcagcgcctgcttcacccagatgttcttcgtgcacctggccaccgccgtggagaccggcctgctgctgaccatggccttcgacagatacgtggccatctgcaagcccctgcactacaagagaatcctgaccccccaggtgatgctgggcatgagcatggccgtgaccatcagagccgtgaccttcatgacccccctgagctggatgatgaaccacctgcccttctgcggcagcaacgtggtggtgcacagctactgcaagcacatcgccctggccagactggcctgcgccgaccccgtgcccagcagcctgtacagcctgatcggcagcagcctgatggtgggcagcgacgtggccttcatcgccgccagctacatcctgatcctgagagccgtgttcgacctgagcagcaagaccgcccagctgaaggccctgagcacctgcggcagccacgtgggcgtgatggccctgtactacctgcccggcatggccagcatctacgccgcctggctgggccaggacatcgtgcccctgcacacccaggtgctgctggccgacctgtacgtgatcatccccgccaccctgaaccccatcatctacggcatgagaaccaagcagctgctggagggcatctggagctacctgatgcacttcctgttcgaccacagcaacctgggcagctag

SEQ ID NO: 20590 - DNA, 1053 bp, Artificial Sequence
  Description of Artificial Sequence: Synthetic coding sequence
atgtgccagcagatcctgagagactgcatcctgctgatccaccacctgtgcatcaacagaaagaaggtgagcctggtgatgctgggccccgcctacaaccacaccatggagacccccgccagcttcctgctggtgggcatccccggcctgcagagcagccacctgtggctggccatcagcctgagcgccatgtacatcatcgccctgctgggcaacaccatcatcgtgaccgccatctggatggacagcaccagacacgagcccatgtactgcttcctgtgcgtgctggccgccgtggacatcgtgatggccagcagcgtggtgcccaagatggtgagcatcttctgcagcggcgacagcagcatcagcttcagcgcctgcttcacccagatgttcttcgtgcacctggccaccgccgtggagaccggcctgctgctgaccatggccttcgacagatacgtggccatctgcaagcccctgcactacaagagaatcctgaccccccaggtgatgctgggcatgagcatggccatcaccatcagagccatcatcgccatcacccccctgagctggatggtgagccacctgcccttctgcggcagcaacgtggtggtgcacagctactgcgagcacatcgccctggccagactggcctgcgccgaccccgtgcccagcagcctgtacagcctgatcggcagcagcctgatggtgggcagcgacgtggccttcatcgccgccagctacatcctgatcctgaaggccgtgttcggcctgagcagcaagaccgcccagctgaaggccctgagcacctgcggcagccacgtgggcgtgatggccctgtactacctgcccggcatggccagcatctacgccgcctggctgggccaggacgtggtgcccctgcacacccaggtgctgctggccgacctgtacgtgatcatccccgccaccctgaaccccatcatctacggcatgagaaccaagcagctgagagagagaatctggagctacctgatgcacgtgctgttcgaccacagcaacctgggcagctag

SEQ ID NO: 20591 - DNA, 936 bp, Artificial Sequence
  Description of Artificial Sequence: Synthetic coding sequence
atgttctaccacaacaagagcatcttccaccccgtgaccttcttcctgatcggcatccccggcctggaggacttccacatgtggatcagcggccccttctgcagcgtgtacctggtggccctgctgggcaacgccaccatcctgctggtgatcaaggtggagcagaccctgagagagcccatgttctacttcctggccatcctgagcaccatcgacctggccctgagcaccaccagcgtgcccagaatgctgggcatcttctggttcgacgcccacgagatcaactacggcgcctgcgtggcccagatgttcctgatccacgccttcaccggcatggaggccgaggtgctgctggccatggccttcgacagatacgtggccgtgtgcgcccccctgcactacgccaccatcctgaccagccaggtgctggtgggcatcagcatgtgcatcgtgatcagacccgtgctgctgaccctgcccatggtgtacctgatctacagactgcccttctgccaggcccacatcatcgcccacagctactgcgagcacatgggcatcgccaagctgagctgcggcaacatcagaatcaacggcatctacggcctgttcgtggtgagcttcttcgtgctgaacctggtgctgatcggcatcagctacgtgtacatcctgagagccgtgttcagactgcccagccacgacgcccagctgaaggccctgagcacctgcggcgcccacgtgggcgtgatctgcgtgttctacatccccagcgtgttcagcttcctgacccacagattcggccaccagatccccggctacatccacatcctggtggccaacctgtacctgatcatcccccccagcctgaaccccatcatctacggcgtgagaaccaagcagatcagagagagagtgctgtacgtgttcaccaagaagtag

SEQ ID NO: 20592 - DNA, 945 bp, Artificial Sequence
  Description of Artificial Sequence: Synthetic coding sequence
atgctgcccagcaacatcaccagcacccaccccgccgtgttcctgctggtgggcatccccggcctggagcacctgcacgcctggatcagcatccccttctgcttcgcctacaccctggccctgctgggcaactgcaccctgctgttcatcatccaggccgacgccgccctgcacgagcccatgtacctgttcctggccatgctggccaccatcgacctggtgctgagcagcaccaccctgcccaagatgctggccatcttctggttcagagaccaggagatcaacttcttcgcctgcctggtgcagatgttcttcctgcacagcttcagcatcatggagagcgccgtgctgctggccatggccttcgacagatacgtggccatctgcaagcccctgcactacaccaccgtgctgaccggcagcctgatcaccaagatcggcatggccgccgtggccagagccgtgaccctgatgacccccctgcccttcctgctgagaagattccactactgcagaggccccgtgatcgcccactgctactgcgagcacatggccgtggtgagactggcctgcggcgacaccagcttcaacaacatctacggcatcgccgtggccatgttcatcgtggtgctggacctgctgttcgtgatcctgagctacgtgttcatcctgcaggccgtgctgcagctggccagccaggaggccagatacaaggccttcggcacctgcgtgagccacatcggcgccatcctgagcacctacacccccgtggtgatcagcagcgtgatgcacagagtggccagacacgccgcccccagagtgcacatcctgctggccatcttctacctgctgttcccccccatggtgaaccccatcatctacggcgtgaagaccaagcagatcagagagtacgtgctgagcctgttccagagaaagaacatgtag

SEQ ID NO: 20593 - DNA, 945 bp, Artificial Sequence
  Description of Artificial Sequence: Synthetic coding sequence
atgagcgccagcaacatcaccctgacccaccccaccgccttcctgctggtgggcatccccggcctggagcacctgcacatctggatcagcatccccttctgcctggcctacaccctggccctgctgggcaactgcaccctgctgctgatcatccaggccgacgccgccctgcacgagcccatgtacctgttcctggccatgctggccgccatcgacctggtgctgagcagcagcgccctgcccaagatgctggccatcttctggttcagagacagagagatcaacttcttcgcctgcctggcccagatgttcttcctgcacagcttcagcatcatggagagcgccgtgctgctggccatggccttcgacagatacgtggccatctgcaagcccctgcactacaccaaggtgctgaccggcagcctgatcaccaagatcggcatggccgccgtggccagagccgtgaccctgatgacccccctgcccttcctgctgagatgcttccactactgcagaggccccgtgatcgcccactgctactgcgagcacatggccgtggtgagactggcctgcggcgacaccagcttcaacaacatctacggcatcgccgtggccatgttcatcgtggtgctggacctgctgctggtgatcctgagctacatcttcatcctgcaggccgtgctgctgctggccagccaggaggccagatacaaggccttcggcacctgcgtgagccacatcggcgccatcctggccttctacaccaccgtggtgatcagcagcgtgatgcacagagtggccagacacgccgccccccacgtgcacatcctgctggccaacttctacctgctgttcccccccatggtgaaccccatcatctacggcgtgaagaccaagcagatcagagagagcatcctgggcgtgttccccagaaaggacatgtag

SEQ ID NO: 20594 - DNA, 990 bp, Artificial Sequence
  Description of Artificial Sequence: Synthetic coding sequence
atgaccctggtgagcttcttcagcttcctgagcaagcccctgatcatgctgctgagcaacagcagctggagactgagccagcccagcttcctgctggtgggcatccccggcctggaggagagccagcactggatcgccctgcccctgggcatcctgtacctgctggccctggtgggcaacgtgaccatcctgttcatcatctggatggaccccagcctgcaccagagcatgtacctgttcctgagcatgctggccgccatcgacctggtgctggccagcagcaccgcccccaaggccctggccgtgctgctggtgcacgcccacgagatcggctacatcgtgtgcctgatccagatgttcttcatccacgccttcagcagcatggagagcggcgtgctggtggccatggccctggactgctacgtggccatctgccaccccctgcaccacagcaccatcctgcaccccggcgtgatcggctgcatcggcatggtggtgctggtgagaggcctgctgctgctgatccccttccccatcctgctgggcaagctgatcttctgccaggccaccatcatcggccacgcctactgcgagcacatggccgtggtgaagctggcctgcagcgagaccaccgtgaacagagcctacggcctgaccatggccctgctggtgatcggcctggacgtgctggccatcggcgtgagctacgcccacatcctgcaggccgtgctgaaggtgcccggcagcgaggccagactgaaggccttcagcacctgcggcagccacatctgcgtgatcctggtgttctacgtgcccggcatcttcagcttcctgacccacagattcggccaccacgtgccccaccacgtgcacgtgctgctggccacctggtacctgctgatgccccccgccctgaaccccctggtgtacggcgtgaagacccagcagatcagacagagagtgctgagagtgttcacccagaaggactag

SEQ ID NO: 20595 - DNA, 954 bp, Artificial Sequence
  Description of Artificial Sequence: Synthetic coding sequence
atgctgaccttccacaacgtgtgcagcgtgcccagcagcttctggctgaccggcatccccggcctggagagcctgcacgtgtggctgagcatccccttcggcagcatgtacctggtggccgtggtgggcaacgtgaccatcctggccgtggtgaagatcgagagaagcctgcaccagcccatgtacttcttcctgtgcatgctggccgccatcgacctggtgctgagcaccagcaccatccccaagctgctgggcatcttctggttcggcgcctgcgacatcggcctggacgcctgcctgggccagatgttcctgatccactgcttcgccaccgtggagagcggcatcttcctggccatggccttcgacagatacgtggccatctgcaaccccctgagacacagcatggtgctgacctacaccgtggtgggcagactgggcctggtgagcctgctgagaggcgtgctgtacatcggccccctgcccctgatgatcagactgagactgcccctgtacaagacccacgtgatcagccacagctactgcgagcacatggccgtggtggccctgacctgcggcgacagcagagtgaacaacgtgtacggcctgagcatcggcttcctggtgctgatcctggacagcgtggccatcgccgccagctacgtgatgatcttcagagccgtgatgggcctggccacccccgaggccagactgaagaccctgggcacctgcgccagccacctgtgcgccatcctgatcttctacgtgcccatcgccgtgagcagcctgatccacagattcggccagtgcgtgcccccccccgtgcacaccctgctggccaacttctacctgctgatcccccccatcctgaaccccatcgtgtacgccgtgagaaccaagcagatcagagagagcctgctgcagatccccagaatcgagatgaagatcagatag

SEQ ID NO: 20596 - DNA, 963 bp, Artificial Sequence
  Description of Artificial Sequence: Synthetic coding sequence
atgagcttcctgaacggcaccagcctgacccccgccagcttcatcctgaacggcatccccggcctggaggacgtgcacctgtggatcagcttccccctgtgcaccatgtacagcatcgccatcaccggcaacttcggcctgatgtacctgatctactgcgacgaggccctgcacagacccatgtacgtgttcctggccctgctgagcttcaccgacgtgctgatgtgcaccagcaccctgcccaacaccctgttcatcctgtggttcaacctgaaggagatcgacttcaaggcctgcctggcccagatgttcttcgtgcacaccttcaccggcatggagagcggcgtgctgatgctgatggccctggaccactgcgtggccatctgcttccccctgagatacgccaccatcctgaccaacagcgtgatcgccaaggccggcttcctgaccttcctgagaggcgtgatgctggtgatccccagcaccttcctgaccaagagactgccctactgcaagggcaacgtgatcccccacacctactgcgaccacatgagcgtggccaagatcagctgcggcaacgtgagagtgaacgccatctacggcctgatcgtggccctgctgatcggcggcttcgacatcctgtgcatcaccatcagctacaccatgatcctgcaggccgtggtgagcctgagcagcgccgacgccagacagaaggccttcagcacctgcaccgcccacttctgcgccatcgtgctgacctacgtgcccgccttcttcaccttcttcacccaccacttcggcggccacaccatccccctgcacatccacatcatcatggccaacctgtacctgctgatgccccccaccatgaaccccatcgtgtacggcgtgaagaccagacaggtgagagagagcgtgatcagattcttcctgaagggcaaggacaacagccacaacttctag

SEQ ID NO: 20597 - DNA, 966 bp, Artificial Sequence
  Description of Artificial Sequence: Synthetic coding sequence
atgagcggcgacaacagcagcagcctgacccccggcttcttcatcctgaacggcgtgcccggcctggaggccacccacatctggatcagcctgcccttctgcttcatgtacatcatcgccgtggtgggcaactgcggcctgatctgcctgatcagccacgaggaggccctgcacagacccatgtactacttcctggccctgctgagcttcaccgacgtgaccctgtgcaccaccatggtgcccaacatgctgtgcatcttctggttcaacctgaaggagatcgacttcaacgcctgcctggcccagatgttcttcgtgcacatgctgaccggcatggagagcggcgtgctgatgctgatggccctggacagatacgtggccatctgctaccccctgagatacgccaccatcctgaccaaccccgtgatcgccaaggccggcctggccaccttcctgagaaacgtgatgctgatcatccccttcaccctgctgaccaagagactgccctactgcagaggcaacttcatcccccacacctactgcgaccacatgagcgtggccaaggtgagctgcggcaacttcaaggtgaacgccatctacggcctgatggtggccctgctgatcggcgtgttcgacatctgctgcatcagcgtgagctacaccatgatcctgcaggccgtgatgagcctgagcagcgccgacgccagacacaaggccttcagcacctgcaccagccacatgtgcagcatcgtgatcacctacgtggccgccttcttcaccttcttcacccacagattcgtgggccacaacatccccaaccacatccacatcatcgtggccaacctgtacctgctgctgccccccaccatgaaccccatcgtgtacggcgtgaagaccaagcagatccaggagggcgtgatcaagttcctgctgggcgacaaggtgagcttcacctacgacaagtag

SEQ ID NO: 20598 - DNA, 966 bp, Artificial Sequence
  Description of Artificial Sequence: Synthetic coding sequence
atgctgaccctgaacaagaccgacctgatccccgccagcttcatcctgaacggcgtgcccggcctggaggacacccagctgtggatcagcttccccttctgcagcatgtacgtggtggccatggtgggcaactgcggcctgctgtacctgatccactacgaggacgccctgcacaagcccatgtactacttcctggccatgctgagcttcaccgacctggtgatgtgcagcagcaccatccccaaggccctgtgcatcttctggttccacctgaaggacatcggcttcgacgagtgcctggtgcagatgttcttcacccacaccttcaccggcatggagagcggcgtgctgatgctgatggccctggacagatacgtggccatctgctaccccctgagatacagcaccatcctgaccaaccccgtgatcgccaaggtgggcaccgccaccttcctgagaggcgtgctgctgatcatccccttcaccttcctgaccaagctgctgccctactgcagaggcaacatcctgccccacacctactgcgaccacatgagcgtggccaagctgagctgcggcaacgtgaaggtgaacgccatctacggcctgatggtggccctgctgatctggggcttcgacatcctgtgcatcaccaacagctacaccatgatcctgagagccgtggtgagcctgagcagcgccgacgccagacagaaggccttcaacacctgcaccgcccacatctgcgccatcgtgttcagctacacccccgccttcttcagcttcttcagccacagattcggcgagcacatcatcccccccagctgccacatcatcgtggccaacatctacctgctgctgccccccaccatgaaccccatcgtgtacggcgtgaagaccaagcagatcagagactgcgtgatcagaatcctgagcggcagcaaggacaccaagagctacagcatgtag

SEQ ID NO: 20599 - DNA, 975 bp, Artificial Sequence
  Description of Artificial Sequence: Synthetic coding sequence
atgcccctgttcaacagcctgtgctggttccccaccatccacgtgaccccccccagcttcatcctgaacggcatccccggcctggagagagtgcacgtgtggatcagcctgcccctgtgcaccatgtacatcatcttcctggtgggcaacctgggcctggtgtacctgatctactacgaggagagcctgcaccaccccatgtacttcttcttcggccacgccctgagcctgatcgacctgctgacctgcaccaccaccctgcccaacgccctgtgcatcttctggttcagcctgaaggagatcaacttcaacgcctgcctggcccagatgttcttcgtgcacggcttcaccggcgtggagagcggcgtgctgatgctgatggccctggacagatacgtggccatctgctaccccctgagatacgccaccaccctgaccaaccccatcatcgccaaggccgagctggccaccttcctgagaggcgtgctgctgatgatccccttccccttcctggtgaagagactgcccttctgccagagcaacatcatcagccacacctactgcgaccacatgagcgtggtgaagctgagctgcgccagcatcaaggtgaacgtgatctacggcctgatggtggccctgctgatcggcgtgttcgacatctgctgcatcagcctgagctacaccctgatcctgaaggccgccatcagcctgagcagcagcgacgccagacagaaggccttcagcacctgcaccgcccacatcagcgccatcatcatcacctacgtgcccgccttcttcaccttcttcgcccacagattcggcggccacaccatcccccccagcctgcacatcatcgtggccaacctgtacctgctgctgccccccaccctgaaccccatcgtgtacggcgtgaagaccaagcagatcagaaagagcgtgatcaagttcttccagggcgacaagggcgccggctag

SEQ ID NO: 20600 - DNA, 948 bp, Artificial Sequence
  Description of Artificial Sequence: Synthetic coding sequence
atggtgctggccagcggcaacagcagcagccaccccgtgagcttcatcctgctgggcatccccggcctggagagcttccagctgtggatcgccttccccttctgcgccacctacgccgtggccgtggtgggcaacatcaccctgctgcacgtgatcagaatcgaccacaccctgcacgagcccatgtacctgttcctggccatgctggccatcaccgacctggtgctgagcagcagcacccagcccaagatgctggccatcttctggttccacgcccacgagatccagtaccacgcctgcctgatccaggtgttcttcatccacgccttcagcagcgtggagagcggcgtgctgatggccatggccctggactgctacgtggccatctgcttccccctgagacacagcagcatcctgacccccagcgtggtgatcaagctgggcaccatcgtgatgctgagaggcctgctgtgggtgagccccttctgcttcatggtgagcagaatgcccttctgccagcaccaggccatcccccagagctactgcgagcacatggccgtgctgaagctggtgtgcgccgacaccagcatcagcagaggcaacggcctgttcgtggccttcagcgtggccggcttcgacatgatcgtgatcggcatgagctacgtgatgatcctgagagccgtgctgcagctgcccagcggcgaggccagactgaaggccttcagcaccagaagcagccacatctgcgtgatcctggccctgtacatccccgccctgttcagcttcctgacctacagattcggccacgacgtgcccagagtggtgcacatcctgttcgccaacctgtacctgctgatcccccccatgctgaaccccatcatctacggcgtgagaaccaagcagatcggcgacagagtgatccagggctgctgcggcaacatcccctag

SEQ ID NO: 20601 - DNA, 1185 bp, Artificial Sequence
  Description of Artificial Sequence: Synthetic coding sequence
atgttctaccccatcctgaacgacatcagcaccaagaacaacagcaacatcatgagctgctgcaacatcctgttcatcaagaccgtggagatcatcctggtgtacaaccagacccagagcccctggtaccccatcgtgcccagcaagagcctggtgtacaacaacaacacctgcttcgactgctaccacctgcagagagtggactgcgtgcccagcagagaccacatcaaccagagcatggtgctggccagcggcaacagcagcagccaccccgtgagcttcatcctgctgggcatccccggcctggagagcttccagctgtggatcgccttccccttctgcgccacctacgccgtggccgtggtgggcaacatcaccctgctgcacgtgatcagaatcgaccacaccctgcacgagcccatgtacctgttcctggccatgctggccatcaccgacctggtgctgagcagcagcacccagcccaagatgctggccatcttctggttccacgcccacgagatccagtaccacgcctgcctgatccaggtgttcttcatccacgccttcagcagcgtggagagcggcgtgctgatggccatggccctggactgctacgtggccatctgcttccccctgagacacagcagcatcctgacccccagcgtggtgatcaagctgggcaccatcgtgatgctgagaggcctgctgtgggtgagccccttctgcttcatggtgagcagaatgcccttctgccagcaccaggccatcccccagagctactgcgagcacatggccgtgctgaagctggtgtgcgccgacaccagcatcagcagaggcaacggcctgttcgtggccttcagcgtggccggcttcgacatgatcgtgatcggcatgagctacgtgatgatcctgagagccgtgctgcagctgcccagcggcgaggccagactgaaggccttcagcaccagaagcagccacatctgcgtgatcctggccctgtacatccccgccctgttcagcttcctgacctacagattcggccacgacgtgcccagagtggtgcacatcctgttcgccaacctgtacctgctgatcccccccatgctgaaccccatcatctacggcgtgagaaccaagcagatcggcgacagagtgatccagggctgctgcggcaacatcccctag

SEQ ID NO: 20602 - DNA, 963 bp, Artificial Sequence
  Description of Artificial Sequence: Synthetic coding sequence
atggccgagaccctgcagctgaacagcaccttcctgcaccccaacttcttcatcctgaccggcttccccggcctgggcagcgcccagacctggctgaccctggtgttcggccccatctacctgctggccctgctgggcaacggcgccctgcccgccgtggtgtggatcgacagcaccctgcaccagcccatgttcctgctgctggccatcctggccgccaccgacctgggcctggccaccagcatcgcccccggcctgctggccgtgctgtggctgggccccagaagcgtgccctacgccgtgtgcctggtgcagatgttcttcgtgcacgccctgaccgccatggagagcggcgtgctgctggccatggcctgcgacagagccgccgccatcggcagacccctgcactaccccgtgctggtgaccaaggcctgcgtgggctacgccgccctggccctggccctgaaggccgtggccatcgtggtgcccttccccctgctggtggccaagttcgagcacttccaggccaagaccatcggccacacctactgcgcccacatggccgtggtggagctggtggtgggcaacacccaggccaccaacctgtacggcctggccctgagcctggccatcagcggcatggacatcctgggcatcaccggcagctacggcctgatcgcccacgccgtgctgcagctgcccaccagagaggcccacgccaaggccttcggcacctgcagcagccacatctgcgtgatcctggccttctacatccccggcctgttcagctacctgacccacagattcggccaccacaccgtgcccaagcccgtgcacatcctgctgagcaacatctacctgctgctgccccccgccctgaaccccctgatctacggcgccagaaccaagcagatcagagacagactgctggagaccttcaccttcagaaagagccccctgtag

SEQ ID NO: 20603 - DNA, 957 bp, Artificial Sequence
  Description of Artificial Sequence: Synthetic coding sequence
atgatccagcccatggccagccccagcaacagcagcaccgtgcccgtgagcgagttcctgctgatctgcttccccaacttccagagctggcagcactggctgagcctgcccctgagcctgctgttcctgctggccatgggcgccaacaccaccctgctgatcaccatccagctggaggccagcctgcaccagcccctgtactacctgctgagcctgctgagcctgctggacatcgtgctgtgcctgaccgtgatccccaaggtgctggccatcttctggtacgacctgagaagcatcagcttccccgcctgcttcctgcagatgttcatcatgaacagcttcctgcccatggagagctgcaccttcatggtgatggcctacgacagatacgtggccatctgccaccccctgagataccccagcatcatcaccaaccagttcgtggccaaggccagcgtgttcatcgtggtgagaaacgccctgctgaccgcccccatccccatcctgaccagcctgctgcactactgcggcgagaacgtgatcgagaactgcatctgcgccaacctgagcgtgagcagactgagctgcgacaacttcaccctgaacagaatctaccagttcgtggccggctggaccctgctgggcagcgacctgttcctgatcttcctgagctacaccttcatcctgagagccgtgctgagattcaaggccgagggcgccgccgtgaaggccctgagcacctgcggcagccacttcatcctgatcctgttcttcagcaccatcctgctggtggtggtgctgaccaacgtggccagaaagaaggtgcccatggacatcctgatcctgctgaacgtgctgcaccacctgatcccccccgccctgaaccccatcgtgtacggcgtgagaaccaaggagatcaagcagggcatccagaagctgctgcagagaggcagatag

SEQ ID NO: 20604 - DNA, 948 bp, Artificial Sequence
  Description of Artificial Sequence: Synthetic coding sequence
atgaccacccacagaaacgacaccctgagcaccgaggccagcgacttcctgctgaactgcttcgtgagaagccccagctggcagcactggctgagcctgcccctgagcctgctgttcctgctggccgtgggcgccaacaccaccctgctgatgaccatctggctggaggccagcctgcaccagcccctgtactacctgctgagcctgctgagcctgctggacatcgtgctgtgcctgaccgtgatccccaaggtgctgaccatcttctggttcgacctgagacccatcagcttccccgcctgcttcctgcagatgtacatcatgaactgcttcctggccatggagagctgcaccttcatggtgatggcctacgacagatacgtggccatctgccaccccctgagataccccagcatcatcaccgaccacttcgtggtgaaggccgccatgttcatcctgaccagaaacgtgctgatgaccctgcccatccccatcctgagcgcccagctgagatactgcggcagaaacgtgatcgagaactgcatctgcgccaacatgagcgtgagcagactgagctgcgacgacgtgaccatcaaccacctgtaccagttcgccggcggctggaccctgctgggcagcgacctgatcctgatcttcctgagctacaccttcatcctgagagccgtgctgagactgaaggccgagggcgccgtggccaaggccctgagcacctgcggcagccacttcatgctgatcctgttcttcagcaccatcctgctggtgttcgtgctgacccacgtggccaagaagaaggtgagccccgacgtgcccgtgctgctgaacgtgctgcaccacgtgatccccgccgccctgaaccccatcatctacggcgtgagaacccaggagatcaagcagggcatgcagagactgctgaagaagggctgctag

SEQ ID NO: 20605 - DNA, 1098 bp, Artificial Sequence
  Description of Artificial Sequence: Synthetic coding sequence
atgatgaccgtgatcctgaagaccctgctgggccagatccagggcctgagcggcaacccccacagcaccaccagcagaatgtacttcctgtgcttctgcaccagcctgctgagattcaaggtgcactgggtgagcagactgatcagaaagctgtacatggccagccccagcaacgacagcaccgcccccgtgagcgagttcctgctgatctgcttccccaacttccagagctggcagcactggctgagcctgcccctgagcctgctgttcctgctggccatgggcgccaacaccaccctgctgatcaccatccagctggaggccagcctgcaccagcccctgtactacctgctgagcctgctgagcctgctggacatcgtgctgtgcctgaccgtgatccccaaggtgctggccatcttctggttcgacctgagaagcatcagcttccccgcctgcttcctgcagatgttcatcatgaacagcttcctgaccatggagagctgcaccttcatggtgatggcctacgacagatacgtggccatctgccaccccctgagataccccagcatcatcaccgaccagttcgtggccagagccgtggtgttcgtgatcgccagaaacgccttcgtgagcctgcccgtgcccatgctgagcgccagactgagatactgcgccggcaacatcatcaagaactgcatctgcagcaacctgagcgtgagcaagctgagctgcgacgacatcaccttcaaccagctgtaccagttcgtggccggctggaccctgctgggcagcgacctgatcctgatcgtgatcagctacagcttcatcctgaaggtggtgctgagaatcaaggccgagggcgccgtggccaaggccctgagcacctgcggcagccacttcatcctgatcctgttcttcagcaccgtgctgctggtgctggtgatcaccaacctggccagaaagagaatcccccccgacgtgcccatcctgctgaacatcctgcaccacctgatcccccccgccctgaaccccatcgtgtacggcgtgagaaccaaggagatcaagcagggcatccagaacctgctgaagagactgtag

SEQ ID NO: 20606 - DNA, 975 bp, Artificial Sequence
  Description of Artificial Sequence: Synthetic coding sequence
atgaaccacatgagcgccagcctgaagatcagcaacagcagcaagttccaggtgagcgagttcatcctgctgggcttccccggcatccacagctggcagcactggctgagcctgcccctggccctgctgtacctgagcgccctggccgccaacaccctgatcctgatcatcatctggcagaaccccagcctgcagcagcccatgtacatcttcctgggcatcctgtgcatggtggacatgggcctggccaccaccatcatccccaagatcctggccatcttctggttcgacgccaaggtgatcagcctgcccgagtgcttcgcccagatctacgccatccacttcttcgtgggcatggagagcggcatcctgctgtgcatggccttcgacagatacgtggccatctgccaccccctgagataccccagcatcgtgaccagcagcctgatcctgaaggccaccctgttcatggtgctgagaaacggcctgttcgtgacccccgtgcccgtgctggccgcccagagagactactgcagcaagaacgagatcgagcactgcctgtgcagcaacctgggcgtgaccagcctggcctgcgacgacagaagacccaacagcatctgccagctggtgctggcctggctgggcatgggcagcgacctgagcctgatcatcctgagctacatcctgatcctgtacagcgtgctgagactgaacagcgccgaggccgccgccaaggccctgagcacctgcagcagccacctgaccctgatcctgttcttctacaccatcgtggtggtgatcagcgtgacccacctgaccgagatgaaggccaccctgatccccgtgctgctgaacgtgctgcacaacatcatcccccccagcctgaaccccaccgtgtacgccctgcagaccaaggagctgagagccgccttccagaaggtgctgttcgccctgaccaaggagatcagaagctag

SEQ ID NO: 20607 - DNA, 960 bp, Artificial Sequence
  Description of Artificial Sequence: Synthetic coding sequence
atggacaccagcaccagcgtgacctacgacagcagcctgcagatcagccagttcatcctgatgggcctgcccggcatccacgagtggcagcactggctgagcctgcccctgaccctgctgtacctgctggccctgggcgccaacctgctgatcatcatcaccatccagcacgagaccgtgctgcacgagcccatgtaccacctgctgggcatcctggccgtggtggacatcggcctggccaccaccatcatgcccaagatcctggccatcttctggttcgacgccaaggccatcagcctgcccatgtgcttcgcccagatctacgccatccactgcttcttctgcatcgagagcggcatcttcctgtgcatggccgtggacagatacatcgccatctgcagacccctgcagtaccccagcatcgtgaccaaggccttcgtgttcaaggccaccggcttcatcatgctgagaaacggcctgctgaccatccccgtgcccatcctggccgcccagagacactactgcagcagaaacgagatcgagcactgcctgtgcagcaacctgggcgtgatcagcctggcctgcgacgacatcaccgtgaacaagttctaccagctgatgctggcctgggtgctggtgggcagcgacatggccctggtgttcagcagctacgccgtgatcctgcacagcgtgctgagactgaacagcgccgaggccatgagcaaggccctgagcacctgcagcagccacctgatcctgatcctgttccacaccggcatcatcgtgctgagcgtgacccacctggccgagaagaagatccccctgatccccgtgttcctgaacgtgctgcacaacgtgatcccccccgccctgaaccccctggcctgcgccctgagaatgcacaagctgagactgggcttccagagactgctgggcctgggccaggacgtgagcaagtag

SEQ ID NO: 20608 - DNA, 984 bp, Artificial Sequence
  Description of Artificial Sequence: Synthetic coding sequence
atggagtggagaaaccacagcggcagagtgagcgagttcgtgctgctgggcttccccgcccccgcccccctgcaggtgctgctgttcgccctgctgctgctggcctacgtgctggtgctgaccgagaacaccctgatcatcatggccatcagaaaccacagcaccctgcacaagcccatgtacttcttcctggccaacatgagcttcctggagatctggtacgtgaccgtgaccatccccaagatgctggccggcttcgtgggcagcaagcaggaccacggccagctgatcagcttcgagggctgcatgacccagctgtacttcttcctgggcctgggctgcaccgagtgcgtgctgctggccgtgatggcctacgacagatacatggccatctgctaccccctgcactaccccgtgatcgtgagcggcagactgtgcgtgcagatggccgccggcagctgggccggcggcttcggcatcagcatggtgaaggtgttcctgatcagcggcctgagctactgcggccccaacatcatcaaccacttcttctgcgacgtgagccccctgctgaacctgagctgcaccgacatgagcaccgccgagctgaccgacttcatcctggccatcttcatcctgctgggccccctgagcgtgaccggcgccagctacgtggccatcaccggcgccgtgatgcacatccccagcgccgccggcagatacaaggccttcagcacctgcgccagccacctgaccgtggtgatcatcttctacgccgccagcatcttcatctacgccagacccaaggccctgagcgccttcgacaccaacaagctggtgagcgtgctgtacgccgtgatcgtgcccctgctgaaccccatcatctactgcctgagaaaccaggaggtgaagagagccctgtgctgcaccctgcacctgtaccagcaccaggaccccgaccccaagaaggccagcagaaacgtgtag

SEQ ID NO: 20609 - DNA, 936 bp, Artificial Sequence
  Description of Artificial Sequence: Synthetic coding sequence
atggagctggagaaccagaccagagtgaccaagttcatcctggtgggcttccccggcagcctgagcatgagagccgccatgttcctgatcttcctggtggcctacatcctgaccgtggccgagaacgtgatcatcatcctgctggtgctgcagaacagacccctgcacaagcccatgtacttcttcctggccaacctgagcttcctggagacctggtacatcagcgtgaccgtgcccaagctgctgttcagcttctggagcgtgaacaacagcatcagcttcaccctgtgcatgatccagctgtacttcttcatcgccctgatgtgcaccgagtgcgtgctgctggccgccatggcctacgacagatacgtggccatctgcagacccctgcactaccccaccatcatgagccacggcctgtgcttcagactggccctgggcagctgggccatcggcttcggcatcagcctggccaagatctacttcatcagctgcctgagcttctgcggccccaacgtgatcaaccacttcttctgcgacatcagccccgtgctgaacctgagctgcaccgacatgagcatcaccgagctggtggacttcatcctggccctggtgatcttcctgttccccctgttcatcaccgtgctgagctacggctgcatcctggccaccatcctgtgcatgcccaccggcaagcagaaggccttcagcacctgcgccagccacctggtggtggtgaccatcttctacagcgccatcatcttcatgtacgccagacccagagtgatccacgccttcaacatgaacaagatcatcagcatcttctacgccatcgtgacccccagcctgaaccccttcatctactgcctgagaaacagagaggtgaaggaggccctgaagaagctggcctactgccaggccagcagaagcgactag

SEQ ID NO: 20610 - DNA, 939 bp, Artificial Sequence
  Description of Artificial Sequence: Synthetic coding sequence
atgagcggcgagaacgtgaccaaggtgagcaccttcatcctggtgggcctgcccaccgcccccggcctgcagtacctgctgttcctgctgttcctgctgacctacctgttcgtgctggtggagaacctggccatcatcctgatcgtgtggagcagcaccagcctgcacagacccatgtactacttcctgagcagcatgagcttcctggagatctggtacgtgagcgacatcacccccaagatgctggagggcttcctgctgcagcagaagagaatcagcttcgtgggctgcatgacccagctgtacttcttcagcagcctggtgtgcaccgagtgcgtgctgctggccagcatggcctacgacagatacgtggccatctgccaccccctgagataccacgtgctggtgacccccggcctgtgcctgcagctggtgggcttcagcttcgtgagcggcttcaccatcagcatgatcaaggtgtgcttcatcagcagcgtgaccttctgcggcagcaacgtgctgaaccacttcttctgcgacatcagccccatcctgaagctggcctgcaccgacttcagcaccgccgagctggtggacttcatcctggccttcatcatcctggtgttccccctgctggccaccatcctgagctactggcacatcaccctggccgtgctgagaatccccagcgccaccggctgctggagagccttcagcacctgcgccagccacctgaccgtggtgaccgtgttctacaccgccctgctgttcatgtacgtgagaccccaggccatcgacagccagagcagcaacaagctgatcagcgccgtgtacaccgtggtgacccccatcatcaaccccctgatctactgcctgagaaacaaggagttcaaggacgccctgaagaaggccctgggcctgggccagaccagccactag

SEQ ID NO: 20611 - DNA, 996 bp, Artificial Sequence
  Description of Artificial Sequence: Synthetic coding sequence
atgagcggcgagaacgtgaccagagtgggcaccttcatcctggtgggcttccccaccgcccccggcctgcagtacctgctgttcctgctgttcctgctgacctacctgttcgtgctggtggagaacctggccatcatcctgaccgtgtggagcagcaccagcctgcacagacccatgtactacttcctgagcagcatgagcttcctggagatctggtacgtgagcgacatcacccccaagatgctggagggcttcctgctgcagcagaagagaatcagcttcgtgggctgcatgacccagctgtacttcttcagcagcctggtgtgcaccgagtgcgtgctgctggccagcatggcctacgacagatacgtggccatctgccaccccctgagataccacgtgctggtgacccccggcctgtgcctgcagctggtgggcttcagcttcgtgagcggcttcaccatcagcatgatcaaggtgtgcttcatcagcagcgtgaccttctgcggcagcaacgtgctgaaccacttcttctgcgacatcagccccatcctgaagctggcctgcaccgacttcagcaccgccgagctggtggacttcatcctggccttcatcatcctggtgttccccctgctggccaccatgctgagctacgcccacatcaccctggccgtgctgagaatccccagcgccaccggctgctggagagccttcttcacctgcgccagccacctgaccgtggtgaccgtgttctacaccgccctgctgttcatgtacgtgagaccccaggccatcgacagcagaagcagcaacaagctgatcagcgtgctgtacaccgtgatcacccccatcctgaaccccctgatctactgcctgagaaacaaggagttcaagaacgccctgaagaaggccttcggcctgaccagctgcgccgtggagggcagactgagcagcctgctggagctgcacctgcagatccacagccagcccctgtag

SEQ ID NO: 20612 - DNA, 939 bp, Artificial Sequence
  Description of Artificial Sequence: Synthetic coding sequence
atgagaaaccacaccgagatcaccgagttcatcctgctgggcctgaccgacgaccccaacttccaggtggtgatcttcgtgttcctgctgatcacctacatgctgagcatcaccggcaacctgaccctgatcaccatcaccctgctggacagccacctgcagacccccatgtacttcttcctgagaaacttcagcatcctggagatcagcttcaccaccgtgagcatccccaagttcctgggcaacatcatcagcggcgacaagaccatcagcttcaacaactgcatcgtgcagctgttcttcttcatcctgctgggcgtgaccgagttctacctgctggccgccatgagctacgacagatacgtggccatctgcaagcccctgcactgcctgagcatcatgaacagaagagtgtgcaccctgctggtgttcaccagctggctggtgagcttcctgatcatcttccccgccctgatgctgctgctgaagctgcactactgcagaagcaacatcatcgaccacttcacctgcgactacttccccctgctgcagctggcctgcagcgacaccaagttcctggaggtgatgggcttcagctgcgccgccttcaccctgatgttcaccctggccctgatcttcctgagctacatctacatcatcagaaccatcctgagaatccccagcaccagccagagaaccaaggccttcagcacctgcagcagccacatggtggtggtgagcatcagctacggcagctgcatcttcatgtacatcaagcccagcgccaaggacagagtgagcctgagcaagggcgtggccatcctgaacaccagcgtggcccccatgatgaaccccttcatctacagcctgagaaaccagcaggtgaagcaggccttcatcaacatggccagaaagaccgtgttcttcaccagcacctag

SEQ ID NO: 20613 - DNA, 939 bp, Artificial Sequence
  Description of Artificial Sequence: Synthetic coding sequence
atgaagaaccacaccgtgatcagaaccttcatcctgctgggcctgaccggcgacccccacctgcaggtgctgctgttcatcttcctgttcctgacctacatgctgagcgtgaccggcaacctgaccatcatcaccctgaccctggtggaccaccacctgaagacccccatgtacttcttcctgagaaacttcagcttcctggaggtgagcttcaccaccgtgtgcatccccagattcctgtacaacatcagcatgggcgacaacaccatcacctacaacgcctgcgccagccagatcttcttcgtgatcctgttcggcgccaccgagttcttcctgctggccgccatgagctacgacagatacgtggccatctgcaagcccctgcactacgtggtgatcatgaacaacagagtgtgcaccctgctggtgctgtgctgctgggtggccggcctgatgatcatcgtgccccccctgagcctgggcctgcagctggagttctgcgacagcaacgccatcgaccacttcagctgcgacgccggccccctgctgaagatcagctgcagcgacacctgggtgatcgagcagatggtgatcctgatggccgtgttcgccctgatcatcaccctggtgtgcgtgatcctgagctacctgtacatcgtgagaaccatcctgaagttccccagcgtgcagcagagaaagaaggccttcagcacctgcagcagccacatgatcgtggtgagcatcgcctacggcagctgcatcttcatctacatcaagcccagcgccaaggacgaggtggccatcaacaagggcgtgagcgtgctgaccaccagcgtggcccccctgctgaaccccttcatctacaccctgagaaacaagcaggtgaagcaggccttcagcgacagcatcaagagaatcgccttcctgagcaagaagtag

SEQ ID NO: 20614 - DNA, 936 bp, Artificial Sequence
  Description of Artificial Sequence: Synthetic coding sequence
atgaaccacaccatggtgaccgagttcgtgctgctgggcctgagcgacgaccccgacctgcagatcgtgatcttcctgttcctgttcatcacctacatcctgagcgtgaccggcaacctgaccatcatcaccctgaccttcgtggacagccacctgcagacccccatgtacttcttcctgagaaacttcagcttcctggagatcagcttcaccaccgtgtgcatccccagattcctgggcgccatcatcaccagaaacaagaccatcagctacaacaactgcgccgcccagctgttcttcttcatcttcatgggcgtgaccgagttctacatcctgaccgccatgagctacgacagatacgtggccatctgcaagcccctgcactacaccagcatcatgaacagaaagctgtgcaccctgctggtgctgtgcgcctggctgagcggcttcctgaccatcttcccccccctgatgctgctgctgcagctggactactgcgccagcaacgtgatcgaccacttcgcctgcgactacttccccctgctgcagctgagctgcagcgacacctggctgctggaggtgatcggcttctacttcgccctggtgaccctgctgttcaccctggccctggtgatcctgagctacatgtacatcatcagaaccatcctgagaatccccagcgccagccagagaaagaaggccttcagcacctgcagcagccacatgatcgtgatcagcatcagctacggcagctgcatcttcatgtacgccaaccccagcgccaaggagaaggccagcctgaccaagggcatcgccatcctgaacaccagcgtggcccccatgctgaaccccttcatctacaccctgagaaaccagcaggtgaagcaggccttcaagaacgtggtgcacaaggtggtgttctacgccaaccagtag

SEQ ID NO: 20615 - DNA, 930 bp, Artificial Sequence
  Description of Artificial Sequence: Synthetic coding sequence
atgaagaacagaaccatgttcggcgagttcatcctgctgggcctgaccaaccagcccgagctgcaggtgatgatcttcatcttcctgttcctgacctacatgctgagcatcctgggcaacctgaccatcatcaccctgaccctgctggacccccacctgcagacccccatgtacttcttcctgagaaacttcagcttcctggagatcagcttcaccagcatcttcatccccagattcctgaccagcatgaccaccggcaacaaggtgatcagcttcgccggctgcctgacccagtacttcttcgccatcttcctgggcgccaccgagttctacctgctggccagcatgagctacgacagatacgtggccatctgcaagcccctgcactacctgaccatcatgagcagcagagtgtgcatccagctggtgttctgcagctggctgggcggcttcctggccatcctgccccccatcatcctgatgacccaggtggacttctgcgtgagcaacatcctgaaccactactactgcgactacggccccctggtggagctggcctgcagcgacaccagcctgctggagctgatggtgatcctgctggccgtggtgaccctgatggtgaccctggtgctggtgaccctgagctacacctacatcatcagaaccatcctgagaatccccagcgcccagcagagaaccaaggccttcagcacctgcagcagccacatgatcgtgatcagcctgagctacggcagctgcatgttcatgtacatcaaccccagcgccaaggagggcggcgccttcaacaagggcatcgccgtgctgatcaccagcgtgacccccctgctgaaccccttcatctacaccctgagaaaccagcaggtgaagcaggccttcaaggacagcgtgaagaagatcgtgaagctgtag

SEQ ID NO: 20616 - DNA, 939 bp, Artificial Sequence
  Description of Artificial Sequence: Synthetic coding sequence
atgcccaacatgaccagcatcagagagttcatcctgctgggcttcaccgacaaccccgagctgcaggtggtgatcttcttcttcatgctgatcacctacctgctgagcgtgagcggcaacatgatcatcatcatgctgaccctgagcaacatccacctgaagacccccatgtacttcttcctgagaaacttcagcttcctggagatcagcttcaccaccgtgttcatccccagattcctgatcaacatcgccaccggcgacaccaccatcagctacaacgccagcatggcccaggtgttcttcctgatcctgctgggcagcaccgagttcttcctgctggccgtgatgagctacgacagatacgtggccatctgcaagcccctgcactacaccaccatcatgagcaacaaggtgtgcaactggctggtgatcagcagctggctggccggcttcctgatcatcttcccccccgtgatcatgggcctgcagctggacttctgcgacagcagcaccatcgaccacttcatctgcgacagcagccccatgctgctgatcgcctgcaccgacacccagttcctggagctgatggccttcctgctggccgtgttcaccctgatggtgaccctggccctggtggtgctgagctacaccctgatcctgaagaccatcctgaagatccccagcgcccagcagagaaagaaggccttcagcacctgcagcagccacatgatcgtggtgagcgtgagctacggcagctgcatcttcatgtgcgtgaagaccagcgccaaggagggcatggccctgagcaagggcgtggccgtgctgaacaccagcgtggcccccatgctgaaccccttcatctacaccctgagaaaccagcaggtgaagcaggccctgagagagttcaccaagaagatcctgagcctgaacaagcagtag

SEQ ID NO: 20617 - DNA, 954 bp, Artificial Sequence
  Description of Artificial Sequence: Synthetic coding sequence
atgcagaagagcgtgatgagaaagcacaccgccatcaccaccttcatcctgctgggcctgaccgaggacccccagctgcaggtgctgctgttcatgttcctgttcatcacctacatgctgagcgtgaccggcaagctgaccatcatcgccctgaccatgctggacccccacctgaagacccccatgtacttcttcctgcagaacctgagcttcctggagatcagcttcaccgccacctgcgtgcccagattcctgtacagcatcagcaccggcaacaagatcatcacctacaacgcctgcgtgatccagctgttcttcgccgacctgttcggcgtgaccgagttcttcctgctggccaccatgagctacgacagatacgtggccatctgcaagcccctgcactacatggccatcatgagcaacaaggtgtgcaagaccatggtgatctgctgctggatggccgccctgatgatcatcctgccccccctgagcctgggcttccacctggagttctgcgacagcaacgtgatcaaccacttcggctgcgacgccctgcccatcctgaagatcccctgcagcgacaccagcctgatcgagcagatggtggtggccagcgccgtgctgaccttcatcatcaccctggtgtgcgtggtgctgagctacacctacatcatcagaaccatcctgaagttccccagcgtgcagcagaagaagaaggccttcagcacctgcagcagccacatcaccgtggtgagcatcacctacggcagctgcatcttcatctacatcaagcccagcgccaaggaggaggtgaacatcaacaagggcgtgagcgtgctgatcagcagcatcagccccatgctgaacagcttcatctacaccctgagaaacgagcaggtgaagcaggccttccacgacagcctgaagaagatcgccttcagactgaagaagtag

SEQ ID NO: 20618 - DNA, 939 bp, Artificial Sequence
  Description of Artificial Sequence: Synthetic coding sequence
atgagaaagcacaccgccatcaccaccttcatcctgctgggcctgaccgaggacccccagctgcaggtgctgctgttcatgttcctgttcatcacctacatgctgagcgtgaccggcaagctgaccatcatcgccctgaccatgctggacccccacctgaagacccccatgtacttcttcctgcagaacctgagcttcctggagatcagcttcaccgccacctgcgtgcccagattcctgtacagcatcagcaccggcaacaagatcatcacctacaacgcctgcgtgatccagctgttcttcgccgacctgttcggcgtgaccgagttcttcctgctggccaccatgagctacgacagatacgtggccatctgcaagcccctgcactacatggccatcatgagcaacaaggtgtgcaagaccatggtgatctgctgctggatggccgccctgatgatcatcctgccccccctgagcctgggcttccacctggagttctgcgacagcaacgtgatcaaccacttcggctgcgacgccctgcccatcctgaagatcccctgcagcgacaccagcctgatcgagcagatggtggtggccagcgccgtgctgaccttcatcatcaccctggtgtgcgtggtgctgagctacacctacatcatcagaaccatcctgaagttccccagcgtgcagcagaagaagaaggccttcagcacctgcagcagccacatcaccgtggtgagcatcacctacggcagctgcatcttcatctacatcaagcccagcgccaaggaggaggtgaacatcaacaagggcgtgagcgtgctgatcagcagcatcagccccatgctgaacagcttcatctacaccctgagaaacgagcaggtgaagcaggccttccacgacagcctgaagaagatcgccttcagactgaagaagtag

SEQ ID NO: 20619 - DNA, 939 bp, Artificial Sequence
  Description of Artificial Sequence: Synthetic coding sequence
atgaagaaccacaccagacagatcgagttcatcctgctgggcctgaccgacaacagccagctgcagatcgtgatcttcctgttcctgctgctgaactgcgtgctgagcatgatcggcaacttcaccatcatcgccctgatcctgctggacagccagctgaagacccccatgtacttcttcctgagaaacttcagcttcctggagatcagcttcaccaccgcctgcatccccagattcctgatcaccatcgtgaccagagagaagaccatcagctgcaacggctgcatcagccagctgttcttctacatcttcctgggcgtgaccgagttcttcctgctggccgccctgagctacgacagatacgtggccatctgcaagcccctgagatacatgagcatcatgagcaacaaggtgtgctaccagctggtgttcagcagctgggtgaccggcttcctgatcatcttcacccccctgatcctgggcctgaacctggacttctgcgccagcaacatcatcgaccacttcatctgcgacatcagcctgatcctgcagctgagctgcagcgacacccacctgctggagctgatcgccttcctgctggccgtgatgaccctgatcgtgaccctgttcctggtgatcctgagctacagctacatcatcaagaccatcctgaagttccccagcgcccagcagaagaagaaggccttcagcacctgcagcagccacatgatcgtggtgagcatcacctacggcagctgcatgttcatctacatcaagcccagcgccaacgagagagtggccctgagcaagggcgtgaccgtgctgaacaccagcgtggcccccctgctgaaccccttcatctacaccctgagaaaccagcaggtgaagcaggccttcaaggccgtgttcagaaagatcttcagcgccagcgacaagtag

SEQ ID NO: 20620 - DNA, 939 bp, Artificial Sequence
  Description of Artificial Sequence: Synthetic coding sequence
atgagaaaccacaccaccgtggccaacttcatcctgctgggcctgaccgacgacccccagctgcaggtgatcatcttcctgctgctgttcttcacctacatgctgagcatcaccggcaacctgaccatcatcaccctgaccctgctggacctgcacctgaagacccccatgtacttcttcctgagaaacttcagcttcctggaggtgagcttcaccaccgtgtacatccccaagttcctggtgagcatggccaccggcgacaagaccatcagctacaacgactgcgccgcccagctgttcttcaccatcctgctgggcgccaccgagttcttcctgctggccgccatgagctacgagagatacgtggccatctgcaagcccctgcactacaccaccatcatgagcagcagagtgtgcagcctgctggtgttcgccagctggatggccggcttcctgatcatcttcccccccctgctgatgggcctgcagctggacttctgcgccgccaacaccgtggaccacttcttctgcgacgtgagccccatcctgcagctgagctgcaccgacaccgacatcatcgagctgatgatgctgctgagcgccatcctgaccctgctggtgaccctggtgctggtgatcctgagctacaccaacatcatcagaaccatcctgaagatccccagcagccagcagagaaagaaggccttcagcacctgcagcagccacatggtggtggtgagcatcagctacggcagctgcatcttcatgtacgtgaagcccagcgccaaggagagagtgagcctgaacaagggcatcgccctgctgagcaccagcgtggcccccatgctgaaccccttcatctacaccctgagaaacaagcaggtgaaggacgtgttcaagcacaccgtgaagaagatcgagctgttcagcatgaagtag

SEQ ID NO: 20621 - DNA, 939 bp, Artificial Sequence
  Description of Artificial Sequence: Synthetic coding sequence
atgagaaacagcaccgccgtgaccgacttcatcctgctgggcctgaccagcgacccccagtggcaggtggtgctgttcatcttcctgctggtgacctacatgctgagcgtgaccggcaacctgatcatcatcaccctgaccctgagcgacccccacctgcagacccccatgtacttcttcctgagaaacttcagcttcctggagatcagcttcaccagcgtgtgcatccccagattcctggtgaccgtggtgaccggcaacagaaccatcagctacaacggctgcgtggcccagctgttcttcttcatcttcctgggcgtgaccgagttctacctgctggccgccatgagctacgacagatgcatggccatctgcaagcccctgcactacaccatcatcatgagcaccagagtgtgcaccctgctggtgttcagcagctggctggccggcttcctgatcatcttcccccccgtgatgctgctgctgcagctggacttctgcgccagcaacgtgatcgaccacttcatctgcgacagcagccccatgctgcagctgagctgcaccaacacccacttcctggagctgatggccttcttcctggccgtggtgaccctgatggtgaccctgaccctggtgatcctgagctacaccaacatcatcagaaccatcctgaagatccccagcatgagccagagaaagaaggccttcagcacctgcagcagccacatgatcgtggtgagcatcagctacagcagctgcatcttcatgtacatcaagaccagcgccagagagagagtgaccctgagcaagggcgtggccgtgctgaacaccagcgtggcccccctgctgaaccccttcatctacaccctgagaaacaagcaggtgaagcaggccttcaagagcatggtgcagaagatgatcttcagcctgaacaagtag

SEQ ID NO: 20622 - DNA, 927 bp, Artificial Sequence
  Description of Artificial Sequence: Synthetic coding sequence
atggacaccggcaacaagaccctgccccaggacttcctgctgctgggcttccccggcagccagaccctgcagctgagcctgttcatgctgttcctggtgatgtacatcctgaccgtgagcggcaacgtggccatcctgatgctggtgagcaccagccaccagctgcacacccccatgtacttcttcctgagcaacctgagcttcctggagatctggtacaccaccgccgccgtgcccaaggccctggccatcctgctgggcagaagccagaccatcagcttcaccagctgcctgctgcagatgtacttcgtgttcagcctgggctgcaccgagtacttcctgctggccgccatggcctacgacagatgcctggccatctgctaccccctgcactacggcgccatcatgagcagcctgctgagcgcccagctggccctgggcagctgggtgtgcggcttcgtggccatcgccgtgcccaccgccctgatcagcggcctgagcttctgcggccccagagccatcaaccacttcttctgcgacatcgccccctggatcgccctggcctgcaccaacacccaggccgtggagctggtggccttcgtgatcgccgtggtggtgatcctgagcagctgcctgatcaccttcgtgagctacgtgtacatcatcagcaccatcctgagaatccccagcgccagcggcagaagcaaggccttcagcacctgcagcagccacctgaccgtggtgctgatctggtacggcagcaccgtgttcctgcacgtgagaaccagcatcaaggacgccctggacctgatcaaggccgtgcacgtgctgaacaccgtggtgacccccgtgctgaaccccttcatctacaccctgagaaacaaggaggtgagagagaccctgctgaagaagtggaagggcaagtag

SEQ ID NO: 20623 - DNA, 1044 bp, Artificial Sequence
  Description of Artificial Sequence: Synthetic coding sequence
atgggcaactggaccgccgccgtgaccgagttcgtgctgctgggcttcagcctgagcagagaggtggagctgctgctgctggtgctgctgctgcccaccttcctgctgaccctgctgggcaacctgctgatcatcagcaccgtgctgagctgcagcagactgcacacccccatgtacttcttcctgtgcaacctgagcatcctggacatcctgttcaccagcgtgatcagccccaaggtgctggccaacctgggcagcagagacaagaccatcagcttcgccggctgcatcacccagtgctacttctacttcttcctgggcaccgtggagttcctgctgctgaccgtgatgagctacgacagatacgccaccatctgctgccccctgagatacaccaccatcatgagacccagcgtgtgcatcggcaccgtggtgttcagctgggtgggcggcttcctgagcgtgctgttccccaccatcctgatcagccagctgcccttctgcggcagcaacatcatcaaccacttcttctgcgacagcggccccctgctggccctggcctgcgccgacaccaccgccatcgagctgatggacttcatgctgagcagcatggtgatcctgtgctgcatcgtgctggtggcctacagctacacctacatcatcctgaccatcgtgagaatccccagcgccagcggcagaaagaaggccttcaacacctgcgccagccacctgaccatcgtgatcatccccagcggcatcaccgtgttcatctacgtgacccccagccagaaggagtacctggagatcaacaagatccccctggtgctgagcagcgtggtgacccccttcctgaaccccttcatctacaccctgagaaacgacaccgtgcagggcgtgctgagagacgtgtgggtgagagtgagaggcgtgttcgagaagagaatgagagccgtgctgagaagcagactgagcagcaacaaggaccaccagggcagagcctgcagcagccccccctgcgtgtacagcgtgaagctgcagtgctag

SEQ ID NO: 20624 - DNA, 975 bp, Artificial Sequence
  Description of Artificial Sequence: Synthetic coding sequence
atggagagccccaacagaaccaccatccaggagttcatcttcagcgccttcccctacagctgggtgaagagcgtggtgtgcttcgtgcccctgctgttcatctacgccttcatcgtggtgggcaacctggtgatcatcaccgtggtgcagctgaacacccacctgcacacccccatgtacaccttcatcagcgccctgagcttcctggagatctggtacaccaccgccaccatccccaagatgctgagcagcctgctgagcgagagaagcatcagcttcaacggctgcctgctgcagatgtacttcttccacagcaccggcatctgcgaggtgtgcctgctgaccgtgatggccttcgaccactacctggccatctgcagccccctgcactaccccagcatcatgacccccaagctgtgcacccagctgaccctgagctgctgcgtgtgcggcttcatcacccccctgcccgagatcgcctggatcagcaccctgcccttctgcggcagcaaccacctggagcacatcttctgcgacttcctgcccgtgctgagactggcctgcaccgacaccagagccatcgtgatgatccaggtggtggacgtgatccacgccgtggagatcatcaccgccgtgatgctgatcttcatgagctacgacggcatcgtggccgtgatcctgagaatccacagcgccggcggcagaagaaccgccttcagcacctgcgtgagccacttcatcgtgttcagcctgttcttcggcagcgtgaccctgatgtacctgagattcagcgccacctacagcctgttctgggacatcgccatcgccctggccttcgccgtgctgagccccttcttcaaccccatcatctacagcctgagaaacaaggagatcaaggaggccatcaagaagcacatcggccaggccaagatcttcttcagcgtgagacccggcaccagcagcaagatcttctag

SEQ ID NO: 20625 - DNA, 948 bp, Artificial Sequence
  Description of Artificial Sequence: Synthetic coding sequence
atggagagcggcaaccagagcaccgtgaccgagttcatcttcaccggcttcccccagctgcaggacggcagcctgctgtacttcttccccctgctgttcatctacaccttcatcatcatcgacaacctgctgatcttcagcgccgtgagactggacacccacctgcacaaccccatgtacaacttcatcagcatcttcagcttcctggagatctggtacaccaccgccaccatccccaagatgctgagcaacctgatcagcgagaagaaggccatcagcatgaccggctgcatcctgcagatgtacttcttccacagcctggagaacagcgagggcatcctgctgaccaccatggccatcgacagatacgtggccatctgcaaccccctgagataccagatgatcatgacccccagactgtgcgcccagctgagcgccggcagctgcctgttcggcttcctgatcctgctgcccgagatcgtgatgatcagcaccctgcccttctgcggccccaaccagatccaccagatcttctgcgacctggtgcccgtgctgagcctggcctgcaccgacaccagcatgatcctgatcgaggacgtgatccacgccgtgaccatcatcatcaccttcctgatcatcgccctgagctacgtgagaatcgtgaccgtgatcctgagaatccccagcagcgagggcagacagaaggccttcagcacctgcgccggccacctgatggtgttccccatcttcttcggcagcgtgagcctgatgtacctgagattcagcgacacctacccccccgtgctggacaccgccatcgccctgatgttcaccgtgctggcccccttcttcaaccccatcatctacagcctgagaaacaaggacatgaacaacgccatcaagaagctgttctgcctgcagaaggtgctgaacaagcccggcggctag

SEQ ID NO: 20626 - DNA, 996 bp, Artificial Sequence
  Description of Artificial Sequence: Synthetic coding sequence
atgtgctggaccatgcccagccccttcaccggcagcagcaccagaaacatggagagcggcaaccagagcaccgtgaccgagttcatcttcaccggcttcccccagctgcaggacggcagcctgctgtacttcttccccctgctgttcatctacaccttcatcatcatcgacaacctgctgatcttcagcgccgtgagactggacacccacctgcacaaccccatgtacaacttcatcagcatcttcagcttcctggagatctggtacaccaccgccaccatccccaagatgctgagcaacctgatcagcgagaagaaggccatcagcatgaccggctgcatcctgcagatgtacttcttccacagcctggagaacagcgagggcatcctgctgaccaccatggccatcgacagatacgtggccatctgcaaccccctgagataccagatgatcatgacccccagactgtgcgcccagctgagcgccggcagctgcctgttcggcttcctgatcctgctgcccgagatcgtgatgatcagcaccctgcccttctgcggccccaaccagatccaccagatcttctgcgacctggtgcccgtgctgagcctggcctgcaccgacaccagcatgatcctgatcgaggacgtgatccacgccgtgaccatcatcatcaccttcctgatcatcgccctgagctacgtgagaatcgtgaccgtgatcctgagaatccccagcagcgagggcagacagaaggccttcagcacctgcgccggccacctgatggtgttccccatcttcttcggcagcgtgagcctgatgtacctgagattcagcgacacctacccccccgtgctggacaccgccatcgccctgatgttcaccgtgctggcccccttcttcaaccccatcatctacagcctgagaaacaaggacatgaacaacgccatcaagaagctgttctgcctgcagaaggtgctgaacaagcccggcggctag

SEQ ID NO: 20627 - DNA, 1032 bp, Artificial Sequence
  Description of Artificial Sequence: Synthetic coding sequence
atgaagcagtacagcgtgggcaaccagcacagcaactacagaagcctgctgttccccttcctgtgcagccagatgacccagctgaccgccagcggcaaccagaccatggtgaccgagttcctgttcagcatgttcccccacgcccacagaggcggcctgctgttcttcatccccctgctgctgatctacggcttcatcctgaccggcaacctgatcatgttcatcgtgatccaggtgggcatggccctgcacacccccctgtacttcttcatcagcgtgctgagcttcctggagatctgctacaccaccaccaccatccccaagatgctgagctgcctgatcagcgagcagaagagcatcagcgtggccggctgcctgctgcagatgtacttcttccacagcctgggcatcaccgagagctgcgtgctgaccgccatggccatcgacagatacatcgccatctgcaaccccctgagataccccaccatcatgatccccaagctgtgcatccagctgaccgtgggcagctgcttctgcggcttcctgctggtgctgcccgagatcgcctggatcagcaccctgcccttctgcggcagcaaccagatccaccagatcttctgcgacttcacccccgtgctgagcctggcctgcaccgacaccttcctggtggtgatcgtggacgccatccacgccgccgagatcgtggccagcttcctggtgatcgccctgagctacatcagaatcatcatcgtgatcctgggcatgcacagcgccgagggccaccacaaggccttcagcacctgcgccgcccacctggccgtgttcctgctgttcttcggcagcgtggccgtgatgtacctgagattcagcgccacctacagcgtgttctgggacaccgccatcgccgtgaccttcgtgatcctggcccccttcttcaaccccatcatctacagcctgaagaacaaggacatgaaggaggccatcggcagactgttccactaccagaagagagccggctgggccggcaagtag

SEQ ID NO: 20628 - DNA, 942 bp, Artificial Sequence
  Description of Artificial Sequence: Synthetic coding sequence
atgggcaactggagcaccgtgaccgagatcaccctgatcgccttccccgccctgctggagatcagaatcagcctgttcgtggtgctggtggtgacctacaccctgaccgccaccggcaacatcaccatcatcagcctgatctggatcgaccacagactgcagacccccatgtacttcttcctgagcaacctgagcttcctggacatcctgtacaccaccgtgatcacccccaagctgctggcctgcctgctgggcgaggagaagaccatcagcttcgccggctgcatgatccagacctacttctacttcttcctgggcaccgtggagttcatcctgctggccgtgatgagcttcgacagatacatggccatctgcgaccccctgcactacaccgtgatcatgaacagcagagcctgcctgctgctggtgctgggctgctgggtgggcgccttcctgagcgtgctgttccccaccatcgtggtgaccagactgccctactgcagaaaggagatcaaccacttcttctgcgacatcgcccccctgctgcaggtggcctgcatcaacacccacctgatcgagaagatcaacttcctgctgagcgccctggtgatcctgagcagcctggccttcaccaccggcagctacgtgtacatcatcagcaccatcctgagaatccccagcacccagggcagacagaaggccttcagcacctgcgccagccacatcaccgtggtgagcatcgcccacggcagcaacatcttcgtgtacgtgagacccaaccagaacagcagcctggactacgacaaggtggccgccgtgctgatcaccgtggtgacccccctgctgaaccccttcatctacagcctgagaaacgagaaggtgcaggaggtgctgagagagaccgtgaacagaatcatgaccctgatccagagaaagacctag

SEQ ID NO: 20629 - DNA, 939 bp, Artificial Sequence
  Description of Artificial Sequence: Synthetic coding sequence
atggacaccggcaactggagccaggtggccgagttcatcatcctgggcttcccccacctgcagggcgtgcagatctacctgttcctgctgctgctgctgatctacctgatgaccgtgctgggcaacctgctgatcttcctggtggtgtgcctggacagcagactgcacacccccatgtaccacttcgtgagcatcctgagcttcagcgagctgggctacaccgccgccaccatccccaagatgctggccaacctgctgagcgagaagaagaccatcagcttcagcggctgcctgctgcagatctacttcttccacagcctgggcgccaccgagtgctacctgctgaccgccatggcctacgacagatacctggccatctgcagacccctgcactaccccaccctgatgacccccaccctgtgcgccgagatcgccatcggctgctggctgggcggcctggccggccccgtggtggagatcagcctgatcagcagactgcccttctgcggccccaacagaatccagcacgtgttctgcgacttcccccccgtgctgagcctggcctgcaccgacaccagcatcaacgtgctggtggacttcgtgatcaacagctgcaagatcctggccaccttcctgctgatcctgtgcagctacgtgcagatcatctgcaccgtgctgagaatccccagcgccgccggcaagagaaaggccatcagcacctgcgccagccacttcaccgtggtgctgatcttctacggcagcatcctgagcatgtacgtgcagctgaagaagagctacagcctggactacgaccaggccctggccgtggtgtacagcgtgctgacccccttcctgaaccccttcatctacagcctgagaaacaaggagatcaaggaggccgtgagaagacagctgaagagaatcggcatcctggcctag

SEQ ID NO: 20630 - DNA, 954 bp, Artificial Sequence
  Description of Artificial Sequence: Synthetic coding sequence
atggaccagtacaaccacagcagcctggccgagttcgtgttcctgggcttcgccagcgtgggctacgtgagaggctggctgttcgtgctgctgctgctggcctacctgttcaccatctgcggcaacatgctgatcttcagcgtgatcagactggacgccgccctgcacacccccatgtaccacttcgtgagcgtgctgagcttcctggagctgtggtacaccgccaccaccatccccaagatgctgagcaacatcctgagcgagaagaagaccatcagcttcgccggctgcctgctgcagacctacttcttccacagcctgggcgccagcgagtgctacctgctgaccgccatggcctacgacagatacctggccatctgcagacccctgcactaccccatcatcatgaccaccaccctgtgcgccaagatggccgccgcctgctggacctgcggcttcctgtgccccatcagcgaggtgatcctggccagccagctgcccttctgcgcctacaacgagatccagcacatcttctgcgacttcccccccctgctgagcctggcctgcaaggacaccagcgccaacatcctggtggacttcgccatcaacgccttcatcatcctgatcaccttcttcttcatcatgatcagctacgccagaatcatcggcgccgtgctgaagatcaagaccgccagcggcagaaagaaggccttcagcacctgcgccagccacctggccgtggtgctgatcttcttcggcagcatcatcttcatgtacgtgagactgaagaagagctacagcctgaccctggacagaaccctggccatcgtgtacagcgtgctgacccccatggtgaaccccatcatctacagcctgagaaacaaggagatcatcaaggccatcaagagaaccatcttccagaagggcgacaaggccagcctggcccacctgtag

SEQ ID NO: 20631 - DNA, 954 bp, Artificial Sequence
  Description of Artificial Sequence: Synthetic coding sequence
atgagaaacctgagcggcggccacgtggaggagttcgtgctggtgggcttccccaccaccccccccctgcagctgctgctgttcgtgctgttcttcgccatctacctgctgaccctgctggagaacgccctgatcgtgttcaccatctggctggcccccagcctgcacagacccatgtacttcttcctgggccacctgagcttcctggagctgtggtacatcaacgtgaccatccccagactgctggccgccttcctgacccaggacggcagagtgagctacgtgggctgcatgacccagctgtacttcttcatcgccctggcctgcaccgagtgcgtgctgctggccgtgatggcctacgacagatacctggccatctgcggccccctgctgtaccccagcctgatgcccagcagcctggccaccagactggccgccgccagctggggcagcggcttcttcagcagcatgatgaagctgctgttcatcagccagctgagctactgcggccccaacatcatcaaccacttcttctgcgacatcagccccctgctgaacctgacctgcagcgacaaggagcaggccgagctggtggacttcctgctggccctggtgatgatcctgctgcccctgctggccgtggtgagcagctacaccgccatcatcgccgccatcctgagaatccccaccagcagaggcagacacaaggccttcagcacctgcgccgcccacctggccgtggtggtgatctactacagcagcaccctgttcacctacgccagacccagagccatgtacaccttcaaccacaacaagatcatcagcgtgctgtacaccatcatcgtgcccttcttcaaccccgccatctactgcctgagaaacaaggaggtgaaggaggccttcagaaagaccgtgatgggcagatgccactaccccagagacgtgcaggactag

SEQ ID NO: 20632 - DNA, 954 bp, Artificial Sequence
  Description of Artificial Sequence: Synthetic coding sequence
atgcagccctacaccaagaactggacccaggtgaccgagttcgtgatgatgggcttcgccggcatccacgaggcccacctgctgttcttcatcctgttcctgaccatgtacctgttcaccctggtggagaacctggccatcatcctggtggtgggcctggaccacagactgagaagacccatgtacttcttcctgacccacctgagctgcctggagatctggtacaccagcgtgaccgtgcccaagatgctggccggcttcatcggcgtggacggcggcaagaacatcagctacgccgactgcctgagccagctgttcatcttcaccttcctgggcgccaccgagtgcttcctgctggccgccatggcctacgacagatacgtggccatctgcatgcccctgcactacggcgccttcgtgagctggggcacctgcatcagactggccgccgcctgctggctggtgggcttcctgacccccatcctgcccatctacctgctgagccagctgaccttctacggccccaacgtgatcgaccacttcagctgcgacgccagccccctgctggccctgagctgcagcgacgtgacctggaaggagaccgtggacttcctggtgagcctggccgtgctgctggccagcagcatggtgatcgccgtgagctacggcaacatcgtgtggaccctgctgcacatcagaagcgccgccgagagatggaaggccttcagcacctgcgccgcccacctgaccgtggtgagcctgttctacggcaccctgttcttcatgtacgtgcagaccaaggtgaccagcagcatcaacttcaacaaggtggtgagcgtgttctacagcgtggtgacccccatgctgaaccccctgatctacagcctgagaaacaaggaggtgaagggcgccctgggcagagtgttcagcctgaacttctggaagggccagtag

SEQ ID NO: 20633 - DNA, 996 bp, Artificial Sequence
  Description of Artificial Sequence: Synthetic coding sequence
atgagccccgacggcaaccacagcagcgaccccaccgagttcgtgctggccggcctgcccaacctgaacagcgccagagtggagctgttcagcgtgttcctgctggtgtacctgctgaacctgaccggcaacgtgctgatcgtgggcgtggtgagagccgacaccagactgcagacccccatgtacttcttcctgggcaacctgagctgcctggagatcctgctgaccagcgtgatcatccccaagatgctgagcaacttcctgagcagacagcacaccatcagcttcgccgcctgcatcacccagttctacttctacttcttcctgggcgccagcgagttcctgctgctggccgtgatgagcgccgacagatacctggccatctgccaccccctgagataccccctgctgatgagcggcgccgtgtgcttcagagtggccctggcctgctgggtgggcggcctggtgcccgtgctgggccccaccgtggccgtggccctgctgcccttctgcaagcagggcgccgtggtgcagcacttcttctgcgacagcggccccctgctgagactggcctgcaccaacaccaagaagctggaggagaccgacttcgtgctggccagcctggtgatcgtgagcagcctgctgatcaccgccgtgagctacggcctgatcgtgctggccgtgctgagcatccccagcgccagcggcagacagaaggccttcagcacctgcaccagccacctgatcgtggtgaccctgttctacggcagcgccatcttcctgtacgtgagacccagccagagcggcagcgtggacaccaactgggccgtgaccgtgatcaccaccttcgtgacccccctgctgaaccccttcatctacgccctgagaaacgagcaggtgaaggaggccctgaaggacatgttcagaaaggtggtggccggcgtgctgggcaacctgctgctggacaagtgcctgagcgagaaggccgtgaagtag

SEQ ID NO: 20634 - DNA, 972 bp, Artificial Sequence
  Description of Artificial Sequence: Synthetic coding sequence
atgaaccccgagaactggacccaggtgaccagcttcgtgctgctgggcttccccagcagccacctgatccagttcctggtgttcctgggcctgatggtgacctacatcgtgaccgccaccggcaagctgctgatcatcgtgctgagctggatcgaccagagactgcacatccagatgtacttcttcctgagaaacttcagcttcctggagctgctgctggtgaccgtggtggtgcccaagatgctggtggtgatcctgaccggcgaccacaccatcagcttcgtgagctgcatcatccagagctacctgtacttcttcctgggcaccaccgacttcttcctgctggccgtgatgagcctggacagatacctggccatctgcagacccctgagatacgagaccctgatgaacggccacgtgtgcagccagctggtgctggccagctggctggccggcttcctgtgggtgctgtgccccaccgtgctgatggccagcctgcccttctgcggccccaacggcatcgaccacttcttcagagacagctggcccctgctgagactgagctgcggcgacacccacctgctgaagctggtggccttcatgctgagcaccctggtgctgctgggcagcctggccctgaccagcgtgagctacgcctgcatcctggccaccgtgctgagagcccccaccgccgccgagagaagaaaggccttcagcacctgcgccagccacctgaccgtggtggtgatcatctacggcagcagcatcttcctgtacatcagaatgagcgaggcccagagcaagctgctgaacaagggcgccagcgtgctgagctgcatcatcacccccctgctgaaccccttcatcttcaccctgagaaacgacaaggtgcagcaggccctgagagaggccctgggctggcccagactgaccgccgtgatgaagctgagagtgaccagccagagaaagtag

SEQ ID NO: 20635 - DNA, 942 bp, Artificial Sequence
  Description of Artificial Sequence: Synthetic coding sequence
atggccaacctgagccagcccagcgagttcgtgctgctgggcttcagcagcttcggcgagctgcaggccctgctgtacggccccttcctgatgctgtacctgctggccttcatgggcaacaccatcatcatcgtgatggtgatcgccgacacccacctgcacacccccatgtacttcttcctgggcaacttcagcctgctggagatcctggtgaccatgaccgccgtgcccagaatgctgagcgacctgctggtgccccacaaggtgatcaccttcaccggctgcatggtgcagttctacttccacttcagcctgggcagcaccagcttcctgatcctgaccgacatggccctggacagattcgtggccatctgccaccccctgagatacggcaccctgatgagcagagccatgtgcgtgcagctggccggcgccgcctgggccgcccccttcctggccatggtgcccaccgtgctgagcagagcccacctggactactgccacggcgacgtgatcaaccacttcttctgcgacaacgagcccctgctgcagctgagctgcagcgacaccagactgctggagttctgggacttcctgatggccctgaccttcgtgctgagcagcttcctggtgaccctgatcagctacggctacatcgtgaccaccgtgctgagaatccccagcgccagcagctgccagaaggccttcagcacctgcggcagccacctgaccctggtgttcatcggctacagcagcaccatcttcctgtacgtgagacccggcaaggcccacagcgtgcaggtgagaaaggtggtggccctggtgaccagcgtgctgacccccttcctgaaccccttcatcctgaccttctgcaaccagaccgtgaagaccgtgctgcagggccagatgcagagactgaagggcctgtgcaaggcccagtag

SEQ ID NO: 20636 - DNA, 939 bp, Artificial Sequence
  Description of Artificial Sequence: Synthetic coding sequence
atgagaaacggcaccgtgatcaccgagttcatcctgctgggcttccccgtgatccagggcctgcagacccccctgttcatcgccatcttcctgacctacatcctgaccctggccggcaacggcctgatcatcgccaccgtgtgggccgagcccagactgcagatccccatgtacttcttcctgtgcaacctgagcttcctggagatctggtacaccaccaccgtgatccccaagctgctgggcaccttcgtggtggccagaaccgtgatctgcatgagctgctgcctgctgcaggccttcttccacttcttcgtgggcaccaccgagttcctgatcctgaccatcatgagcttcgacagatacctgaccatctgcaaccccctgcaccaccccaccatcatgaccagcaagctgtgcctgcagctggccctgagcagctgggtggtgggcttcaccatcgtgttctgccagaccatgctgctgatccagctgcccttctgcggcaacaacgtgatcagccacttctactgcgacgtgggccccagcctgaaggccgcctgcatcgacaccagcatcctggagctgctgggcgtgatcgccaccatcctggtgatccccggcagcctgctgttcaacatgatcagctacatctacatcctgagcgccatcctgagaatccccagcgccaccggccaccagaagaccttcagcacctgcgccagccacctgaccgtggtgagcctgctgtacggcgccgtgctgttcatgtacctgagacccaccgcccacagcagcttcaagatcaacaaggtggtgagcgtgctgaacaccatcctgacccccctgctgaaccccttcatctacaccatcagaaacaaggaggtgaagggcgccctgagaaaggccatgacctgccccaagaccggccacgccaagtag

SEQ ID NO: 20637 - DNA, 978 bp, Artificial Sequence
  Description of Artificial Sequence: Synthetic coding sequence
atgaccaccatcatcctggaggtggacaaccacaccgtgaccaccagattcatcctgctgggcttccccaccagacccgccttccagctgctgttcttcagcatcttcctggccacctacctgctgaccctgctggagaacctgctgatcatcctggccatccacagcgacggccagctgcacaagcccatgtacttcttcctgagccacctgagcttcctggagatgtggtacgtgaccgtgatcagccccaagatgctggtggacttcctgagccacgacaagagcatcagcttcaacggctgcatgacccagctgtacttcttcgtgaccttcgtgtgcaccgagtacatcctgctggccatcatggccttcgacagatacgtggccatctgcaaccccctgagataccccgtgatcatgaccaaccagctgtgcggcaccctggccggcggctgctggttctgcggcctgatgaccgccatgatcaagatggtgttcatcgcccagctgcactactgcggcatgccccagatcaaccactacttctgcgacatcagccccctgctgaacgtgagctgcgaggacgccagccaggccgagatggtggacttcttcctggccctgatggtgatcgccatccccctgtgcgtggtggtggccagctacgccgccatcctggccaccatcctgagaatccccagcgcccagggcagacagaaggccttcagcacctgcgccagccacctgaccgtggtgatcctgttctacagcatgaccctgttcacctacgccagacccaagctgatgtacgcctacaacagcaacaaggtggtgagcgtgctgtacaccgtgatcgtgcccctgctgaaccccatcatctactgcctgagaaaccacgaggtgaaggccgccctgagaaagaccatccactgcagaggcagcggcccccagggcaacggcgccttcagcagctag

SEQ ID NO: 20638 - DNA, 930 bp, Artificial Sequence
  Description of Artificial Sequence: Synthetic coding sequence
atgaagagctggaacaacaccatcatcctggagttcctgctgctgggcatcagcgaggagcccgagctgcaggccttcctgttcggcctgttcctgagcatgtacctggtgaccgtgctgggcaacctgctgatcatcctggccaccatcagcgacagccacctgcacacccccatgtacttcttcctgagcaacctgagcttcgtggacatctgcttcgtgagcaccaccgtgcccaagatgctggtgaacatccagacccacaacaaggtgatcacctacgccggctgcatcacccagatgtgcttcttcctgctgttcgtgggcctggacaacttcctgctgaccgtgatggcctacgacagattcgtggccatctgccaccccctgcactacatggtgatcatgaacccccagctgtgcggcctgctggtgctggccagctggatcatgagcgtgctgaacagcatgctgcagagcctgatggtgctgcccctgcccttctgcacccacatggagatcccccacttcttctgcgagatcaaccaggtggtgcacctggcctgcagcgacaccttcctgaacgacatcgtgatgtacttcgccgtggccctgctgggcggcggccccctgaccggcatcctgtacagctacagcaagatcgtgagcagcatcagagccatcagcagcgcccagggcaagtacaaggccttcagcacctgcgccagccacctgagcgtggtgagcctgttctacggcacctgcctgggcgtgtacctgagcagcgccgccacccacaacagccacaccggcgccgccgccagcgtgatgtacaccgtggtgacccccatgctgaaccccttcatctacagcctgagaaacaagcacatcaagggcgccatgaagaccttcttcagaggcaagcagtag

SEQ ID NO: 20639 - DNA, 930 bp, Artificial Sequence
  Description of Artificial Sequence: Synthetic coding sequence
atggagcccgagaacgacaccggcatcagcgagttcgtgctgctgggcctgagcgaggagcccgagctgcagcccttcctgttcggcctgttcctgagcatgtacctggtgaccgtgctgggcaacctgctgatcatcctggccaccatcagcgacagccacctgcacacccccatgtacttcttcctgagcaacctgagcttcgccgacatctgcttcatcagcaccaccatccccaagatgctgatcaacatccagacccagagcagagtgatcacctacgccggctgcatcacccagatgtgcttcttcgtgctgttcggcggcctggacagcctgctgctggccgtgatggcctacgacagattcgtggccatctgccaccccctgcactacaccgtgatcatgaaccccagactgtgcggcctgctggtgctggccagctggatgatcgccgccctgaacagcctgagccagagcctgatggtgctgtggctgagcttctgcaccgacctggagatcccccacttcttctgcgagctgaaccaggtgatccacctggcctgcagcgacaccttcctgaacgacatgggcatgtacttcgccgccggcctgctggccggcggccccctggtgggcatcctgtgcagctacagcaagatcgtgagcagcatcagagccatcagcagcgcccagggcaagtacaaggccttcagcacctgcgccagccacctgagcgtggtgagcctgttctgctgcaccggcctgggcgtgtacctgaccagcgccgccacccacaacagccacaccagcgccaccgccagcgtgatgtacaccgtggccacccccatgctgaaccccttcatctacagcctgagaaacaaggacatcaagagagccctgaagatgagcttcagaggcaagcagtag

SEQ ID NO: 20640 - DNA, 930 bp, Artificial Sequence
  Description of Artificial Sequence: Synthetic coding sequence
gtgaaggccggcaacgagacccagatcagcgagttcctgctgctgggcttcagcgagaagcaggagctgcagcccttcctgttcggcctgttcctgagcatgtacctggtgaccgtgctgggcaacctgctgatcatcctggccgccatcagcgacagctgcctgcacacccccatgtacttcttcctgagcaacctgagcttcgtggacatctgcttcgccagcaccatggtgcccaagatgctggtgaacatccagacccagagcaaggtgatcacctacgccggctgcatcacccagatgtgcttcttcgtgctgttcatcgtgctggacagcctgctgctgaccgtgatggcctacgaccagttcgtggccatctgccaccccctgcactacaccgtgatcatgagcccccagctgtgcggcctgctggtgctggtgagctggatcatgagcgtgctgaacagcatgctgcagagcctggtgaccctgcagctgagcttctgcaccgacctggagatcccccacttcttctgcgagctgaacgagatgatccacctggcctgcagcgacaccttcgtgaacaacatggtgatgcacttcgccgccgtgctgctggacggcggccccctggtgggcatcctgtacagctactgcagaatcgtgagcagcatcagagccatcagcagcacccagggcaagtacaaggccctgagcacctgcgccagccacctgagcgtggtgagcatcttctacggcaccggcctgggcgtgtacctgagcagcaccatgacccagaacctgcacagcaccgccgtggccagcgtgatgtacaccgtggtgacccccatgctgaaccccttcatctacagcctgagaaacaaggacatcaagggcgccctgacccagttcttcagaggcaagcagtag

SEQ ID NO: 20641 - DNA, 960 bp, Artificial Sequence; identical to SEQ ID NO: 20167
  Description of Artificial Sequence: Synthetic coding sequence

SEQ ID NO: 20642 - DNA, 939 bp, Artificial Sequence
  Description of Artificial Sequence: Synthetic coding sequence
atggaggccggcaaccagaccggcttcctggagttcatcctgctgggcctgagcgaggaccccgagctgcagcccttcatcttcggcctgttcctgagcatgtacctggtgaccgtgctgggcaacctgctgatcatcctggccatcagcagcgacagccacctgcacacccccatgtacttcttcctgagcaacctgagctgggtggacatctgcttcagcacctgcatcgtgcccaagatgctggtgaacatccagaccgagaacaaggccatcagctacatggactgcctgacccaggtgtacttcagcatgttcttccccatcctggacaccctgctgctgaccgtgatggcctacgacagattcgtggccgtgtgccaccccctgcactacatgatcatcatgaacccccacctgtgcggcctgctggtgttcgtgacctggctgatcggcgtgatgaccagcctgctgcacatcagcctgatgatgcacctgatcttctgcaaggacttcgagatcccccacttcttctgcgagctgacctacatcctgcagctggcctgcagcgacaccttcctgaacagcaccctgatctacttcatgaccggcgtgctgggcgtgttccccctgctgggcatcatcttcagctacagcagaatcgccagcagcatcagaaagatgagcagcagcggcggcaagcagaaggccctgagcacctgcggcagccacctgagcgtggtgagcctgttctacggcaccggcatcggcgtgcacttcaccagcgccgtgacccacagcagccagaagatcagcgtggccagcgtgatgtacaccgtggtgacccccatgctgaaccccttcatctacagcctgagaaacaaggacgtgaagggcgccctgggcagcctgctgagcagagccgccagctgcctgtag

SEQ ID NO: 20643 - DNA, 1020 bp, Artificial Sequence
  Description of Artificial Sequence: Synthetic coding sequence
atgagctacttccccatcctgttcttcttcttcctgaagagatgccccagctacaccgagccccagaacctgaccggcgtgagcgagttcctgctgctgggcctgagcgaggaccccgagctgcagcccgtgctggccggcctgttcctgagcatgtacctggtgaccgtgctgggcaacctgctgatcatcctggccgtgagcagcgacagccacctgcacacccccatgtacttcttcctgagcaacctgagcctggccgacatcggcttcaccagcaccaccgtgcccaagatgatcgtggacatgcagacccacagcagagtgatcagctacgagggctgcctgacccagatgagcttcttcgtgctgttcgcctgcatggacgacatgctgctgagcgtgatggcctacgacagattcgtggccatctgccaccccctgcactacagaatcatcatgaaccccagactgtgcggcttcctgatcctgctgagcttcttcatcagcctgctggacagccagctgcacaacctgatcatgctgcagctgacctgcttcaaggacgtggacatcagcaacttcttctgcgaccccagccagctgctgcacctgagatgcagcgacaccttcatcaacgagatggtgatctacttcatgggcgccatcttcggctgcctgcccatcagcggcatcctgttcagctactacaagatcgtgagccccatcctgagagtgcccaccagcgacggcaagtacaaggccttcagcacctgcggcagccacctggccgtggtgtgcctgttctacggcaccggcctggtgggctacctgagcagcgccgtgctgcccagccccagaaagagcatggtggccagcgtgatgtacaccgtggtgacccccatgctgaaccccttcatctacagcctgagaaacaaggacatccagagcgccctgtgcagactgcacggcagaatcatcaagagccaccacctgcaccccttctgctacatgggctag

SEQ ID NO: 20644 - DNA, 1002 bp, Artificial Sequence
  Description of Artificial Sequence: Synthetic coding sequence
atgggccccagaaaccagaccgccgtgagcgagttcctgctgatgaaggtgaccgaggaccccgagctgaagctgatccccttcagcctgttcctgagcatgtacctggtgaccatcctgggcaacctgctgatcctgctggccgtgatcagcgacagccacctgcacacccccatgtacttcctgctgttcaacctgagcttcaccgacatctgcctgaccaccaccaccgtgcccaagatcctggtgaacatccaggcccagaaccagagcatcacctacaccggctgcctgacccagatctgcctggtgctggtgttcgccggcctggagagctgcttcctggccgtgatggcctacgacagatacgtggccatctgccaccccctgagatacaccgtgctgatgaacgtgcacttctggggcctgctgatcctgctgagcatgttcatgagcaccatggacgccctggtgcagagcctgatggtgctgcagctgagcttctgcaagaacgtggagatccccctgttcttctgcgaggtggtgcaggtgatcaagctggcctgcagcgacaccctgatcaacaacatcctgatctacttcgccagcagcgtgttcggcgccatccccctgagcggcatcatcttcagctacagccagatcgtgaccagcgtgctgagaatgcccagcgccagaggcaagtacaaggccttcagcacctgcggctgccacctgagcgtgttcagcctgttctacggcaccgccttcggcgtgtacatcagcagcgccgtggccgagagcagcagaatcaccgccgtggccagcgtgatgtacaccgtggtgccccagatgatgaaccccttcatctacagcctgagaaacaaggagatgaagaaggccctgagaaagctgatcggctggagcaccgtggccagaagcagactgaccgccaacagcgccagcagagtgcacgccatcctgctgcccagaccccccgagtag

SEQ ID NO: 20645 - DNA, 936 bp, Artificial Sequence
  Description of Artificial Sequence: Synthetic coding sequence
atgggccccagaaaccagaccgccgtgagcgagttcctgctgatgaaggtgaccgaggaccccgagctgaagctgatccccttcagcctgttcctgagcatgtacctggtgaccatcctgggcaacctgctgatcctgctggccgtgatcagcgacagccacctgcacacccccatgtacttcctgctgttcaacctgagcttcaccgacatctgcctgaccaccaccaccgtgcccaagatcctggtgaacatccaggcccagaaccagagcatcacctacaccggctgcctgacccagatctgcctggtgctggtgttcgccggcctggagagctgcttcctggccgtgatggcctacgacagatacgtggccatctgccaccccctgagatacaccgtgctgatgaacgtgcacttctggggcctgctgatcctgctgagcatgttcatgagcaccatggacgccctggtgcagagcctgatggtgctgcagctgagcttctgcaagaacgtggagatccccctgttcttctgcgaggtggtgcaggtgatcaagctggcctgcagcgacaccctgatcaacaacatcctgatctacttcgccagcagcgtgttcggcgccatccccctgagcggcatcatcttcagctacagccagatcgtgaccagcgtgctgagaatgcccagcgccagaggcaagtacaaggccttcagcacctgcggctgccacctgagcgtgttcagcctgttctacggcaccgccttcggcgtgtacatcagcagcgccgtggccgagagcagcagaatcaccgccgtggccagcgtgatgtacaccgtggtgccccagatgatgaaccccttcatctacagcctgagaaacaaggagatgaagaaggccctgagaaagctgatcggcagactgttccccttctag

SEQ ID NO: 20646 - DNA, 1038 bp, Artificial Sequence
  Description of Artificial Sequence: Synthetic coding sequence
atgcccatgcagctgctgctgaccgacttcatcatcttcagcatcagattcatcatcaacagcatggaggccagaaaccagaccgccatcagcaagttcctgctgctgggcctgatcgaggaccccgagctgcagcccgtgctgttcagcctgttcctgagcatgtacctggtgaccatcctgggcaacctgctgatcctgctggccgtgatcagcgacagccacctgcacacccccatgtacttcttcctgagcaacctgagcttcctggacatctgcctgagcaccaccaccatccccaagatgctggtgaacatccaggcccagaacagaagcatcacctacagcggctgcctgacccagatctgcttcgtgctgttcttcgccggcctggagaactgcctgctggccgccatggcctacgacagatacgtggccatctgccaccccctgagatacaccgtgatcatgaaccccagactgtgcggcctgctgatcctgctgagcctgctgaccagcgtggtgaacgccctgctgctgagcctgatggtgctgagactgagcttctgcaccgacctggagatccccctgttcttctgcgagctggcccaggtgatccagctgacctgcagcgacaccctgatcaacaacatcctgatctacttcgccgcctgcatcttcggcggcgtgcccctgagcggcatcatcctgagctacacccagatcaccagctgcgtgctgagaatgcccagcgccagcggcaagcacaaggccgtgagcacctgcggcagccacctgagcatcgtgctgctgttctacggcgccggcctgggcgtgtacatcagcagcgtggtgaccgacagccccagaaagaccgccgtggccagcgtgatgtacagcgtgttcccccagatggtgaaccccttcatctacagcctgagaaacaaggacatgaagggcaccctgagaaagttcatcggcagaatccccagcctgctgtggtgcgccatctgcttcggcttcagattcctggagtag

SEQ ID NO: 20647 - DNA, 939 bp, Artificial Sequence
  Description of Artificial Sequence: Synthetic coding sequence
atgaaggccggcaacttcagcgacacccccgagttcttcctgctgggcctgagcggcgaccccgagctgcagcccatcctgttcatgctgttcctgagcatgtacctggccaccatgctgggcaacctgctgatcatcctggccgtgaacagcgacagccacctgcacacccccatgtacttcctgctgagcatcctgagcctggtggacatctgcttcaccagcaccaccatgcccaagatgctggtgaacatccaggcccaggcccagagcatcaactacaccggctgcctgacccagatctgcttcgtgctggtgttcgtgggcctggagaacggcatcctggtgatgatggcctacgacagattcgtggccatctgccaccccctgagatacaacgtgatcatgaaccccaagctgtgcggcctgctgctgctgctgagcttcatcgtgagcgtgctggacgccctgctgcacaccctgatggtgctgcagctgaccttctgcatcgacctggagatcccccacttcttctgcgagctggcccacatcctgaagctggcctgcagcgacgtgctgatcaacaacatcctggtgtacctggtgaccagcctgctgggcgtggtgcccctgagcggcatcatcttcagctacaccagaatcgtgagcagcgtgatgaagatccccagcgccggcggcaagtacaaggccttcagcatctgcggcagccacctgatcgtggtgagcctgttctacggcaccggcttcggcgtgtacctgagcagcggcgccacccacagcagcagaaagggcgccatcgccagcgtgatgtacaccgtggtgacccccatgctgaaccccctgatctacagcctgagaaacaaggacatgctgaaggccctgagaaagctgatcagcagaatccccagcttccactag

SEQ ID NO: 20648 - DNA, 981 bp, Artificial Sequence
  Description of Artificial Sequence: Synthetic coding sequence
atgggcttcctgagccccatgcacccctgcagaccccccacccagagaagaatggccgccggcaaccacagcaccgtgaccgagttcatcctgaagggcctgaccaagagagccgacctgcagctgcccctgttcctgctgttcctgggcatctacctggtgaccatcgtgggcaacctgggcatgatcaccctgatctgcctgaacagccagctgcacacccccatgtactacttcctgagcaacctgagcctgatggacctgtgctacagcagcgtgatcacccccaagatgctggtgaacttcgtgagcgagaagaacatcatcagctacgccggctgcatgagccagctgtacttcttcctggtgttcgtgatcgccgagtgctacatgctgaccgtgatggcctacgacagatacgtggccatctgccaccccctgctgtacaacatcatcatgagccaccacacctgcctgctgctggtggccgtggtgtacgccatcggcctgatcggcagcaccatcgagaccggcctgatgctgaagctgccctactgcgagcacctgatcagccactacttctgcgacatcctgcccctgatgaagctgagctgcagcagcacctacgacgtggagatgaccgtgttcttcagcgccggcttcaacatcatcgtgaccagcctgaccgtgctggtgagctacaccttcatcctgagcagcatcctgggcatcagcaccaccgagggcagaagcaaggccttcagcacctgcagcagccacctggccgccgtgggcatgttctacggcagcaccgccttcatgtacctgaagcccagcaccatcagcagcctgacccaggagaacgtggccagcgtgttctacaccaccgtgatccccatgctgaaccccctgatctacagcctgagaaacaaggaggtgaaggccgccgtgcagaagaccctgagaggcaagctgttctag

SEQ ID NO: 20649 - DNA, 933 bp, Artificial Sequence
  Description of Artificial Sequence: Synthetic coding sequence
atggccgccaagaacagcagcgtgaccgagttcatcctggagggcctgacccaccagcccggcctgagaatccccctgttcttcctgttcctgggcttctacaccgtgaccgtggtgggcaacctgggcctgatcaccctgatcggcctgaacagccacctgcacacccccatgtacttcttcctgttcaacctgagcctgatcgacttctgcttcagcaccaccatcacccccaagatgctgatgagcttcgtgagcagaaagaacatcatcagcttcaccggctgcatgacccagctgttcttcttctgcttcttcgtggtgagcgagagcttcatcctgagcgccatggcctacgacagatacgtggccatctgcaaccccctgctgtacaccgtgaccatgagctgccaggtgtgcctgctgctgctgctgggcgcctacggcatgggcttcgccggcgccatggcccacaccggcagcatcatgaacctgaccttctgcgccgacaacctggtgaaccacttcatgtgcgacatcctgcccctgctggagctgagctgcaacagcagctacatgaacgagctggtggtgttcatcgtggtggccgtggacgtgggcatgcccatcgtgaccgtgttcatcagctacgccctgatcctgagcagcatcctgcacaacagcagcaccgagggcagaagcaaggccttcagcacctgcagcagccacatcatcgtggtgagcctgttcttcggcagcggcgccttcatgtacctgaagcccctgagcatcctgcccctggagcagggcaaggtgagcagcctgttctacaccatcatcgtgcccgtgctgaaccccctgatctacagcctgagaaacaaggacgtgaaggtggccctgagaagaaccctgggcagaaagatcttcagctag

SEQ ID NO: 20650 - DNA, 942 bp, Artificial Sequence
  Description of Artificial Sequence: Synthetic coding sequence
atgctggccagaaacaacagcctggtgaccgagttcatcctggccggcctgaccgaccaccccgagttcagacagcccctgttcttcctgttcctggtgatctacatcgtgaccatggtgggcaacctgggcctgatcaccctgttcggcctgaacagccacctgcacacccccatgtactacttcctgttcaacctgagcttcatcgacctgtgctacagcagcgtgttcacccccaagatgctgatgaacttcgtgagcaagaagaacatcatcagcaacgtgggctgcatgaccagactgttcttcttcctgttcttcgtgatcagcgagtgctacatgctgaccagcatggcctacgacagatacgtggccatctgcaaccccctgctgtacaaggtgaccatgagccaccaggtgtgcagcatgctgaccttcgccgcctacatcatgggcctggccggcgccaccgcccacaccggctgcatgctgagactgaccttctgcagcgccaacatcatcaaccactacctgtgcgacatcctgcccctgctgcagctgagctgcaccagcacctacgtgaacgaggtggtggtgctgatcgtggtgggcaccaacatcaccgtgcccagctgcaccatcctgatcagctacgtgttcatcgtgaccagcatcctgcacatcaagagcacccagggcagaagcaaggccttcagcacctgcagcagccacgtgatcgccctgagcctgttcttcggcagcgccgccttcatgtacatcaagtacagcagcggcagcatggagcagggcaaggtgagcagcgtgttctacaccaacgtggtgcccatgctgaaccccctgatctacagcctgagaaacaaggacgtgaaggtggccctgagaaaggccctgatcaagatccagagaagaaacatcttctag

SEQ ID NO: 20651 - DNA, 942 bp, Artificial Sequence
  Description of Artificial Sequence: Synthetic coding sequence
atgctggccagaaacaacagcctggtgaccgagttcatcctggccggcctgaccgaccaccccgagttccagcagcccctgttcttcctgttcctggtggtgtacatcgtgaccatggtgggcaacctgggcctgatcatcctgttcggcctgaacagccacctgcacacccccatgtactacttcctgttcaacctgagcttcatcgacctgtgctacagcagcgtgttcacccccaagatgctgatgaacttcgtgagcaagaagaacatcatcagctacgtgggctgcatgacccagctgttcttcttcctgttcttcgtgatcagcgagtgctacatgctgaccagcatggcctacgacagatacgtggccatctgcaaccccctgctgtacaaggtgaccatgagccaccaggtgtgcagcatgctgaccttcgccgcctacatcatgggcctggccggcgccaccgcccacaccggctgcatgctgagactgaccttctgcagcgccaacatcatcaaccactacctgtgcgacatcctgcccctgctgcagctgagctgcaccagcacctacgtgaacgaggtggtggtgctgatcgtggtgggcatcaacatcatggtgcccagctgcaccatcctgatcagctacgtgttcatcgtgaccagcatcctgcacatcaagagcacccagggcagaagcaaggccttcagcacctgcagcagccacgtgatcgccctgagcctgttcttcggcagcgccgccttcatgtacatcaagtacagcagcggcagcatggagcagggcaaggtgagcagcgtgttctacaccaacgtggtgcccatgctgaaccccctgatctacagcctgagaaacaaggacgtgaaggtggccctgagaaaggccctgatcaagatccagagaagaaacatcttctag

SEQ ID NO: 20652 - DNA, 930 bp, Artificial Sequence
  Description of Artificial Sequence: Synthetic coding sequence
atgaccctgagaaacagcagcagcgtgaccgagttcatcctggtgggcctgagcgagcagcccgagctgcagctgcccctgttcctgctgttcctgggcatctacgtgttcaccgtggtgggcaacctgggcctgatcaccctgatcggcatcaaccccagcctgcacacccccatgtacttcttcctgttcaacctgagcttcatcgacctgtgctacagctgcgtgttcacccccaagatgctgaacgacttcgtgagcgagagcatcatcagctacgtgggctgcatgacccagctgttcttcttctgcttcttcgtgaacagcgagtgctacgtgctggtgagcatggcctacgacagatacgtggccatctgcaaccccctgctgtacatggtgaccatgagccccagagtgtgcttcctgctgatgttcggcagctacgtggtgggcttcgccggcgccatggcccacaccggcagcatgctgagactgaccttctgcgacagcaacgtgatcgaccactacctgtgcgacgtgctgcccctgctgcagctgagctgcaccagcacccacgtgagcgagctggtgttcttcatcgtggtgggcgtgatcaccatgctgagcagcatcagcatcgtgatcagctacgccctgatcctgagcaacatcctgtgcatccccagcgccgagggcagaagcaaggccttcagcacctggggcagccacatcatcgccgtggccctgttcttcggcagcggcaccttcacctacctgaccaccagcttccccggcagcatgaaccacggcagattcgccagcgtgttctacaccaacgtggtgcccatgctgaaccccagcatctacagcctgagaaacaaggacgacaagctggccctgggcaagaccctgaagagagtgctgttctag

SEQ ID NO: 20653 - DNA, 936 bp, Artificial Sequence
  Description of Artificial Sequence: Synthetic coding sequence
atggccgccgagaacagcagcttcgtgacccagttcatcctggccggcctgaccgaccagcccggcgtgcagatccccctgttcttcctgttcctgggcttctacgtggtgaccgtggtgggcaacctgggcctgatcaccctgatcagactgaacagccacctgcacacccccatgtacttcttcctgtacaacctgagcttcatcgacttctgctacagcagcgtgatcacccccaagatgctgatgagcttcgtgctgaagaagaacagcatcagctacgccggctgcatgacccagctgttcttcttcctgttcttcgtggtgagcgagagcttcatcctgagcgccatggcctacgacagatacgtggccatctgcaaccccctgctgtacatggtgaccatgagcccccaggtgtgcttcctgctgctgctgggcgtgtacggcatgggcttcgccggcgccatggcccacaccgcctgcatgatgggcgtgaccttctgcgccaacaacctggtgaaccactacatgtgcgacatcctgcccctgctggagtgcgcctgcaccagcacctacgtgaacgagctggtggtgttcgtggtggtgggcatcgacatcggcgtgcccaccgtgaccatcttcatcagctacgccctgatcctgagcagcatcttccacatcgacagcaccgagggcagaagcaaggccttcagcacctgcagcagccacatcatcgccgtgagcctgttcttcggcagcggcgccttcatgtacctgaagcccttcagcctgctggccatgaaccagggcaaggtgagcagcctgttctacaccaccgtggtgcccatgctgaaccccctgatctacagcctgagaaacaaggacgtgaaggtggccctgaagaagatcctgaacaagaacgccttcagctag

SEQ ID NO: 20654 - DNA, 927 bp, Artificial Sequence
  Description of Artificial Sequence: Synthetic coding sequence
atgaccatggagaactacagcatggccgcccagttcgtgctggacggcctgacccagcaggccgagctgcagctgcccctgttcctgctgttcctgggcatctacgtggtgaccgtggtgggcaacctgggcatgatcctgctgatcgccgtgagccccctgctgcacacccccatgtactacttcctgagcagcctgagcttcgtggacttctgctacagcagcgtgatcacccccaagatgctggtgaacttcctgggcaagaagaacaccatcctgtacagcgagtgcatggtgcagctgttcttcttcgtggtgttcgtggtggccgagggctacctgctgaccgccatggcctacgacagatacgtggccatctgcagccccctgctgtacaacgccatcatgagcagctgggtgtgcagcctgctggtgctggccgccttcttcctgggcttcctgagcgccctgacccacaccagcgccatgatgaagctgagcttctgcaagagccacatcatcaaccactacttctgcgacgtgctgcccctgctgaacctgagctgcagcaacacccacctgaacgagctgctgctgttcatcatcgccggcttcaacaccctggtgcccaccctggccgtggccgtgagctacgccttcatcctgtacagcatcctgcacatcagaagcagcgagggcagaagcaaggccttcggcacctgcagcagccacctgatggccgtggtgatcttcttcggcagcatcaccttcatgtacttcaagccccccagcagcaacagcctggaccaggagaaggtgagcagcgtgttctacaccaccgtgatccccatgctgaaccccctgatctacagcctgagaaacaaggacgtgaagaaggccctgagaaaggtgctggtgggcaagtag

SEQ ID NO: 20655 - DNA, 936 bp, Artificial Sequence
  Description of Artificial Sequence: Synthetic coding sequence
atggccaccagcaaccacagcagcggcgccgagttcatcctggccggcctgacccagagacccgagctgcagctgcccctgttcctgctgttcctgggcatctacgtggtgaccgtggtgggcaacctgggcatgatcttcctgatcgccctgagcagccagctgtacccccccgtgtactacttcctgagccacctgagcttcatcgacctgtgctacagcagcgtgatcacccccaagatgctggtgaacttcgtgcccgaggagaacatcatcagcttcctggagtgcatcacccagctgtacttcttcctgatcttcgtgatcgccgagggctacctgctgaccgccatggagtacgacagatacgtggccatctgcagacccctgctgtacaacatcgtgatgagccacagagtgtgcagcatcatgatggccgtggtgtacagcctgggcttcctgtgggccaccgtgcacaccaccagaatgagcgtgctgagcttctgcagaagccacaccgtgagccactacttctgcgacatcctgcccctgctgaccctgagctgcagcagcacccacatcaacgagatcctgctgttcatcatcggcggcgtgaacaccctggccaccaccctggccgtgctgatcagctacgccttcatcttcagcagcatcctgggcatccacagcaccgagggccagagcaaggccttcggcacctgcagcagccacctgctggccgtgggcatcttcttcggcagcatcaccttcatgtacttcaagccccccagcagcaccaccatggagaaggagaaggtgagcagcgtgttctacatcaccatcatccccatgctgaaccccctgatctacagcctgagaaacaaggacgtgaagaacgccctgaagaagatgaccagaggcagacagagcagctag

SEQ ID NO: 20656 - DNA, 945 bp, Artificial Sequence
  Description of Artificial Sequence: Synthetic coding sequence
atgggcgtgaagaaccacagcaccgtgaccgagttcctgctgagcggcctgaccgagcaggccgagctgcagctgcccctgttctgcctgttcctgggcatctacaccgtgaccgtggtgggcaacctgagcatgatcagcatcatcagactgaacagacagctgcacacccccatgtactacttcctgagcagcctgagcttcctggacttctgctacagcagcgtgatcacccccaagatgctgagcggcttcctgtgcagagacagaagcatcagctacagcggctgcatgatccagctgttcttcttctgcgtgtgcgtgatcagcgagtgctacatgctggccgccatggcctgcgacagatacgtggccatctgcagccccctgctgtacagagtgatcatgagccccagagtgtgcagcctgctggtggccgccgtgttcagcgtgggcttcaccgacgccgtgatccacggcggctgcatcctgagactgagcttctgcggcagcaacatcatcaagcactacttctgcgacatcgtgcccctgatcaagctgagctgcagcagcacctacatcgacgagctgctgatcttcgtgatcggcggcttcaacatggtggccaccagcctgaccatcatcatcagctacgccttcatcctgaccagcatcctgagaatccacagcaagaagggcagatgcaaggccttcagcacctgcagcagccacctgaccgccgtgctgatgttctacggcagcctgatgagcatgtacctgaagcccgccagcagcagcagcctgacccaggagaaggtgagcagcgtgttctacaccaccgtgatcctgatgctgaaccccctgatctacagcctgagaaacaacgaggtgagaaacgccctgatgaagctgctgagaagaaagatcagcctgagccccggctag

SEQ ID NO: 20657 - DNA, 936 bp, Artificial Sequence
  Description of Artificial Sequence: Synthetic coding sequence
atgggcagaagaaacaacaccaacgtgcccgacttcatcctgaccggcctgagcgacagcgaggaggtgcagatggccctgttcatcctgttcctgctgatctacctgatcaccatgctgggcaacgtgggcatgatcctgatcatcagactggacctgcagctgcacacccccatgtacttcttcctgacccacctgagcttcatcgacctgagctacagcaccgtgatcacccccaagaccctggccaacctgctgaccagcaactacatcagcttcatgggctgcttcgcccagatgttcttcttcgtgttcctgggcgccgccgagtgcttcctgctgagcagcatggcctacgacagatacgtggccatctgcagccccctgagataccccgtgatcatgagcaagagactgtgctgcgccctggtgaccggcccctacgtgatcagcttcatcaacagcttcgtgaacgtggtgtggatgagcagactgcacttctgcgacagcaacgtggtgagacacttcttctgcgacaccagccccatcctggccctgagctgcatggacacctacgacatcgagatcatgatccacatcctggccggcagcaccctgatggtgagcctgatcaccatcagcgccagctacgtgagcatcctgagcaccatcctgaagatcaacagcaccagcggcaagcagaaggccctgagcacctgcgccagccacctgctgggcgtgaccatcttctacggcaccatgatcttcacctacctgaagcccagaaagagctacagcctgggcagagaccaggtggccagcgtgttctacaccatcgtgatccccatgctgaaccccctgatctacagcctgagaaacaaggaggtgaagaacgccctgatcagagtgatgcagagaagacaggacagcagatag

SEQ ID NO: 20658 - DNA, 930 bp, Artificial Sequence
  Description of Artificial Sequence: Synthetic coding sequence
aacaacaccaacgtgcccgacttcatcctgaccggcctgagcgacagcgaggaggtgcagatggccctgttcatcctgttcctgctgatctacctgatcaccatgctgggcaacgtgggcatgatcctgatcatcagactggacctgcagctgcacacccccatgtacttcttcctgacccacctgagcttcatcgacctgagctacagcaccgtgatcacccccaagaccctggccaacctgctgaccagcaactacatcagcttcatgggctgcttcgcccagatgttcttcttcgtgttcctgggcgccgccgagtgcttcctgctgagcagcatggcctacgacagatacgtggccatctgcagccccctgagataccccgtgatcatgagcaagagactgtgctgcgccctggtgaccggcccctacgtgatcagcttcatcaacagcttcgtgaacgtggtgtggatgagcagactgcacttctgcgacagcaacgtggtgagacacttcttctgcgacaccagccccatcctggccctgagctgcatggacacctacgacatcgagatcatgatccacatcctggccggcagcaccctgatggtgagcctgatcaccatcagcgccagctacgtgagcatcctgagcaccatcctgaagatcaacagcaccagcggcaagcagaaggccctgagcacctgcgccagccacctgctgggcgtgaccatcttctacggcaccatgatcttcacctacctgaagcccagaaagagctacagcctgggcagagaccaggtggccagcgtgttctacaccatcgtgatccccatgctgaaccccctgatctacagcctgagaaacaaggaggtgaagaacgccctgatcagagtgatgcagagaatctggtacgtgctgggcctgtag

SEQ ID NO: 20659 - DNA, 939 bp, Artificial Sequence
  Description of Artificial Sequence: Synthetic coding sequence
atgatgggcagaagaaacaacaccaacgtggccgacttcatcctgatgggcctgaccctgagcgaggagatccagatggccctgttcatgctgttcctgctgatctacctgatcaccatgctgggcaacgtgggcatgatcctgatcatcagactggacctgcagctgcacacccccatgtacttcttcctgacccacctgagcttcatcgacctgagctacagcaccgtggtgacccccaagaccctggccaacctgctgaccagcaactacatcagcttcaccggctgcttcgcccagatgttcttcttcgccttcctgggcaccgccgagtgctacctgctgagcagcatggcccacgacagatacgccgccatctgcagccccctgcactacaccgtgatcatgagcaagagactgtgcctggccctgatcaccggcccctacgtgatcggcttcatcgacagcttcgtgaacgtggtgagcatgagcagactgcacttctacgacagcaacgtgatccaccacttcttctgcgacaccagccccatcctggccctgagctgcaccgacacctacaacaccgagatcctgatcttcatcatcgtgggcagcaccctgatggtgagcctgttcaccatcagcgccagctacgtgttcatcctgttcaccatcctgaagatcaacagcaccagcggcaagcagaaggccttcagcacctgcgtgagccacctgctgggcgtgaccatcttctacagcaccctgatcttcacctacctgaagcccagaaagagctacagcctgggcagagaccaggtggccagcgtgttctacaccatcgtgatccccgtgctgaaccccctgatctacagcctgagaaacaaggaggtgaagaacgccgtgatcagagtgatgcagagaagacaggacagcagatag

SEQ ID NO: 20660 - DNA, 939 bp, Artificial Sequence
  Description of Artificial Sequence: Synthetic coding sequence
atgatgggcagaagaaacgacaccaacgtggccgacttcatcctgaccggcctgagcgacagcgaggaggtgcagatggccctgttcatgctgttcctgctgatctacctgatcaccatgctgggcaacgtgggcatgctgctgatcatcagactggacctgcagctgcacacccccatgtacttcttcctgacccacctgagcttcatcgacctgagctacagcaccgtggtgacccccaagaccctggccaacctgctgaccagcaactacatcagcttcaccggctgcttcgcccagatgttctgcttcgtgttcctgggcaccgccgagtgctacctgctgagcagcatggcctacgacagatacgccgccatctgcagccccctgcactacaccgtgatcatgcccaagagactgtgcctggccctgatcaccggcccctacgtgatcggcttcatggacagcttcgtgaacgtggtgagcatgagcagactgcacttctgcgacagcaacatcatccaccacttcttctgcgacaccagccccatcctggccctgagctgcaccgacaccgacaacaccgagatgctgatcttcatcatcgccggcagcaccctgatggtgagcctgatcaccatcagcgccagctacgtgagcatcctgagcaccatcctgaagatcaacagcaccagcggcaagcagaaggccttcagcacctgcgtgagccacctgctgggcgtgaccatcttctacggcaccatgatcttcacctacctgaagcccagaaagagctacagcctgggcagagaccaggtggcccccgtgttctacaccatcgtgatccccatgctgaaccccctgatctacagcctgagaaacagagaggtgaagaacgccctgatcagagtgatgcagagaagacaggacagcagatag

SEQ ID NO: 20661 - DNA, 933 bp, Artificial Sequence
  Description of Artificial Sequence: Synthetic coding sequence
atggccggcaacaacttcaccgaggtgaccgtgttcatcctgagcggcttcgccaaccaccccgagctgcaggtgagcctgttcctgatgttcctgttcatctacctgttcaccgtgctgggcaacctgggcctgatcaccctgatcagaatggacagccagctgcacacccccatgtacttcttcctgagcaacctggccttcatcgacatcttctacagcagcaccgtgacccccaaggccctggtgaacttccagagcaacagaagaagcatcagcttcgtgggctgcttcgtgcagatgtacttcttcgtgggcctggtgtgctgcgagtgcttcctgctgggcagcatggcctacaacagatacatcgccatctgcaaccccctgctgtacagcgtggtgatgagccagaaggtgagcaactggctgggcgtgatgccctacgtgatcggcttcaccagcagcctgatcagcgtgtgggtgatcagcagcctggccttctgcgacagcagcatcaaccacttcttctgcgacaccaccgccctgctggccctgagctgcgtggacaccttcggcaccgagatggtgagcttcgtgctggccggcttcaccctgctgagcagcctgctgatcatcaccgtgacctacatcatcatcatcagcgccatcctgagaatccagagcgccgccggcagacagaaggccttcagcacctgcgccagccacctgatggccgtgaccatcttctacggcagcctgatcttcacctacctgcagcccgacaacaccagcagcctgacccaggcccaggtggccagcgtgttctacaccatcgtgatccccatgctgaaccccctgatctacagcctgagaaacaaggacgtgaagaacgccctgctgagagtgatccacagaaagctgttcccctag

SEQ ID NO: 20662 - DNA, 951 bp, Artificial Sequence
  Description of Artificial Sequence: Synthetic coding sequence
atggcccccgagaacttcaccagagtgaccgagttcatcctgaccggcgtgagcagctgccccgagctgcagatccccctgttcctggtgttcctggtgctgtacggcctgaccatggccggcaacctgggcatcatcaccctgaccagcgtggacagcagactgcagacccccatgtacttcttcctgcagcacctggccctgatcaacctgggcaacagcaccgtgatcgcccccaagatgctgatcaacttcctggtgaagaagaagaccaccagcttctacgagtgcgccacccagctgggcggcttcctgttcttcatcgtgagcgaggtgatcatgctggccctgatggcctacgacagatacgtggccatctgcaaccccctgctgtacatggtggtggtgagcagaagactgtgcctgctgctggtgagcctgacctacctgtacggcttcagcaccgccatcgtggtgagcagctacgtgttcagcgtgagctactgcagcagcaacatcatcaaccacttctactgcgacaacgtgcccctgctggccctgagctgcagcgacacctacctgcccgagaccgtggtgttcatcagcgccgccaccaacgtggtgggcagcctgatcatcgtgctggtgagctacttcaacatcgtgctgagcatcctgaagatctgcagcagcgagggcagaaagaaggccttcagcacctgcgccagccacatgatggccgtgaccatcttctacggcaccctgctgttcatgtacgtgcagcccagaagcaaccacagcctggacaccgacgacaagatggccagcgtgttctacaccctggtgatccccatgctgaaccccctgatctacagcctgagaaacaaggacgtgaagaccgccctgcagagattcatgaccaacctgtgctacagcttcaagaccatgtag

SEQ ID NO: 20663 - DNA, 948 bp, Artificial Sequence
  Description of Artificial Sequence: Synthetic coding sequence
atggcccccgagaacttcaccagagtgaccgagttcatcctgaccggcgtgagcagctgccccgagctgcagatccccctgttcctggtgttcctggtgctgtacgtgctgaccatggccggcaacctgggcatcatcaccctgaccagcgtggacagcagactgcagaaccccatgtacttcttcctgagacacctggccatcatcaacctgggcaacagcaccgtgatcgcccccaagatgctgatgaacttcctggtgaagaagaagaccaccagcttctacgagtgcgccacccagctgggcggcttcctgttcttcatcgtgagcgaggtgatgatgctggccgtgatggcctacgacagatacgtggccatctgcaaccccctgctgtacatggtggtggtgagcagaagactgtgcctgctgctggtgagcctgacctacctgtacggcttcagcaccgccatcgtggtgagcccctgcatcttcagcgtgagctactgcagcagcaacatcatcaaccacttctactgcgacatcgcccccctgctggccctgagctgcagcgacacctacatccccgagaccatcgtgttcatcagcgccgccaccaacctggtgttcagcatgatcaccgtgctggtgagctacttcaacatcgtgctgagcatcctgagaatcagaagccccgagggcagaaagaaggccttcagcacctgcgccagccacatgatcgccgtgaccgtgttctacggcaccatgctgttcatgtacctgcagccccagaccaaccacagcctggacaccgacaagatggccagcgtgttctacaccctggtgatccccatgctgaaccccctgatctacagcctgagaaacaacgacgtgaacgtggccctgaagaagttcatggagaacccctgctacagcttcaagagcatgtag

SEQ ID NO: 20664 - DNA, 960 bp, Artificial Sequence
  Description of Artificial Sequence: Synthetic coding sequence
atgaaccacgtggtgaagcacaaccacaccgccgtgaccaaggtgaccgagttcatcctgatgggcatcaccgacaaccccggcctgcaggcccccctgttcggcctgttcctgatcatctacctggtgaccgtgatcggcaacctgggcatggtgatcctgacctacctggacagcaagctgcacacccccatgtacttcttcctgagacacctgagcatcaccgacctgggctacagcaccgtgatcgcccccaagatgctggtgaacttcatcgtgcacaagaacaccatcagctacaactggtacgccacccagctggccttcttcgagatcttcatcatcagcgagctgttcatcctgagcgccatggcctacgacagatacgtggccatctgcaagcccctgctgtacgtgatcatcatggccgagaaggtgctgtgggtgctggtgatcgtgccctacctgtacagcaccttcgtgagcctgttcctgaccatcaagctgttcaagctgagcttctgcggcagcaacatcatcagctacttctactgcgactgcatccccctgatgagcatcctgtgcagcgacaccaacgagctggagctgatcatcctgatcttcagcggctgcaacctgctgttcagcctgagcatcgtgctgatcagctacatgttcatcctggtggccatcctgagaatgaacagcagaaagggcagatacaaggccttcagcacctgcagcagccacctgaccgtggtgatcatgttctacggcaccctgctgttcatctacctgcagcccaagagcagccacaccctggccatcgacaagatggccagcgtgttctacaccctgctgatccccatgctgaaccccctgatctacagcctgagaaacaaggaggtgaaggacgccctgaagagaaccctgaccaacagattcaagatccccatctag

SEQ ID NO: 20665 - DNA, 939 bp, Artificial Sequence
  Description of Artificial Sequence: Synthetic coding sequence
atggagcagcacaacctgaccaccgtgaacgagttcatcctgaccggcatcaccgacatcgccgagctgcaggcccccctgttcgccctgttcctgatgatctacgtgatcagcgtgatgggcaacctgggcatgatcgtgctgaccaagctggacagcagactgcagacccccatgtacttcttcctgagacacctggccttcatggacctgggctacagcaccaccgtgggccccaagatgctggtgaacttcgtggtggacaagaacatcatcagctactacttctgcgccacccagctggccttcttcctggtgttcatcggcagcgagctgttcatcctgagcgccatgagctacgacctgtacgtggccatctgcaaccccctgctgtacaccgtgatcatgagcagaagagtgtgccaggtgctggtggccatcccctacctgtactgcaccttcatcagcctgctggtgaccatcaagatcttcaccctgagcttctgcggctacaacgtgatcagccacttctactgcgacagcctgcccctgctgcccctgctgtgcagcaacacccacgagatcgagctgatcatcctgatcttcgccgccatcgacctgatcagcagcctgctgatcgtgctgctgagctacctgctgatcctggtggccatcctgagaatgaacagcgccggcagacagaaggccttcagcacctgcggcgcccacctgaccgtggtgatcgtgttctacggcaccctgctgttcatgtacgtgcagcccaagagcagccacagcttcgacaccgacaaggtggccagcatcttctacaccctggtgatccccatgctgaaccccctgatctacagcctgagaaacaaggacgtgaagtacgccctgagaagaacctggaacaacctgtgcaacatcttcgtgtag

SEQ ID NO: 20666 - DNA, 924 bp, Artificial Sequence
  Description of Artificial Sequence: Synthetic coding sequence
atgggccagcacaacctgaccgtgctgaccgagttcatcctgatggagctgaccagaagacccgagctgcagatccccctgttcggcgtgttcctggtgatctacctgatcaccgtggtgggcaacctgaccatgatcatcctgaccaagctggacagccacctgcacacccccatgtacttcagcatcagacacctggccttcgtggacctgggcaacagcaccgtgatctgccccaaggtgctggccaacttcgtggtggacagaaacaccatcagctactacgcctgcgccgcccagctggccttcttcctgatgttcatcatcagcgagttcttcatcctgagcgccatggcctacgacagatacgtggccatctgcaaccccctgctgtactacgtgatcatgagccagagactgtgccacgtgctggtgggcatccagtacctgtacagcaccttccaggccctgatgttcaccatcaagatcttcaccctgaccttctgcggcagcaacgtgatcagccacttctactgcgacgacgtgcccctgctgcccatgctgtgcagcaacgcccaggagatcgagctgctgagcatcctgttcagcgtgttcaacctgatcagcagcttcctgatcgtgctggtgagctacatgctgatcctgctggccatctgccagatgcacagcgccgagggcagaaagaaggccttcagcacctgcggcagccacctgaccgtggtggtggtgttctacggcagcctgctgttcatgtacatgcagcccaacagcacccacttcttcgacaccgacaagatggccagcgtgttctacaccctggtgatccccatgctgaaccccctgatctacagcctgagaaacgaggaggtgaagaacgccttctacaagctgttcgagaactag

SEQ ID NO: 20667 - DNA, 1080 bp, Artificial Sequence
  Description of Artificial Sequence: Synthetic coding sequence
atggccctgggcaaccacagcaccatcaccgagttcctgctgctgggcctgagcgccgaccccaacatcagagccctgctgttcgtgctgttcctgggcatctacctgctgaccatcatggagaacctgatgctgctgctgatgatcagagccgacagctgcctgcacaagcccatgtacttcttcctgagccacctgagcttcgtggacctgtgcttcagcagcgtgatcgtgcccaagatgctggagaacctgctgagccagagaaagaccatcagcgtggagggctgcctggcccaggtgttcttcgtgttcgtgaccgccggcaccgaggcctgcctgctgagcggcatggcctacgacagacacgccgccatctgcagacccctgctgtacggccagatcatgggcaagcagctgtacatgcacctggtgtggggcagctggggcctgggcttcctggacgccctgatcaacgtgctgctggccgtgaacatggtgttctgcgaggccaagatcatccaccactacagctacgagatgcccagcctgctgcccctgagctgcagcgacatcagcagaagcctgatcgccctgctgtgcagcaccctgctgcacggcctgggcaacttcctgctggtgttcctgagctacaccagaatcatcagcaccatcctgagcatcagcagcaccagcggcagaagcaaggccttcagcacctgcagcgcccacctgaccgccgtgaccctgtactacggcagcggcctgctgagacacctgatgcccaacagcggcagccccatcgagctgatcttcagcgtgcagtacaccgtggtgacccccatgctgaacagcctgatctacagcctgaagaacaaggaggtgaagggcgagagaagcctgagagacagcagccacctgccccagctgcacaagggccaggccagatggaagagacccgccttcaccgagggcagaagagagcccggccaccccgagctgagcatccccgtgaccccccagccccagggcgcctgcgcctgcagcgccctgagagccgcccccaccgccctgccctag

SEQ ID NO: 20668 - DNA, 930 bp, Artificial Sequence
  Description of Artificial Sequence: Synthetic coding sequence
atggcccacatcaactgcacccaggccaccgagttcatcctggtgggcctgaccgaccaccaggagctgaagatgcccctgttcgtgctgttcctgagcatctacctgttcaccgtggtgggcaacctgggcctgatcctgctgatcagagccgacaccagcctgaacacccccatgtacttcttcctgagcaacctggccttcgtggacttctgctacagcagcgtgatcacccccaagatgctgggcaacttcctgtacaagcagaacgtgatcagcttcgacgcctgcgccacccagctgggctgcttcctgaccttcatgatcagcgagagcctgctgctggccagcatggcctacgacagatacgtggccatctgcaaccccctgctgtacatggtggtgatgacccccggcatctgcatccagctggtggccgtgccctacagctacagcttcctgatggccctgttccacaccatcctgaccttcagactgagctactgccacagcaacatcgtgaaccacttctactgcgacgacatgcccctgctgagactgacctgcagcgacaccagattcaagcagctgtggatcttcgcctgcgccggcatcatgttcatcagcagcctgctgatcgtgttcgtgagctacatgttcatcatcagcgccatcctgagaatgcacagcgccgagggcagacagaaggccttcagcacctgcggcagccacatgctggccgtgaccatcttctacggcaccctgatcttcatgtacctgcagcccagcagcagccacgccctggacaccgacaagatggccagcgtgttctacaccgtgatcatccccatgctgaaccccctgatctacagcctgcagaacaaggaggtgaaggaggccctgaagaagatcatcatcaacaagaactag

SEQ ID NO: 20669 - DNA, 933 bp, Artificial Sequence
  Description of Artificial Sequence: Synthetic coding sequence
atgatggacaaccacagcagcgccaccgagttccacctgctgggcttccccggcagccagggcctgcaccacatcctgttcgccatcttcttcttcttctacctggtgaccctgatgggcaacaccgtgatcatcgtgatcgtgtgcgtggacaagagactgcagagccccatgtacttcttcctgagccacctgagcaccctggagatcctggtgaccaccatcatcgtgcccatgatgctgtggggcctgctgttcctgggctgcagacagtacctgagcctgcacgtgagcctgaacttcagctgcggcaccatggagttcgccctgctgggcgtgatggccgtggacagatacgtggccgtgtgcaaccccctgagatacaacatcatcatgaacagcagcacctgcatctgggtggtgatcgtgagctgggtgttcggcttcctgagcgagatctggcccatctacgccaccttccagttcaccttcagaaagagcaacagcctggaccacttctactgcgacagaggccagctgctgaagctgagctgcgacaacaccctgctgaccgagttcatcctgttcctgatggccgtgttcatcctgatcggcagcctgatccccaccatcgtgagctacacctacatcatcagcaccatcctgaagatccccagcgccagcggcagaagaaaggccttcagcaccttcgccagccacttcacctgcgtggtgatcggctacggcagctgcctgttcctgtacgtgaagcccaagcagacccagggcgtggagtacaacaagatcgtgagcctgctggtgagcgtgctgacccccttcctgaaccccttcatcttcaccctgagaaacgacaaggtgaaggaggccctgagagacggcatgaagagatgctgccagctgctgaaggactag

SEQ ID NO: 20670 - DNA, 945 bp, Artificial Sequence
  Description of Artificial Sequence: Synthetic coding sequence
atgctgatgaactacagcagcgccaccgagttctacctgctgggcttccccggcagcgaggagctgcaccacatcctgttcgccatcttcttcttcttctacctggtgaccctgatgggcaacaccgtgatcatcatgatcgtgtgcgtggacaagagactgcagagccccatgtacttcttcctgggccacctgagcgccctggagatcctggtgaccaccatcatcgtgcccgtgatgctgtggggcctgctgctgcccggcatgcagaccatctacctgagcgcctgcgtggtgcagctgttcctgtacctggccgtgggcaccaccgagttcgccctgctgggcgccatggccgtggacagatacgtggccgtgtgcaaccccctgagatacaacatcatcatgaacagacacacctgcaacttcgtggtgctggtgagctgggtgttcggcttcctgttccagatctggcccgtgtacgtgatgttccagctgacctactgcaagagcaacgtggtgaacaacttcttctgcgacagaggccagctgctgaagctgagctgcaacaacaccctgttcaccgagttcatcctgttcctgatggccgtgttcgtgctgttcggcagcctgatccccaccatcgtgagcaacgcctacatcatcagcaccatcctgaagatccccagcagcagcggcagaagaaagagcttcagcacctgcgccagccacttcacctgcgtggtgatcggctacggcagctgcctgttcctgtacgtgaagcccaagcagacccaggccgccgactacaactgggtggtgagcctgatggtgagcgtggtgacccccttcctgaaccccttcatcttcaccctgagaaacgacaaggtgatcgaggccctgagagacggcgtgaagagatgctgccagctgttcagaaactag

SEQ ID NO: 20671 - DNA, 918 bp, Artificial Sequence
  Description of Artificial Sequence: Synthetic coding sequence
atgcagagaagcaaccacaccgtgaccgagttcatcctgctgggcttcaccaccgaccccggcatgcagctgggcctgttcgtggtgttcctgggcgtgtacagcctgaccgtggtgggcaacagcaccctgatcgtgctgatctgcaacgacagctgcctgcacacccccatgtacttcttcaccggcaacctgagcttcctggacctgtggtacagcagcgtgtacacccccaagatcctggtgacctgcatcagcgaggacaagagcatcagcttcgccggctgcctgtgccagttcttcttcagcgccggcctggcctacagcgagtgctacctgctggccgccgtggcctacgacagatacgtggccatcagcaagcccctgctgtacgcccaggccatgagcatcaagctgtgcgccctgctggtggccgtgagctactgcggcggcttcatcaacagcagcatcatcaccaagaagaccttcagcttcaacttctgcagagagaacatcatcgacgacttcttctgcgacctgctgcccctggtggagctggcctgcggcgagaagggcggctacaagatcatgatgtacttcctgctggccagcaacgtgatctgccccgccgtgctgatcctggccagctacctgttcatcatcaccagcgtgctgagaatcagcagcagcaagggctacctgaaggccttcagcacctgcagcagccacctgaccagcgtgaccctgtactacggcagcatcctgtacatctacgccctgcccagaagcagctacagcttcgacatggacaagatcgtgagcaccttctacaccgtggtgttccccatgctgaacctgatgatctacagcctgagaaacaaggacgtgaaggaggccctgaagaagctgctgccctag

SEQ ID NO: 20672 - DNA, 984 bp, Artificial Sequence
  Description of Artificial Sequence: Synthetic coding sequence
atgatcttccccagccacgacagccaggccttcaccagcgtggacatggaggtgggcaactgcaccatcctgaccgagttcatcctgctgggcttcagcgccgacagccagtggcagcccatcctgttcggcgtgttcctgatgctgtacctgatcaccctgagcggcaacatgaccctggtgatcctgatcagaaccgacagccacctgcacacccccatgtacttcttcatcggcaacctgagcttcctggacttctggtacaccagcgtgtacacccccaagatcctggccagctgcgtgagcgaggacaagagaatcagcctggccggctgcggcgcccagctgttcttcagctgcgtggtggcctacaccgagtgctacctgctggccgccatggcctacgacagacacgccgccatctgcaaccccctgctgtacagcggcaccatgagcaccgccctgtgcaccggcctggtggccggcagctacatcggcggcttcctgaacgccatcgcccacaccgccaacaccttcagactgcacttctgcggcaagaacatcatcgaccacttcttctgcgacgccccccccctggtgaagatgagctgcaccaacaccagagtgtacgagaaggtgctgctgggcgtggtgggcttcaccgtgctgagcagcatcctggccatcctgatcagctacgtgaacatcctgctggccatcctgagaatccacagcgccagcggcagacacaaggccttcagcacctgcgccagccacctgatcagcgtgatgctgttctacggcagcctgctgttcatgtacagcagacccagcagcacctacagcctggagagagacaaggtggccgccctgttctacaccgtgatcaaccccctgctgaaccccctgatctacagcctgagaaacaaggacatcaaggaggccttcagaaaggccacccagaccatccagccccagacctag

SEQ ID NO: 20673 - DNA, 945 bp, Artificial Sequence
  Description of Artificial Sequence: Synthetic coding sequence
atggccaagaacaacctgaccagagtgaccgagttcatcctgatgggcttcatggaccaccccaagctggagatccccctgttcctggtgttcctgagcttctacctggtgaccctgctgggcaacgtgggcatgatcatgctgatccaggtggacgtgaagctgtacacccccatgtacttcttcctgagccacctgagcctgctggacgcctgctacaccagcgtgatcaccccccagatcctggccaccctggccaccggcaagaccgtgatcagctacggccactgcgccgcccagttcttcctgttcaccatctgcgccggcaccgagtgcttcctgctggccgtgatggcctacgacagatacgccgccatcagaaaccccctgctgtacaccgtggccatgaaccccagactgtgctggagcctggtggtgggcgcctacgtgtgcggcgtgagcggcgccatcctgagaaccacctgcaccttcaccctgagcttctgcaaggacaaccagatcaacttcttcttctgcgacctgccccccctgctgaagctggcctgcagcgacaccgccaacatcgagatcgtgatcatcttcttcggcaacttcgtgatcctggccaacgccagcgtgatcctgatcagctacctgctgatcatcaagaccatcctgaaggtgaagagcagcggcggcagagccaagaccttcagcacctgcgccagccacatcaccgccgtggccctgttcttcggcgccctgatcttcatgtacctgcagagcggcagcggcaagagcctggaggaggacaaggtggtgagcgtgttctacaccgtggtgatccccatgctgaaccccctgatctacagcctgagaaacaaggacgtgaaggacgccttcagaaaggtggccagaagactgcaggtgagcctgagcatgtag

SEQ ID NO: 20674 - DNA, 1008 bp, Artificial Sequence
  Description of Artificial Sequence: Synthetic coding sequence
atgctgggcagcaagcccagagtgcacctgtacatcctgccctgcgccagccagcaggtgagcaccatgggcgacagaggcaccagcaaccacagcgagatgaccgacttcatcctggccggcttcagagtgagacccgagctgcacatcctgctgttcctgctgttcctgttcgtgtacgccatgatcctgctgggcaacgtgggcatgatgaccatcatcatgaccgaccccagactgaacacccccatgtacttcttcctgggcaacctgagcttcatcgacctgttctacagcagcgtgatcgagcccaaggccatgatcaacttctggagcgagaacaagagcatcagcttcgccggctgcgtggcccagctgttcctgttcgccctgctgatcgtgaccgagggcttcctgctggccgccatggcctacgacagattcatcgccatctgcaaccccctgctgtacagcgtgcagatgagcaccagactgtgcacccagctggtggccggcagctacttctgcggctgcatcagcagcgtgatccagaccagcatgaccttcaccctgagcttctgcgccagcagagccgtggaccacttctactgcgacagcagacccctgcagagactgagctgcagcgacctgttcatccacagaatgatcagcttcagcctgagctgcatcatcatcctgcccaccatcatcgtgatcatcgtgagctacatgtacatcgtgagcaccgtgctgaagatccacagcaccgagggccacaagaaggccttcagcacctgcagcagccacctgggcgtggtgagcgtgctgtacggcgccgtgttcttcatgtacctgacccccgacagattccccgagctgagcaaggtggccagcctgtgctacagcctggtgacccccatgctgaaccccctgatctacagcctgagaaacaaggacgtgcaggaggccctgaagaagttcctggagaagaagaacatcatcctgtag

SEQ ID NO: 20675 - DNA, 933 bp, Artificial Sequence
  Description of Artificial Sequence: Synthetic coding sequence
atggccgagatgaacctgaccctggtgaccgagttcctgctgatcgccttcaccgagtaccccgagtgggccctgcccctgttcctgctgttcctgttcatgtacctgatcaccgtgctgggcaacctggagatgatcatcctgatcctgatggaccaccagctgcacgcccccatgtacttcctgctgagccacctggccttcatggacgtgtgctacagcagcatcaccgtgccccagatgctggccgtgctgctggagcacggcgccgccctgagctacaccagatgcgccgcccagttcttcctgttcaccttcttcggcagcatcgactgctacctgctggccctgatggcctacgacagatacctggccgtgtgccagcccctgctgtacgtgaccatcctgacccagcaggccagactgagcctggtggccggcgcctacgtggccggcctgatcagcgccctggtgagaaccgtgagcgccttcaccctgagcttctgcggcaccagcgagatcgacttcatcttctgcgacctgccccccctgctgaagctgacctgcggcgagagctacacccaggaggtgctgatcatcatgttcgccatcttcgtgatccccgccagcatggtggtgatcctggtgagctacctgttcatcatcgtggccatcatgggcatccccgccggcagccaggccaagaccttcagcacctgcaccagccacctgaccgccgtgagcctgttcttcggcaccctgatcttcatgtacctgagaggcaacagcgaccagagcagcgagaagaacagagtggtgagcgtgctgtacaccgaggtgatccccatgctgaaccccctgatctacagcctgagaaacaaggaggtgaaggaggccctgagaaagatcctgaacagagccaagctgagctag

SEQ ID NO: 20676 - DNA, 945 bp, Artificial Sequence
  Description of Artificial Sequence: Synthetic coding sequence
atggccgagagaaactacaccgtggtgaccgagttcttcctgaccgccttcaccgagcacctgcagtggagagtgcccctgttcctgatcttcctgagcttctacctggccaccatgctgggcaacaccggcatgatcctgctgatcagaggcgacagaagactgcacacccccatgtacttcttcctgagccacctgagcctggtggacatctgctacagcagcgccatcatcccccagatgctggccgtgctgtgggagcacggcaccaccatcagccaggccagatgcgccgcccagttcttcctgttcaccttcttcgccagcatcgactgctacctgctggccatcatggcctacgacagatacaccgccgtgtgccagcccctgctgtacgtgaccatcatcaccgagaaggccagatggggcctggtgaccggcgcctacgtggccggcttcttcagcgccttcgtgagaaccgtgaccgccttcaccctgagcttctgcggcaacaacgagatcaacttcatcttctgcgacctgccccccctgctgaagctgagctgcggcgacagctacacccaggaggtggtgatcatcgtgttcgccctgttcgtgatgcccgcctgcatcctggtgatcctggtgagctacctgttcatcatcgtggccatcctgcagatccacagcgccggcggcagagccaagaccttcagcacctgcgccagccacctgaccgccgtggccctgttcttcggcaccctgatcttcatgtacctgagagacaacaccggccagagcagcgagggcgacagagtggtgagcgtgctgtacaccgtggtgacccccatgctgaaccccctgatctacagcctgagaaacaaggaggtgaaggaggccaccagaaaggccctgagcaagagcaagcccgccagaagaccctag

SEQ ID NO: 20677 - DNA, 426 bp, Artificial Sequence
  Description of Artificial Sequence: Synthetic coding sequence
atgagcttcagcctgaacttcaccctgcccgccaacaccaccagcagccccgtgaccggcggcaaggagaccgactgcggccccagcctgggcctggccgccggcatccccctgctggtggccaccgccctgctggtggccctgctgttcaccctgatccacagaagaagaagcagcatcgaggccatggaggagagcgacagaccctgcgagatcagcgagatcgacgacaaccccaagatcagcgagaaccccagaagaagccccacccacgagaagaacaccatgggcgcccaggaggcccacatctacgtgaagaccgtggccggcagcgaggagcccgtgcacgacagatacagacccaccatcgagatggagagaagaagaggcctgtggtggctggtgcccagactgagcctggagtag

SEQ ID NO: 20678 - DNA, 393 bp, Artificial Sequence
  Description of Artificial Sequence: Synthetic coding sequence
atgagcttcagcctgaacttcaccctgcccgccaacaccgactgcggccccagcctgggcctggccgccggcatccccctgctggtggccaccgccctgctggtggccctgctgttcaccctgatccacagaagaagaagcagcatcgaggccatggaggagagcgacagaccctgcgagatcagcgagatcgacgacaaccccaagatcagcgagaaccccagaagaagccccacccacgagaagaacaccatgggcgcccaggaggcccacatctacgtgaagaccgtggccggcagcgaggagcccgtgcacgacagatacagacccaccatcgagatggagagaagaagaggcctgtggtggctggtgcccagactgagcctggagtag

SEQ ID NO: 20679 - DNA, 357 bp, Artificial Sequence
  Description of Artificial Sequence: Synthetic coding sequence
atggactgcggccccagcctgggcctggccgccggcatccccctgctggtggccaccgccctgctggtggccctgctgttcaccctgatccacagaagaagaagcagcatcgaggccatggaggagagcgacagaccctgcgagatcagcgagatcgacgacaaccccaagatcagcgagaaccccagaagaagccccacccacgagaagaacaccatgggcgcccaggaggcccacatctacgtgaagaccgtggccggcagcgaggagcccgtgcacgacagatacagacccaccatcgagatggagagaagaagaggcctgtggtggctggtgcccagactgagcctggagtag

SEQ ID NO: 20680 - DNA, 396 bp, Artificial Sequence
  Description of Artificial Sequence: Synthetic coding sequence
atgagaatgaccagcagccccgtgaccggcggcaaggagaccgactgcggccccagcctgggcctggccgccggcatccccctgctggtggccaccgccctgctggtggccctgctgttcaccctgatccacagaagaagaagcagcatcgaggccatggaggagagcgacagaccctgcgagatcagcgagatcgacgacaaccccaagatcagcgagaaccccagaagaagccccacccacgagaagaacaccatgggcgcccaggaggcccacatctacgtgaagaccgtggccggcagcgaggagcccgtgcacgacagatacagacccaccatcgagatggagagaagaagaggcctgtggtggctggtgcccagactgagcctggagtag

SEQ ID NO: 20681 - DNA, 396 bp, Artificial Sequence; identical to SEQ ID NO: 20680
  Description of Artificial Sequence: Synthetic coding sequence

SEQ ID NO: 20682 - DNA, 450 bp, Artificial Sequence
  Description of Artificial Sequence: Synthetic coding sequence
atggagaccctgtacagagtgcccttcctggtgctggagtgccccaacctgaagctgaagaagcccccctggctgcacatgcccagcgccatgaccgtgtacgccctggtggtggtgagctacttcctgatcaccggcggcatcatctacgacgtgatcgtggagccccccagcgtgggcagcatgaccgacgagcacggccaccagagacccgtggccttcctggcctacagagtgaacggccagtacatcatggagggcctggccagcagcttcctgttcaccatgggcggcctgggcttcatcatcctggacagaagcaacgcccccaacatccccaagctgaacagattcctgctgctgttcatcggcttcgtgtgcgtgctgctgagcttcttcatggccagagtgttcatgagaatgaagctgcccggctacctgatgggctag

SEQ ID NO: 20683 - DNA, 516 bp, Artificial Sequence
  Description of Artificial Sequence: Synthetic coding sequence
atggagaccctgtacagagtgcccttcctggtgctggagtgccccaacctgaagctgaagaagcccccctggctgcacatgcccagcgccatgaccgtgtacgccctggtggtggtgagctacttcctgatcaccggcggcatcatctacgacgtgatcgtggagccccccagcgtgggcagcatgaccgacgagcacggccaccagagacccgtggccttcctggcctacagagtgaacggccagtacatcatggagggcctggccagcagcttcctgttcaccatgggcggcctgggcttcatcatcctggacagaagcaacgcccccaacatccccaagctgaacagattcctgctgctgttcatcggcttcgtgtgcgtgctgctgagcttcttcatggccagagtgttcatgagaatgaagctgcccagaagcctggccctgctgcccagactggagtgcagcggcgtgatcagcgcccactacaagctgtgcctgcccggcgccatctag

SEQ ID NO: 20684 - DNA, 1461 bp, Artificial Sequence
  Description of Artificial Sequence: Synthetic coding sequence
atgagcttcatctgcggcctgcagagcgccgccagaaaccacgtgttcttcagattcaacagcctgagcaactggagaaagtgcaacaccctggccagcaccagcagaggctgccaccaggtgcaggtgaaccacatcgtgaacaagtaccagggcctgggcgtgaaccagtgcgacagatggagcttcctgcccggcaacttccacttctacagcaccttcaacaacaagagaaccggcggcctgagcagcaccaagagcaaggagatctggagaatcaccagcaagtgcaccgtgtggaacgacgccttcagcagacagctgctgatcaaggaggtgaccgccgtgcccagcctgagcgtgctgcaccccctgagccccgccagcatcagagccatcagaaacttccacaccagccccagattccaggccgcccccgtgcccctgctgctgatgatcctgaagcccgtgcagaagctgttcgccatcatcgtgggcagaggcatcagaaagtggtggcaggccctgccccccaacaagaaggaggtggtgaaggagaacatcagaaagaacaagtggaagctgttcctgggcctgagcagcttcggcctgctgttcgtggtgttctacttcacccacctggaggtgagccccatcaccggcagaagcaagctgctgctgctgggcaaggagcagttcagactgctgagcgagctggagtacgaggcctggatggaggagttcaagaacgacatgctgaccgagaaggacgccagatacctggccgtgaaggaggtgctgtgccacctgatcgagtgcaacaaggacgtgcccggcatcagccagatcaactgggtgatccacgtggtggacagccccatcatcaacgccttcgtgctgcccaacggccagatgttcgtgttcaccggcttcctgaacagcgtgaccgacatccaccagctgagcttcctgctgggccacgagatcgcccacgccgtgctgggccacgccgccgagaaggccggcatggtgcacctgctggacttcctgggcatgatcttcctgaccatgatctgggccatctgccccagagacagcctggccctgctgtgccagtggatccagagcaagctgcaggagtacatgttcaacagaccctacagcagaaagctggaggccgaggccgacaagatcggcctgctgctggccgccaaggcctgcgccgacatcagagccagcagcgtgttctggcagcagatggagttcgtggacagcctgcacggccagcccaagatgcccgagtggctgagcacccaccccagccacggcaacagagtggagtacctggacagactgatcccccagctggtgagagaggagaagttcatcgagcagcccgagcagatcgccgagctgaccctgaacagcttcatccagaacaccgagatctgcagaagctag

SEQ ID NO: 20685 - DNA, 1575 bp, Artificial Sequence
  Description of Artificial Sequence: Synthetic coding sequence
atgagcttcatctgcggcctgcagagcgccgccagaaaccacgtgttcttcagattcaacagcctgagcaactggagaaagtgcaacaccctggccagcaccagcagaggctgccaccaggtgcaggtgaaccacatcgtgaacaagtaccagggcctgggcgtgaaccagtgcgacagatggagcttcctgcccggcaacttccacttctacagcaccttcaacaacaagagaaccggcggcctgagcagcaccaagagcaaggagatctggagaatcaccagcaagtgcaccgtgtggaacgacgccttcagcagacagctgctgatcaaggaggtgaccgccgtgcccagcctgagcgtgctgcaccccctgagccccgccagcatcagagccatcagaaacttccacaccagccccagattccaggccgcccccgtgcccctgctgctgatgatcctgaagcccgtgcagaagctgttcgccatcatcgtgggcagaggcatcagaaagtggtggcaggccctgccccccaacaagaaggaggtggtgaaggagaacatcagaaagaacaagtggaagctgttcctgggcctgagcagcttcggcctgctgttcgtggtgttctacttcacccacctggaggtgagccccatcaccggcagaagcaagctgctgctgctgggcaaggagcagttcagactgctgagcgagctggagtacgaggcctggatggaggagttcaagaacgacatgctgaccgagaaggacgccagatacctggccgtgaaggaggtgctgtgccacctgatcgagtgcaacaaggacgtgcccggcatcagccagatcaactgggtgatccacgtggtggacagccccatcatcaacgccttcgtgctgcccaacggccagatgttcgtgttcaccggcttcctgaacagcgtgaccgacatccaccagctgagcttcctgctgggccacgagatcgcccacgccgtgctgggccacgccgccgagaaggccggcatggtgcacctgctggacttcctgggcatgatcttcctgaccatgatctgggccatctgccccagagacagcctggccctgctgtgccagtggatccagagcaagctgcaggagtacatgttcaacagaccctacagcagaaagctggaggccgaggccgacaagatcggcctgctgctggccgccaaggcctgcgccgacatcagagccagcagcgtgttctggcagcagatggagttcgtggacagcctgcacggccagcccaagatgcccgagtggctgagcacccaccccagccacggcaacagagtggagtacctggacagactgatcccccaggccctgaagatcagagagatgtgcaactgcccccccctgagcaaccccgaccccagactgctgttcaagctgagcaccaagcacttcctggaggagagcgagaaggaggacctgaacatcaccaagaagcagaagatggacaccctgcccatccagaagcaggagcagatccccctgacctacatcgtggagaagagaaccggcagctag

SEQ ID NO: 20686 - DNA, 768 bp, Artificial Sequence
  Description of Artificial Sequence: Synthetic coding sequence
atgagcttcatctgcggcctgcagagcgccgccagaaaccacgtgttcttcagattcaacagcctgagcaactggagaaagtgcaacaccctggccagcaccagcagaggctgccaccaggtgcaggtgaaccacatcgtgaacaagtaccagggcctgggcgtgaaccagtgcgacagatggagcttcctgcccggcaacttccacttctacagcaccttcaacaacaagagaaccggcggcctgagcagcaccaagagcaaggagatctggagaatcaccagcaagtgcaccgtgtggaacgacgccttcagcagacagctgctgatcaaggaggtgaccgccgtgcccagcctgagcgtgctgcaccccctgagccccgccagcatcagagccatcagaaacttccacaccagccccagattccaggccgcccccgtgcccctgctgctgatgatcctgaagcccgtgcagaagctgttcgccatcatcgtgggcagaggcatcagaaagtggtggcaggccctgccccccaacaagaaggaggtggtgaaggagaacatcagaaagaacaagtggaagctgttcctgggcctgagcagcttcggcctgctgttcgtggtgttctacttcacccacctggaggtgagccccatcaccggcagaagcaagctgctgctgctgggcaaggagcagttcagactgctgagcgagctggagtacgaggcctggatggaggagttcaagaacgacatgctgaccgagtag

SEQ ID NO: 20687 - DNA, 987 bp, Artificial Sequence
  Description of Artificial Sequence: Synthetic coding sequence
tgactgttcgccatcatcgtgggcagaggcatcagaaagtggtggcaggccctgccccccaacaagaaggaggtggtgaaggagaacatcagaaagaacaagtggaagctgttcctgggcctgagcagcttcggcctgctgttcgtggtgttctacttcacccacctggaggtgagccccatcaccggcagaagcaagctgctgctgctgggcaaggagcagttcagactgctgagcgagctggagtacgaggcctggatggaggagttcaagaacgacatgctgaccgagaaggacgccagatacctggccgtgaaggaggtgctgtgccacctgatcgagtgcaacaaggacgtgcccggcatcagccagatcaactgggtgatccacgtggtggacagccccatcatcaacgccttcgtgctgcccaacggccagatgttcgtgttcaccggcttcctgaacagcgtgaccgacatccaccagctgagcttcctgctgggccacgagatcgcccacgccgtgctgggccacgccgccgagaaggccggcatggtgcacctgctggacttcctgggcatgatcttcctgaccatgatctgggccatctgccccagagacagcctggccctgctgtgccagtggatccagagcaagctgcaggagtacatgttcaacagaccctacagcagaaagctggaggccgaggccgacaagatcggcctgctgctggccgccaaggcctgcgccgacatcagagccagcagcgtgttctggcagcagatggagttcgtggacagcctgcacggccagcccaagatgcccgagtggctgagcacccaccccagccacggcaacagagtggagtacctggacagactgatcccccagctggtgagagaggagaagttcatcgagcagcccgagcagatcgccgagctgaccctgaacagcttcatccagaacaccgagatctgcagaagctag

SEQ ID NO: 20688 - DNA, 762 bp, Artificial Sequence
  Description of Artificial Sequence: Synthetic coding sequence
atgagcttcatctgcggcctgcagagcgccgccagaaaccacgtgttcttcagattcaacagcctgagcaactggagaaagtgcaacaccctggccagcaccagcagaggctgccaccaggtgcaggtgaaccacatcgtgaacaagtaccagggcctgggcgtgaaccagtgcgacagatggagcttcctgcccggcaacttccacttctacagcaccttcaacaacaagagaaccggcggcctgagcagcaccaagagcaaggagatctggagaatcaccagcaagtgcaccgtgtggaacgacgccttcagcagacagctgctgatcaaggaggtgaccgccgtgcccagcctgagcgtgctgcaccccctgagccccgccagcatcagagccatcagaaacttccacaccagccccagattccaggccgcccccgtgcccctgctgctgatgatcctgaagcccgtgcagaagctgttcgccatcatcgtgggcagaggcatcagaaagtggtggcaggccctgccccccaacaagaaggaggtggtgaaggagaacatcagaaagaacaagtggaagctgttcctgggcctgagcagcttcggcctgctgttcgtggtgttctacttcacccacctggaggtgagccccatcaccggcagaagcaagctgctgctgctgggcaaggagcagttcagactgctgagcgagctggagtacgaggcctggatggaggagttcaagaacgacatgctgtag

SEQ ID NO: 20689 - DNA, 555 bp, Artificial Sequence
  Description of Artificial Sequence: Synthetic coding sequence
atgagcttcatctgcggcctgcagagcgccgccagaaaccacgtgttcttcagattcaacagcctgagcaactggagaaagtgcaacaccctggccagcaccagcagaggctgccaccaggtgcaggtgaaccacatcgtgaacaagtaccagggcctgggcgtgaaccagtgcgacagatggagcttcctgcccggcaacttccacttctacagcaccttcaacaacaagagaaccggcggcctgagcagcaccaagagcaaggagatctggagaatcaccagcaagtgcaccgtgtggaacgacgccttcagcagacagctgctgatcaaggaggtgaccgccgtgcccagcctgagcgtgctgcaccccctgagccccgccagcatcagagccatcagaaacttccacaccagccccagattccaggccgcccccgtgcccctgctgctgatgatcctgaagcccgtgcagaagctgttcgccatcatcgtgggcagaggcatcagaaagtggtggcaggccctgccccccaacaagaaggaggtggtgtag

SEQ ID NO: 20690 - DNA, 981 bp, Artificial Sequence
  Description of Artificial Sequence: Synthetic coding sequence
atgagcttcatctgcggcctgcagagcgccgccagaaaccacgtgttcttcagattcaacagcctgagcaactggagaaagtgcaacaccctggccagcaccagcagaggctgccaccaggtgcaggtgaaccacatcgtgaacaagtaccagggcctgggcgtgaaccagtgcgacagatggagcttcctgcccggcaacttccacttctacagcaccttcaacaacaagagaaccggcggcctgagcagcaccaagagcaaggagatctggagaatcaccagcaagtgcaccgtgtggaacgacgccttcagcagacagctgctgatcaaggaggtgaccgccgtgcccagcctgagcgtgctgcaccccctgagccccgccagcatcagagccatcagaaacttccacaccagccccagattccaggccgcccccgtgcccctgctgctgatgatcctgaagcccgtgcagaagctgttcgccatcatcgtgggcagaggcatcagaaagtggtggcaggccctgccccccaacaagaaggaggtggtgaaggagaacatcagaaagaacaagtggaagctgttcctgggcctgagcagcttcggcctgctgttcgtggtgttctacttcacccacctggaggtgagccccatcaccggcagaagcaagctgctgctgctgggcaaggagcagttcagactgctgagcgagctggagtacgaggcctggatggaggagttcaagaacgacatgctgaccgagaaggacgccagatacctggccgtgaaggaggtgctgtgccacctgatcgagtgcaacaaggacgtgcccggcatcagccagatcaactgggtgatccacgtggtggacagccccatcatcaacgccttcgtgctgcccaacggccagatgttcgtgttcaccggcttcctgaacagcgtgaccgacatccaccagctgagcttcctgctgggctag

SEQ ID NO: 20691 - DNA, 1086 bp, Artificial Sequence
  Description of Artificial Sequence: Synthetic coding sequence
atgagccccgagtgcgccagagccgccggcgacgcccccctgagaagcctggagcaggccaacagaaccagattccccttcttcagcgacgtgaagggcgaccacagactggtgctggccgccgtggagaccaccgtgctggtgctgatcttcgccgtgagcctgctgggcaacgtgtgcgccctggtgctggtggccagaagaagaagaagaggcgccaccgcctgcctggtgctgaacctgttctgcgccgacctgctgttcatcagcgccatccccctggtgctggccgtgagatggaccgaggcctggctgctgggccccgtggcctgccacctgctgttctacgtgatgaccctgagcggcagcgtgaccatcctgaccctggccgccgtgagcctggagagaatggtgtgcatcgtgcacctgcagagaggcgtgagaggccccggcagaagagccagagccgtgctgctggccctgatctggggctacagcgccgtggccgccctgcccctgtgcgtgttcttcagagtggtgccccagagactgcccggcgccgaccaggagatcagcatctgcaccctgatctggcccaccatccccggcgagatcagctgggacgtgagcttcgtgaccctgaacttcctggtgcccggcctggtgatcgtgatcagctacagcaagatcctgcagatcaccaaggccagcagaaagagactgaccgtgagcctggcctacagcgagagccaccagatcagagtgagccagcaggacttcagactgttcagaaccctgttcctgctgatggtgagcttcttcatcatgtggagccccatcatcatcaccatcctgctgatcctgatccagaacttcaagcaggacctggtgatctggcccagcctgttcttctgggtggtggccttcaccttcgccaacagcgccctgaaccccatcctgtacaacatgaccctgtgcagaaacgagtggaagaagatcttctgctgcttctggttccccgagaagggcgccatcctgaccgacaccagcgtgaagagaaacgacctgagcatcatcagcggctag

SEQ ID NO: 20692 - DNA, 1134 bp, Artificial Sequence
  Description of Artificial Sequence: Synthetic coding sequence
atgagccccgagtgcgccagagccgccggcgacgcccccctgagaagcctggagcaggccaacagaaccagattccccttcttcagcgacgtgaagggcgaccacagactggtgctggccgccgtggagaccaccgtgctggtgctgatcttcgccgtgagcctgctgggcaacgtgtgcgccctggtgctggtggccagaagaagaagaagaggcgccaccgcctgcctggtgctgaacctgttctgcgccgacctgctgttcatcagcgccatccccctggtgctggccgtgagatggaccgaggcctggctgctgggccccgtggcctgccacctgctgttctacgtgatgaccctgagcggcagcgtgaccatcctgaccctggccgccgtgagcctggagagaatggtgtgcatcgtgcacctgcagagaggcgtgagaggccccggcagaagagccagagccgtgctgctggccctgatctggggctacagcgccgtggccgccctgcccctgtgcgtgttcttcagagtggtgccccagagactgcccggcgccgaccaggagatcagcatctgcaccctgatctggcccaccatccccggcgagatcagctgggacgtgagcttcgtgaccctgaacttcctggtgcccggcctggtgatcgtgatcagctacagcaagatcctgcagaccagcgagcacctgctggacgccagagccgtggtgacccacagcgagatcaccaaggccagcagaaagagactgaccgtgagcctggcctacagcgagagccaccagatcagagtgagccagcaggacttcagactgttcagaaccctgttcctgctgatggtgagcttcttcatcatgtggagccccatcatcatcaccatcctgctgatcctgatccagaacttcaagcaggacctggtgatctggcccagcctgttcttctgggtggtggccttcaccttcgccaacagcgccctgaaccccatcctgtacaacatgaccctgtgcagaaacgagtggaagaagatcttctgctgcttctggttccccgagaagggcgccatcctgaccgacaccagcgtgaagagaaacgacctgagcatcatcagcggctag

SEQ ID NO: 20693 - DNA, 1113 bp, Artificial Sequence
  Description of Artificial Sequence: Synthetic coding sequence
atggagcccctgttccccgcccccttctgggaggtgatctacggcagccacctgcagggcaacctgagcctgctgagccccaaccacagcctgctgcccccccacctgctgctgaacgccagccacggcgccttcctgcccctgggcctgaaggtgaccatcgtgggcctgtacctggccgtgtgcgtgggcggcctgctgggcaactgcctggtgatgtacgtgatcctgagacacaccaagatgaagaccgccaccaacatctacatcttcaacctggccctggccgacaccctggtgctgctgaccctgcccttccagggcaccgacatcctgctgggcttctggcccttcggcaacgccctgtgcaagaccgtgatcgccatcgactactacaacatgttcaccagcaccttcaccctgaccgccatgagcgtggacagatacgtggccatctgccaccccatcagagccctggacgtgagaaccagcagcaaggcccaggccgtgaacgtggccatctgggccctggccagcgtggtgggcgtgcccgtggccatcatgggcagcgcccaggtggaggacgaggagatcgagtgcctggtggagatccccaccccccaggactactggggccccgtgttcgccatctgcatcttcctgttcagcttcatcgtgcccgtgctggtgatcagcgtgtgctacagcctgatgatcagaagactgagaggcgtgagactgctgagcggcagcagagagaaggacagaaacctgagaagaatcaccagactggtgctggtggtggtggccgtgttcgtgggctgctggacccccgtgcaggtgttcgtgctggcccagggcctgggcgtgcagcccagcagcgagaccgccgtggccatcctgagattctgcaccgccctgggctacgtgaacagctgcctgaaccccatcctgtacgccttcctggacgagaacttcaaggcctgcttcagaaagttctgctgcgccagcgccctgagaagagacgtgcaggtgagcgacagagtgagaagcatcgccaaggacgtggccctggcctgcaagaccagcgagaccgtgcccagacccgcctag

SEQ ID NO: 20694 - DNA, 1113 bp, Artificial Sequence; identical to SEQ ID NO: 20693
  Description of Artificial Sequence: Synthetic coding sequence

SEQ ID NO: 20695 - DNA, 1113 bp, Artificial Sequence; identical to SEQ ID NO: 20693
  Description of Artificial Sequence: Synthetic coding sequence

SEQ ID NO: 20696 - DNA, 495 bp, Artificial Sequence
  Description of Artificial Sequence: Synthetic coding sequence
atcaccggcctgtggagcctggccatcatcagctgggagagatggctggtggtgtgcaagcccttcggcaacgtgagattcgacgccaagctggccatcgtgggcatcgccttcagctggatctggagcgccgtgtggaccgccccccccatcttcggctggagcagatactggccccacggcctgaagaccagctgcggccccgacgtgttcagcggcagcagctaccccggcgtgcagagctacatgatcgtgctgatggtgacctgctgcatcatccccctggccatcatcatgctgtgctacctgcaggtgtggctggccatcagagccgtggccaagcagcagaaggagagcgagagcacccagaaggccgagaaggagttcagaaactgcatcctgcagctgttcggcaagaaggtggacgacggcagcgagctgagcagcgccagcaagaccgaggtgagcagcgtgagcagcgtgagccccgcctag

SEQ ID NO: 20697 - DNA, 1095 bp, Artificial Sequence
  Description of Artificial Sequence: Synthetic coding sequence
atggcccagcagtggagcctgcagagactggccggcagacacccccaggacagctacgaggacagcacccagagcagcatcttcacctacaccaacagcaacagcaccagaggccccttcgagggccccaactaccacatcgcccccagatgggtgtaccacctgaccagcgtgtggatgatcttcgtggtgatcgccagcgtgttcaccaacggcctggtgctggccgccaccatgaagttcaagaagctgagacaccccctgaactggatcctggtgaacctggccgtggccgacctggccgagaccgtgatcgccagcaccatcagcgtggtgaaccaggtgtacggctacttcgtgctgggccaccccatgtgcgtgctggagggctacaccgtgagcctgtgcggcatcaccggcctgtggagcctggccatcatcagctgggagagatggatggtggtgtgcaagcccttcggcaacgtgagattcgacgccaagctggccatcgtgggcatcgccttcagctggatctgggccgccgtgtggaccgccccccccatcttcggctggagcagatactggccccacggcctgaagaccagctgcggccccgacgtgttcagcggcagcagctaccccggcgtgcagagctacatgatcgtgctgatggtgacctgctgcatcacccccctgagcatcatcgtgctgtgctacctgcaggtgtggctggccatcagagccgtggccaagcagcagaaggagagcgagagcacccagaaggccgagaaggaggtgaccagaatggtggtggtgatggtgctggccttctgcttctgctggggcccctacgccttcttcgcctgcttcgccgccgccaaccccggctaccccttccaccccctgatggccgccctgcccgccttcttcgccaagagcgccaccatctacaaccccgtgatctacgtgttcatgaacagacagttcagaaactgcatcctgcagctgttcggcaagaaggtggacgacggcagcgagctgagcagcgccagcaagaccgaggtgagcagcgtgagcagcgtgagccccgcctag

SEQ ID NO: 20698 - DNA, 1437 bp, Artificial Sequence
  Description of Artificial Sequence: Synthetic coding sequence
atgaacccccccagcggccccagagtgccccccagccccacccaggagcccagctgcatggccacccccgccccccccagctggtgggacagcagccagagcagcatcagcagcctgggcagactgcccagcatcagccccaccgcccccggcacctgggccgccgcctgggtgcccctgcccaccgtggacgtgcccgaccacgcccactacaccctgggcaccgtgatcctgctggtgggcctgaccggcatgctgggcaacctgaccgtgatctacaccttctgcagaagcagaagcctgagaacccccgccaacatgttcatcatcaacctggccgtgagcgacttcctgatgagcttcacccaggcccccgtgttcttcaccagcagcctgtacaagcagtggctgttcggcgagaccggctgcgagttctacgccttctgcggcgccctgttcggcatcagcagcatgatcaccctgaccgccatcgccctggacagatacctggtgatcaccagacccctggccaccttcggcgtggccagcaagagaagagccgccttcgtgctgctgggcgtgtggctgtacgccctggcctggagcctgccccccttcttcggctggagcgcctacgtgcccgagggcctgctgaccagctgcagctgggactacatgagcttcacccccgccgtgagagcctacaccatgctgctgtgctgcttcgtgttcttcctgcccctgctgatcatcatctactgctacatcttcatcttcagagccatcagagagaccggcagagccctgcagaccttcggcgcctgcaagggcaacggcgagagcctgtggcagagacagagactgcagagcgagtgcaagatggccaagatcatgctgctggtgatcctgctgttcgtgctgagctgggccccctacagcgccgtggccctggtggccttcgccggctacgcccacgtgctgaccccctacatgagcagcgtgcccgccgtgatcgccaaggccagcgccatccacaaccccatcatctacgccatcacccaccccaagtacagagtggccatcgcccagcacctgccctgcctgggcgtgctgctgggcgtgagcagaagacacagcagaccctaccccagctacagaagcacccacagaagcaccctgaccagccacaccagcaacctgagctggatcagcatcagaagaagacaggagagcctgggcagcgagagcgaggtgggctggacccacatggaggccgccgccgtgtggggcgccgcccagcaggccaacggcagaagcctgtacggccagggcctggaggacctggaggccaaggccccccccagaccccagggccacgaggccgagacccccggcaagaccaagggcctgatccccagccaggaccccagaatgtag

SEQ ID NO: 20699 - DNA, 1470 bp, Artificial Sequence
  Description of Artificial Sequence: Synthetic coding sequence
atgaacccccccagcggccccagagtgccccccagccccacccaggagcccagctgcatggccacccccgccccccccagctggtgggacagcagccagagcagcatcagcagcctgggcagactgcccagcatcagccccaccgcccccggcacctgggccgccgcctgggtgcccctgcccaccgtggacgtgcccgaccacgcccactacaccctgggcaccgtgatcctgctggtgggcctgaccggcatgctgggcaacctgaccgtgatctacaccttctgcagagccgtgctgagaggcgtgaccgtgatgatgcagagcagaagcctgagaacccccgccaacatgttcatcatcaacctggccgtgagcgacttcctgatgagcttcacccaggcccccgtgttcttcaccagcagcctgtacaagcagtggctgttcggcgagaccggctgcgagttctacgccttctgcggcgccctgttcggcatcagcagcatgatcaccctgaccgccatcgccctggacagatacctggtgatcaccagacccctggccaccttcggcgtggccagcaagagaagagccgccttcgtgctgctgggcgtgtggctgtacgccctggcctggagcctgccccccttcttcggctggagcgcctacgtgcccgagggcctgctgaccagctgcagctgggactacatgagcttcacccccgccgtgagagcctacaccatgctgctgtgctgcttcgtgttcttcctgcccctgctgatcatcatctactgctacatcttcatcttcagagccatcagagagaccggcagagccctgcagaccttcggcgcctgcaagggcaacggcgagagcctgtggcagagacagagactgcagagcgagtgcaagatggccaagatcatgctgctggtgatcctgctgttcgtgctgagctgggccccctacagcgccgtggccctggtggccttcgccggctacgcccacgtgctgaccccctacatgagcagcgtgcccgccgtgatcgccaaggccagcgccatccacaaccccatcatctacgccatcacccaccccaagtacagagtggccatcgcccagcacctgccctgcctgggcgtgctgctgggcgtgagcagaagacacagcagaccctaccccagctacagaagcacccacagaagcaccctgaccagccacaccagcaacctgagctggatcagcatcagaagaagacaggagagcctgggcagcgagagcgaggtgggctggacccacatggaggccgccgccgtgtggggcgccgcccagcaggccaacggcagaagcctgtacggccagggcctggaggacctggaggccaaggccccccccagaccccagggccacgaggccgagacccccggcaagaccaagggcctgatccccagccaggaccccagaatgtag

SEQ ID NO: 20700 - DNA, 1488 bp, Artificial Sequence
  Description of Artificial Sequence: Synthetic coding sequence
atgaacccccccagcggccccagagtgccccccagccccacccaggagcccagctgcatggccacccccgccccccccagctggtgggacagcagccagagcagcatcagcagcctgggcagactgcccagcatcagccccaccgcccccggcacctgggccgccgcctgggtgcccctgcccaccgtggacgtgcccgaccacgcccactacaccctgggcaccgtgatcctgctggtgggcctgaccggcatgctgggcaacctgaccgtgatctacaccttctgcagagccgtgctgagaggcgtgaccgtgatgatgcagagcagaagcctgagaacccccgccaacatgttcatcatcaacctggccgtgagcgacttcctgatgagcttcacccaggcccccgtgttcttcaccagcagcctgtacaagcagtggctgttcggcgagaccggctgcgagttctacgccttctgcggcgccctgttcggcatcagcagcatgatcaccctgaccgccatcgccctggacagatacctggtgatcaccagacccctggccaccttcggcgtggccagcaagagaagagccgccttcgtgctgctgggcgtgtggctgtacgccctggcctggagcctgccccccttcttcggctggagcgcctacgtgcccgagggcctgctgaccagctgcagctgggactacatgagcttcacccccgccgtgagagcctacaccatgctgctgtgctgcttcgtgttcttcctgcccctgctgatcatcatctactgctacatcttcatcttcagagccatcagagagaccggcagagccctgcagaccttcggcgcctgcaagggcaacggcgagagcctgtggcagagacagagactgcagagcgagtgcaagatggccaagatcatgctgctggtgatcctgctgttcgtgctgagctgggccccctacagcgccgtggccctggtggccttcgccggctacgcccacgtgctgaccccctacatgagcagcgtgcccgccgtgatcgccaaggccagcgccatccacaaccccatcatctacgccatcacccaccccaagtacagagtggccatcgcccagcacctgccctgcctgggcgtgctgctgggcgtgagcagaagacacagcagaccctaccccagctacagaagcacccacagaagcaccctgaccagccacaccagcaacctgagctggatcagcatcagaagaagacaggagagcctgggcagcgagagcgaggtgggctggacccacatggaggccgccgccgtgtggggcgccgcccagcaggccaacggcagaagcctgtacggccagggcctggaggacctggaggccaaggccccccccagaccccagggccacgaggccgagacccccggcaagagaagagccagcagcggcagaagccagagacccgagagacagagagccgccccctag

SEQ ID NO: 20701 - DNA, 1065 bp, Artificial Sequence
  Description of Artificial Sequence: Synthetic coding sequence
atggccctgaaccacaccgccctgccccaggacgagagactgccccactacctgagagacggcgaccccttcgccagcaagctgagctgggaggccgacctggtggccggcttctacctgaccatcatcggcatcctgagcaccttcggcaacggctacgtgctgtacatgagcagcagaagaaagaagaagctgagacccgccgagatcatgaccatcaacctggccgtgtgcgacctgggcatcagcgtggtgggcaagcccttcaccatcatcagctgcttctgccacagatgggtgttcggctggatcggctgcagatggtacggctgggccggcttcttcttcggctgcggcagcctgatcaccatgaccgccgtgagcctggacagatacctgaagatctgctacctgagctacggcgtgtggctgaagagaaagcacgcctacatctgcctggccgccatctgggcctacgccagcttctggaccaccatgcccctggtgggcctgggcgactacgtgcccgagcccttcggcaccagctgcaccctggactggtggctggcccaggccagcgtgggcggccaggtgttcatcctgaacatcctgttcttctgcctgctgctgcccaccgccgtgatcgtgttcagctacgtgaagatcatcgccaaggtgaagagcagcagcaaggaggtggcccacttcgacagcagaatccacagcagccacgtgctggagatgaagctgaccaaggtggccatgctgatctgcgccggcttcctgatcgcctggatcccctacgccgtggtgagcgtgtggagcgccttcggcagacccgacagcatccccatccagctgagcgtggtgcccaccctgctggccaagagcgccgccatgtacaaccccatcatctaccaggtgatcgactacaagttcgcctgctgccagaccggcggcctgaaggccaccaagaagaagagcctggagggcttcagactgcacaccgtgaccaccgtgagaaagagcagcgccgtgctggagatccacgaggagtgggagtag

SEQ ID NO: 20702 - DNA, 1140 bp, Artificial Sequence
  Description of Artificial Sequence: Synthetic coding sequence
atgagcgtgagaaccctgcccctgctgttcctgaacctgggcggcgagatgctgtacatcctggaccagagactgagagcccagaacatccccggcgacaaggccagaaaggtgctgaacgacatcatcagcaccatgttcaacagaaagttcatggaggagctgttcaagccccaggagctgtacagcaagaaggccctgagaaccgtgtacgagagactggcccacgccagcatcatgaagctgaaccaggccagcatggacaagctgtacgacctgatgaccatggccttcaagtaccaggtgctgctgtgccccagacccaaggacgtgctgctggtgaccttcaaccacctggacaccatcaagggcttcatcagagacagccccaccatcctgcagcaggtggacgagaccctgagacagctgaccgagatctacggcggcctgagcgccggcgagttccagctgatcagacagaccctgctgatcttcttccaggacctgcacatcagagtgagcatgttcctgaaggacaaggtgcagaacaacaacggcagattcgtgctgcccgtgagcggccccgtgccctggggcaccgaggtgcccggcctgatcagaatgttcaacaacaagggcgaggaggtgaagagaatcgagttcaagcacggcggcaactacgtgcccgcccccaaggagggcagcttcgagctgtacggcgacagagtgctgaagctgggcaccaacatgtacagcgtgaaccagcccgtggagacccacgtgagcggcagcagcaagaacctggccagctggacccaggagagcatcgcccccaaccccctggccaaggaggagctgaacttcctggccagactgatgggcggcatggagatcaagaagcccagcggccccgagcccggcttcagactgaacctgttcaccaccgacgaggaggaggagcaggccgccctgaccagacccgaggagctgagctacgaggtgatcaacatccaggccacccaggaccagcagagaagcgaggagctggccagaatcatgggcgagttcgagatcaccgagcagcccagactgagcaccagcaagggcgacgacctgctggccatgatggacgagctgtag

SEQ ID NO: 20703 - DNA, 1020 bp, Artificial Sequence
  Description of Artificial Sequence: Synthetic coding sequence
atgagcgtgagaaccctgcccctgctgttcctgaacctgggcggcgagatgctgtacatcctggaccagagactgagagcccagaacatccccggcgacaaggccagaaaggacgagtggaccgaggtggacagaaagagagtgctgaacgacatcatcagcaccatgttcaacagaaagttcatggaggagctgttcaagccccaggagctgtacagcaagaaggccctgagaaccgtgtacgagagactggcccacgccagcatcatgaagctgaaccaggccagcatggacaagctgtacgacctgatgaccatggccttcaagtaccaggtgctgctgtgccccagacccaaggacgtgctgctggtgaccttcaaccacctggacaccatcaagggcttcatcagagacagccccaccatcctgcagcaggtggacgagaccctgagacagctgaccgagatctacggcggcctgagcgccggcgagttccagctgatcagacagaccctgctgatcttcttccaggacctgcacatcagagtgagcatgttcctgaaggacaaggtgcagaacaacaacggcagattcgtgctgcccgtgagcggccccgtgccctggggcaccgaggtgcccggcctgatcagaatgttcaacaacaagggcgaggaggtgaagagaatcgagttcaagcacggcggcaactacgtgcccgcccccaaggagggcagcttcgagctgtacggcgacagagtgctgaagctgggcaccaacatgtacagcgtgaaccagcccgtggagacccacgtgagcggcagcagcaagaacctggccagctggacccaggagagcatcgcccccaaccccctggccaaggaggagctgaacttcctggccagactgatgggcggcatggagatcaagaagcccagcggccccgagcccggcttcagactgaacctgttcaccaccgacgaggagggcgacgacctgctggccatgatggacgagctgtag

SEQ ID NO: 20704 - DNA, 672 bp, Artificial Sequence
  Description of Artificial Sequence: Synthetic coding sequence
atgagcgtgagaaccctgcccctgctgttcctgaacctgggcggcgagatgctgtacatcctggaccagagactgagagcccagaacatccccggcgacaaggccagaaaggtgctgaacgacatcatcagcaccatgttcaacagaaagttcatggaggagctgttcaagccccaggagctgtacagcaagaaggccctgagaaccgtgtacgagagactggcccacgccagcatcatgaagctgaaccaggccagcatggacaagctgtacgacctgatgaccatggccttcaagtaccaggtgctgctgtgccccagacccaaggacgtgctgctggtgaccttcaaccacctggacaccatcaagggcttcatcagagacagccccaccatcctgcagcaggtggacgagaccctgagacagctgaccgagatctacggcggcctgagcgccggcgagttccagctgatcagacagaccctgctgatcttcttccaggacctgcacatcagaagagagtgcttctggaagcacatgcaggagaccgtgcacagcgcccagtgctgcctgcccggcgtgggcaactacatggaggacagaagaagaagactgaccttccactacgtgtaccccttcgagaacttcgagttctgcacctgggccaagtag

SEQ ID NO: 20705 - DNA, 1170 bp, Artificial Sequence
  Description of Artificial Sequence: Synthetic coding sequence
atgagcgtgagaaccctgcccctgctgttcctgaacctgggcggcgagatgctgtacatcctggaccagagactgagagcccagaacatccccggcgacaaggccagaaaggacgagtggaccgaggtggacagaaagagagtgctgaacgacatcatcagcaccatgttcaacagaaagttcatggaggagctgttcaagccccaggagctgtacagcaagaaggccctgagaaccgtgtacgagagactggcccacgccagcatcatgaagctgaaccaggccagcatggacaagctgtacgacctgatgaccatggccttcaagtaccaggtgctgctgtgccccagacccaaggacgtgctgctggtgaccttcaaccacctggacaccatcaagggcttcatcagagacagccccaccatcctgcagcaggtggacgagaccctgagacagctgaccgagatctacggcggcctgagcgccggcgagttccagctgatcagacagaccctgctgatcttcttccaggacctgcacatcagagtgagcatgttcctgaaggacaaggtgcagaacaacaacggcagattcgtgctgcccgtgagcggccccgtgccctggggcaccgaggtgcccggcctgatcagaatgttcaacaacaagggcgaggaggtgaagagaatcgagttcaagcacggcggcaactacgtgcccgcccccaaggagggcagcttcgagctgtacggcgacagagtgctgaagctgggcaccaacatgtacagcgtgaaccagcccgtggagacccacgtgagcggcagcagcaagaacctggccagctggacccaggagagcatcgcccccaaccccctggccaaggaggagctgaacttcctggccagactgatgggcggcatggagatcaagaagcccagcggccccgagcccggcttcagactgaacctgttcaccaccgacgaggaggaggagcaggccgccctgaccagacccgaggagctgagctacgaggtgatcaacatccaggccacccaggaccagcagagaagcgaggagctggccagaatcatgggcgagttcgagatcaccgagcagcccagactgagcaccagcaagggcgacgacctgctggccatgatggacgagctgtag

SEQ ID NO: 20706 - DNA, 1023 bp, Artificial Sequence
  Description of Artificial Sequence: Synthetic coding sequence
atggagcccggcagaacccagatcaagctggaccccagatacaccgccgacctgctggaggtgctgaagaccaactacggcatccccagcgcctgcttcagccagccccccaccgccgcccagctgctgagagccctgggccccgtggagctggccctgaccagcatcctgaccctgctggccctgggcagcatcgccatcttcctggaggacgccgtgtacctgtacaagaacaccctgtgccccatcaagagaagaaccctgctgtggaagagcagcgcccccaccgtggtgagcgtgctgtgctgcttcggcctgtggatccccagaagcctggtgctggtggagatgaccatcaccagcttctacgccgtgtgcttctacctgctgatgctggtgatggtggagggcttcggcggcaaggaggccgtgctgagaaccctgagagacacccccatgatggtgcacaccggcccctgctgctgctgctgcccctgctgccccagactgctgctgaccagaaagaagctgcagctgctgatgctgggccccttccagtacgccttcctgaagatcaccctgaccctggtgggcctgttcctggtgcccgacggcatctacgaccccgccgacatcagcgagggcagcaccgccctgtggatcaacaccttcctgggcgtgagcaccctgctggccctgtggaccctgggcatcatcagcagacaggccagactgcacctgggcgagcagaacatgggcgccaagttcgccctgttccaggtgctgctgatcctgaccgccctgcagcccagcatcttcagcgtgctggccaacggcggccagatcgcctgcagccccccctacagcagcaagaccagaagccaggtgatgaactgccacctgctgatcctggagaccttcctgatgaccgtgctgaccagaatgtactacagaagaaaggaccacaaggtgggctacgagaccttcagcagccccgacctggacctgaacctgaaggcctag

SEQ ID NO: 20707 - DNA, 387 bp, Artificial Sequence
  Description of Artificial Sequence: Synthetic coding sequence
atggagcacagcgagggcgcccccggcgaccccgccggcaccgtggtgccccaggagctgctggaggagatgctgtggttcttcagagtggaggacgccagcccctggaaccacagcatcctggccctggccgccgtggtggtgatcatcagcatggtgctgctgggcagaagcatccaggccagcagaaaggagaagatgcagccccccgagaaggagacccccgaggtgctgcacctggacgaggccaaggaccacaacagcctgaacaacctgagagagaccctgctgagcgagaagcccaacctggcccaggtggagctggagctgaaggagagagacgtgctgagcgtgttcctgcccgacgtgcccgagaccgagagctag

SEQ ID NO: 20708 - DNA, 1245 bp, Artificial Sequence
  Description of Artificial Sequence: Synthetic coding sequence
atgctgatcctgaccaagaccgccggcgtgttcttcaagcccagcaagagaaaggtgtacgagttcctgagaagcttcaacttccaccccggcaccctgttcctgcacaagatcgtgctgggcatcgagaccagctgcgacgacaccgccgccgccgtggtggacgagaccggcaacgtgctgggcgaggccatccacagccagaccgaggtgcacctgaagaccggcggcatcgtgccccccgccgcccagcagctgcacagagagaacatccagagaatcgtgcaggaggccctgagcgccagcggcgtgagccccagcgacctgagcgccatcgccaccaccatcaagcccggcctggccctgagcctgggcgtgggcctgagcttcagcctgcagctggtgggccagctgaagaagcccttcatccccatccaccacatggaggcccacgccctgaccatcagactgaccaacaaggtggagttccccttcctggtgctgctgatcagcggcggccactgcctgctggccctggtgcagggcgtgagcgacttcctgctgctgggcaagagcctggacatcgcccccggcgacatgctggacaaggtggccagaagactgagcctgatcaagcaccccgagtgcagcaccatgagcggcggcaaggccatcgagcacctggccaagcagggcaacagattccacttcgacatcaagccccccctgcaccacgccaagaactgcgacttcagcttcaccggcctgcagcacgtgaccgacaagatcatcatgaagaaggagaaggaggagggcatcgagaagggccagatcctgagcagcgccgccgacatcgccgccaccgtgcagcacaccatggcctgccacctggtgaagagaacccacagagccatcctgttctgcaagcagagagacctgctgccccagaacaacgccgtgctggtggccagcggcggcgtggccagcaacttctacatcagaagagccctggagatcctgaccaacgccacccagtgcaccctgctgtgccccccccccagactgtgcaccgacaacggcatcatgatcgcctggaacggcatcgagagactgagagccggcctgggcatcctgcacgacatcgagggcatcagatacgagcccaagtgccccctgggcgtggacatcagcaaggaggtgggcgaggccagcatcaaggtgccccagctgaagatggagatctag

SEQ ID NO: 20709 - DNA, 669 bp, Artificial Sequence
  Description of Artificial Sequence: Synthetic coding sequence
atgctgatcctgaccaagaccgccggcgtgttcttcaagcccagcaagagaaaggtgtacgagttcctgagaagcttcaacttccaccccggcaccctgttcctgcacaagatcgtgctgggcatcgagaccagctgcgacgacaccgccgccgccgtggtggacgagaccggcaacgtgctgggcgaggccatccacagccagaccgaggtgcacctgaagaccggcggcatcgtgccccccgccgcccagcagctgcacagagagaacatccagagaatcgtgcaggaggccctgagcgccagcggcgtgagccccagcgacctgagcgccatcgccaccaccatcaagcccggcctggccctgagcctgggcgtgggcctgagcttcagcctgcagctggtgggccagctgaagaagcccttcatccccatccaccacatggaggcccacgccctgaccatcagactgaccaacaaggtggagttccccttcctggtgctgctgatcagcggcggccactgcctgctggccctggtgcagggcgtgagcgacttcctgctgctgggcaagagcctggacatcgcccccggcgacatgctggacaaggtggccagaagactgagcctgatcaagcaccccgagtgcagcaccatgagcggcggctag

SEQ ID NO: 20710 - DNA, 612 bp, Artificial Sequence
  Description of Artificial Sequence: Synthetic coding sequence
atgctgatcctgaccaagaccgccggcgtgttcttcaagcccagcaagagaaaggtgtacgagttcctgagaagcttcaacttccaccccggcaccctgttcctgcacaagatcgtgctgggcatcgagaccagctgcgacgacaccgccgccgccgtggtggacgagaccggcaacgtgctgggcgaggccatccacagccagaccgaggtgcacctgaagaccggcggcatcgtgccccccgccgcccagcagctgcacagagagaacatccagagaatcgtgcaggaggccctgagcgccagcggcgtgagccccagcgacctgagcgccatcgccaccaccatcaagcccggcctggccctgagcctgggcgtgggcctgagcttcagcctgcagctggtgggccagctgaagaagcccttcatccccatccaccacatggaggcccacgccctgaccatcagactgaccaacaaggtggagttccccttcctggtgctgctgatcagcggcggccactgcctgctggccctggtgcagggcgtgagcgacttcctgctgctgggcaagagcctggacatcgcccccggcgacatgctggacaagtag

SEQ ID NO: 20711 - DNA, 1245 bp, Artificial Sequence; identical to SEQ ID NO: 20708
  Description of Artificial Sequence: Synthetic coding sequence

SEQ ID NO: 20712 - DNA, 1689 bp, Artificial Sequence
  Description of Artificial Sequence: Synthetic coding sequence
atgagcgaggagctggcccagggccccaaggagagcccccccgcccccagagccggccccagagaggtgtggaagaagggcggcagactgctgagcgtgctgctggccgtgaacgtgctgctgctggcctgcaccctgatcagcggcggcgccttcaacaaggtggccgtgtacgacaccgacgtgttcgccctgctgaccgccatgatgctgctggccaccctgtggatcctgttctacctgctgagaaccgtgagatgcccctgcgccgtgccctacagagacgcccacgccggccccatctggctgagaggcggcctggtgctgttcggcatctgcaccctgatcatggacgtgttcaagaccggctactacagcagcttcttcgagtgccagagcgccatcaagatcctgcaccccctgatccaggccgtgttcgtgatcatccagacctacttcctgtgggtgagcgccaaggactgcgtgcacgtgcacctggacctgacctggtgcggcctgatgttcaccctgaccaccaacctggccatctggatggccgccgtggtggacgagagcgtgcaccagagccacagctacagcagcagccacagcaacgccagccacgccagactgatcagcgaccagcacgccgacaaccccgtgggcggcgacagctgcctgtgcagcaccgccgtgtgccagatcttccagcagggctacttctacctgtaccccttcaacatcgagtacagcctgttcgccagcaccatgctgtacgtgatgtggaagaacgtgggcagattcctggccagcacccccggccacagccacacccccacccccgtgagcctgttcagagagaccttcttcgccggccccgtgctgggcctgctgctgttcgtggtgggcctggccgtgttcatcatctacgaggtgcaggtgagcggcgacggcagcagaaccagacaggccctggtgatctactacagcttcaacatcgtgtgcctgggcctgaccaccctggtgagcctgagcggcagcatcatctacagattcgacagaagagccatggaccaccacaagaaccccaccagaaccctggacgtggccctgctgatgggcgccgccctgggccagtacgccatcagctactacagcatcgtggccgtggtggccggcaccccccaggacctgctggccggcctgaacctgacccacgccctgctgatgatcgcccagcacaccttccagaacatgttcatcatcgagagcctgcacagaggcccccccggcgccgagccccacagcacccaccccaaggagccctgccaggacctgaccttcaccaacctggacgccctgcacaccctgagcgcctgcccccccaaccccggcctggtgagccccagccccagcgaccagagagaggccgtggccatcgtgagcacccccagaagccagtggagaagacagtgcctgaaggacatcagcctgttcctgctgctgtgcaacgtgatcctgtggatcatgcccgccttcggcgccagaccccacttcagcaacaccgtggaggtggacttctacggctacagcctgtgggccgtgatcgtgaacatctgcctgcccttcggcatcttctacagaatgcacgccgtgagcagcctgctggaggtgtacgtgctgagctag

SEQ ID NO: 20713 - DNA, 1791 bp, Artificial Sequence
  Description of Artificial Sequence: Synthetic coding sequence
atgggcagaggcgccagagccgccgccgcccagagcagatggggcagagccagcagagccagcgtgagccccggcagaaccatcagaagcgcccccgccgtgggcgaggcccaggagaccgaggccgcccccgagaaggagaacagagtggacgtgggcgccgaggagagagccgccgccaccagacccagacagaagagctggctggtgagacacttcagcctgctgctgagaagagacagacaggcccagaaggccggccagctgttcagcggcctgctggccctgaacgtggtgttcctgggcggcgccttcatctgcagcatgatcttcaacaaggtggccgtgaccctgggcgacgtgtggatcctgctggccaccctgaaggtgctgagcctgctgtggctgctgtactacgtggccagcaccaccagaagaccccacgccgtgctgtaccaggacccccacgccggccccctgtgggtgagaggcagcctggtgctgttcggcagctgcaccttctgcctgaacatcttcagagtgggctacgacgtgagccacatcagatgcaagagccagctggacctggtgttcagcgtgatcgagatggtgttcatcggcgtgcagacctgggtgctgtggaagcactgcaaggactgcgtgagagtgcagaccaacttcaccagatgcggcctgatgctgaccctggccaccaacctgctgctgtgggtgctggccgtgaccaacgacagcatgcacagagagatcgaggccgagctgggcatcctgatggagaagagcaccggcaacgagaccaacacctgcctgtgcctgaacgccaccgcctgcgaggccttcagaagaggcttcctgatgctgtaccccttcagcaccgagtactgcctgatctgctgcgccgtgctgttcgtgatgtggaagaacgtgggcagacacgtggccccccacatgggcgcccaccccgccaccgcccccttccacctgcacggcgccatcttcggccccctgctgggcctgctggtgctgctggccggcgtgtgcgtgttcgtgctgttccagatcgaggccagcggccccgccatcgcctgccagtacttcaccctgtactacgccttctacgtggccgtgctgcccaccatgagcctggcctgcctggccggcaccgccatccacggcctggaggagagagagctggacaccgtgaagaaccccaccagaagcctggacgtggtgctgctgatgggcgccgccctgggccagatgggcatcgcctacttcagcatcgtggccatcgtggccaagagaccccacgagctgctgaacagactgatcctggcctacagcctgctgctgatcctgcagcacatcgcccagaacctgttcatcatcgagggcctgcacagaagacccctgtgggagaccgtgcccgagggcctggccggcaagcaggaggccgagccccccagaagaggcagcctgctggagctgggccagggcctgcagagagccagcctggcctacatccacagctacagccacctgaactggaagagaagagccctgaaggagatcagcctgttcctgatcctgtgcaacatcaccctgtggatgatgcccgccttcggcatccaccccgagttcgagaacggcctggagaaggacttctacggctaccagatctggttcgccatcgtgaacttcggcctgcccctgggcgtgttctacagaatgcacagcgtgggcggcctggtggaggtgtacctgggcgcctag

SEQ ID NO: 20714 - DNA, 939 bp, Artificial Sequence
  Description of Artificial Sequence: Synthetic coding sequence
atggcctgcgccgccgtgatgatccccggcctgctgagatgcagcgtgggcgccatcagaatcgaggccgccagcctgagactgaccctgagcaccctgagacacctgaccctgaccagcatcatgaagagcaagagaaagaccgaccacatggagagaaccgccagcgtgctgagaagagagatcgtgagcgccgccaaggtgtgcggcgccgccagcgagagccccagcgtgaagagcctgagactgctggtggccgaccaggacttcagcttcaaggccggccagtgggtggacttcttcatccccggcgtgagcgtggtgggcggcttcagcatctgcagcagccccagactgctggagcaggagagagtgatcgagctggccgtgaagtacaccaaccacccccccgccctgtgggtgcacaacacctgcaccctggactgcgaggtggccgtgagagtgggcggcgagttcttcttcgacccccagcccgccgacgccagcagaaacctggtgctgatcgccggcggcgtgggcatcaaccccctgctgagcatcctgagacacgccgccgacctgctgagagagcaggccaacaagagaaacggctacgagatcggcaccatcaagctgttctacagcgccaagaacaccagcgagctgctgttcaagaagaacatcctggacctggtgaacgagttccccgagaagatcgcctgcagcctgcacgtgaccaagcagaccacccagatcaacgccgagctgaagccctacatcaccgagggcagaatcaccgagaaggagatcagagaccacatcagcaaggagaccctgttctacatctgcggccccccccccatgaccgacttcttcagcaagcagctggagaacaaccacgtgcccaaggagcacatctgcttcgagaagtggtggtag

SEQ ID NO: 20715 - DNA, 486 bp, Artificial Sequence
  Description of Artificial Sequence: Synthetic coding sequence
atggcctgcgccgccgtgatgatccccggcctgctgagatgcagcgtgggcgccatcagaatcgaggccgccagcctgagactgaccctgagcaccctgagacacctgaccctgaccagcatcatgaagagcaagagaaagaccgaccacatggagagaaccgccagcgtgctgagaagagagatcgtgagcgccgccaaggtgtgcggcgccgccagcgagagccccagcgtgaagagcctgagactgctggtggccgaccaggacttcagcttcaaggccggccagtgggtggacttcttcatccccggcgtgagcgtggtgggcggcttcagcatctgcagcagccccagactgctggagcaggagagagtgatcgagctggccgtgaagtacaccaaccacccccccgccctgtgggtgcacaacacctgcaccctggactgcgaggtggccgtgagagtgggcggcgagttcttcttctag

SEQ ID NO: 20716 - DNA, 993 bp, Artificial Sequence
  Description of Artificial Sequence: Synthetic coding sequence
atgacccccaagatcagctggaccagcaagttcagcgtgtgccccgagagcgccatggcctgcgccgccgtgatgatccccggcctgctgagatgcagcgtgggcgccatcagaatcgaggccgccagcctgagactgaccctgagcaccctgagacacctgaccctgaccagcatcatgaagagcaagagaaagaccgaccacatggagagaaccgccagcgtgctgagaagagagatcgtgagcgccgccaaggtgtgcggcgccgccagcgagagccccagcgtgaagagcctgagactgctggtggccgaccaggacttcagcttcaaggccggccagtgggtggacttcttcatccccggcgtgagcgtggtgggcggcttcagcatctgcagcagccccagactgctggagcaggagagagtgatcgagctggccgtgaagtacaccaaccacccccccgccctgtgggtgcacaacacctgcaccctggactgcgaggtggccgtgagagtgggcggcgagttcttcttcgacccccagcccgccgacgccagcagaaacctggtgctgatcgccggcggcgtgggcatcaaccccctgctgagcatcctgagacacgccgccgacctgctgagagagcaggccaacaagagaaacggctacgagatcggcaccatcaagctgttctacagcgccaagaacaccagcgagctgctgttcaagaagaacatcctggacctggtgaacgagttccccgagaagatcgcctgcagcctgcacgtgaccaagcagaccacccagatcaacgccgagctgaagccctacatcaccgagggcagaatcaccgagaaggagatcagagaccacatcagcaaggagaccctgttctacatctgcggccccccccccatgaccgacttcttcagcaagcagctggagaacaaccacgtgcccaaggagcacatctgcttcgagaagtggtggtag

SEQ ID NO: 20717 - DNA, 1272 bp, Artificial Sequence
  Description of Artificial Sequence: Synthetic coding sequence
atgctgtgccacagaggcggccagctgatcgtgcccatcatccccctgtgccccgagcacagctgcagaggcagaagactgcagaacctgctgagcggcccctggcccaagcagcccatggagctgcacaacctgagcagccccagccccagcctgagcagcagcgtgctgccccccagcttcagccccagccccagcagcgcccccagcgccttcaccaccgtgggcggcagcagcggcggcccctgccaccccaccagcagcagcctggtgagcgccttcctggcccccatcctggccctggagttcgtgctgggcctggtgggcaacagcctggccctgttcatcttctgcatccacaccagaccctggaccagcaacaccgtgttcctggtgagcctggtggccgccgacttcctgctgatcagcaacctgcccctgagagtggactactacctgctgcacgagacctggagattcggcgccgccgcctgcaaggtgaacctgttcatgctgagcaccaacagaaccgccagcgtggtgttcctgaccgccatcgccctgaacagatacctgaaggtggtgcagccccaccacgtgctgagcagagccagcgtgggcgccgccgccagagtggccggcggcctgtgggtgggcatcctgctgctgaacggccacctgctgctgagcaccttcagcggccccagctgcctgagctacagagtgggcaccaagcccagcgccagcctgagatggcaccaggccctgtacctgctggagttcttcctgcccctggccctgatcctgttcgccatcgtgagcatcggcctgaccatcagaaacagaggcctgggcggccaggccggcccccagagagccatgagagtgctggccatggtggtggccgtgtacaccatctgcttcctgcccagcatcatcttcggcatggccagcatggtggccttctggctgagcgcctgcagaagcctggacctgtgcacccagctgttccacggcagcctggccttcacctacctgaacagcgtgctggaccccgtgctgtactgcttcagcagccccaacttcctgcaccagagcagagccctgctgggcctgaccagaggcagacagggccccgtgagcgacgagagcagctaccagcccagcagacagtggagatacagagaggccagcagaaaggccgaggccatcggcaagctgaaggtgcagggcgaggtgagcctggagaaggagggcagcagccagggctag

SEQ ID NO: 20718 - DNA, 1014 bp, Artificial Sequence
  Description of Artificial Sequence: Synthetic coding sequence
atgaacgagcccctggactacctggccaacgccagcgacttccccgactacgccgccgccttcggcaactgcaccgacgagaacatccccctgaagatgcactacctgcccgtgatctacggcatcatcttcctggtgggcttccccggcaacgccgtggtgatcagcacctacatcttcaagatgagaccctggaagagcagcaccatcatcatgctgaacctggcctgcaccgacctgctgtacctgaccagcctgcccttcctgatccactactacgccagcggcgagaactggatcttcggcgacttcatgtgcaagttcatcagattcagcttccacttcaacctgtacagcagcatcctgttcctgacctgcttcagcatcttcagatactgcgtgatcatccaccccatgagctgcttcagcatccacaagaccagatgcgccgtggtggcctgcgccgtggtgtggatcatcagcctggtggccgtgatccccatgaccttcctgatcaccagcaccaacagaaccaacagaagcgcctgcctggacctgaccagcagcgacgagctgaacaccatcaagtggtacaacctgatcctgaccgccaccaccttctgcctgcccctggtgatcgtgaccctgtgctacaccaccatcatccacaccctgacccacggcctgcagaccgacagctgcctgaagcagaaggccagaagactgaccatcctgctgctgctggccttctacgtgtgcttcctgcccttccacatcctgagagtgatcagaatcgagagcagactgctgagcatcagctgcagcatcgagaaccagatccacgaggcctacatcgtgagcagacccctggccgccctgaacaccttcggcaacctgctgctgtacgtggtggtgagcgacaacttccagcaggccgtgtgcagcaccgtgagatgcaaggtgagcggcaacctggagcaggccaagaagatcagctacagcaacaacccctag

SEQ ID NO: 20719 - DNA, 189 bp, Artificial Sequence
  Description of Artificial Sequence: Synthetic coding sequence
atgaacgagcccctggactacctggccaacgccagcgacttccccgactacgccgccgccttcggcaactgcaccgacgagaacatccccctgaagatgcactacctgcccgtgatctacggcatcatcttcctggtgggcttccccggcaacgccgtggtgatcagcacctacatcttcaagatgtag

SEQ ID NO: 20720 - DNA, 210 bp, Artificial Sequence
  Description of Artificial Sequence: Synthetic coding sequence
atgaacgagcccctggactacctggccaacgccagcgacttccccgactacgccgccgccttcggcaactgcaccgacgagaacatccccctgaagatgcactacctgcccgtgatctacggcatcatcttcctggtgggcttccccggcaacgccgtggtgatcagcacctacatcttcaagatgagaccctggaagagcagcacctag

SEQ ID NO: 20721 - DNA, 1014 bp, Artificial Sequence; identical to SEQ ID NO: 20718
  Description of Artificial Sequence: Synthetic coding sequence

SEQ ID NO: 20722 - DNA, 3033 bp, Artificial Sequence
  Description of Artificial Sequence: Synthetic coding sequence
atgagccagctgagactgctgcccagcagactgggcgtgcaggccgccagactgctggccgcccacgacgtgcccgtgttcggctggagaagcagaagcagcggcccccccgccaccttccccagcagcaagggcggcggcggcagcagctacatggaggagatgtacttcgcctggctggagaacccccagagcgtgcacaagagctgggacagcttcttcagagaggccagcgaggaggccttcagcggcagcgcccagcccagaccccccagcgtggtgcacgagagcagaagcgccgtgagcagcagaaccaagaccagcaagctggtggaggaccacctggccgtgcagagcctgatcagagcctaccagatcagaggccaccacgtggcccagctggaccccctgggcatcctggacgccgacctggacagcttcgtgcccagcgacctgatcaccaccatcgacaagctggccttctacgacctgcaggaggccgacctggacaaggagttccagctgcccaccaccaccttcatcggcggcagcgagaacaccctgagcctgagagagatcatcagaagactggagaacacctactgccagcacatcggcctggagttcatgttcatcaacgacgtggagcagtgccagtggatcagacagaagttcgagacccccggcgtgatgcagttcagcagcgaggagaagagaaccctgctggccagactggtgagaagcatgagattcgaggacttcctggccagaaagtggagcagcgagaagagattcggcctggagggctgcgaggtgatgatccccgccctgaagaccatcatcgacaagagcagcgagatgggcatcgagaacgtgatcctgggcatgccccacagaggcagactgaacgtgctggccaacgtgatcagaaaggacctggagcagatcttctgccagttcgaccccaagctggaggccgccgacgagggcagcggcgacgtgaagtaccacctgggcatgtaccacgagagaatcaacagagtgaccaacagaaacatcaccctgagcctggtggccaaccccagccacctggaggccgtggaccccgtggtgcagggcaagaccaaggccgagcagttctacagaggcgacgcccagggcaagaaggtgatgagcatcctggtgcacggcgacgccgccttcgccggccagggcgtggtgtacgagaccttccacctgagcgacctgcccagctacaccaccaacggcaccgtgcacgtggtggtgaacaaccagatcggcttcaccaccgaccccagaatggccagaagcagcccctaccccaccgacgtggccagagtggtgaacgcccccatcttccacgtgaacgccgacgaccccgaggccgtgatctacgtgtgcagcgtggccgccgagtggagaaacaccttcaacaaggacgtggtggtggacctggtgtgctacagaagaagaggccacaacgagatggacgagcccatgttcacccagcccctgatgtacaagcagatccacagacaggtgcccgtgctgaagaagtacgccgacaagctgatcgccgagggcaccgtgaccctgcaggagttcgaggaggagatcgccaagtacgacagaatctgcgaggaggcctacggcagaagcaaggacaagaagatcctgcacatcaagcactggctggacagcccctggcccggcttcttcaacgtggacggcgagcccaagagcatgacctgccccgccaccggcatccccgaggacatgctgacccacatcggcagcgtggccagcagcgtgcccctggaggacttcaagatccacaccggcctgagcagaatcctgagaggcagagccgacatgaccaagaacagaaccgtggactgggccctggccgagtacatggccttcggcagcctgctgaaggagggcatccacgtgagactgagcggccaggacgtggagagaggcaccttcagccacagacaccacgtgctgcacgaccaggaggtggacagaagaacctgcgtgcccatgaaccacctgtggcccgaccaggccccctacaccgtgtgcaacagcagcctgagcgagtacggcgtgctgggcttcgagctgggctacgccatggccagccccaacgccctggtgctgtgggaggcccagttcggcgacttccacaacaccgcccagtgcatcatcgaccagttcatcagcaccggccaggccaagtgggtgagacacaacggcatcgtgctgctgctgccccacggcatggagggcatgggccccgagcacagcagcgccagacccgagagattcctgcagatgagcaacgacgacagcgacgcctaccccgccttcaccaaggacttcgaggtgagccagctgtacgactgcaactggatcgtggtgaactgcagcacccccgccaactacttccacgtgctgagaagacagatcctgctgcccttcagaaagcccctgatcatcttcacccccaagagcctgctgagacaccccgaggccaagagcagcttcgaccagatggtgagcggcaccagcttccagagagtgatccccgaggacggcgccgccgccagagcccccgagcaggtgcagagactgatcttctgcaccggcaaggtgtactacgacctggtgaaggagagaagcagccaggacctggaggagaaggtggccatcaccagactggagcagatcagccccttccccttcgacctgatcaagcaggaggccgagaagtaccccggcgccgagctggcctggtgccaggaggagcacaagaacatgggctactacgactacatcagccccagattcatgaccatcctgagaagagccagacccatctggtacgtgggcagagaccccgccgccgcccccgccaccggcaacagaaacacccacctggtgagcctgaagaagttcctggacaccgccttcaacctgcaggccttcgagggcaagaccttctag

SEQ ID NO: 20723 - DNA, 2862 bp, Artificial Sequence
  Description of Artificial Sequence: Synthetic coding sequence
atgagccagctgagactgctgcccagcagactgggcgtgcaggccgccagactgctggccgcccacgacgtgcccgtgttcggctggagaagcagaagcagcggcccccccgccaccttccccagcagcaagggcggcggcggcagcagctacatggaggagatgtacttcgcctggctggagaacccccagagcgtgcacaagatcagaggccaccacgtggcccagctggaccccctgggcatcctggacgccgacctggacagcttcgtgcccagcgacctgatcaccaccatcgacaagctggccttctacgacctgcaggaggccgacctggacaaggagttccagctgcccaccaccaccttcatcggcggcagcgagaacaccctgagcctgagagagatcatcagaagactggagaacacctactgccagcacatcggcctggagttcatgttcatcaacgacgtggagcagtgccagtggatcagacagaagttcgagacccccggcgtgatgcagttcagcagcgaggagaagagaaccctgctggccagactggtgagaagcatgagattcgaggacttcctggccagaaagtggagcagcgagaagagattcggcctggagggctgcgaggtgatgatccccgccctgaagaccatcatcgacaagagcagcgagatgggcatcgagaacgtgatcctgggcatgccccacagaggcagactgaacgtgctggccaacgtgatcagaaaggacctggagcagatcttctgccagttcgaccccaagctggaggccgccgacgagggcagcggcgacgtgaagtaccacctgggcatgtaccacgagagaatcaacagagtgaccaacagaaacatcaccctgagcctggtggccaaccccagccacctggaggccgtggaccccgtggtgcagggcaagaccaaggccgagcagttctacagaggcgacgcccagggcaagaaggtgatgagcatcctggtgcacggcgacgccgccttcgccggccagggcgtggtgtacgagaccttccacctgagcgacctgcccagctacaccaccaacggcaccgtgcacgtggtggtgaacaaccagatcggcttcaccaccgaccccagaatggccagaagcagcccctaccccaccgacgtggccagagtggtgaacgcccccatcttccacgtgaacgccgacgaccccgaggccgtgatctacgtgtgcagcgtggccgccgagtggagaaacaccttcaacaaggacgtggtggtggacctggtgtgctacagaagaagaggccacaacgagatggacgagcccatgttcacccagcccctgatgtacaagcagatccacagacaggtgcccgtgctgaagaagtacgccgacaagctgatcgccgagggcaccgtgaccctgcaggagttcgaggaggagatcgccaagtacgacagaatctgcgaggaggcctacggcagaagcaaggacaagaagatcctgcacatcaagcactggctggacagcccctggcccggcttcttcaacgtggacggcgagcccaagagcatgacctgccccgccaccggcatccccgaggacatgctgacccacatcggcagcgtggccagcagcgtgcccctggaggacttcaagatccacaccggcctgagcagaatcctgagaggcagagccgacatgaccaagaacagaaccgtggactgggccctggccgagtacatggccttcggcagcctgctgaaggagggcatccacgtgagactgagcggccaggacgtggagagaggcaccttcagccacagacaccacgtgctgcacgaccaggaggtggacagaagaacctgcgtgcccatgaaccacctgtggcccgaccaggccccctacaccgtgtgcaacagcagcctgagcgagtacggcgtgctgggcttcgagctgggctacgccatggccagccccaacgccctggtgctgtgggaggcccagttcggcgacttccacaacaccgcccagtgcatcatcgaccagttcatcagcaccggccaggccaagtgggtgagacacaacggcatcgtgctgctgctgccccacggcatggagggcatgggccccgagcacagcagcgccagacccgagagattcctgcagatgagcaacgacgacagcgacgcctaccccgccttcaccaaggacttcgaggtgagccagctgtacgactgcaactggatcgtggtgaactgcagcacccccgccaactacttccacgtgctgagaagacagatcctgctgcccttcagaaagcccctgatcatcttcacccccaagagcctgctgagacaccccgaggccaagagcagcttcgaccagatggtgagcggcaccagcttccagagagtgatccccgaggacggcgccgccgccagagcccccgagcaggtgcagagactgatcttctgcaccggcaaggtgtactacgacctggtgaaggagagaagcagccaggacctggaggagaaggtggccatcaccagactggagcagatcagccccttccccttcgacctgatcaagcaggaggccgagaagtaccccggcgccgagctggcctggtgccaggaggagcacaagaacatgggctactacgactacatcagccccagattcatgaccatcctgagaagagccagacccatctggtacgtgggcagagaccccgccgccgcccccgccaccggcaacagaaacacccacctggtgagcctgaagaagttcctggacaccgccttcaacctgcaggccttcgagggcaagaccttctag

SEQ ID NO: 20724 - DNA, 2406 bp, Artificial Sequence
  Description of Artificial Sequence: Synthetic coding sequence
atgttcatcaacgacgtggagcagtgccagtggatcagacagaagttcgagacccccggcgtgatgcagttcagcagcgaggagaagagaaccctgctggccagactggtgagaagcatgagattcgaggacttcctggccagaaagtggagcagcgagaagagattcggcctggagggctgcgaggtgatgatccccgccctgaagaccatcatcgacaagagcagcgagatgggcatcgagaacgtgatcctgggcatgccccacagaggcagactgaacgtgctggccaacgtgatcagaaaggacctggagcagatcttctgccagttcgaccccaagctggaggccgccgacgagggcagcggcgacgtgaagtaccacctgggcatgtaccacgagagaatcaacagagtgaccaacagaaacatcaccctgagcctggtggccaaccccagccacctggaggccgtggaccccgtggtgcagggcaagaccaaggccgagcagttctacagaggcgacgcccagggcaagaaggtgatgagcatcctggtgcacggcgacgccgccttcgccggccagggcgtggtgtacgagaccttccacctgagcgacctgcccagctacaccaccaacggcaccgtgcacgtggtggtgaacaaccagatcggcttcaccaccgaccccagaatggccagaagcagcccctaccccaccgacgtggccagagtggtgaacgcccccatcttccacgtgaacgccgacgaccccgaggccgtgatctacgtgtgcagcgtggccgccgagtggagaaacaccttcaacaaggacgtggtggtggacctggtgtgctacagaagaagaggccacaacgagatggacgagcccatgttcacccagcccctgatgtacaagcagatccacagacaggtgcccgtgctgaagaagtacgccgacaagctgatcgccgagggcaccgtgaccctgcaggagttcgaggaggagatcgccaagtacgacagaatctgcgaggaggcctacggcagaagcaaggacaagaagatcctgcacatcaagcactggctggacagcccctggcccggcttcttcaacgtggacggcgagcccaagagcatgacctgccccgccaccggcatccccgaggacatgctgacccacatcggcagcgtggccagcagcgtgcccctggaggacttcaagatccacaccggcctgagcagaatcctgagaggcagagccgacatgaccaagaacagaaccgtggactgggccctggccgagtacatggccttcggcagcctgctgaaggagggcatccacgtgagactgagcggccaggacgtggagagaggcaccttcagccacagacaccacgtgctgcacgaccaggaggtggacagaagaacctgcgtgcccatgaaccacctgtggcccgaccaggccccctacaccgtgtgcaacagcagcctgagcgagtacggcgtgctgggcttcgagctgggctacgccatggccagccccaacgccctggtgctgtgggaggcccagttcggcgacttccacaacaccgcccagtgcatcatcgaccagttcatcagcaccggccaggccaagtgggtgagacacaacggcatcgtgctgctgctgccccacggcatggagggcatgggccccgagcacagcagcgccagacccgagagattcctgcagatgagcaacgacgacagcgacgcctaccccgccttcaccaaggacttcgaggtgagccagctgtacgactgcaactggatcgtggtgaactgcagcacccccgccaactacttccacgtgctgagaagacagatcctgctgcccttcagaaagcccctgatcatcttcacccccaagagcctgctgagacaccccgaggccaagagcagcttcgaccagatggtgagcggcaccagcttccagagagtgatccccgaggacggcgccgccgccagagcccccgagcaggtgcagagactgatcttctgcaccggcaaggtgtactacgacctggtgaaggagagaagcagccaggacctggaggagaaggtggccatcaccagactggagcagatcagccccttccccttcgacctgatcaagcaggaggccgagaagtaccccggcgccgagctggcctggtgccaggaggagcacaagaacatgggctactacgactacatcagccccagattcatgaccatcctgagaagagccagacccatctggtacgtgggcagagaccccgccgccgcccccgccaccggcaacagaaacacccacctggtgagcctgaagaagttcctggacaccgccttcaacctgcaggccttcgagggcaagaccttctag

SEQ ID NO: 20725 - DNA, 2160 bp, Artificial Sequence
  Description of Artificial Sequence: Synthetic coding sequence
atgttcggcaagaagaagaagaagatcgagatcagcggccccagcaacttcgagcacagagtgcacaccggcttcgacccccaggagcagaagttcaccggcctgccccagcagtggcacagcctgctggccgacaccgccaacagacccaagcccatggtggaccccagctgcatcacccccatccagctggcccccatgaagaccatcgtgagaggcaacaagccctgcaaggagaccagcatcaacggcctgctggaggacttcgacaacatcagcgtgaccagaagcaacagcctgagaaaggagagcccccccacccccgaccagggcgccagcagccacggccccggccacgccgaggagaacggcttcatcaccttcagccagtacagcagcgagagcgacaccaccgccgactacaccaccgagaagtacagagagaagagcctgtacggcgacgacctggacccctactacagaggcagccacgccgccaagcagaacggccacgtgatgaagatgaagcacggcgaggcctactacagcgaggtgaagcccctgaagagcgacttcgccagattcagcgccgactaccacagccacctggacagcctgagcaagcccagcgagtacagcgacctgaagtgggagtaccagagagccagcagcagcagccccctggactacagcttccagttcacccccagcagaaccgccggcaccagcggctgcagcaaggagagcctggcctacagcgagagcgagtggggccccagcctggacgactacgacagaagacccaagagcagctacctgaaccagaccagcccccagcccaccatgagacagagaagcagaagcggcagcggcctgcaggagcccatgatgcccttcggcgccagcgccttcaagacccacccccagggccacagctacaacagctacacctaccccagactgagcgagcccaccatgtgcatccccaaggtggactacgacagagcccagatggtgctgagcccccccctgagcggcagcgacacctaccccagaggccccgccaagctgccccagagccagagcaagagcggctacagcagcagcagccaccagtaccccagcggctaccacaaggccaccctgtaccaccaccccagcctgcagagcagcagccagtacatcagcaccgccagctacctgagcagcctgagcctgagcagcagcacctaccccccccccagctggggcagcagcagcgaccagcagcccagcagagtgagccacgagcagttcagagccgccctgcagctggtggtgagccccggcgaccccagagagtacctggccaacttcatcaagatcggcgagggcagcaccggcatcgtgtgcatcgccaccgagaagcacaccggcaagcaggtggccgtgaagaagatggacctgagaaagcagcagagaagagagctgctgttcaacgaggtggtgatcatgagagactaccaccacgacaacgtggtggacatgtacagcagctacctggtgggcgacgagctgtgggtggtgatggagttcctggagggcggcgccctgaccgacatcgtgacccacaccagaatgaacgaggagcagatcgccaccgtgtgcctgagcgtgctgagagccctgagctacctgcacaaccagggcgtgatccacagagacatcaagagcgacagcatcctgctgaccagcgacggcagaatcaagctgagcgacttcggcttctgcgcccaggtgagcaaggaggtgcccaagagaaagagcctggtgggcaccccctactggatggcccccgaggtgatcagcagactgccctacggcaccgaggtggacatctggagcctgggcatcatggtgatcgagatgatcgacggcgagcccccctacttcaacgagccccccctgcaggccatgagaagaatcagagacagcctgccccccagagtgaaggacctgcacaaggtgagcagcgtgctgagaggcttcctggacctgatgctggtgagagagcccagccagagagccaccgcccaggagctgctgggccaccccttcctgaagctggccggcccccccagctgcatcgtgcccctgatgagacagtacagacaccactag

SEQ ID NO: 20726 - DNA, 2160 bp, Artificial Sequence; identical to SEQ ID NO: 20725
  Description of Artificial Sequence: Synthetic coding sequence

SEQ ID NO: 20727 - DNA, 2160 bp, Artificial Sequence; identical to SEQ ID NO: 20725
  Description of Artificial Sequence: Synthetic coding sequence

SEQ ID NO: 20728 - DNA, 1743 bp, Artificial Sequence
  Description of Artificial Sequence: Synthetic coding sequence
atggtggaccccagctgcatcacccccatccagctggcccccatgaagaccatcgtgagaggcaacaagccctgcaaggagaccagcatcaacggcctgctggaggacttcgacaacatcagcgtgaccagaagcaacagcctgagaaaggagagcccccccacccccgaccagggcgccagcagccacggccccggccacgccgaggagaacggcttcatcaccttcagccagtacagcagcgagagcgacaccaccgccgactacaccaccgagaagtacagagagaagagcctgtacggcgacgacctggacccctactacagaggcagccacgccgccaagcagaacggccacgtgatgaagatgaagcacggcgaggcctactacagcgaggtgaagcccctgaagagcgacttcgccagattcagcgccgactaccacagccacctggacagcctgagcaagcccagcgagtacagcgacctgaagtgggagtaccagagagccagcagcagcagccccctggactacagcttccagttcacccccagcagaaccgccggcaccagcggctgcagcaaggagagcctggcctacagcgagagcgagtggggccccagcctggacgactacgacagaagacccaagagcagctacctgaaccagaccagcccccagcccaccatgagacagagaagcagaagcggcagcggcctgcaggagcccatgatgcccttcggcgccagcgccttcaagacccacccccagggccacagctacaacagctacacctaccccagactgagcgagcccaccatgtgcatccccaaggtggactacgacagagcccagatggtgctgagcccccccctgagcggcagcgacacctaccccagaggccccgccaagctgccccagagccagagcaagagcggctacagcagcagcagccaccagtaccccagcggctaccacaaggccaccctgtaccaccaccccagcctgcagagcagcagccagtacatcagcaccgccagctacctgagcagcctgagcctgagcagcagcacctaccccccccccagctggggcagcagcagcgaccagcagcccagcagagtgagccacgagcagttcagagccgccctgcagctggtggtgagccccggcgaccccagagagtacctggccaacttcatcaagatcggcgagggcagcaccggcatcgtgtgcatcgccaccgagaagcacaccggcaagcaggtggccgtgaagaagatggacctgagaaagcagcagagaagagagctgctgttcaacgaggtggtgatcatgagagactaccaccacgacaacgtggtggacatgtacagcagctacctggtgggcgacgagctgtgggtggtgatggagttcctggagggcggcgccctgaccgacatcgtgacccacaccagaatgaacgaggagcagatcgccaccgtgtgcctgagcgtgctgagagccctgagctacctgcacaaccagggcgtgatccacagagacatcaagagcgacagcatcctgctgaccagcgacggcagagtgagcagcgtgctgagaggcttcctggacctgatgctggtgagagagcccagccagagagccaccgcccaggagctgctgggccaccccttcctgaagctggccggcccccccagctgcatcgtgcccctgatgagacagtacagacaccactag

SEQ ID NO: 20729 - DNA, 366 bp, Artificial Sequence
  Description of Artificial Sequence: Synthetic coding sequence
atgagcaccctgttccccagcctgttccccagagtgaccgagaccctgtggttcaacctggacagaccctgcgtggaggagaccgagctgcagcagcaggagcagcagcaccaggcctggctgcagagcatcgccgagaaggacaacaacctggtgcccatcggcaagcccgccagcgagcactacgacgacgaggaggaggaggacgacgaggacgacgaggacagcgaggaggacagcgaggacgacgaggacatgcaggacatggacgagatgaacgactacaacgagagccccgacgacggcgaggtgaacgaggtggacatggagggcaacgagcaggaccaggaccagtggatgatctag

SEQ ID NO: 20730 - DNA, 1269 bp, Artificial Sequence
  Description of Artificial Sequence: Synthetic coding sequence
atggccatcgcccagctggccaccgagtacgtgttcagcgacttcctgctgaaggagcccaccgagcccaagttcaagggcctgagactggagctggccgtggacaagatggtgacctgcatcgccgtgggcctgcccctgctgctgatcagcctggccttcgcccaggagatcagcatcggcacccagatcagctgcttcagccccagcagcttcagctggagacaggccgccttcgtggacagctactgctgggccgccgtgcagcagaagaacagcctgcagagcgagagcggcaacctgcccctgtggctgcacaagttcttcccctacatcctgctgctgttcgccatcctgctgtacctgccccccctgttctggagattcgccgccgccccccacatctgcagcgacctgaagttcatcatggaggagctggacaaggtgtacaacagagccatcaaggccgccaagagcgccagagacctggacatgagagacggcgcctgcagcgtgcccggcgtgaccgagaacctgggccagagcctgtgggaggtgagcgagagccacttcaagtaccccatcgtggagcagtacctgaagaccaagaagaacagcaacaacctgatcatcaagtacatcagctgcagactgctgaccctgatcatcatcctgctggcctgcatctacctgggctactacttcagcctgagcagcctgagcgacgagttcgtgtgcagcatcaagagcggcatcctgagaaacgacagcaccgtgcccgaccagttccagtgcaagctgatcgccgtgggcatcttccagctgctgagcgtgatcaacctggtggtgtacgtgctgctggcccccgtggtggtgtacaccctgttcgtgcccttcagacagaagaccgacgtgctgaaggtgtacgagatcctgcccaccttcgacgtgctgcacttcaagagcgagggctacaacgacctgagcctgtacaacctgttcctggaggagaacatcagcgaggtgaagagctacaagtgcctgaaggtgctggagaacatcaagagcagcggccagggcatcgaccccatgctgctgctgaccaacctgggcatgatcaagatggacgtggtggacggcaagacccccatgagcgccgagatgagagaggagcagggcaaccagaccgccgagctgcaggacagcgagaccaaggccaacaacggcgagaagaacgccagacagagactgctggacagcagctgctag

SEQ ID NO: 20731 - DNA, 2034 bp, Artificial Sequence
  Description of Artificial Sequence: Synthetic coding sequence
atgcaccacctgctggagcagagcgccgacatggccaccgccctgctggccggcgagaagctgagagagctgatcctgcccggcgcccaggacgacaaggccggcgccctggccgccctgctgctgcagctgaagctggagctgcccttcgacagagtggtgaccatcggcaccgtgctggtgcccatcctgctggtgaccctggtgttcaccaagaacttcgccgaggagcccatctactgctacaccccccacaacttcaccagagaccaggccctgtacgccagaggctactgctggaccgagctgagagacgccctgcccggcgtggacgccagcctgtggcccagcctgttcgagcacaagttcctgccctacgccctgctggccttcgccgccatcatgtacgtgcccgccctgggctgggagttcctggccagcaccagactgaccagcgagctgaacttcctgctgcaggagatcgacaactgctaccacagagccgccgagggcagagcccccaagatcgagaagcagatccagagcaagggccccggcatcaccgagagagagaagagagagatcatcgagaacgccgagaaggagaagagccccgagcagaacctgttcgagaagtacctggagagaagaggcagaagcaacttcctggccaagctgtacctggccagacacgtgctgatcctgctgctgagcgccgtgcccatcagctacctgtgcacctactacgccacccagaagcagaacgagttcacctgcgccctgggcgccagccccgacggcgccgccggcgccggccccgccgtgagagtgagctgcaagctgcccagcgtgcagctgcagagaatcatcgccggcgtggacatcgtgctgctgtgcgtgatgaacctgatcatcctggtgaacctgatccacctgttcatcttcagaaagagcaacttcatcttcgacaagctgcacaaggtgggcatcaagaccagaagacagtggagaagaagccagttctgcgacatcaacatcctggccatgttctgcaacgagaacagagaccacatcaagagcctgaacagactggacttcatcaccaacgagagcgacctgatgtacgacaacgtggtgagacagctgctggccgccctggcccagagcaaccacgacgccacccccaccgtgagagacagcggcgtgcagaccgtggaccccagcgccaaccccgccgagcccgacggcgccgccgagccccccgtggtgaagagacccagaaagaagatgaagtggatccccaccagcaaccccctgccccagcccttcaaggagcccctggccatcatgagagtggagaacagcaaggccgagaagcccaagcccgccagaagaaagaccgccaccgacaccctgatcgcccccctgctggacagaagcgcccaccactacaagggcggcggcggcgaccccggccccggccccgcccccgcccccgcccccccccccgcccccgacaagaagcacgccagacacttcagcctggacgtgcacccctacatcctgggcaccaagaaggccaaggccgaggccgtgcccgccgccctgcccgccagcagaagccaggagggcggcttcctgagccaggccgaggactgcggcctgggcctggcccccgcccccatcaaggacgcccccctgcccgagaaggagatcccctaccccaccgagcccgccagagccggcctgcccagcggcggccccttccacgtgagaagcccccccgccgcccccgccgtggcccccctgacccccgccagcctgggcaaggccgagcccctgaccatcctgagcagaaacgccacccaccccctgctgcacatcaacaccctgtacgaggccagagaggaggaggacggcggccccagactgccccaggacgtgggcgacctgatcgccatccccgccccccagcagatcctgatcgccaccttcgacgagcccagaaccgtggtgagcaccgtggagttctag

SEQ ID NO: 20732 - DNA, 1065 bp, Artificial Sequence
  Description of Artificial Sequence: Synthetic coding sequence
atgaacctgatcatcctggtgaacctgatccacctgttcatcttcagaaagagcaacttcatcttcgacaagctgcacaaggtgggcatcaagaccagaagacagtggagaagaagccagttctgcgacatcaacatcctggccatgttctgcaacgagaacagagaccacatcaagagcctgaacagactggacttcatcaccaacgagagcgacctgatgtacgacaacgtggtgagacagctgctggccgccctggcccagagcaaccacgacgccacccccaccgtgagagacagcggcgtgcagaccgtggaccccagcgccaaccccgccgagcccgacggcgccgccgagccccccgtggtgaagagacccagaaagaagatgaagtggatccccaccagcaaccccctgccccagcccttcaaggagcccctggccatcatgagagtggagaacagcaaggccgagaagcccaagcccgccagaagaaagaccgccaccgacaccctgatcgcccccctgctggacagaagcgcccccgacaagaagcacgccagacacttcagcctggacgtgcacccctacatcctgggcaccaagaaggccaaggccgaggccgtgcccgccgccctgcccgccagcagaagccaggagggcggcttcctgagccaggccgaggactgcggcctgggcctggcccccgcccccatcaaggacgcccccctgcccgagaaggagatcccctaccccaccgagcccgccagagccggcctgcccagcggcggccccttccacgtgagaagcccccccgccgcccccgccgtggcccccctgacccccgccagcctgggcaaggccgagcccctgaccatcctgagcagaaacgccacccaccccctgctgcacatcaacaccctgtacgaggccagagaggaggaggacggcggccccagactgccccaggacgtgggcgacctgatcgccatccccgccccccagcagatcctgatcgccaccttcgacgagcccagaaccgtggtgagcaccgtggagttctag

SEQ ID NO: 20733 - DNA, 1179 bp, Artificial Sequence
  Description of Artificial Sequence: Synthetic coding sequence
atgagcctggcccacaccgccgccgagtacatgctgagcgacgccctgctgcccgacagaagaggccccagactgaagggcctgagactggagctgcccctggacagaatcgtgaagttcgtggccgtgggcagccccctgctgctgatgagcctggccttcgcccaggagttcagcagcggcagccccatcagctgcttcagccccagcaacttcagcatcagacaggccgcctacgtggacagcagctgctgggacagcctgctgcaccacaagcaggacggccccggccaggacaagatgaagagcctgtggccccacaaggccctgccctacagcctgctggccctggccctgctgatgtacctgcccgtgctgctgtggcagtacgccgccgtgcccgccctgagcagcgacctgctgttcatcatcagcgagctggacaagagctacaacagaagcatcagactggtgcagcacatgctgaagatcagacagaagagcagcgacccctacgtgttctggaacgagctggagaaggccagaaaggagagatacttcgagttccccctgctggagagatacctggcctgcaagcagagaagccacagcctggtggccacctacctgctgagaaacagcctgctgctgatcttcaccagcgccacctacctgtacctgggccacttccacctggacgtgttcttccaggaggagttcagctgcagcatcaagaccggcctgctgagcgacgagacccacgtgcccaacctgatcacctgcagactgaccagcctgagcatcttccagatcgtgagcctgagcagcgtggccatctacaccatcctggtgcccgtgatcatctacaacctgaccagactgtgcagatgggacaagagactgctgagcgtgtacgagatgctgcccgccttcgacctgctgagcagaaagatgctgggctgccccatcaacgacctgaacgtgatcctgctgttcctgagagccaacatcagcgagctgatcagcttcagctggctgagcgtgctgtgcgtgctgaaggacaccaccacccagaagcacaacatcgacaccgtggtggacttcatgaccctgctggccggcctggagcccagcaagcccaagcacctgaccaacagcgcctgcgacgagcacccctag

SEQ ID NO: 20734 - DNA, 309 bp, Artificial Sequence
  Description of Artificial Sequence: Synthetic coding sequence
atgagatacggcttcgtgagaaagaagcacagaggcctgttcctgaccaccgtggccgccctgcccatctggaaccccatcagcgagttcgtgaagtggtacaagagccacaagctgagccagcactgcatcagaatctgcggccacctgtgccagaagcacctggacatgttcctgagcgtgatcggccagagatggcccatcgacgtgttcagcagcgtgttcgaccaccaggtgagcgccatcggcagcgacatcatctggtggttcctgaagctgttcctggtgagcttcttcttcttcttctag

SEQ ID NO: 20735 - DNA, 3315 bp, Artificial Sequence
  Description of Artificial Sequence: Synthetic coding sequence
atgaaggtgaccgtgtgcttcggcagaaccggcatcgtggtgccctgcaaggagggccagctgagagtgggcgagctgacccagcaggccctgcagagatacctgaagaccagagagaagggccccggctactgggtgaagatccaccacctggagtacaccgacggcggcatcctggaccccgacgacgtgctggccgacgtggtggaggacaaggacaagctgatcgccgtgttcgaggagcaggagcccctgcacaagatcgagagccccagcggcaaccccgccgacagacagagccccgacgccttcgagaccgaggtggccgcccagctggccgccttcaagcccatcggcggcgagatcgaggtgacccccagcgccctgaagctgggcacccccctgctggtgagaagaagcagcgaccccgtgcccggcccccccgccgacacccagcccagcgccagccaccccggcggccagagcctgaagctggtggtgcccgacagcacccagaacctggaggacagagaggtgctgaacggcgtgcagaccgagctgctgaccagccccagaaccaaggacaccctgagcgacatgaccagaaccgtggagatcagcggcgagggcggccccctgggcatccacgtggtgcccttcttcagcagcctgagcggcagaatcctgggcctgttcatcagaggcatcgaggacaacagcagaagcaagagagagggcctgttccacgagaacgagtgcatcgtgaagatcaacaacgtggacctggtggacaagaccttcgcccaggcccaggacgtgttcagacaggccatgaagagccccagcgtgctgctgcacgtgctgcccccccagaacagagagcagtacgagaagagcgtgatcggcagcctgaacatcttcggcaacaacgacggcgtgctgaagaccaaggtgcccccccccgtgcacggcaagagcggcctgaagaccgccaacctgaccggcaccgacagccccgagaccgacgccagcgccagcctgcagcagaacaagagccccagagtgcccagactgggcggcaagcccagcagccccagcctgagccccctgatgggcttcggcagcaacaagaacgccaagaagatcaagatcgacctgaagaagggccccgagggcctgggcttcaccgtggtgaccagagacagcagcatccacggccccggccccatcttcgtgaagaacatcctgcccaagggcgccgccatcaaggacggcagactgcagagcggcgacagaatcctggaggtgaacggcagagacgtgaccggcagaacccaggaggagctggtggccatgctgagaagcaccaagcagggcgagaccgccagcctggtgatcgccagacaggagggccacttcctgcccagagagctgaagggcgagcccgactgctgcgccctgagcctggagaccagcgagcagctgaccttcgagatccccctgaacgacagcggcagcgccggcctgggcgtgagcctgaagggcaacaagagcagagagaccggcaccgacctgggcatcttcatcaagagcatcatccacggcggcgccgccttcaaggacggcagactgagaatgaacgaccagctgatcgccgtgaacggcgagagcctgctgggcaagagcaaccacgaggccatggagaccctgagaagaagcatgagcatggagggcaacatcagaggcatgatccagctggtgatcctgagaagacccgagagacccatggaggaccccgccgagtgcggcgccttcagcaagccctgcttcgagaactgccagaacgccgtgaccaccagcagaagaaacgacaacagcatcctgcaccccctgggcacctgcagcccccaggacaagcagaagggcctgctgctgcccaacgacggctgggccgagagcgaggtgccccccagccccaccccccacagcgccctgggcctgggcctggaggactacagccacagcagcggcgtggacagcgccgtgtacttccccgaccagcacatcaacttcagaagcgtgacccccgccagacagcccgagagcatcaacctgaaggccagcaagagcatggacctggtgcccgacgagagcaaggtgcacagcctggccggccagaagagcgagagccccagcaaggacttcggccccaccctgggcctgaagaagagcagcagcctggagagcctgcagaccgccgtggccgaggtgagaaagaacgacctgcccttccacagacccagaccccacatggtgagaggcagaggctgcaacgagagcttcagagccgccatcgacaagagctacgacggccccgaggagatcgaggccgacggcctgagcgacaagagcagccacagcggccagggcgccctgaactgcgagagcgccccccagggcaacagcgagctggaggacatggagaacaaggccagaaaggtgaagaagaccaaggagaaggagaagaagaaggagaagggcaagctgaaggtgaaggagaagaagagaaaggaggagaacgaggaccccgagagaaagatcaagaagaagggcttcggcgccatgctgagattcggcaagaagaaggaggacaagggcggcaaggccgagcagaagggcaccctgaagcacggcggcctgagagaggaggagctggagaagatgaaggaggagagagagagcggcagacccaccggcggcagcaccgacagaatccagaagctgagaaaggagtactaccaggccagaagagagggcttccccctgtacgaggacgacgagggcagagccagacccagcgagtacgacctgctgtgggtgcccggcagaggccccgacggcaacgcccacaacctgagattcgagggcatggagagacagtacgccagcctgcccagaggcggccccgccgaccccgtggactacctgcccgccgcccccagaggcctgtacaaggagagagagctgccctactaccccggcgcccaccccatgcacccccccaagggcagctaccccagacccaccgagctgagagtggccgacctgagatacccccagcactacccccccccccccgccccccagcacaagggccccttcagacaggacgtgccccccagccccccccagcaccagagaatgcccgcctaccaggagaccggcagacccggccccagaggcggcagccccgaccagtacccctacagaacccaggacagcagacagaagaaccccatgaccgccgccgtgtag

SEQ ID NO: 20736 - DNA, 3411 bp, Artificial Sequence
  Description of Artificial Sequence: Synthetic coding sequence
atgaaggtgaccgtgtgcttcggcagaaccggcatcgtggtgccctgcaaggagggccagctgagagtgggcgagctgacccagcaggccctgcagagatacctgaagaccagagagaagggccccggctactgggtgaagatccaccacctggagtacaccgacggcggcatcctggaccccgacgacgtgctggccgacgtggtggaggacaaggacaagctgatcgccgtgttcgaggagcaggagcccctgcacaagatcgagagccccagcggcaaccccgccgacagacagagccccgacgccttcgagaccgaggtggccgcccagctggccgccttcaagcccatcggcggcgagatcgaggtgacccccagcgccctgaagctgggcacccccctgctggtgagaagaagcagcgaccccgtgcccggcccccccgccgacacccagcccagcgccagccaccccggcggccagagcctgaagctggtggtgcccgacagcacccagaacctggaggacagagaggtgctgaacggcgtgcagaccgagctgctgaccagccccagaaccaaggacaccctgagcgacatgaccagaaccgtggagatcagcggcgagggcggccccctgggcatccacgtggtgcccttcttcagcagcctgagcggcagaatcctgggcctgttcatcagaggcatcgaggacaacagcagaagcaagagagagggcctgttccacgagaacgagtgcatcgtgaagatcaacaacgtggacctggtggacaagaccttcgcccaggcccaggacgtgttcagacaggccatgaagagccccagcgtgctgctgcacgtgctgcccccccagaacagagagcagtacgagaagagcgtgatcggcagcctgaacatcttcggcaacaacgacggcgtgctgaagaccaaggtgcccccccccgtgcacggcaagagcggcctgaagaccgccaacctgaccggcaccgacagccccgagaccgacgccagcgccagcctgcagcagaacaagagccccagagtgcccagactgggcggcaagcccagcagccccagcctgagccccctgatgggcttcggcagcaacaagaacgccaagaagatcaagatcgacctgaagaagggccccgagggcctgggcttcaccgtggtgaccagagacagcagcatccacggccccggccccatcttcgtgaagaacatcctgcccaagggcgccgccatcaaggacggcagactgcagagcggcgacagaatcctggaggtgaacggcagagacgtgaccggcagaacccaggaggagctggtggccatgctgagaagcaccaagcagggcgagaccgccagcctggtgatcgccagacaggagggccacttcctgcccagagagctgaagggcgagcccgactgctgcgccctgagcctggagaccagcgagcagctgaccttcgagatccccctgaacgacagcggcagcgccggcctgggcgtgagcctgaagggcaacaagagcagagagaccggcaccgacctgggcatcttcatcaagagcatcatccacggcggcgccgccttcaaggacggcagactgagaatgaacgaccagctgatcgccgtgaacggcgagagcctgctgggcaagagcaaccacgaggccatggagaccctgagaagaagcatgagcatggagggcaacatcagaggcatgatccagctggtgatcctgagaagacccgagagacccatggaggaccccgccgagtgcggcgccttcagcaagccctgcttcgagaactgccagaacgccgtgaccaccagcagaagaaacgacaacagcatcctgcaccccctgggcacctgcagcccccaggacaagcagaagggcctgctgctgcccaacgacggctgggccgagagcgaggtgccccccagccccaccccccacagcgccctgggcctgggcctggaggactacagccacagcagcggcgtggacagcgccgtgtacttccccgaccagcacatcaacttcagaagcgtgacccccgccagacagcccgagagcatcaacctgaaggccagcaagagcatggacctggtgcccgacgagagcaaggtgcacagcctggccggccagaagagcgacggcctgagcgacaagagcagccacagcggccagggcgccctgaactgcgagagcgccccccagggcaacagcgagctggaggacatggagaacaaggccagaaaggtgaagaagaccaaggagaaggagaagaagaaggagaagggcaagctgaaggtgaaggagaagaagagaaaggaggagaacgaggaccccgagagaaagatcaagaagaagggcttcggcgccatgctgagattcggcaagaagaaggaggacaagggcggcaaggccgagcagaagggcaccctgaagcacggcggcctgagagaggaggagctggagaagatgaaggaggagagagagagaatcggcgccaagcaccaggagctgagagagaagcaggccagaggcctgctggactacgccaccggcgccatcggcagcgtgtacgacatggacgacgacgagatggaccccaactacgccagagtgaaccacttcagagagccctgcaccagcgccaacgtgttcagaagccccagcccccccagagccggccccttcggctaccccagagacggccaccccctgagccccgagagagaccacctggagggcctgtacgccaaggtgaacaagccctaccaccccctggtgcccgccgacagcggcagacccaccggcggcagcaccgacagaatccagaagctgagaaaggagtactaccaggccagaagagagggcttccccctgtacgaggacgacgagggcagagccagacccagcgagtacgacctgctgtgggtgcccggcagaggccccgacggcaacgcccacaacctgagattcgagggcatggagagacagtacgccagcctgcccagaggcggccccgccgaccccgtggactacctgcccgccgcccccagaggcctgtacaaggagagagagctgccctactaccccggcgcccaccccatgcacccccccaagggcagctaccccagacccaccgagctgagagtggccgacctgagatacccccagcactacccccccccccccgccccccagcacaagggccccttcagacaggacgtgccccccagccccccccagcaccagagaatgcccgcctaccaggagaccggcagacccggccccagaggcggcagccccgaccagtacccctacagaacccaggacagcagacagaagaaccccatgaccgccgccgtgtag

SEQ ID NO: 20737 - DNA, 3432 bp, Artificial Sequence
  Description of Artificial Sequence: Synthetic coding sequence
atgaaggtgaccgtgtgcttcggcagaaccggcatcgtggtgccctgcaaggagggccagctgagagtgggcgagctgacccagcaggccctgcagagatacctgaagaccagagagaagggccccggctactgggtgaagatccaccacctggagtacaccgacggcggcatcctggaccccgacgacgtgctggccgacgtggtggaggacaaggacaagctgatcgccgtgttcgaggagcaggagcccctgcacaagatcgagagccccagcggcaaccccgccgacagacagagccccgacgccttcgagaccgaggtggccgcccagctggccgccttcaagcccatcggcggcgagatcgaggtgacccccagcgccctgaagctgggcacccccctgctggtgagaagaagcagcgaccccgtgcccggcccccccgccgacacccagcccagcgccagccaccccggcggccagagcctgaagctggtggtgcccgacagcacccagaacctggaggacagagaggtgctgaacggcgtgcagaccgagctgctgaccagccccagaaccaaggacaccctgagcgacatgaccagaaccgtggagatcagcggcgagggcggccccctgggcatccacgtggtgcccttcttcagcagcctgagcggcagaatcctgggcctgttcatcagaggcatcgaggacaacagcagaagcaagagagagggcctgttccacgagaacgagtgcatcgtgaagatcaacaacgtggacctggtggacaagaccttcgcccaggcccaggacgtgttcagacaggccatgaagagccccagcgtgctgctgcacgtgctgcccccccagaacagagagcagtacgagaagagcgtgatcggcagcctgaacatcttcggcaacaacgacggcgtgctgaagaccaaggtgcccccccccgtgcacggcaagagcggcctgaagaccgccaacctgaccggcaccgacagccccgagaccgacgccagcgccagcctgcagcagaacaagagccccagagtgcccagactgggcggcaagcccagcagccccagcctgagccccctgatgggcttcggcagcaacaagaacgccaagaagatcaagatcgacctgaagaagggccccgagggcctgggcttcaccgtggtgaccagagacagcagcatccacggccccggccccatcttcgtgaagaacatcctgcccaagggcgccgccatcaaggacggcagactgcagagcggcgacagaatcctggaggtgaacggcagagacgtgaccggcagaacccaggaggagctggtggccatgctgagaagcaccaagcagggcgagaccgccagcctggtgatcgccagacaggagggccacttcctgcccagagagctggacggcagactgagaatgaacgaccagctgatcgccgtgaacggcgagagcctgctgggcaagagcaaccacgaggccatggagaccctgagaagaagcatgagcatggagggcaacatcagaggcatgatccagctggtgatcctgagaagacccgagagacccatggaggaccccgccgagtgcggcgccttcagcaagccctgcttcgagaactgccagaacgccgtgaccaccagcagaagaaacgacaacagcatcctgcaccccctgggcacctgcagcccccaggacaagcagaagggcctgctgctgcccaacgacggctgggccgagagcgaggtgccccccagccccaccccccacagcgccctgggcctgggcctggaggactacagccacagcagcggcgtggacagcgccgtgtacttccccgaccagcacatcaacttcagaagcgtgacccccgccagacagcccgagagcatcaacctgaaggccagcaagagcatggacctggtgcccgacgagagcaaggtgcacagcctggccggccagaagagcgagagccccagcaaggacttcggccccaccctgggcctgaagaagagcagcagcctggagagcctgcagaccgccgtggccgaggtgagaaagaacgacctgcccttccacagacccagaccccacatggtgagaggcagaggctgcaacgagagcttcagagccgccatcgacaagagctacgacggccccgaggagatcgaggccgacggcctgagcgacaagagcagccacagcggccagggcgccctgaactgcgagagcgccccccagggcaacagcgagctggaggacatggagaacaaggccagaaaggtgaagaagaccaaggagaaggagaagaagaaggagaagggcaagctgaaggtgaaggagaagaagagaaaggaggagaacgaggaccccgagagaaagatcaagaagaagggcttcggcgccatgctgagattcggcaagaagaaggaggacaagggcggcaaggccgagcagaagggcaccctgaagcacggcggcctgagagaggaggagctggagaagatgaaggaggagagagagagaatcggcgccaagcaccaggagctgagagagaagcaggccagaggcctgctggactacgccaccggcgccatcggcagcgtgtacgacatggacgacgacgagatggaccccaactacgccagagtgaaccacttcagagagccctgcaccagcgccaacgtgttcagaagccccagcccccccagagccggccccttcggctaccccagagacggccaccccctgagccccgagagagaccacctggagggcctgtacgccaaggtgaacaagccctaccaccccctggtgcccgccgacagcggcagacccaccggcggcagcaccgacagaatccagaagctgagaaaggagtactaccaggccagaagagagggcttccccctgtacgaggacgacgagggcagagccagacccagcgagtacgacctgctgtgggtgcccggcagaggccccgacggcaacgcccacaacctgagattcgagggcatggagagacagtacgccagcctgcccagaggcggccccgccgaccccgtggactacctgcccgccgcccccagaggcctgtacaaggagagagagctgccctactaccccggcgcccaccccatgcacccccccaagggcagctaccccagacccaccgagctgagagtggccgacctgagatacccccagcactacccccccccccccgccccccagcacaagggccccttcagacaggacgtgccccccagccccccccagcaccagagaatgcccgcctaccaggagaccggcagacccggccccagaggcggcagccccgaccagtacccctacagaacccaggacagcagacagaagaaccccatgaccgccgccgtgtag

SEQ ID NO: 20738 - DNA, 3618 bp, Artificial Sequence
  Description of Artificial Sequence: Synthetic coding sequence
atgaaggtgaccgtgtgcttcggcagaaccggcatcgtggtgccctgcaaggagggccagctgagagtgggcgagctgacccagcaggccctgcagagatacctgaagaccagagagaagggccccggctactgggtgaagatccaccacctggagtacaccgacggcggcatcctggaccccgacgacgtgctggccgacgtggtggaggacaaggacaagctgatcgccgtgttcgaggagcaggagcccctgcacaagatcgagagccccagcggcaaccccgccgacagacagagccccgacgccttcgagaccgaggtggccgcccagctggccgccttcaagcccatcggcggcgagatcgaggtgacccccagcgccctgaagctgggcacccccctgctggtgagaagaagcagcgaccccgtgcccggcccccccgccgacacccagcccagcgccagccaccccggcggccagagcctgaagctggtggtgcccgacagcacccagaacctggaggacagagaggtgctgaacggcgtgcagaccgagctgctgaccagccccagaaccaaggacaccctgagcgacatgaccagaaccgtggagatcagcggcgagggcggccccctgggcatccacgtggtgcccttcttcagcagcctgagcggcagaatcctgggcctgttcatcagaggcatcgaggacaacagcagaagcaagagagagggcctgttccacgagaacgagtgcatcgtgaagatcaacaacgtggacctggtggacaagaccttcgcccaggcccaggacgtgttcagacaggccatgaagagccccagcgtgctgctgcacgtgctgcccccccagaacagagagcagtacgagaagagcgtgatcggcagcctgaacatcttcggcaacaacgacggcgtgctgaagaccaaggtgcccccccccgtgcacggcaagagcggcctgaagaccgccaacctgaccggcaccgacagccccgagaccgacgccagcgccagcctgcagcagaacaagagccccagagtgcccagactgggcggcaagcccagcagccccagcctgagccccctgatgggcttcggcagcaacaagaacgccaagaagatcaagatcgacctgaagaagggccccgagggcctgggcttcaccgtggtgaccagagacagcagcatccacggccccggccccatcttcgtgaagaacatcctgcccaagggcgccgccatcaaggacggcagactgcagagcggcgacagaatcctggaggtgaacggcagagacgtgaccggcagaacccaggaggagctggtggccatgctgagaagcaccaagcagggcgagaccgccagcctggtgatcgccagacaggagggccacttcctgcccagagagctgaagggcgagcccgactgctgcgccctgagcctggagaccagcgagcagctgaccttcgagatccccctgaacgacagcggcagcgccggcctgggcgtgagcctgaagggcaacaagagcagagagaccggcaccgacctgggcatcttcatcaagagcatcatccacggcggcgccgccttcaaggacggcagactgagaatgaacgaccagctgatcgccgtgaacggcgagagcctgctgggcaagagcaaccacgaggccatggagaccctgagaagaagcatgagcatggagggcaacatcagaggcatgatccagctggtgatcctgagaagacccgagagacccatggaggaccccgccgagtgcggcgccttcagcaagccctgcttcgagaactgccagaacgccgtgaccaccagcagaagaaacgacaacagcatcctgcaccccctgggcacctgcagcccccaggacaagcagaagggcctgctgctgcccaacgacggctgggccgagagcgaggtgccccccagccccaccccccacagcgccctgggcctgggcctggaggactacagccacagcagcggcgtggacagcgccgtgtacttccccgaccagcacatcaacttcagaagcgtgacccccgccagacagcccgagagcatcaacctgaaggccagcaagagcatggacctggtgcccgacgagagcaaggtgcacagcctggccggccagaagagcgagagccccagcaaggacttcggccccaccctgggcctgaagaagagcagcagcctggagagcctgcagaccgccgtggccgaggtgagaaagaacgacctgcccttccacagacccagaccccacatggtgagaggcagaggctgcaacgagagcttcagagccgccatcgacaagagctacgacggccccgaggagatcgaggccgacggcctgagcgacaagagcagccacagcggccagggcgccctgaactgcgagagcgccccccagggcaacagcgagctggaggacatggagaacaaggccagaaaggtgaagaagaccaaggagaaggagaagaagaaggagaagggcaagctgaaggtgaaggagaagaagagaaaggaggagaacgaggaccccgagagaaagatcaagaagaagggcttcggcgccatgctgagattcggcaagaagaaggaggacaagggcggcaaggccgagcagaagggcaccctgaagcacggcggcctgagagaggaggagctggagaagatgaaggaggagagagagagaatcggcgccaagcaccaggagctgagagagaagcaggccagaggcctgctggactacgccaccggcgccatcggcagcgtgtacgacatggacgacgacgagatggaccccaactacgccagagtgaaccacttcagagagccctgcaccagcgccaacgtgttcagaagccccagcccccccagagccggccccttcggctaccccagagacggccaccccctgagccccgagagagaccacctggagggcctgtacgccaaggtgaacaagccctaccaccccctggtgcccgccgacagcggcagacccaccggcggcagcaccgacagaatccagaagctgagaaaggagtactaccaggccagaagagagggcttccccctgtacgaggacgacgagggcagagccagacccagcgagtacgacctgctgtgggtgcccggcagaggccccgacggcaacgcccacaacctgagattcgagggcatggagagacagtacgccagcctgcccagaggcggccccgccgaccccgtggactacctgcccgccgcccccagaggcctgtacaaggagagagagctgccctactaccccggcgcccaccccatgcacccccccaagggcagctaccccagacccaccgagctgagagtggccgacctgagatacccccagcactacccccccccccccgccccccagcacaagggccccttcagacaggacgtgccccccagccccccccagcaccagagaatgcccgcctaccaggagaccggcagacccggccccagaggcggcagccccgaccagtacccctacagaacccaggacagcagacagaagaaccccatgaccgccgccgtgtag

SEQ ID NO: 20739 - DNA, 828 bp, Artificial Sequence
  Description of Artificial Sequence: Synthetic coding sequence
atgccctacgccaaccagcccaccgtgagaatcaccgagctgaccgacgagaacgtgaagttcatcatcgagaacaccgacctggccgtggccaacagcatcagaagagtgttcatcgccgaggtgcccatcatcgccatcgactgggtgcagatcgacgccaacagcagcgtgctgcacgacgagttcatcgcccacagactgggcctgatccccctgatcagcgacgacatcgtggacaagctgcagtacagcagagactgcacctgcgaggagttctgccccgagtgcagcgtggagttcaccctggacgtgagatgcaacgaggaccagaccagacacgtgaccagcagagacctgatcagcaacagccccagagtgatccccgtgaccagcagaaacagagacaacgaccccaacgactacgtggagcaggacgacatcctgatcgtgaagctgagaaagggccaggagctgagactgagagcctacgccaagaagggcttcggcaaggagcacgccaagtggaaccccaccgccggcgtggccttcgagtacgaccccgacaacgccctgagacacaccgtgtaccccaagcccgaggagtggcccaagagcgagtacagcgagctggacgaggacgagagccaggccccctacgaccccaacggcaagcccgagagattctactacaacgtggagagctgcggcagcctgagacccgagaccatcgtgctgagcgccctgagcggcctgaagaagaagctgagcgacctgcagacccagctgagccacgagatccagagcgacgtgctgaccatcaactag

SEQ ID NO: 20740 - DNA, 1038 bp, Artificial Sequence
  Description of Artificial Sequence: Synthetic coding sequence
atggccagaccccagagaacccccgccagaagccccgacagcatcgtggaggtgaagagcaagttcgacgccgagttcagaagattcgccctgcccagagccagcgtgagcggcttccaggagttcagcagactgctgagagccgtgcaccagatccccggcctggacgtgctgctgggctacaccgacgcccacggcgacctgctgcccctgaccaacgacgacagcctgcacagagccctggccagcggccccccccccctgagactgctggtgcagaagagagaggccgacagcagcggcctggccttcgccagcaacagcctgcagagaagaaagaagggcctgctgctgagacccgtggcccccctgagaaccagaccccccctgctgatcagcctgccccaggacttcagacaggtgagcagcgtgatcgacgtggacctgctgcccgagacccacagaagagtgagactgcacaagcacggcagcgacagacccctgggcttctacatcagagacggcatgagcgtgagagtggccccccagggcctggagagagtgcccggcatcttcatcagcagactggtgagaggcggcctggccgagagcaccggcctgctggccgtgagcgacgagatcctggaggtgaacggcatcgaggtggccggcaagaccctggaccaggtgaccgacatgatggtggccaacagccacaacctgatcgtgaccgtgaagcccgccaaccagagaaacaacgtggtgagaggcgccagcggcagactgaccggcccccccagcgccggccccggccccgccgagcccgacagcgacgacgacagcagcgacctggtgatcgagaacagacagccccccagcagcaacggcctgagccagggccccccctgctgggacctgcaccccggctgcagacaccccggcaccagaagcagcctgcccagcctggacgaccaggagcaggccagcagcggctggggcagcagaatcagaggcgacggcagcggcttcagcctgtag

SEQ ID NO: 20741 - DNA, 1032 bp, Artificial Sequence
  Description of Artificial Sequence: Synthetic coding sequence
atggaggtgctggccgccgagaccaccagccagcaggagagactgcaggccatcgccgagaagagaaagagacaggccgagatcgagaacaagagaagacagctggaggacgagagaagacagctgcagcacctgaagagcaaggccctgagagagagatggctgctggagggcacccccagcagcgccagcgagggcgacgaggacctgagaagacagatgcaggacgacgagcagaagaccagactgctggaggacagcgtgagcagactggagaaggagatcgaggtgctggagagaggcgacagcgcccccgccaccgccaaggagaacgccgccgcccccagccccgtgagagcccccgcccccagccccgccaaggaggagagaaagaccgaggtggtgatgaacagccagcagacccccgtgggcacccccaaggacaagagagtgagcaacacccccctgagaaccgtggacggcagccccatgatgaaggccgtggtgcacgccgtggacggcaccgccgagaacggcatccaccccctgagcagcagcgaggtggacgagctgatccacaaggccgacgaggtgaccctgagcgaggccggcagcaccgccggcgccgccgagaccagaggcgccgtggagggcgccgccagaaccacccccagcagaagagagatcaccggcgtgcaggcccagcccggcgaggccaccagcggcccccccggcatccagcccggccaggagccccccgtgaccatgatcttcatgggctaccagaacgtggaggacgaggccgagaccaagaaggtgctgggcctgcaggacaccatcaccgccgagctggtggtgatcgaggacgccgccgagcccaaggagcccgccccccccaacggcagcgccgccgagccccccaccgaggccgccagcagagaggagaaccaggccggccccgaggccaccaccagcgacccccaggacctggacatgaagaagcacagatgcaagtgctgcagcatcatgtag

SEQ ID NO: 20742 - DNA, 1164 bp, Artificial Sequence
  Description of Artificial Sequence: Synthetic coding sequence
atggaggtgctggccgccgagaccaccagccagcaggagagactgcaggccatcgccgagaagagaaagagacaggccgagatcgagaacaagagaagacagctggaggacgagagaagacagctgcagcacctgaagagcaaggccctgagagagagatggctgctggagggcacccccagcagcgccagcgagggcgacgaggacctgagaagacagatgcaggacgacgagcagaagaccagactgctggaggacagcgtgagcagactggagaaggagatcgaggtgctggagagaggcgacagcgcccccgccaccgccaaggagaacgccgccgcccccagccccgtgagagcccccgcccccagccccgccaaggaggagagaaagaccgaggtggtgatgaacagccagcagacccccgtgggcacccccaaggacaagagagtgagcaacacccccctgagaaccgtggacggcagccccatgatgaaggccgccatgtacagcgtggagatcaccgtggagaaggacaaggtgaccggcgagaccagagtgctgagcagcaccaccctgctgcccagacagcccctgcccctgggcatcaaggtgtacgaggacgagaccaaggtggtgcacgccgtggacggcaccgccgagaacggcatccaccccctgagcagcagcgaggtggacgagctgatccacaaggccgacgaggtgaccctgagcgaggccggcagcaccgccggcgccgccgagaccagaggcgccgtggagggcgccgccagaaccacccccagcagaagagagatcaccggcgtgcaggcccagcccggcgaggccaccagcggcccccccggcatccagcccggccaggagccccccgtgaccatgatcttcatgggctaccagaacgtggaggacgaggccgagaccaagaaggtgctgggcctgcaggacaccatcaccgccgagctggtggtgatcgaggacgccgccgagcccaaggagcccgccccccccaacggcagcgccgccgagccccccaccgaggccgccagcagagaggagaaccaggccggccccgaggccaccaccagcgacccccaggacctggacatgaagaagcacagatgcaagtgctgcagcatcatgtag

SEQ ID NO: 20743 - DNA, 759 bp, Artificial Sequence
  Description of Artificial Sequence: Synthetic coding sequence
atgaacagccagcagacccccgtgggcacccccaaggacaagagagtgagcaacacccccctgagaaccgtggacggcagccccatgatgaaggccgccatgtacagcgtggagatcaccgtggagaaggacaaggtgaccggcgagaccagagtgctgagcagcaccaccctgctgcccagacagcccctgcccctgggcatcaaggtgtacgaggacgagaccaaggtggtgcacgccgtggacggcaccgccgagaacggcatccaccccctgagcagcagcgaggtggacgagctgatccacaaggccgacgaggtgaccctgagcgaggccggcagcaccgccggcgccgccgagaccagaggcgccgtggagggcgccgccagaaccacccccagcagaagagagatcaccggcgtgcaggcccagcccggcgaggccaccagcggcccccccggcatccagcccggccaggagccccccgtgaccatgatcttcatgggctaccagaacgtggaggacgaggccgagaccaagaaggtgctgggcctgcaggacaccatcaccgccgagctggtggtgatcgaggacgccgccgagcccaaggagcccgccccccccaacggcagcgccgccgagccccccaccgaggccgccagcagagaggagaaccaggccggccccgaggccaccaccagcgacccccaggacctggacatgaagaagcacagatgcaagtgctgcagcatcatgtag

SEQ ID NO: 20744 - DNA, 1062 bp, Artificial Sequence
  Description of Artificial Sequence: Synthetic coding sequence
atggccatgaccctgctggaggactggtgcagaggcatggacgtgaacagccagagagccctgctggtgtggggcatccccgtgaactgcgacgaggccgagatcgaggagaccctgcaggccgccatgccccaggtgagctacagaatgctgggcagaatgttctggagagaggagaacgccaaggccgccctgctggagctgaccggcgccgtggactacgccgccatccccagagagatgcccggcaagggcggcgtgtggaaggtgctgttcaagccccccaccagcgacgccgagttcctggagagactgcacctgttcctggccagagagggctggaccgtgcaggacgtggccagagtgctgggcttccagaaccccacccccacccccggccccgagatgcccgccgagatgctgaactacatcctggacaacgtgatccagcccctggtggagagcatctggtacaagagactgaccctgttcagcggcagagacatccccggccccggcgaggagaccttcgacccctggctggagcacaccaacgaggtgctggaggagtggcaggtgagcgacgtggagaagagaagaagactgatggagagcctgagaggccccgccgccgacgtgatcagaatcctgaagagcaacaaccccgccatcaccaccgccgagtgcctgaaggccctggagcaggtgttcggcagcgtggagagcagcagagacgcccagatcaagttcctgaacacctaccagaaccccggcgagaagctgagcgcctacgtgatcagactggagcccctgctgcagaaggtggtggagaagggcgccatcgacaaggacaacgtgaaccaggccagactggagcaggtgatcgccggcgccaaccacagcggcgccatcagaagacagctgtggctgaccggcgccggcgagggccccgcccccaacctgttccagctgctggtgcagatcagagaggaggaggccaaggaggaggaggaggaggccgaggccaccctgctgcagctgggcctggagggccacttctag

SEQ ID NO: 20745 - DNA, 1782 bp, Artificial Sequence
  Description of Artificial Sequence: Synthetic coding sequence
atgggcaccgccagaatcgcccccggcctggccctgctgctgtgctgccccgtgctgagcagcgcctacgccctggtggacgccgacgacgtgatgaccaaggaggagcagatcttcctgctgcacagagcccaggcccagtgcgagaagagactgaaggaggtgctgcagagacccgccagcatcatggagagcgacaagggctggaccagcgccagcaccagcggcaagcccagaaaggacaaggccagcggcaagctgtaccccgagagcgaggaggacaaggaggcccccaccggcagcagatacagaggcagaccctgcctgcccgagtgggaccacatcctgtgctggcccctgggcgcccccggcgaggtggtggccgtgccctgccccgactacatctacgacttcaaccacaagggccacgcctacagaagatgcgacagaaacggcagctgggagctggtgcccggccacaacagaacctgggccaactacagcgagtgcgtgaagttcctgaccaacgagaccagagagagagaggtgttcgacagactgggcatgatctacaccgtgggctacagcgtgagcctggccagcctgaccgtggccgtgctgatcctggcctacttcagaagactgcactgcaccagaaactacatccacatgcacctgttcctgagcttcatgctgagagccgtgagcatcttcgtgaaggacgccgtgctgtacagcggcgccaccctggacgaggccgagagactgaccgaggaggagctgagagccatcgcccaggccccccccccccccgccaccgccgccgccggctacgccggctgcagagtggccgtgaccttcttcctgtacttcctggccaccaactactactggatcctggtggagggcctgtacctgcacagcctgatcttcatggccttcttcagcgagaagaagtacctgtggggcttcaccgtgttcggctggggcctgcccgccgtgttcgtggccgtgtgggtgagcgtgagagccaccctggccaacaccggctgctgggacctgagcagcggcaacaagaagtggatcatccaggtgcccatcctggccagcatcgtgctgaacttcatcctgttcatcaacatcgtgagagtgctggccaccaagctgagagagaccaacgccggcagatgcgacaccagacagcagtacagaaagctgctgaagagcaccctggtgctgatgcccctgttcggcgtgcactacatcgtgttcatggccaccccctacaccgaggtgagcggcaccctgtggcaggtgcagatgcactacgagatgctgttcaacagcttccagggcttcttcgtggccatcatctactgcttctgcaacggcgaggtgcaggccgagatcaagaagagctggagcagatggaccctggccctggacttcaagagaaaggccagaagcggcagcagcagctacagctacggccccatggtgagccacaccagcgtgaccaacgtgggccccagagtgggcctgggcctgcccctgagccccagactgctgcccaccgccaccaccaacggccacccccagctgcccggccacgccaagcccggcacccccgccctggagaccctggagaccaccccccccgccatggccgcccccaaggacgacggcttcctgaacggcagctgcagcggcctggacgaggaggccagcggccccgagagaccccccgccctgctgcaggaggagtgggagaccgtgatgtag

SEQ ID NO: 20746 - DNA, 1782 bp, Artificial Sequence; identical to SEQ ID NO: 20745
  Description of Artificial Sequence: Synthetic coding sequence

SEQ ID NO: 20747 - DNA, 1584 bp, Artificial Sequence
  Description of Artificial Sequence: Synthetic coding sequence
atgggcaccgccagaatcgcccccggcctggccctgctgctgtgctgccccgtgctgagcagcgcctacgccctggtggacgccgacgacgtgatgaccaaggaggagcagatcttcctgctgcacagagcccaggcccagtgcgagaagagactgaaggaggtgctgcagagacccgccagcatcatggagagcgacaagggctggaccagcgccagcaccagcggcaagcccagaaaggacaaggccagcggcaagctgtaccccgagagcgaggaggacaaggaggcccccaccggcagcagatacagaggcagaccctgcctgcccgagtgggaccacatcctgtgctggcccctgggcgcccccggcgaggtggtggccgtgccctgccccgactacatctacgacttcaaccacaagggccacgcctacagaagatgcgacagaaacggcagctgggagctggtgcccggccacaacagaacctgggccaactacagcgagtgcgtgaagttcctgaccaacgagaccagagagagagaggtgttcgacagactgggcatgatctacaccgtgggctacagcgtgagcctggccagcctgaccgtggccgtgctgatcctggcctacttcagaagactgcactgcaccagaaactacatccacatgcacctgttcctgagcttcatgctgagagccgtgagcatcttcgtgaaggacgccgtgctgtacagcggcgccaccctggacgaggccgagagactgaccgaggaggagctgagagccatcgcccaggccccccccccccccgccaccgccgccgccggctacgccggctgcagagtggccgtgaccttcttcctgtacttcctggccaccaactactactggatcctggtggagggcctgtacctgcacagcctgatcttcatggccttcttcagcgagaagaagtacctgtggggcttcaccgtgttcggctggggcctgcccgccgtgttcgtggccgtgtgggtgagcgtgagagccaccctggccaacaccggctgctgggacctgagcagcggcaacaagaagtggatcatccaggtgcccatcctggccagcatcgtgctgaacttcatcctgttcatcaacatcgtgagagtgctggccaccaagctgagagagaccaacgccggcagatgcgacaccagacagcagtacagaaagctgctgaagagcaccctggtgctgatgcccctgttcggcgtgcactacatcgtgttcatggccaccccctacaccgaggtgagcggcaccctgtggcaggtgcagatgcactacgagatgctgttcaacagcttccagggcttcttcgtggccatcatctactgcttctgcaacggcgaggtgcaggccgagatcaagaagagctggagcagatggaccctggccctggacttcaagagaaaggccagaagcggcagcagcagctacagctacggccccatggtgagccacaccagcgtgaccaacgtgggccccagagtgggcctgggcctgcccctgagccccagactgctgcccaccgccacctag

SEQ ID NO: 20748 - DNA, 1002 bp, Artificial Sequence
  Description of Artificial Sequence: Synthetic coding sequence
atgggcaccgccagaatcgcccccggcctggccctgctgctgtgctgccccgtgctgagcagcgcctacgccctggtggacgccgacgacgtgatgaccaaggaggagcagatcttcctgctgcacagagcccaggcccagtgcgagaagagactgaaggaggtgctgcagagacccgccagcatcatggagagcgacaagggctggaccagcgccagcaccagcggcaagcccagaaaggacaaggccagcggcaagctgtaccccgagagcgaggaggacaaggaggcccccaccggcagcagatacagaggcagaccctgcctgcccgagtgggaccacatcctgtgctggcccctgggcgcccccggcgaggtggtggccgtgccctgccccgactacatctacgacttcaaccacaagggccacgcctacagaagatgcgacagaaacggcagctgggagctggtgcccggccacaacagaacctgggccaactacagcgagtgcgtgaagttcctgaccaacgagaccagagagagagaggtgttcgacagactgggcatgatctacaccgtgggctacagcgtgagcctggccagcctgaccgtggccgtgctgatcctggcctacttcagaagactgcactgcaccagaaactacatccacatgcacctgttcctgagcttcatgctgagagccgtgagcatcttcgtgaaggacgccgtgctgtacagcggcgccaccctggacgaggccgagagactgaccgaggaggagctgagagccatcgcccaggccccccccccccccgccaccgccgccgccggctacgccggctgcagagtggccgtgaccttcttcctgtacttcctggccaccaactactactggatcctggtggagggcctgtacctgcacagcctgatcttcatggccttcttcagcgagaagaagtacctgtggggcttcaccgtgttcggctggggcgccggcacctag

SEQ ID NO: 20749 - DNA, 1782 bp, Artificial Sequence; identical to SEQ ID NO: 20745
  Description of Artificial Sequence: Synthetic coding sequence

SEQ ID NO: 20750 - DNA, 1782 bp, Artificial Sequence; identical to SEQ ID NO: 20745
  Description of Artificial Sequence: Synthetic coding sequence

SEQ ID NO: 20751 - DNA, 1653 bp, Artificial Sequence
  Description of Artificial Sequence: Synthetic coding sequence
atggccggcctgggcgccagcctgcacgtgtggggctggctgatgctgggcagctgcctgctggccagagcccagctggacagcgacggcaccatcaccatcgaggagcagatcgtgctggtgctgaaggccaaggtgcagtgcgagctgaacatcaccgcccagctgcaggagggcgagggcaactgcttccccgagtgggacggcctgatctgctggcccagaggcaccgtgggcaagatcagcgccgtgccctgccccccctacatctacgacttcaaccacaagggcgtggccttcagacactgcaaccccaacggcacctgggacttcatgcacagcctgaacaagacctgggccaactacagcgactgcctgagattcctgcagcccgacatcagcatcggcaagcaggagttcttcgagagactgtacgtgatgtacaccgtgggctacagcatcagcttcggcagcctggccgtggccatcctgatcatcggctacttcagaagactgcactgcaccagaaactacatccacatgcacctgttcgtgagcttcatgctgagagccaccagcatcttcgtgaaggacagagtggtgcacgcccacatcggcgtgaaggagctggagagcctgatcatgcaggacgacccccagaacagcatcgaggccaccagcgtggacaagagccagtacatcggctgcaagatcgccgtggtgatgttcatctacttcctggccaccaactactactggatcctggtggagggcctgtacctgcacaacctgatcttcgtggccttcttcagcgacaccaagtacctgtggggcttcatcctgatcggctggggcttccccgccgccttcgtggccgcctgggccgtggccagagccaccctggccgacgccagatgctgggagctgagcgccggcgacatcaagtggatctaccaggcccccatcctggccgccatcggcctgaacttcatcctgttcctgaacaccgtgagagtgctggccaccaagatctgggagaccaacgccgtgggccacgacaccagaaagcagtacagaaagctggccaagagcaccctggtgctggtgctggtgttcggcgtgcactacatcgtgttcgtgtgcctgccccacagcttcaccggcctgggctgggagatcagaatgcactgcgagctgttcttcaacagcttccagggcttcttcgtgagcatcatctactgctactgcaacggcgaggtgcaggccgaggtgaagaagatgtggagcagatggaacctgagcgtggactggaagagaacccccccctgcggcagcagaagatgcggcagcgtgctgaccaccgtgacccacagcaccagcagccagagccaggtggccgccagcaccagaatggtgctgatcagcggcaaggccgccaagatcgccagcagacagcccgacagccacatcaccctgcccggctacgtgtggagcaacagcgagcaggactgcctgccccacagcttccacgaggagaccaaggaggacagcggcagacagggcgacgacatcctgatggagaagcccagcagacccatggagagcaaccccgacaccgagggctgccagggcgagaccgaggacgtgctgtag

SEQ ID NO: 20752 - DNA, 345 bp, Artificial Sequence
  Description of Artificial Sequence: Synthetic coding sequence
atgagcgccctgagcctgctgatcctgggcctgctgaccgccgtgccccccgccagctgccagcagggcctgggcaacctgcagccctggatgcagggcctgatcgccgtggccgtgttcctggtgctggtggccatcgccttcgccgtgaaccacttctggtgccaggaggagcccgagcccgcccacatgatcctgaccgtgggcaacaaggccgacggcgtgctggtgggcaccgacggcagatacagcagcatggccgccagcttcagaagcagcgagcacgagaacgcctacgagaacgtgcccgaggaggagggcaaggtgagaagcacccccatgtag

SEQ ID NO: 20753 - DNA, 345 bp, Artificial Sequence; identical to SEQ ID NO: 20752
  Description of Artificial Sequence: Synthetic coding sequence

SEQ ID NO: 20754 - DNA, 6810 bp, Artificial Sequence
  Description of Artificial Sequence: Synthetic coding sequence
atgggcagccagaccctgcagatcctgagacagggcgtgtgggccgccctgagcggcggctggtactacgacccccaccaggccaccttcgtgaacgccctgcacctgtacctgtggctgttcctgctgggcctgcccttcaccctgtacatggccctgcccagcaccatgatcatcgtggccgtgtactgccccgtgatcgccgccgtgttcatcgtgctgaagatggtgaactacagactgcacagagccctggacgccggcgaggtggtggacagaaccgccaacgagttcaccgaccagagaaccaaggccgagcagggcaactgcagcaccagaagaaaggacagcaacggccccagcgaccccggcggcggcatcgagatgagcgagttcatcagagaggccaccccccccgtgggctgcagcagcagaaacagctacgccggcctggaccccagcaaccagatcggcagcggcagcagcagactgggcaccgccgccaccatcaagggcgacaccgacaccgccaagaccagcgacgacatcagcctgagcctgggccagagcagcagcctgtgcaaggagggcagcgaggagcaggacctggccgccgacagaaagctgttcagactggtgagcaacgacagcttcatcagcatccagcccagcctgagcagctgcggccaggacctgcccagagacttcagcgacaaggtgaacctgcccagccacaaccaccaccaccacgtggaccagagcctgagcagcgcctgcgacaccgaggtggccagcctggtgcccctgcacagccacagctacagaaaggaccacagacccagaggcgtgcccagaaccagcagcagcgccgtggccttccccgacaccagcctgaacgacttccccctgtaccagcagagaagaggcctggaccccgtgagcgagctggagagcagcaagcccctgagcggcagcaaggagagcctggtggagaacagcggcctgagcggcgagttccagctggccggcgacctgaagatcaacaccagccagccccccaccaagagcggcaagagcaagcccctgaaggccgagaagagcatggacagcctgagaagcctgagcaccagaagcagcggcagcaccgagagctactgcagcggcaccgacagagacaccaacagcaccgtgagcagctacaagagcgagcagaccagcagcacccacatcgagagcatcctgagcgagcacgaggagagccccaaggccggcaccaagagcggcagaaagaaggagtgctgcgccggccccgaggagaagaacagctgcgccagcgacaagagaaccagcagcgagaagatcgccatggaggccagcaccaacagcggcgtgcacgaggccaaggaccccacccccagcgacgagatgcacaaccagagaggcctgagcaccagcgccagcgaggaggccaacaagaacccccacgccaacgagttcaccagccagggcgacagaccccccggcaacaccgccgagaacaaggaggagaagagcgacaagagcgccgtgagcgtggacagcaaggtgagaaaggacgtgggcggcaagcagaaggagggcgacgtgagacccaagagcagcagcgtgatccacagaaccgccagcgcccacaagagcggcagaagaagaaccggcaagaagagagccagcagcttcgacagcagcagacacagagactacgtgtgcttcagaggcgtgagcggcaccaagccccacagcgccatcttctgccacgacgaggacagcagcgaccagagcgacctgagcagagccagcagcgtgcagagcgcccaccagttcagcagcgacagcagcagcagcaccaccagccacagctgccagagccccgagggcagatacagcgccctgaagaccaagcacacccacaaggagagaggcaccgacagcgagcacacccacaaggcccacctggtgcccgagggcaccagcaagaagagagccaccagaagaaccagcagcaccaacagcgccaagaccagagccagagtgctgagcctggacagcggcaccgtggcctgcctgaacgacagcaacagactgatggcccccgagagcatcaagcccctgaccaccagcaagagcgacctggaggccaaggagggcgaggtgctggacgagctgagcctgctgggcagagccagccagctggagaccgtgaccagaagcagaaacagcctgcccaaccaggtggccttccccgagggcgaggagcaggacgccgtgagcggcgccgcccaggccagcgaggaggccgtgagcttcagaagagagagaagcaccttcagaagacaggccgtgagaagaagacacaacgccggcagcaaccccaccccccccaccctgctgatcggcagccccctgagcctgcaggacggccagcagggccagcagagcaccgcccaggtgaaggtgcagagcagaccccccagccaggccgccgtgctgagcgccagcgccagcctgctggtgagaaacggcagcgtgcacctggaggccagccacgacaacgccagcgccgtgggcggcagcagcctgcacgacgagctgggcaagttcagcagcaccctgtacgagaccggcggctgcgacatgagcctggtgaacttcgagcccgccgccagaagagccagcaacatctgcgacaccgacagccacgtgagcagcagcaccagcgtgagattctacccccacgacgtgctgagcctgccccagatcagactgaacagactgctgaccatcgacaccgacctgctggagcagcaggacatcgacctgagccccgacctggccgccacctacggccccaccgaggaggccgcccagaaggtgaagcactactacagattctggatcctgccccagctgtggatcggcatcaacttcgacagactgaccctgctggccctgttcgacagaaacagagagatcctggagaacgtgctggccgtgatcctggccatcctggtggccttcctgggcagcatcctgctgatccagggcttcttcagagacatctgggtgttccagttctgcctggtgatcgccagctgccagtacagcctgctgaagagcgtgcagcccgacagcagcagccccagacacggccacaacagaatcatcgcctacagcagacccgtgtacttctgcatctgctgcggcctgatctggctgctggactacggcagcagaaacctgaccgccaccaagttcaagctgtacggcatcaccttcaccaaccccctggtgttcatcagcgccagagacctggtgatcgtgttcaccctgtgcttccccatcgtgttcttcatcggcctgctgccccaggtgaacaccttcgtgatgtacctgtgcgagcagctggacatccacatcttcggcggcaacgccaccaccagcctgctggccgccctgtacagcttcatctgcagcatcgtggccgtggccctgctgtacggcctgtgctacggcgccctgaaggacagctgggacggccagcacatccccgtgctgttcagcatcttctgcggcctgctggtggccgtgagctaccacctgagcagacagagcagcgaccccagcgtgctgttcagcctggtgcagagcaagatcttccccaagaccgaggagaagaaccccgaggaccccctgagcgaggtgaaggaccccctgcccgagaagctgagaaacagcgtgagcgagagactgcagagcgacctggtggtgtgcatcgtgatcggcgtgctgtacttcgccatccacgtgagcaccgtgttcaccgtgctgcagcccgccctgaagtacgtgctgtacaccctggtgggcttcgtgggcttcgtgacccactacgtgctgccccaggtgagaaagcagctgccctggcactgcttcagccaccccctgctgaagaccctggagtacaaccagtacgaggtgagaaacgccgccaccatgatgtggttcgagaagctgcacgtgtggctgctgttcgtggagaagaacatcatctaccccctgatcgtgctgaacgagctgagcagcagcgccgagaccatcgccagccccaagaagctgaacaccgagctgggcgccctgatgatcaccgtggccggcctgaagctgctgagaagcagcttcagcagccccacctaccagtacgtgaccgtgatcttcaccgtgctgttcttcaagttcgactacgaggccttcagcgagaccatgctgctggacctgttcttcatgagcatcctgttcaacaagctgtgggagctgctgtacaagctgcagttcgtgtacacctacatcgccccctggcagatcacctggggcagcgccttccacgccttcgcccagcccttcgccgtgccccacagcgccatgctgttcatccaggccgccgtgagcgccttcttcagcacccccctgaaccccttcctgggcagcgccatcttcatcaccagctacgtgagacccgtgaagttctgggagagagactacaacaccaagagagtggaccacagcaacaccagactggccagccagctggacagaaaccccggcacctactgccagcagagagaggtggaggccatcaccgagggcgtggaggaggacgagggcttctgctgctgcgagcccggccacatcccccacatgctgagcttcaacgccgccttcagccagagatggctggcctgggaggtgatcgtgaccaagtacatcctggagggctacagcatcaccgacaacagcgccgccagcatgctgcaggtgttcgacctgagaaaggtgctgaccacctactacgtgaagggcatcatctactacgtgaccaccagcagcaagctggaggagtggctggccaacgagaccatgcaggagggcctgagactgtgcgccgacagaaactacgtggacgtggaccccaccttcaaccccaacatcgacgaggactacgaccacagactggccggcatcagcagagagagcttctgcgtgatctacctgaactggatcgagtactgcagcagcagaagagccaagcccgtggacgtggacaaggacagcagcctggtgaccctgtgctacggcctgtgcgtgctgggcagaagagccctgggcaccgccagccaccacatgagcagcaacctggagagcttcctgtacggcctgcacgccctgttcaagggcgacttcagaatcagcagcatcagagacgagtggatcttcgccgacatggagctgctgagaaaggtggtggtgcccggcatcagaatgagcatcaagctgcaccaggaccacttcaccagccccgacgagtacgacgaccccaccgtgctgtacgaggccatcgtgagccacgagaagaacctggtgatcgcccacgagggcgaccccgcctggagaagcgccgtgctggccaacagccccagcctgctggccctgagacacgtgatggacgacggcaccaacgagtacaagatcatcatgctgaacagaagatacctgagcttcagagtgatcaaggtgaacaaggagtgcgtgagaggcctgtgggccggccagcagcaggagctggtgttcctgagaaacagaaaccccgagagaggcagcatccagaacgccaagcaggccctgagaaacatgatcaacagcagctgcgaccagcccatcggctaccccatcttcgtgagccccctgaccaccagctacagcgacagccacgagcagctgaaggacatcctgggcggccccatcagcctgggcaacatcagaaacttcatcgtgagcacctggcacagactgagaaagggctgcggcgccggctgcaacagcggcggcaacatcgaggacagcgacaccggcggcggcaccagctgcaccggcaacaacgccaccaccgccaacaacccccacagcaacgtgacccagggcagcatcggcaaccccggccagggcagcggcaccggcctgcacccccccgtgaccagctacccccccaccctgggcaccagccacagcagccacagcgtgcagagcggcctggtgagacagagccccgccagagccagcgtggccagccagagcagctactgctacagcagcagacacagcagcctgagaatgagcaccaccggcttcgtgccctgcagaagaagcagcaccagccagatcagcctgagaaacctgcccagcagcatccagagcagactgagcatggtgaaccagatggagcccagcggccagagcggcctggcctgcgtgcagcacggcctgcccagcagcagcagcagcagccagagcatccccgcctgcaagcaccacaccctggtgggcttcctggccaccgagggcggccagagcagcgccaccgacgcccagcccggcaacaccctgagccccgccaacaacagccacagcagaaaggccgaggtgatctacagagtgcagatcgtggaccccagccagatcctggagggcatcaacctgagcaagagaaaggagctgcagtggcccgacgagggcatcagactgaaggccggcagaaacagctggaaggactggagcccccaggagggcatggagggccacgtgatccacagatgggtgccctgcagcagagaccccggcaccagaagccacatcgacaaggccgtgctgctggtgcagatcgacgacaagtacgtgaccgtgatcgagaccggcgtgctggagctgggcgccgaggtgtag

SEQ ID NO: 20755 - DNA, 7026 bp, Artificial Sequence
  Description of Artificial Sequence: Synthetic coding sequence
atgggcagccagaccctgcagatcctgagacagggcgtgtgggccgccctgagcggcggctggtactacgacccccaccaggccaccttcgtgaacgccctgcacctgtacctgtggctgttcctgctgggcctgcccttcaccctgtacatggccctgcccagcaccatgatcatcgtggccgtgtactgccccgtgatcgccgccgtgttcatcgtgctgaagatggtgaactacagactgcacagagccctggacgccggcgaggtggtggacagaaccgccaacgagttcaccgaccagagaaccaaggccgagcagggcaactgcagcaccagaagaaaggacagcaacggccccagcgaccccggcggcggcatcgagatgagcgagttcatcagagaggccaccccccccgtgggctgcagcagcagaaacagctacgccggcctggaccccagcaaccagatcggcagcggcagcagcagactgggcaccgccgccaccatcaagggcgacaccgacaccgccaagaccagcgacgacatcagcctgagcctgggccagagcagcagcctgtgcaaggagggcagcgaggagcaggacctggccgccgacagaaagctgttcagactggtgagcaacgacagcttcatcagcatccagcccagcctgagcagctgcggccaggacctgcccagagacttcagcgacaaggtgaacctgcccagccacaaccaccaccaccacgtggaccagagcctgagcagcgcctgcgacaccgaggtggccagcctggtgcccctgcacagccacagctacagaaaggaccacagacccagaggcgtgcccagaaccagcagcagcgccgtggccttccccgacaccagcctgaacgacttccccctgtaccagcagagaagaggcctggaccccgtgagcgagctggagagcagcaagcccctgagcggcagcaaggagagcctggtggagaacagcggcctgagcggcgagttccagctggccggcgacctgaagatcaacaccagccagccccccaccaagagcggcaagagcaagcccctgaaggccgagaagagcatggacagcctgagaagcctgagcaccagaagcagcggcagcaccgagagctactgcagcggcaccgacagagacaccaacagcaccgtgagcagctacaagagcgagcagaccagcagcacccacatcgagagcatcctgagcgagcacgaggagagccccaaggccggcaccaagagcggcagaaagaaggagtgctgcgccggccccgaggagaagaacagctgcgccagcgacaagagaaccagcagcgagaagatcgccatggaggccagcaccaacagcggcgtgcacgaggccaaggaccccacccccagcgacgagatgcacaaccagagaggcctgagcaccagcgccagcgaggaggccaacaagaacccccacgccaacgagttcaccagccagggcgacagaccccccggcaacaccgccgagaacaaggaggagaagagcgacaagagcgccgtgagcgtggacagcaaggtgagaaaggacgtgggcggcaagcagaaggagggcgacgtgagacccaagagcagcagcgtgatccacagaaccgccagcgcccacaagagcggcagaagaagaaccggcaagaagagagccagcagcttcgacagcagcagacacagagactacgtgtgcttcagaggcgtgagcggcaccaagccccacagcgccatcttctgccacgacgaggacagcagcgaccagagcgacctgagcagagccagcagcgtgcagagcgcccaccagttcagcagcgacagcagcagcagcaccaccagccacagctgccagagccccgagggcagatacagcgccctgaagaccaagcacacccacaaggagagaggcaccgacagcgagcacacccacaaggcccacctggtgcccgagggcaccagcaagaagagagccaccagaagaaccagcagcaccaacagcgccaagaccagagccagagtgctgagcctggacagcggcaccgtggcctgcctgaacgacagcaacagactgatggcccccgagagcatcaagcccctgaccaccagcaagagcgacctggaggccaaggagggcgaggtgctggacgagctgagcctgctgggcagagccagccagctggagaccgtgaccagaagcagaaacagcctgcccaaccaggtggccttccccgagggcgaggagcaggacgccgtgagcggcgccgcccaggccagcgaggaggccgtgagcttcagaagagagagaagcaccttcagaagacaggccgtgagaagaagacacaacgccggcagcaaccccaccccccccaccctgctgatcggcagccccctgagcctgcaggacggccagcagggccagcagagcaccgcccaggtgaaggtgcagagcagaccccccagccaggccgccgtgctgagcgccagcgccagcctgctggtgagaaacggcagcgtgcacctggaggccagccacgacaacgccagcgccgtgggcggcagcagcctgcacgacgagctgggcaagttcagcagcaccctgtacgagaccggcggctgcgacatgagcctggtgaacttcgagcccgccgccagaagagccagcaacatctgcgacaccgacagccacgtgagcagcagcaccagcgtgagattctacccccacgacgtgctgagcctgccccagatcagactgaacagactgctgaccatcgacaccgacctgctggagcagcaggacatcgacctgagccccgacctggccgccacctacggccccaccgaggaggccgcccagaaggtgaagcactactacagattctggatcctgccccagctgtggatcggcatcaacttcgacagactgaccctgctggccctgttcgacagaaacagagagatcctggagaacgtgctggccgtgatcctggccatcctggtggccttcctgggcagcatcctgctgatccagggcttcttcagagacatctgggtgttccagttctgcctggtgatcgccagctgccagtacagcctgctgaagagcgtgcagcccgacagcagcagccccagacacggccacaacagaatcatcgcctacagcagacccgtgtacttctgcatctgctgcggcctgatctggctgctggactacggcagcagaaacctgaccgccaccaagttcaagctgtacggcatcaccttcaccaaccccctggtgttcatcagcgccagagacctggtgatcgtgttcaccctgtgcttccccatcgtgttcttcatcggcctgctgccccaggtgaacaccttcgtgatgtacctgtgcgagcagctggacatccacatcttcggcggcaacgccaccaccagcctgctggccgccctgtacagcttcatctgcagcatcgtggccgtggccctgctgtacggcctgtgctacggcgccctgaaggacagctgggacggccagcacatccccgtgctgttcagcatcttctgcggcctgctggtggccgtgagctaccacctgagcagacagagcagcgaccccagcgtgctgttcagcctggtgcagagcaagatcttccccaagaccgaggagaagaaccccgaggaccccctgagcgaggtgaaggaccccctgcccgagaagctgagaaacagcgtgagcgagagactgcagagcgacctggtggtgtgcatcgtgatcggcgtgctgtacttcgccatccacgtgagcaccgtgttcaccgtgctgcagcccgccctgaagtacgtgctgtacaccctggtgggcttcgtgggcttcgtgacccactacgtgctgccccaggtgagaaagcagctgccctggcactgcttcagccaccccctgctgaagaccctggagtacaaccagtacgaggtgagaaacgccgccaccatgatgtggttcgagaagctgcacgtgtggctgctgttcgtggagaagaacatcatctaccccctgatcgtgctgaacgagctgagcagcagcgccgagaccatcgccagccccaagaagctgaacaccgagctgggcgccctgatgatcaccgtggccggcctgaagctgctgagaagcagcttcagcagccccacctaccagtacgtgaccgtgatcttcaccgtgctgttcttcaagttcgactacgaggccttcagcgagaccatgctgctggacctgttcttcatgagcatcctgttcaacaagctgtgggagctgctgtacaagctgcagttcgtgtacacctacatcgccccctggcagatcacctggggcagcgccttccacgccttcgcccagcccttcgccgtgccccacagcgccatgctgttcatccaggccgccgtgagcgccttcttcagcacccccctgaaccccttcctgggcagcgccatcttcatcaccagctacgtgagacccgtgaagttctgggagagagactacaacaccaagagagtggaccacagcaacaccagactggccagccagctggacagaaaccccggcagcgacgacaacaacctgaacagcatcttctacgagcacctgaccagaagcctgcagcacagcctgtgcggcgacctgctgctgggcagatggggcaactacagcaccggcgactgcttcatcctggccagcgactacctgaacgccctggtgcacctgatcgagatcggcaacggcctggtgaccttccagctgagaggcctggagttcagaggcacctactgccagcagagagaggtggaggccatcaccgagggcgtggaggaggacgagggcttctgctgctgcgagcccggccacatcccccacatgctgagcttcaacgccgccttcagccagagatggctggcctgggaggtgatcgtgaccaagtacatcctggagggctacagcatcaccgacaacagcgccgccagcatgctgcaggtgttcgacctgagaaaggtgctgaccacctactacgtgaagggcatcatctactacgtgaccaccagcagcaagctggaggagtggctggccaacgagaccatgcaggagggcctgagactgtgcgccgacagaaactacgtggacgtggaccccaccttcaaccccaacatcgacgaggactacgaccacagactggccggcatcagcagagagagcttctgcgtgatctacctgaactggatcgagtactgcagcagcagaagagccaagcccgtggacgtggacaaggacagcagcctggtgaccctgtgctacggcctgtgcgtgctgggcagaagagccctgggcaccgccagccaccacatgagcagcaacctggagagcttcctgtacggcctgcacgccctgttcaagggcgacttcagaatcagcagcatcagagacgagtggatcttcgccgacatggagctgctgagaaaggtggtggtgcccggcatcagaatgagcatcaagctgcaccaggaccacttcaccagccccgacgagtacgacgaccccaccgtgctgtacgaggccatcgtgagccacgagaagaacctggtgatcgcccacgagggcgaccccgcctggagaagcgccgtgctggccaacagccccagcctgctggccctgagacacgtgatggacgacggcaccaacgagtacaagatcatcatgctgaacagaagatacctgagcttcagagtgatcaaggtgaacaaggagtgcgtgagaggcctgtgggccggccagcagcaggagctggtgttcctgagaaacagaaaccccgagagaggcagcatccagaacgccaagcaggccctgagaaacatgatcaacagcagctgcgaccagcccatcggctaccccatcttcgtgagccccctgaccaccagctacagcgacagccacgagcagctgaaggacatcctgggcggccccatcagcctgggcaacatcagaaacttcatcgtgagcacctggcacagactgagaaagggctgcggcgccggctgcaacagcggcggcaacatcgaggacagcgacaccggcggcggcaccagctgcaccggcaacaacgccaccaccgccaacaacccccacagcaacgtgacccagggcagcatcggcaaccccggccagggcagcggcaccggcctgcacccccccgtgaccagctacccccccaccctgggcaccagccacagcagccacagcgtgcagagcggcctggtgagacagagccccgccagagccagcgtggccagccagagcagctactgctacagcagcagacacagcagcctgagaatgagcaccaccggcttcgtgccctgcagaagaagcagcaccagccagatcagcctgagaaacctgcccagcagcatccagagcagactgagcatggtgaaccagatggagcccagcggccagagcggcctggcctgcgtgcagcacggcctgcccagcagcagcagcagcagccagagcatccccgcctgcaagcaccacaccctggtgggcttcctggccaccgagggcggccagagcagcgccaccgacgcccagcccggcaacaccctgagccccgccaacaacagccacagcagaaaggccgaggtgatctacagagtgcagatcgtggaccccagccagatcctggagggcatcaacctgagcaagagaaaggagctgcagtggcccgacgagggcatcagactgaaggccggcagaaacagctggaaggactggagcccccaggagggcatggagggccacgtgatccacagatgggtgccctgcagcagagaccccggcaccagaagccacatcgacaaggccgtgctgctggtgcagatcgacgacaagtacgtgaccgtgatcgagaccggcgtgctggagctgggcgccgaggtgtag

SEQ ID NO: 20756 - DNA, 6693 bp, Artificial Sequence
  Description of Artificial Sequence: Synthetic coding sequence
atgggcagccagaccctgcagatcctgagacagggcgtgtgggccgccctgagcggcggctggtactacgacccccaccaggccaccttcgtgaacgccctgcacctgtacctgtggctgttcctgctgggcctgcccttcaccctgtacatggccctgcccagcaccatgatcatcgtggccgtgtactgccccgtgatcgccgccgtgttcatcgtgctgaagatggtgaactacagactgcacagagccctggacgccggcgaggtggtggacagaaccgccaacgagttcaccgaccagagaaccaaggccgagcagggcaactgcagcaccagaagaaaggacagcaacggccccagcgaccccggcggcggcatcgagatgagcgagttcatcagagaggccaccccccccgtgggctgcagcagcagaaacagctacgccggcctggaccccagcaaccagatcggcagcggcagcagcagactgggcaccgccgccaccatcaagggcgacaccgacaccgccaagaccagcgacgacatcagcctgagcctgggccagagcagcagcctgtgcaaggagggcagcgaggagcaggacctggccgccgacagaaagctgttcagactggtgagcaacgacagcttcatcagcatccagcccagcctgagcagctgcggccaggacctgcccagagacttcagcgacaaggtgaacctgcccagccacaaccaccaccaccacgtggaccagagcctgagcagcgcctgcgacaccgaggtggccagcctggtgcccctgcacagccacagctacagaaaggaccacagacccagaggcgtgcccagaaccagcagcagcgccgtggccttccccgacaccagcctgaacgacttccccctgtaccagcagagaagaggcctggaccccgtgagcgagctggagagcagcaagcccctgagcggcagcaaggagagcctggtggagaacagcggcctgagcggcgagttccagctggccggcgacctgaagatcaacaccagccagccccccaccaagagcggcaagagcaagcccctgaaggccgagaagagcatggacagcctgagaagcctgagcaccagaagcagcggcagcaccgagagctactgcagcggcaccgacagagacaccaacagcaccgtgagcagctacaagagcgagcagaccagcagcacccacatcgagagcatcctgagcgagcacgaggagagccccaaggccggcaccaagagcggcagaaagaaggagtgctgcgccggccccgaggagaagaacagctgcgccagcgacaagagaaccagcagcgagaagatcgccatggaggccagcaccaacagcggcgtgcacgaggccaaggaccccacccccagcgacgagatgcacaaccagagaggcctgagcaccagcgccagcgaggaggccaacaagaacccccacgccaacgagttcaccagccagggcgacagaccccccggcaacaccgccgagaacaaggaggagaagagcgacaagagcgccgtgagcgtggacagcaaggtgagaaaggacgtgggcggcaagcagaaggagggcgacgtgagacccaagagcagcagcgtgatccacagaaccgccagcgcccacaagagcggcagaagaagaaccggcaagaagagagccagcagcttcgacagcagcagacacagagactacgtgtgcttcagaggcgtgagcggcaccaagccccacagcgccatcttctgccacgacgaggacagcagcgaccagagcgacctgagcagagccagcagcgtgcagagcgcccaccagttcagcagcgacagcagcagcagcaccaccagccacagctgccagagccccgagggcagatacagcgccctgaagaccaagcacacccacaaggagagaggcaccgacagcgagcacacccacaaggcccacctggtgcccgagggcaccagcaagaagagagccaccagaagaaccagcagcaccaacagcgccaagaccagagccagagtgctgagcctggacagcggcaccgtggcctgcctgaacgacagcaacagactgatggcccccgagagcatcaagcccctgaccaccagcaagagcgacctggaggccaaggagggcgaggtgctggacgagctgagcctgctgggcagagccagccagctggagaccgtgaccagaagcagaaacagcctgcccaaccaggtggccttccccgagggcgaggagcaggacgccgtgagcggcggcaagttcagcagcaccctgtacgagaccggcggctgcgacatgagcctggtgaacttcgagcccgccgccagaagagccagcaacatctgcgacaccgacagccacgtgagcagcagcaccagcgtgagattctacccccacgacgtgatcagactgaacagactgctgaccatcgacaccgacctgctggagcagcaggacatcgacctgagccccgacctggccgccacctacggccccaccgaggaggccgcccagaaggtgaagcactactacagattctggatcctgccccagctgtggatcggcatcaacttcgacagactgaccctgctggccctgttcgacagaaacagagagatcctggagaacgtgctggccgtgatcctggccatcctggtggccttcctgggcagcatcctgctgatccagggcttcttcagagacatctgggtgttccagttctgcctggtgatcgccagctgccagtacagcctgctgaagagcgtgcagcccgacagcagcagccccagacacggccacaacagaatcatcgcctacagcagacccgtgtacttctgcatctgctgcggcctgatctggctgctggactacggcagcagaaacctgaccgccaccaagttcaagctgtacggcatcaccttcaccaaccccctggtgttcatcagcgccagagacctggtgatcgtgttcaccctgtgcttccccatcgtgttcttcatcggcctgctgccccaggtgaacaccttcgtgatgtacctgtgcgagcagctggacatccacatcttcggcggcaacgccaccaccagcctgctggccgccctgtacagcttcatctgcagcatcgtggccgtggccctgctgtacggcctgtgctacggcgccctgaaggacagctgggacggccagcacatccccgtgctgttcagcatcttctgcggcctgctggtggccgtgagctaccacctgagcagacagagcagcgaccccagcgtgctgttcagcctggtgcagagcaagatcttccccaagaccgaggagaagaaccccgaggaccccctgagcgaggtgaaggaccccctgcccgagaagctgagaaacagcgtgagcgagagactgcagagcgacctggtggtgtgcatcgtgatcggcgtgctgtacttcgccatccacgtgagcaccgtgttcaccgtgctgcagcccgccctgaagtacgtgctgtacaccctggtgggcttcgtgggcttcgtgacccactacgtgctgccccaggtgagaaagcagctgccctggcactgcttcagccaccccctgctgaagaccctggagtacaaccagtacgaggtgagaaacgccgccaccatgatgtggttcgagaagctgcacgtgtggctgctgttcgtggagaagaacatcatctaccccctgatcgtgctgaacgagctgagcagcagcgccgagaccatcgccagccccaagaagctgaacaccgagctgggcgccctgatgatcaccgtggccggcctgaagctgctgagaagcagcttcagcagccccacctaccagtacgtgaccgtgatcttcaccgtgctgttcttcaagttcgactacgaggccttcagcgagaccatgctgctggacctgttcttcatgagcatcctgttcaacaagctgtgggagctgctgtacaagctgcagttcgtgtacacctacatcgccccctggcagatcacctggggcagcgccttccacgccttcgcccagcccttcgccgtgccccacagcgccatgctgttcatccaggccgccgtgagcgccttcttcagcacccccctgaaccccttcctgggcagcgccatcttcatcaccagctacgtgagacccgtgaagttctgggagagagactacaacaccaagagagtggaccacagcaacaccagactggccagccagctggacagaaaccccggcagcgacgacaacaacctgaacagcatcttctacgagcacctgaccagaagcctgcagcacagcctgtgcggcgacctgctgctgggcagatggggcaactacagcaccggcgactgcttcatcctggccagcgactacctgaacgccctggtgcacctgatcgagatcggcaacggcctggtgaccttccagctgagaggcctggagttcagaggcacctactgccagcagagagaggtggaggccatcaccgagggcgtggaggaggacgagggcttctgctgctgcgagcccggccacatcccccacatgctgagcttcaacgccgccttcagccagagatggctggcctgggaggtgatcgtgaccaagtacatcctggagggctacagcatcaccgacaacagcgccgccagcatgctgcaggtgttcgacctgagaaaggtgctgaccacctactacgtgaagggcatcatctactacgtgaccaccagcagcaagctggaggagtggctggccaacgagaccatgcaggagggcctgagactgtgcgccgacagaaactacgtggacgtggaccccaccttcaaccccaacatcgacgaggactacgaccacagactggccggcatcagcagagagagcttctgcgtgatctacctgaactggatcgagtactgcagcagcagaagagccaagcccgtggacgtggacaaggacagcagcctggtgaccctgtgctacggcctgtgcgtgctgggcagaagagccctgggcaccgccagccaccacatgagcagcaacctggagagcttcctgtacggcctgcacgccctgttcaagggcgacttcagaatcagcagcatcagagacgagtggatcttcgccgacatggagctgctgagaaaggtggtggtgcccggcatcagaatgagcatcaagctgcaccaggaccacttcaccagccccgacgagtacgacgaccccaccgtgctgtacgaggccatcgtgagccacgagaagaacctggtgatcgcccacgagggcgaccccgcctggagaagcgccgtgctggccaacagccccagcctgctggccctgagacacgtgatggacgacggcaccaacgagtacaagatcatcatgctgaacagaagatacctgagcttcagagtgatcaaggtgaacaaggagtgcgtgagaggcctgtgggccggccagcagcaggagctggtgttcctgagaaacagaaaccccgagagaggcagcatccagaacgccaagcaggccctgagaaacatgatcaacagcagctgcgaccagcccatcggctaccccatcttcgtgagccccctgaccaccagctacagcgacagccacgagcagctgaaggacatcctgggcggccccatcagcctgggcaacatcagaaacttcatcgtgagcacctggcacagactgagaaagggctgcggcgccggctgcaacagcggcggcaacatcgaggacagcgacaccggcggcggcaccagctgcaccggcaacaacgccaccaccgccaacaacccccacagcaacgtgacccagggcagcatcggcaaccccggccagggcagcggcaccggcctgcacccccccgtgaccagctacccccccaccctgggcaccagccacagcagccacagcgtgcagagcggcctggtgagacagagccccgccagagccagcgtggccagccagagcagctactgctacagcagcagacacagcagcctgagaatgagcaccaccggcttcgtgccctgcagaagaagcagcaccagccagatcagcctgagaaacctgcccagcagcatccagagcagactgagcatggtgaaccagatggagcccagcggccagagcggcctggcctgcgtgcagcacggcctgcccagcagcagcagcagcagccagagcatccccgcctgcaagcaccacaccctggtgggcttcctggccaccgagggcggccagagcagcgccaccgacgcccagcccggcaacaccctgagccccgccaacaacagccacagcagaaaggccgaggtgatctacagagtgcagatcgtggaccccagccagatcctggagggcatcaacctgagcaagagaaaggagctgcagtggcccgacgagggcatcagactgaaggccggcagaaacagctggaaggactggagcccccaggagggcatggagggccacgtgatccacagatgggtgccctgcagcagagaccccggcaccagaagccacatcgacaaggccgtgctgctggtgcagatcgacgacaagtacgtgaccgtgatcgagaccggcgtgctggagctgggcgccgaggtgtag

SEQ ID NO: 20757 - DNA, 3987 bp, Artificial Sequence
  Description of Artificial Sequence: Synthetic coding sequence
tgagacctgctggagcagcaggacatcgacctgagccccgacctggccgccacctacggccccaccgaggaggccgcccagaaggtgaagcactactacagattctggatcctgccccagctgtggatcggcatcaacttcgacagactgaccctgctggccctgttcgacagaaacagagagatcctggagaacgtgctggccgtgatcctggccatcctggtggccttcctgggcagcatcctgctgatccagggcttcttcagagacatctgggtgttccagttctgcctggtgatcgccagctgccagtacagcctgctgaagagcgtgcagcccgacagcagcagccccagacacggccacaacagaatcatcgcctacagcagacccgtgtacttctgcatctgctgcggcctgatctggctgctggactacggcagcagaaacctgaccgccaccaagttcaagctgtacggcatcaccttcaccaaccccctggtgttcatcagcgccagagacctggtgatcgtgttcaccctgtgcttccccatcgtgttcttcatcggcctgctgccccaggtgaacaccttcgtgatgtacctgtgcgagcagctggacatccacatcttcggcggcaacgccaccaccagcctgctggccgccctgtacagcttcatctgcagcatcgtggccgtggccctgctgtacggcctgtgctacggcgccctgaaggacagctgggacggccagcacatccccgtgctgttcagcatcttctgcggcctgctggtggccgtgagctaccacctgagcagacagagcagcgaccccagcgtgctgttcagcctggtgcagagcaagatcttccccaagaccgaggagaagaaccccgaggaccccctgagcgaggtgaaggaccccctgcccgagaagctgagaaacagcgtgagcgagagactgcagagcgacctggtggtgtgcatcgtgatcggcgtgctgtacttcgccatccacgtgagcaccgtgttcaccgtgctgcagcccgccctgaagtacgtgctgtacaccctggtgggcttcgtgggcttcgtgacccactacgtgctgccccaggtgagaaagcagctgccctggcactgcttcagccaccccctgctgaagaccctggagtacaaccagtacgaggtgagaaacgccgccaccatgatgtggttcgagaagctgcacgtgtggctgctgttcgtggagaagaacatcatctaccccctgatcgtgctgaacgagctgagcagcagcgccgagaccatcgccagccccaagaagctgaacaccgagctgggcgccctgatgatcaccgtggccggcctgaagctgctgagaagcagcttcagcagccccacctaccagtacgtgaccgtgatcttcaccgtgctgttcttcaagttcgactacgaggccttcagcgagaccatgctgctggacctgttcttcatgagcatcctgttcaacaagctgtgggagctgctgtacaagctgcagttcgtgtacacctacatcgccccctggcagatcacctggggcagcgccttccacgccttcgcccagcccttcgccgtgccccacagcgccatgctgttcatccaggccgccgtgagcgccttcttcagcacccccctgaaccccttcctgggcagcgccatcttcatcaccagctacgtgagacccgtgaagttctgggagagagactacaacaccaagagagtggaccacagcaacaccagactggccagccagctggacagaaaccccggcacctactgccagcagagagaggtggaggccatcaccgagggcgtggaggaggacgagggcttctgctgctgcgagcccggccacatcccccacatgctgagcttcaacgccgccttcagccagagatggctggcctgggaggtgatcgtgaccaagtacatcctggagggctacagcatcaccgacaacagcgccgccagcatgctgcaggtgttcgacctgagaaaggtgctgaccacctactacgtgaagggcatcatctactacgtgaccaccagcagcaagctggaggagtggctggccaacgagaccatgcaggagggcctgagactgtgcgccgacagaaactacgtggacgtggaccccaccttcaaccccaacatcgacgaggactacgaccacagactggccggcatcagcagagagagcttctgcgtgatctacctgaactggatcgagtactgcagcagcagaagagccaagcccgtggacgtggacaaggacagcagcctggtgaccctgtgctacggcctgtgcgtgctgggcagaagagccctgggcaccgccagccaccacatgagcagcaacctggagagcttcctgtacggcctgcacgccctgttcaagggcgacttcagaatcagcagcatcagagacgagtggatcttcgccgacatggagctgctgagaaaggtggtggtgcccggcatcagaatgagcatcaagctgcaccaggaccacttcaccagccccgacgagtacgacgaccccaccgtgctgtacgaggccatcgtgagccacgagaagaacctggtgatcgcccacgagggcgaccccgcctggagaagcgccgtgctggccaacagccccagcctgctggccctgagacacgtgatggacgacggcaccaacgagtacaagatcatcatgctgaacagaagatacctgagcttcagagtgatcaaggtgaacaaggagtgcgtgagaggcctgtgggccggccagcagcaggagctggtgttcctgagaaacagaaaccccgagagaggcagcatccagaacgccaagcaggccctgagaaacatgatcaacagcagctgcgaccagcccatcggctaccccatcttcgtgagccccctgaccaccagctacagcgacagccacgagcagctgaaggacatcctgggcggccccatcagcctgggcaacatcagaaacttcatcgtgagcacctggcacagactgagaaagggctgcggcgccggctgcaacagcggcggcaacatcgaggacagcgacaccggcggcggcaccagctgcaccggcaacaacgccaccaccgccaacaacccccacagcaacgtgacccagggcagcatcggcaaccccggccagggcagcggcaccggcctgcacccccccgtgaccagctacccccccaccctgggcaccagccacagcagccacagcgtgcagagcggcctggtgagacagagccccgccagagccagcgtggccagccagagcagctactgctacagcagcagacacagcagcctgagaatgagcaccaccggcttcgtgccctgcagaagaagcagcaccagccagatcagcctgagaaacctgcccagcagcatccagagcagactgagcatggtgaaccagatggagcccagcggccagagcggcctggcctgcgtgcagcacggcctgcccagcagcagcagcagcagccagagcatccccgcctgcaagcaccacaccctggtgggcttcctggccaccgagggcggccagagcagcgccaccgacgcccagcccggcaacaccctgagccccgccaacaacagccacagcagaaaggccgaggtgatctacagagtgcagatcgtggaccccagccagatcctggagggcatcaacctgagcaagagaaaggagctgcagtggcccgacgagggcatcagactgaaggccggcagaaacagctggaaggactggagcccccaggagggcatggagggccacgtgatccacagatgggtgccctgcagcagagaccccggcaccagaagccacatcgacaaggccgtgctgctggtgcagatcgacgacaagtacgtgaccgtgatcgagaccggcgtgctggagctgggcgccgaggtgtag

SEQ ID NO: 20758 - DNA, 6414 bp, Artificial Sequence
  Description of Artificial Sequence: Synthetic coding sequence
atggtgagccaggtgctgcagctgctgagacagggcgtgtgggccgccctgaccggcggctggtaccacgaccccgagcagagcaagttcaccaacagctgccacctgtacctgtggctgttcctgctgctgctgcccctggccctgcacctggccttcccccccaacgccatcatcgtgttcttctactgcagcgccgtgaccatcttcttcaccatcatcaagctggtgagctacagactgcacctgatgttcgacaagggcgaggtgatccagcagaagcccagcagaaaggaggagaagcccaacaaggacaaggaggccaagggcgagcacatcaccaaccacagaaaccccagcaacaacagacagatccacaacggcaagaaggaggaggccagcagaaacctgagcaccccccccctgagatgcagcagcagaggccagagcatcaccagccaccacagcagcggccccctggagctgagcgcccaggagaccgtggaggacctgaagggcgtgatcctgctggaggaccaccccatcgcccccgtgagcagcaccagccccggcatcaaggtggagagcctgcccgccagccaggcccacatgctggagaccaccaccaagagcgtgatccccgtgaagcccgtggccaccgagaccctgatcaacggcaagggcaaggagagaggcggcaagggccagccccccctgagacacagaagcgagggcggcctggtggacaagggccccctgaagaagctgccccacctgagcctgagccagtacgacctgctggagaccgacgtgagcttccagccctggggcagcgagaacagcgtgctgatccccgagcccgtgagctgccccagaggcagcatcagagagagagtgcagagcaagagcccccaggacagcctgagcagcagctgcccccagtgcgacaccatcgtggccaagcccgtggaggagcccgccgacaccagctgccaggtggacaccagctgccagggcgacctgcccctgcaccaggaggtggacagcagcgacagcgaggtggccgtgaccctgatcgacaccagccagcccggcgaccccctgagcctgcacgagcccatcaagatcgtgatcaccatgagcagcacccccaacagcatgaccgacctggagagcagcctgcacctgagagtggtgggcaccgagaagaccagcgtgaagagcgacgccgagcccaccaaccccggcgccgccggcagccccaacgccgagcagatcagcatccccgtgatcaccctggacctgcccgagggcggcggcggcggcgtgccctgccccgagggcaacggcagcgagagaacccccgagagactgaagaccagagtgagcaccaaccagtgcagcggctacggcagcggcgagggcggcaacgccatcaaggaccacagcagcagcagcagagagccctgggagagcgtgagcagactgacccccgacaccggcagcgagagcaaggtgggcaaggagggccagaccaacctggaccccagcagctgcaagagcagccacgagaagagacacgccagagtgctgagcgtggacagcggcaccgacgtgttcctgagcaagagcagcgccgagatcgtgaacgacaccgagaagaccatgcccaccagcaagagcgacctggaggccaaggagggccagatgcccaacgagagcaacttcctggagttcgtgagcctgctggagagcatcaacaccagcaagatgaccgccagcagccagctgaacggcagcgccgagcagaacgaggagagcggcctgctgagagacaactgcagccaggagaagaaggaggagatcctggagaacgagaagcccagcggccacagcagcaagcagggcaagcccgacctgcagagccaggaccacaccagcaccggccccgcctgcacccagcccgccaagaccaccgccttcttccagggcaacagacagagacagatcatctacagagtgaccagccagcaggacagcagcgtgctgcaggtgatcagcggccccgagaccagcgtgcaggaggagatcagcgtggacgccatgcacgtgttcatcgacgagcacggcgagatcagaagctgctacctgaagagcggcaaccagaaggagggccccctgcagcccctgcccagcaacaacgactgcctgagccaggccagagagatgcaggtgagcagcagcagcaccaccaccagcgagagccaggaccccagcagcggcgaccccgccgtgagcgccctgcagcagcagctgctgctgatggtggccagaagaacccagagcgagacccccagacacgtgagccaggacctggaggccagcagctgcagcagcacccagggcaagttcaacagagagcagttctacaagttcatcatcttccccggcaagtggatcaaggtgtggtacgacagactgaccctgctggccctgctggacagaaccgaggacatcaaggagaacgtgctggccatcctgctgatcgtgctggtgagcctgctgggcttcctgaccctgagccagggcttctgcaaggacatgtgggtgctgctgttctgcctggtgatggccagctgccagtacagcctgctgaagagcgtgcagcccgaccccgccagccccatccacggccacaaccagatcatcacctacagcagacccatctacttctgcgtgctgtgcggcctgatcctgctgctggacaccggcgccaaggccagacacccccccagctacgtggtgtacggcctgaagctgttcagccccgtgttcctgcagagcgccagagactacctgatcgtgttcctgtactgcttccccgccatcagcctgctgggcctgttcccccagatcaacaccttctgcacctacctgctggagcagatcgacatgctgttcttcggcggcagcgccgtgagcggcatcaccagcgccgtgtacagcgtggccagaagcgtgctggccgccgccctgctgcacgccgtgtgcttcagcgccgtgaaggagccctggagcatgcagcacatccccgccctgttcagcgccttctgcggcctgctggtggccctgagctaccacctgagcagacagagcagcgaccccagcgtgctgatgagcttcatccagtgcagactgttccccaagttcctgcaccagaacctggccgagagcgccgccgaccccctgcccaagaagatgaaggacagcgtgaccgacgtgctgaagtgggacctgatcgtgtgcgccgtggtggccgtgctgagcttcgccgtgagcgccagcaccgtgttcctgagcctgagacccttcctgagcatcgtgctgttcgccctggccggcgccgtgggcttcgtgacccactacgtgctgccccagctgagaaagcaccacccctggatgtggatcagccaccccatcctgaagaacaaggagtaccaccagagagaggtgagagacgtggcccacctgatgtggttcgagagactgtacgtgtggctgcagtgcttcgagaagtacatcctgtaccccgccctgatcctgaacgccctgaccatcgacgccttcctgatcagcaaccacagaagactgggcacccactgggacatcttcctgatgatcatcgccggcatgaagctgctgagaaccagcttctgcaaccccgtgtaccagttcatcaacctgagcttcaccgtgatcttcttccacttcgactacaaggacatcagcgagagcttcctgctggacttcttcatggtgagcatcctgttcagcaagctgggcgacctgctgcacaagctgcagttcgtgctgacctacgtggccccctggcagatggcctggggcagcagcttccacgtgttcgcccagctgttcgccatcccccacagcgccatgctgttcttccagaccatcgccaccagcatcttcagcacccccctgagccccttcctgggcagcgtgatcttcatcaccagctacgtgagacccgtgaagttctgggagaagaactacaacaccagaagagtggacaacagcaacaccagactggccgtgcagatcgagagagaccccggcaacgacgacaacaacctgaacagcatcttctacgagcacctgaccagaaccctgcaggagagcctgtgcggcgacctggtgctgggcagatggggcaactacagcagcggcgactgcttcatcctggccagcgacgacctgaacgccttcgtgcacctgatcgagatcggcaacggcctggtgaccttccagctgagaggcctggagttcagaggcacctactgccagcagagagaggtggaggccatcatggagggcgacgaggaggacagaggctgctgctgctgcaagcccggccacctgccccacctgctgagctgcaacgccgccttccacctgagatggctgacctgggagatcacccagacccagtacatcctggagggctacagcatcctggacaacaacgccgccaccatgctgcaggtgttcgacctgagaagaatcctgatcagatactacatcaagagcatcatctactacatggtgaccagccccaagctgctgagctggatcaagaacgagagcctgctgaagagcctgcagcccttcgccaagtggcactacatcgagagagacctggccatgttcaacatcaacatcgacgacgactacgtgccctgcctgcagggcatcaccagagccagcttctgcaacgtgtacctggagtggatccagcactgcgccagaaagagacaggagcccagcaccaccctggacagcgacgaggacagccccctggtgaccctgagcttcgccctgtgcaccctgggcagaagagccctgggcaccgccgcccacaacatggccatcagcctggacagcttcctgtacggcctgcacgtgctgttcaagggcgacttcagaatcaccgccagagacgagtgggtgttcgccgacatggacctgctgcacaaggtggtggcccccgccatcagaatgagcctgaagctgcaccaggaccagttcacctgccccgacgagtacgaggaccccgccgtgctgtacgaggccatccagagcttcgagaagaaggtggtgatctgccacgagggcgaccccgcctggagaggcgccgtgctgagcaacaaggaggagctgctgaccctgagacacgtggtggacgagggcgccgacgagtacaaggtgatcatgctgcacagaagcttcctgagcttcaaggtgatcaaggtgaacaaggagtgcgtgagaggcctgtgggccggccagcagcaggagctgatcttcctgagaaacagaaaccccgagagaggcagcatccagaacaacaagcaggtgctgagaaacctgatcaacagcagctgcgaccagcccctgggctaccccatgtacgtgagccccctgaccaccagctacctgggcacccacagacagctgaagaacatctggggcggccccatcaccctggacagaatcagaacctggttctggaccaagtgggtgagaatgagaaaggactgcaacgccagacagcacagcggcggcaacatcgaggacgtggacggcggcggcgcccccaccaccggcggcaacaacgcccccagcggcggcagccaggagagcagcgccgagcagcccagaaagggcggcgcccagcacggcgtgagcagctgcgagggcacccagagaaccggcagaagaaagggcagaagccagagcgtgcaggcccacagcgccctgagccagagaccccccatgctgagcagcagcggccccatcctggagagcagacagaccttcctgcagaccagcaccagcgtgcacgagctggcccagagactgagcggcagcagactgagcctgcacgccagcgccaccagcctgcacagccagcccccccccgtgaccaccaccggccacctgagcgtgagagagagagccgaggccctgatcagaagcagcctgggcagcagcaccagcagcaccctgagcttcctgttcggcaagagaagcttcagcagcgccctggtgatcagcggcctgagcgccgccgagggcggcaacaccagcgacacccagagcagcagcagcgtgaacatcgtgatgggccccagcgccagagccgccagccaggccaccagacacctgagcgagccctgcgagccccccgacgccaccgagcagggccagctgcacgacagatgcctggccgaggccgtggccgacaccctgggcgtggtgtgcagaagagccagccaggaggacatgggcctggacgacaccgccagccagcagagcgtgagcgacgagcagtag

SEQ ID NO: 20759 - DNA, 2334 bp, Artificial Sequence
  Description of Artificial Sequence: Synthetic coding sequence
atgaccttctaccccttcgtggccagcagcagcaccagaagagtggacaacagcaacaccagactggccgtgcagatcgagagagaccccggcaacgacgacaacaacctgaacagcatcttctacgagcacctgaccagaaccctgcaggagagcctgtgcggcgacctggtgctgggcagatggggcaactacagcagcggcgactgcttcatcctggccagcgacgacctgaacgccttcgtgcacctgatcgagatcggcaacggcctggtgaccttccagctgagaggcctggagttcagaggcacctactgccagcagagagaggtggaggccatcatggagggcgacgaggaggacagaggctgctgctgctgcaagcccggccacctgccccacctgctgagctgcaacgccgccttccacctgagatggctgacctgggagatcacccagacccagtacatcctggagggctacagcatcctggacaacaacgccgccaccatgctgcaggtgttcgacctgagaagaatcctgatcagatactacatcaagagcatcatctactacatggtgaccagccccaagctgctgagctggatcaagaacgagagcctgctgaagagcctgcagcccttcgccaagtggcactacatcgagagagacctggccatgttcaacatcaacatcgacgacgactacgtgccctgcctgcagggcatcaccagagccagcttctgcaacgtgtacctggagtggatccagcactgcgccagaaagagacaggagcccagcaccaccctggacagcgacgaggacagccccctggtgaccctgagcttcgccctgtgcaccctgggcagaagagccctgggcaccgccgcccacaacatggccatcagcctggacagcttcctgtacggcctgcacgtgctgttcaagggcgacttcagaatcaccgccagagacgagtgggtgttcgccgacatggacctgctgcacaaggtggtggcccccgccatcagaatgagcctgaagctgcaccaggaccagttcacctgccccgacgagtacgaggaccccgccgtgctgtacgaggccatccagagcttcgagaagaaggtggtgatctgccacgagggcgaccccgcctggagaggcgccgtgctgagcaacaaggaggagctgctgaccctgagacacgtggtggacgagggcgccgacgagtacaaggtgatcatgctgcacagaagcttcctgagcttcaaggtgatcaaggtgaacaaggagtgcgtgagaggcctgtgggccggccagcagcaggagctgatcttcctgagaaacagaaaccccgagagaggcagcatccagaacaacaagcaggtgctgagaaacctgatcaacagcagctgcgaccagcccctgggctaccccatgtacgtgagccccctgaccaccagctacctgggcacccacagacagctgaagaacatctggggcggccccatcaccctggacagaatcagaacctggttctggaccaagtgggtgagaatgagaaaggactgcaacgccagacagcacagcggcggcaacatcgaggacgtggacggcggcggcgcccccaccaccggcggcaacaacgcccccagcggcggcagccaggagagcagcgccgagcagcccagaaagggcggcgcccagcacggcgtgagcagctgcgagggcacccagagaaccggcagaagaaagggcagaagccagagcgtgcaggcccacagcgccctgagccagagaccccccatgctgagcagcagcggccccatcctggagagcagacagaccttcctgcagaccagcaccagcgtgcacgagctggcccagagactgagcggcagcagactgagcctgcacgccagcgccaccagcctgcacagccagcccccccccgtgaccaccaccggccacctgagcgtgagagagagagccgaggccctgatcagaagcagcctgggcagcagcaccagcagcaccctgagcttcctgttcggcaagagaagcttcagcagcgccctggtgatcagcggcctgagcgccgccgagggcggcaacaccagcgacacccagagcagcagcagcgtgaacatcgtgatgggccccagcgccagagccgccagccaggccaccagagtgagaggctgggccggcctgaccagaaccggctgggacggcggcaccggcagctggcccgagagaggcacctgcctggccttcccccccttctgcctgcagaaccccatccccttcagcatgggcctgcccgagtag

SEQ ID NO: 20760 - DNA, 861 bp, Artificial Sequence
  Description of Artificial Sequence: Synthetic coding sequence
atgcacgtgttcatcgacgagcacggcgagatcagaagctgctacctgaagagcggcaaccagaaggagggccccctgcagcccctgcccagcaacaacgactgcctgagccaggccagagagatgcaggtgagcagcagcagcaccaccaccagcgagagccaggaccccagcagcggcgaccccgccgtgagcgccctgcagcagcagctgctgctgatggtggccagaagaacccagagcgagacccccagacacgtgagccaggacctggaggccagcagctgcagcagcacccagggcaagttcaacagagagcagttctacaagttcatcatcttccccggcaagtggatcaaggtgtggtacgacagactgaccctgctggccctgctggacagaaccgaggacatcaaggagaacgtgctggccatcctgctgatcgtgctggtgagcctgctgggcttcctgaccctgagccagggcttctgcaaggacatgtgggtgctgctgttctgcctggtgatggccagctgccagtacagcctgctgaagagcgtgcagcccgaccccgccagccccatccacggccacaaccagatcatcacctacagcagacccatctacttctgcgtgctgtgcggcctgatcctgctgctggacaccggcgccaaggccagacacccccccagctacgtggtgtacggcctgaagctgttcagccccgtgttcctgcagagcgccagagactacctgatcggcaagatcatgaacagccacaaggacttcttcaccagcgagaagaagaaggacaagatcatcagcgccatcagcagcgtgatcttcctgaagagctggtag

SEQ ID NO: 20761 - DNA, 6105 bp, Artificial Sequence
  Description of Artificial Sequence: Synthetic coding sequence
atgggcagccaggtgctgcagatcctgagacagggcgtgtgggccagcctgaccggcggctggttcttcgacccccaccagagcaccttcagcaactgcttccacctgtacgtgtggatcttcctgctgatcttccccttcctgctgtacatggtgctgccccccagcctgatggtggccggcgtgtactgcctggtggtggccgtgatcttcgccaccatcaagaccgtgaactacagactgcacgccatgttcgaccagggcgagatcgtggagaagagaagcagcaccatgggcgagctggaggaggagcccgcccagggcgacagcaacccccccagagaccccggcgtggagatgaccgtgttcagaaaggtgagcagcaccccccccgtgagatgcagcagccagcacagcgtgttcggcttcaaccaggtgagcgagctgctgcccagaatggaggacagcggccccctgagagacatcaaggagctggtgagagagcagggcagcaacaacgtgatcgtgaccagcgccgacagagagatgctgaagctgagcagccaggagaagctgatcggcgacctgccccagaccccccccggcgccgtgcccgaccccagcctggccagcaccgacagcagcgagcccagccccctggccggcgacggcgccccctggagcggcagcagcatggccgacacccccatgagccccctgctgaagggcagcctgagccaggagctgagcaagagcttcctgaccctgacccagcccgacagagccctggtgagaaccagcagcagaagagagcagagaagaggcgccggcggctaccagcccctggacagaagaggcagcggcgagcccaccccccagaaggccggcagcagcgacagctgcttcagcggcaccgacagagagaccctgagcagcttcaagagcgagaagaccaacagcacccacctggacagcccccccggcggccccgcccccgagggcagcgacaccgacccccccagcgaggccgagctgcccgccagccccgacgccggcgtgcccagcgacgacaccctgagaagcttcgacaccgtgatcggcgccggcaccccccccggcctggccgagcccctgctggtggtgagacccaaggacctggccctgctgagacccagcaagagacagccccccctgagaagacacagcccccccggcagagcccccagaagacccctgctggagggcggcggcttcttcgaggacgaggacaccagcgagggcagcgagctgagccccgccagcagcctgagaagccagagaagatacagcaccgacagcagcagcagcaccagctgctacagccccgagagcagcagaggcgccgccggcggccccagaaagagaagagccccccacggcgccgaggagggcaccgccgtgccccccaagagaccctacggcacccagagaacccccagcaccgccagcgccaagacccacgccagagtgctgagcatggacggcgccggcggcgacgtgctgagaccccccctggccggctgcaaggccgagctggaggcccaggtgggcgtggagcaggccgccagcgagcccgtggtgctgcccgccgaggccagaagaggccccgccgccaaccagcccggctggagaggcgagctgcaggaggagggcgccgtgggcggcgccgccgaggagaccggcagaagagacagaagcagcagcgtgagaagaacccaggccatcagaagaagacacaacgccggcagcaaccccaccccccccgccagcgtgatgggcagcccccccagcagcctgcaggaggcccagagaggcagagccgccagccacagcagagccctgaccctgcccagcgccctgcacttcgccagcagcctgctgctgaccagagccggcgccaacgtgcacgaggcctgcaccttcgacgacaccagcgagggcgccgtgcactacttctacgacgagagcggcgtgagaagaagctacaccttcggcctggccggcggcggctacgagaaccccgtgggccagcagggcgagcagaccgccaacggcgcctgggacagacacagccacagcagcagcttccacagcgccgacgtgcccgaggccaccggcggcctgaacctgctgcagcccagacccgtggtgctgcagggcatgcaggtgagaagagtgcccctggagatccccgaggagcagaccctgatggaggaggccccccccagagcccagcacagctacaagtactggctgctgcccggcagatggaccagcgtgagatacgagagactggccctgctggccctgctggacagaaccagaggcgtgctggagaacatcttcggcgtgggcctgagcagcctggtggccttcctgggctacctgctgctgctgaagggcttcttcaccgacatctgggtgttccagttctgcctggtgatcgccagctgccagtacagcctgctgaagagcgtgcagcccgacgccgccagccccatgcacggccacaactgggtgatcgcctacagcagacccgtgtacttctgcatctgctgcctgctgatctggctgctggacgccctgggcagcgcccagcccttcccccccgtgagcctgtacggcctgaccctgttcagcgccagcttcttcttctgcgccagagacgtggccaccgtgttcaccctgtgcttccccttcgtgttcctgctgggcctgctgccccaggtgaacacctgcctgatgtacctgctggagcagatcgacatgcacggcttcggcggcaccgccgccaccagccccctgaccgccgtgttcagcctgagcagaagcctgctggccgccgccctgctgtacggcttctgcctgggcgccatcaagaccccctggcccgagcagcacgtgcccgtgctgttcagcgtgttctgcggcctgctggtggccctgagctaccacctgagcagacagagcagcgaccccaccgtgctgtggagcctgatcagaagcaagctgttccccgagctggaggagagaagcctggagaccgccagagccgagccccccgaccccctgcccgacaagatgagacagagcgtgagagaggtgctgcacagcgacctggtgatgtgcgtggtgatcgccgtgctgaccttcgccatcagcgccagcaccgtgttcatcgccctgaagagcgtgctgggcttcgtgctgtacgccctggccggcgccgtgggcttcttcacccactacctgctgccccagctgagaaagcagctgccctggttctgcctgagccagcccgtgctgaagcccctggagtacagccagtacgaggtgagaggcgccgcccaggtgatgtggttcgagaagctgtacgccggcctgcagtgcgtggagaagtacctgatctaccccgccgtggtgctgaacgccctgaccgtggacgcccacaccgtggtgagccaccccgacaagtactgcttctactgcagagccctgctgatgaccgtggccggcctgaagctgctgagaagcgccttctgctgccccccccagcagtacctgaccctggccttcaccgtgctgctgttccacttcgactaccccagactgagccagggcttcctgctggactacttcctgatgagcctgctgtgcagcaagctgtgggacctgctgtacaagctgagattcgtgctgacctacatcgccccctggcagatcacctggggcagcgccttccacgccttcgcccagcccttcgccgtgccccacagcgccatgctgttcgtgcaggccctgctgagcggcctgttcagcacccccctgaaccccctgctgggcagcgccgtgttcatcatgagctacgccagacccctgaagttctgggagagagactacaacaccaagagagtggaccacagcaacaccagactggtgacccagctggacagaaaccccggcgccgacgacaacaacctgaacagcatcttctacgagcacctgaccagaagcctgcagcacaccctgtgcggcgacctggtgctgggcagatggggcaactacggccccggcgactgcttcgtgctggccagcgactacctgaacgccctggtgcacctgatcgaggtgggcaacggcctggtgaccttccagctgagaggcctggagttcagaggcacctactgccagcagagagaggtggaggccatcaccgagggcgtggaggaggacgagggctgctgctgctgcgagcccggccacctgcccagagtgctgagcttcaacgccgccttcggccagagatggctggcctgggaggtgaccgccagcaagtacgtgctggagggctacagcatcagcgacaacaacgccgccagcatgctgcaggtgttcgacctgagaaagatcctgatcacctactacgtgaagagcatcatctactacgtgagcagaagccccaagctggaggtgtggctgagccacgagggcatcaccgccgccctgagacccgtgagagtgcccggctacgccgacagcgaccccaccttcagcctgagcgtggacgaggactacgacctgagactgagcggcctgagcctgcccagcttctgcgccgtgcacctggagtggatccagtactgcgccagcagaagaagccagcccgtggaccaggactggaacagccccctggtgaccctgtgcttcggcctgtgcgtgctgggcagaagagccctgggcaccgccagccacagcatgagcgccagcctggagcccttcctgtacggcctgcacgccctgttcaagggcgacttcagaatcaccagccccagagacgagtgggtgttcgccgacatggacctgctgcacagagtggtggcccccggcgtgagaatggccctgaagctgcaccaggaccacttcaccagccccgacgagtacgaggagcccgccgccctgtacgacgccatcgccgccaacgaggagagactggtgatcagccacgagggcgaccccgcctggagaagcgccatcctgagcaacacccccagcctgctggccctgagacacgtgctggacgacgccagcgacgagtacaagatcatcatgctgaacagaagacacctgagcttcagagtgatcaaggtgaacagagagtgcgtgagaggcctgtgggccggccagcagcaggagctggtgttcctgagaaacagaaaccccgagagaggcagcatccagaacgccaagcaggccctgagaaacatgatcaacagcagctgcgaccagcccctgggctaccccatctacgtgagccccctgaccaccagcctggccggcagccacccccagctgagagccctgtggggcggccccatcagcctgggcgccatcgcccactggctgctgagaacctgggagagactgcacaagggctgcggcgccggctgcaacagcggcggcaacgtggacgacagcgactgcagcggcggcggcggcctgaccagcctgagcaacaacccccccgtggcccaccccacccccgagaacaccgccggcaacggcgaccagcccctgccccccggccccggctggggccccagaagcagcctgagcggcagcggcgacggcagacccccccccctgctgcagtggcccccccccagactgcccggccccccccccgccagccccatccccaccgagggccccagaaccagcagaccccccggccccggcctgctgagcagcgagggccccagcggcaagtggagcctgggcggcagaaagggcctgggcggcagcgacggcgagcccgccagcggcagccccaagggcggcacccccaagagccaggcccccctggacctgagcctgagcctgagcctgagcctgagccccgacgtgagcaccgaggccagcccccccagagccagccaggacatcccctgcctggacagcagcgcccccgagagcggcacccccatgggcgccctgggcgactggcccgcccccatcgaggagagagagagccccgccgcccagcccctgctggagcaccagtactag

SEQ ID NO: 20762 - DNA, 1167 bp, Artificial Sequence
  Description of Artificial Sequence: Synthetic coding sequence
atggtgagagacagcatggccgccgccttcagacccagcaacagagtgctgctgcaggccctgcagatcctggtgtaccccggcgtgggcggcagcggcagcgtgagctgcagatgccccctgggcgccaagagatacctgctgaccgacaacgtggtgaagctgaaggagttccagcagaagaaggtggccgtggcctgcaacctgagcggcaccaaggagacctacttcagaaacctgaagaagaagctgacccagaacaagctgatcctgaagggcgagctgatcaccctgctgcacctgtgcgagagcagagaccacgtggagctggccaagaacgtgatctacagataccacgccgagaacaagaacttcaccctgggcgagtacaagttcggccccctgttcgtgagactgtgctacgagctggacctggaggagagcgccgtggagctgatgaaggaccagcacctgagaggcttcttcagcgacagcaccagcttcaacatcctgatggacatgctgttcatcaagggcaagtacaagagcgccctgcaggtgctgatcgagatgaagaaccaggacgtgaagttcaccaaggacacctacgtgctggccttcgccatctgctacaagctgaacagccccgagagcttcaagatctgcaccaccctgagagaggaggccctgctgaagggcgagatcctgagcagaagagccagctgcttcgccgtggccctggccctgaaccagaacgagatggccaaggccgtgagcatcttcagccagatcatgaaccccgagagcatcgcctgcatcaacctgaacatcatcatccacatccagagcaacatgctggagaacctgatcaagaccctgaagaacgccgccgagggcaacctgagcaagttcgtgaagagacacgtgttcagcgaggaggtgctggccaaggtgagagagaaggtgaaggacgtgcccgccctggtggccaagttcgacgagatctacggcaccctgcacatcaccggccaggtgaccaccgacagcctggacgccgtgctgtgccacacccccagagacagaaagagccacaccctgctgctgaacaagagaatggtgagcagaagaaccttccagcccctgagccagagcctgctggccgagtag

SEQ ID NO: 20763 - DNA, 1167 bp, Artificial Sequence; identical to SEQ ID NO: 20762
  Description of Artificial Sequence: Synthetic coding sequence

SEQ ID NO: 20764 - DNA, 651 bp, Artificial Sequence
  Description of Artificial Sequence: Synthetic coding sequence
atgtggaactggctgaagatgagcttcaccggcgccctgcaggtgctgatcgagatgaagaaccaggacgtgaagttcaccaaggacacctacgtgctggccttcgccatctgctacaagctgaacagccccgagagcttcaagatctgcaccaccctgagagaggaggccctgctgaagggcgagatcctgagcagaagagccagctgcttcgccgtggccctggccctgaaccagaacgagatggccaaggccgtgagcatcttcagccagatcatgaaccccgagagcatcgcctgcatcaacctgaacatcatcatccacatccagagcaacatgctggagaacctgatcaagaccctgaagaacgccgccgagggcaacctgagcaagttcgtgaagagacacgtgttcagcgaggaggtgctggccaaggtgagagagaaggtgaaggacgtgcccgccctggtggccaagttcgacgagatctacggcaccctgcacatcaccggccaggtgaccaccgacagcctggacgccgtgctgtgccacacccccagagacagaaagagccacaccctgctgctgaacaagagaatggtgagcagaagaaccttccagcccctgagccagagcctgctggccgagtag

SEQ ID NO: 20765 - DNA, 486 bp, Artificial Sequence
  Description of Artificial Sequence: Synthetic coding sequence
atggtgagagacagcatggccgccgccttcagacccagcaacagagtgctgctgcaggccctgcagatcctggtgtaccccggcgtgggcggcagcggcagcgtgagctgcagatgccccctgggcgccaagagatacctgctgaccgacaacgtggtgaagctgaaggagttccagcagaagaaggtggccgtggcctgcaacctgagcggcaccaaggagacctacttcagaaacctgaagaagaagctgacccagaacaagctgatcctgaagggcgagctgatcaccctgctgcacctgtgcgagagcagagaccacgtggagctggccaagaacgtgatctacagataccacgccgagaacaagaacttcaccctgggcgagtacaagttcggccccctgttcgtgagactgtgctacgagctggacctggaggagagcgccgtggagctgatgaaggaccaggtgctgtgcaagtactag

SEQ ID NO: 20766 - DNA, 2070 bp, Artificial Sequence
  Description of Artificial Sequence: Synthetic coding sequence
atggccgtggtgagcgccgtgagatggctgggcctgagaagcagactgggccagcccctgaccggcagaagagccggcctgtgcgagcaggccagaagctgcagattctacagcggcagcgccaccctgagcaaggtggagggcaccgacgtgaccggcatcgaggaggtggtgatccccaagaagaagacctgggacaaggtggccgtgctgcaggccctggccagcaccgtgaacagagacaccaccgccgtgccctacgtgttccaggacgacccctacctgatgcccgccagcagcctggagagcagaagcttcctgctggccaagaagagcggcgagaacgtggccaagttcatcatcaacagctaccccaagtacttccagaaggacatcgccgagccccacatcccctgcctgatgcccgagtacttcgagccccagatcaaggacatcagcgaggccgccctgaaggagagaatcgagctgagaaaggtgaaggccagcgtggacatgttcgaccagctgctgcaggccggcaccaccgtgagcctggagaccaccaacagcctgctggacctgctgtgctactacggcgaccaggagcccagcaccgactaccacttccagcagaccggccagagcgaggccctggaggaggagaacgacgagaccagcagaagaaaggccggccaccagttcggcgtgacctggagagccaagaacaacgccgagagaatcttcagcctgatgcccgagaagaacgagcacagctactgcaccatgatcagaggcatggtgaagcacagagcctacgagcaggccctgaacctgtacaccgagctgctgaacaacagactgcacgccgacgtgtacaccttcaacgccctgatcgaggccaccgtgtgcgccatcaacgagaagttcgaggagaagtggagcaagatcctggagctgctgagacacatggtggcccagaaggtgaagcccaacctgcagaccttcaacaccatcctgaagtgcctgagaagattccacgtgttcgccagaagccccgccctgcaggtgctgagagagatgaaggccatcggcatcgagcccagcctggccacctaccaccacatcatcagactgttcgaccagcccggcgaccccctgaagagaagcagcttcatcatctacgacatcatgaacgagctgatgggcaagagattcagccccaaggaccccgacgacgacaagttcttccagagcgccatgagcatctgcagcagcctgagagacctggagctggcctaccaggtgcacggcctgctgaagaccggcgacaactggaagttcatcggccccgaccagcacagaaacttctactacagcaagttcttcgacctgatctgcctgatggagcagatcgacgtgaccctgaagtggtacgaggacctgatccccagcgcctacttcccccacagccagaccatgatccacctgctgcaggccctggacgtggccaacagactggaggtgatccccaagatctggaaggacagcaaggagtacggccacaccttcagaagcgacctgagagaggagatcctgatgctgatggccagagacaagcacccccccgagctgcaggtggccttcgccgactgcgccgccgacatcaagagcgcctacgagagccagcccatcagacagaccgcccaggactggcccgccaccagcctgaactgcatcgccatcctgttcctgagagccggcagaacccaggaggcctggaagatgctgggcctgttcagaaagcacaacaagatccccagaagcgagctgctgaacgagctgatggacagcgccaaggtgagcaacagccccagccaggccatcgaggtggtggagctggccagcgccttcagcctgcccatctgcgagggcctgacccagagagtgatgagcgacttcgccatcaaccaggagcagaaggaggccctgagcaacctgaccgccctgaccagcgacagcgacaccgacagcagcagcgacagcgacagcgacaccagcgagggcaagtag

SEQ ID NO: 20767 - DNA, 627 bp, Artificial Sequence
  Description of Artificial Sequence: Synthetic coding sequence
atggccgtggtgagcgccgtgagatggctgggcctgagaagcagactgggccagcccctgaccggcagaagagccggcctgtgcgagcaggccagaagctgcagattctacagcggcagcgccaccctgagcaaggtggagggcaccgacgtgaccggcatcgaggaggtggtgatccccaagaagaagacctgggacaaggtggccgtgctgcaggccctggccagcaccgtgaacagagacaccaccgccgtgccctacgtgttccaggacgacccctacctgatgcccgccagcagcctggagagcagaagcttcctgctggccaagaagagcggcgagaacgtggccaagttcatcatcaacagctaccccaagtacttccagaaggacatcgccgagccccacatccccgagcccctgtgcctgctgaagcagcagatcgtgagctggatctactgcgtgaccatggtgaccagaagcccccagctgatcaccatcttcaacaagctggacagccagaagcactggaagagaaagatgatgagacacctgggcggcaagctggtgatcagcctggagctgcacggcgagcagaagaccaccctgagagagagcttcctgtag

SEQ ID NO: 20768 - DNA, 1470 bp, Artificial Sequence
  Description of Artificial Sequence: Synthetic coding sequence
atggccgccgccgccgccagagtggtgctgagcagcgccgccagaagaagactgtggggcttcagcgagagcctgctgatcagaggcgccgccggcagaagcctgtacttcggcgagaacagactgagaagcacccaggccgccacccaggtggtgctgaacgtgcccgagaccagagtgacctgcctggagagcggcctgagagtggccagcgaggacagcggcctgagcacctgcaccgtgggcctgtggatcgacgccggcagcagatacgagaacgagaagaacaacggcaccgcccacttcctggagcacatggccttcaagggcaccaagaagagaagccagctggacctggagctggagatcgagaacatgggcgcccacctgaacgcctacaccagcagagagcagaccgtgtactacgccaaggccttcagcaaggacctgcccagagccgtggagatcctggccgacatcatccagaacagcaccctgggcgaggccgagatcgagagagagagaggcgtgatcctgagagagatgcaggaggtggagaccaacctgcaggaggtggtgttcgactacctgcacgccaccgcctaccagaacaccgccctgggcagaaccatcctgggccccaccgagaacatcaagagcatcagcagaaaggacctggtggactacatcaccacccactacaagggccccagaatcgtgctggccgccgccggcggcgtgagccacgacgagctgctggacctggccaagttccacttcggcgacagcctgtgcacccacaagggcgagatccccgccctgcccccctgcaagttcaccggcagcgagatcagagtgagagacgacaagatgcccctggcccacctggccatcgccgtggaggccgtgggctgggcccaccccgacaccatctgcctgatggtggccaacaccctgatcggcaactgggacagaagcttcggcggcggcatgaacctgagcagcaagctggcccagctgacctgccacggcaacctgtgccacagcttccagagcttcaacaccagctacaccgacaccggcctgtggggcctgtacatggtgtgcgagagcagcaccgtggccgacatgctgcacgtggtgcagaaggagtggatgagactgtgcaccagcgtgaccgagagcgaggtggccagagccagaaacctgctgaagaccaacatgctgctgcagctggacggcagcacccccatctgcgaggacatcggcagacagatgctgtgctacaacagaagaatccccatccccgagctggaggccagaatcgacgccgtgaacgccgagaccatcagagaggtgtgcaccaagtacatctacaacagaagccccgccatcgccgccgtgggccccatcaagcagctgcccgacttcaagcagatcagaagcaacatgtgctggctgagagactag

SEQ ID NO: 20769 - DNA, 1212 bp, Artificial Sequence
  Description of Artificial Sequence: Synthetic coding sequence
atggccttcaagggcaccaagaagagaagccagctggacctggagctggagatcgagaacatgggcgcccacctgaacgcctacaccagcagagagcagaccgtgtactacgccaaggccttcagcaaggacctgcccagagccgtggagatcctggccgacatcatccagaacagcaccctgggcgaggccgagatcgagagagagagaggcgtgatcctgagagagatgcaggaggtggagaccaacctgcaggaggtggtgttcgactacctgcacgccaccgcctaccagaacaccgccctgggcagaaccatcctgggccccaccgagaacatcaagagcatcagcagaaaggacctggtggactacatcaccacccactacaagggccccagaatcgtgctggccgccgccggcggcgtgagccacgacgagctgctggacctggccaagttccacttcggcgacagcctgtgcacccacaagggcgagatccccgccctgcccccctgcaagttcaccggcagcgagatcagagtgagagacgacaagatgcccctggcccacctggccatcgccgtggaggccgtgggctgggcccaccccgacaccatctgcctgatggtggccaacaccctgatcggcaactgggacagaagcttcggcggcggcatgaacctgagcagcaagctggcccagctgacctgccacggcaacctgtgccacagcttccagagcttcaacaccagctacaccgacaccggcctgtggggcctgtacatggtgtgcgagagcagcaccgtggccgacatgctgcacgtggtgcagaaggagtggatgagactgtgcaccagcgtgaccgagagcgaggtggccagagccagaaacctgctgaagaccaacatgctgctgcagctggacggcagcacccccatctgcgaggacatcggcagacagatgctgtgctacaacagaagaatccccatccccgagctggaggccagaatcgacgccgtgaacgccgagaccatcagagaggtgtgcaccaagtacatctacaacagaagccccgccatcgccgccgtgggctacaaccacagaagcgagctgcacgagtggaagtggaacaagctgttcagcaagagacagaccatcagctacagctacgtgaacatcctgctgccccagccccagccccagtacgtgtag

SEQ ID NO: 20770 - DNA, 645 bp, Artificial Sequence
  Description of Artificial Sequence: Synthetic coding sequence
atgagacccggcggcttcctgggcgccggccagagactgagcagagccatgagcagatgcgtgctggagcccagaccccccggcaagagatggatggtggccggcctgggcaaccccggcctgcccggcaccagacacagcgtgggcatggccgtgctgggccagctggccagaagactgggcgtggccgagagctggaccagagacagacactgcgccgccgacctggccctggcccccctgggcgacgcccagctggtgctgctgagacccagaagactgatgaacgccaacggcagaagcgtggccagagccgccgagctgttcggcctgaccgccgaggaggtgtacctggtgcacgacgagctggacaagcccctgggcagactggccctgaagctgggcggcagcgccagaggccacaacggcgtgagaagctgcatcagctgcctgaacagcaacgccatgcccagactgagagtgggcatcggcagacccgcccaccccgaggccgtgcaggcccacgtgctgggctgcttcagccccgccgagcaggagctgctgcccctgctgctggacagagccaccgacctgatcctggaccacatcagagagagaagccagggccccagcctgggcccctag

SEQ ID NO: 20771 - DNA, 645 bp, Artificial Sequence; identical to SEQ ID NO: 20770
  Description of Artificial Sequence: Synthetic coding sequence

SEQ ID NO: 20772 - DNA, 4074 bp, Artificial Sequence
  Description of Artificial Sequence: Synthetic coding sequence
atgcagaccctgggcagcttcttcggcagcctgcccggcttcagcagcgccagaaacctggtggccaacgcccacagcagcgccagagccagacccgccgccgaccccaccggcgcccccgccgccgaggccgcccagccccaggcccaggtggccgcccaccccgagcagaccgccccctggaccgagaaggagctgcagcccagcgagaagcagatggtgagcggcgccaaggacctggtgtgcagcaagatgagcagagccaaggacgccgtgagcagcggcgtggccagcgtggtggacgtggccaagggcgtggtgcagggcggcctggacaccaccagaagcgccctgaccggcaccaaggaggtggtgagcagcggcgtgaccggcgccatggacatggccaagggcgccgtgcagggcggcctggacaccagcaaggccgtgctgaccggcaccaaggacaccgtgagcaccggcctgaccggcgccgtgaacgtggccaagggcaccgtgcaggccggcgtggacaccaccaagaccgtgctgaccggcaccaaggacaccgtgaccaccggcgtgatgggcgccgtgaacctggccaagggcaccgtgcagaccggcgtggagaccagcaaggccgtgctgaccggcaccaaggacgccgtgagcaccggcctgaccggcgccgtgaacgtggccagaggcagcatccagaccggcgtggacaccagcaagaccgtgctgaccggcaccaaggacaccgtgtgcagcggcgtgaccggcgccatgaacgtggccaagggcaccatccagaccggcgtggacaccagcaagaccgtgctgaccggcaccaaggacaccgtgtgcagcggcgtgaccggcgccatgaacgtggccaagggcaccatccagaccggcgtggacaccagcaagaccgtgctgaccggcaccaaggacaccgtgtgcagcggcgtgaccggcgccatgaacgtggccaagggcaccatccagaccggcgtggacaccaccaagaccgtgctgaccggcaccaagaacaccgtgtgcagcggcgtgaccggcgccgtgaacctggccaaggaggccatccagggcggcctggacaccaccaagagcatggtgatgggcaccaaggacaccatgagcaccggcctgaccggcgccgccaacgtggccaagggcgccatgcagaccggcctgaacaccacccagaacatcgccaccggcaccaaggacaccgtgtgcagcggcgtgaccggcgccatgaacctggccagaggcaccatccagaccggcgtggacaccaccaagatcgtgctgaccggcaccaaggacaccgtgtgcagcggcgtgaccggcgccgccaacgtggccaagggcgccgtgcagggcggcctggacaccaccaagagcgtgctgaccggcaccaaggacgccgtgagcaccggcctgaccggcgccgtgaacgtggccaagggcaccgtgcagaccggcgtggacaccaccaagaccgtgctgaccggcaccaaggacaccgtgtgcagcggcgtgaccagcgccgtgaacgtggccaagggcgccgtgcagggcggcctggacaccaccaagagcgtggtgatcggcaccaaggacaccatgagcaccggcctgaccggcgccgccaacgtggccaagggcgccgtgcagaccggcgtggacaccgccaagaccgtgctgaccggcaccaaggacaccgtgaccaccggcctggtgggcgccgtgaacgtggccaagggcaccgtgcagaccggcatggacaccaccaagaccgtgctgaccggcaccaaggacaccatctacagcggcgtgaccagcgccgtgaacgtggccaagggcgccgtgcagaccggcctgaagaccacccagaacatcgccaccggcaccaagaacaccttcggcagcggcgtgaccagcgccgtgaacgtggccaagggcgccgcccagaccggcgtggacaccgccaagaccgtgctgaccggcaccaaggacaccgtgaccaccggcctgatgggcgccgtgaacgtggccaagggcaccgtgcagaccagcgtggacaccaccaagaccgtgctgaccggcaccaaggacaccgtgtgcagcggcgtgaccggcgccgccaacgtggccaagggcgccatccagggcggcctggacaccaccaagagcgtgctgaccggcaccaaggacgccgtgagcaccggcctgaccggcgccgtgaagctggccaagggcaccgtgcagaccggcatggacaccaccaagaccgtgctgaccggcaccaaggacgccgtgtgcagcggcgtgaccggcgccgccaacgtggccaagggcgccgtgcagatgggcgtggacaccgccaagaccgtgctgaccggcaccaaggacaccgtgtgcagcggcgtgaccggcgccgccaacgtggccaagggcgccgtgcagaccggcctgaagaccacccagaacatcgccaccggcaccaagaacaccctgggcagcggcgtgaccggcgccgccaaggtggccaagggcgccgtgcagggcggcctggacaccaccaagagcgtgctgaccggcaccaaggacgccgtgagcaccggcctgaccggcgccgtgaacctggccaagggcaccgtgcagaccggcgtggacaccagcaagaccgtgctgaccggcaccaaggacaccgtgtgcagcggcgtgaccggcgccgtgaacgtggccaagggcaccgtgcagaccggcgtggacaccgccaagaccgtgctgagcggcgccaaggacgccgtgaccaccggcgtgaccggcgccgtgaacgtggccaagggcaccgtgcagaccggcgtggacgccagcaaggccgtgctgatgggcaccaaggacaccgtgttcagcggcgtgaccggcgccatgagcatggccaagggcgccgtgcagggcggcctggacaccaccaagaccgtgctgaccggcaccaaggacgccgtgagcgccggcctgatgggcagcggcaacgtggccaccggcgccacccacaccggcctgagcaccttccagaactggctgcccagcacccccgccaccagctggggcggcctgaccagcagcagaaccaccgacaacggcggcgagcagaccgccctgagcccccaggaggcccccttcagcggcatcagcaccccccccgacgtgctgagcgtgggccccgagcccgcctgggaggccgccgccaccaccaagggcctggccaccgacgtggccaccttcacccagggcgccgcccccggcagagaggacaccggcctgctggccaccacccacggccccgaggaggcccccagactggccatgctgcagaacgagctggagggcctgggcgacatcttccaccccatgaacgccgaggagcaggcccagctggccgccagccagcccggccccaaggtgctgagcgccgagcagggcagctacttcgtgagactgggcgacctgggccccagcttcagacagagagccttcgagcacgccgtgagccacctgcagcacggccagttccaggccagagacaccctggcccagctgcaggactgcttcagactgatcgagaaggcccagcaggcccccgagggccagcccagactggaccagggcagcggcgccagcgccgaggacgccgccgtgcaggaggagagagacgccggcgtgctgagcagagtgtgcggcctgctgagacagctgcacaccgcctacagcggcctggtgagcagcctgcagggcctgcccgccgagctgcagcagcccgtgggcagagccagacacagcctgtgcgagctgtacggcatcgtggccagcgccggcagcgtggaggagctgcccgccgagagactggtgcagagcagagagggcgtgcaccaggcctggcagggcctggagcagctgctggagggcctgcagcacaacccccccctgagctggctggtgggccccttcgccctgcccgccggcggccagtag

SEQ ID NO: 20773 - DNA, 780 bp, Artificial Sequence
  Description of Artificial Sequence: Synthetic coding sequence
atggacgcctgggtgagattcagcgcccagagccaggccagagagagactgtgcagagccgcccagtacgcctgcagcctgctgggccacgccctgcagagacacggcgccagccccgagctgcagaagcagatcagacagctggagagccacctgagcctgggcagaaagctgctgagactgggcaacagcgccgacgccctggagagcgccaagagagccgtgcacctgagcgacgtggtgctgagattctgcatcaccgtgagccacctgaacagagccctgtacttcgcctgcgacaacgtgctgtgggccggcaagagcggcctggcccccagagtggaccaggagaagtgggcccagagaagcttcagatactacctgttcagcctgatcatgaacctgagcagagacgcctacgagatcagactgctgatggagcaggagagcagcgcctgcagcagaagactgaagggcagcggcggcggcgtgcccggcggcagcgagaccggcggcctgggcggccccggcacccccggcggcggcctgccccagctggccctgaagctgagactgcaggtgctgctgctggccagagtgctgagaggccacccccccctgctgctggacgtggtgagaaacgcctgcgacctgttcatccccctggacaagctgggcctgtggagatgcggccccggcatcgtgggcctgtgcggcctggtgagcagcatcctgagcatcctgaccctgatctacccctggctgagactgaagccctag

SEQ ID NO: 20774 - DNA, 246 bp, Artificial Sequence
  Description of Artificial Sequence: Synthetic coding sequence
cccggcggcggcctgccccagctggccctgaagctgagactgcaggtgctgctgctggccagagtgctgagaggccacccccccctgctgctggacgtggtgagaaacgcctgcgacctgttcatccccctggacaagctgggcctgtggagatgcggccccggcatcgtgggcctgtgcggcctggtgagcagcatcctgagcatcctgaccctgatctacccctggctgagactgaagccctag

SEQ ID NO: 20775 - DNA, 738 bp, Artificial Sequence
  Description of Artificial Sequence: Synthetic coding sequence
atgggcaagctgagagccgcccagtacgcctgcagcctgctgggccacgccctgcagagacacggcgccagccccgagctgcagaagcagatcagacagctggagagccacctgagcctgggcagaaagctgctgagactgggcaacagcgccgacgccctggagagcgccaagagagccgtgcacctgagcgacgtggtgctgagattctgcatcaccgtgagccacctgaacagagccctgtacttcgcctgcgacaacgtgctgtgggccggcaagagcggcctggcccccagagtggaccaggagaagtgggcccagagaagcttcagatactacctgttcagcctgatcatgaacctgagcagagacgcctacgagatcagactgctgatggagcaggagagcagcgcctgcagcagaagactgaagggcagcggcggcggcgtgcccggcggcagcgagaccggcggcctgggcggccccggcacccccggcggcggcctgccccagctggccctgaagctgagactgcaggtgctgctgctggccagagtgctgagaggccacccccccctgctgctggacgtggtgagaaacgcctgcgacctgttcatccccctggacaagctgggcctgtggagatgcggccccggcatcgtgggcctgtgcggcctggtgagcagcatcctgagcatcctgaccctgatctacccctggctgagactgaagccctag

SEQ ID NO: 20776 - DNA, 297 bp, Artificial Sequence
  Description of Artificial Sequence: Synthetic coding sequence
atgaaggtgagcgccgtgctgctgtgcctgctgctgatgaccgccgccttcaacccccagggcctggcccagcccgacgccctgaacgtgcccagcacctgctgcttcaccttcagcagcaagaagatcagcctgcagagactgaagagctacgtgatcaccaccagcagatgcccccagaaggccgtgatcttcagaaccaagctgggcaaggagatctgcgccgaccccaaggagaagtgggtgcagaactacatgaagcacctgggcagaaaggcccacaccctgaagacctag

SEQ ID NO: 20777 - DNA, 975 bp, Artificial Sequence
  Description of Artificial Sequence: Synthetic coding sequence
atggccgagcacggcgcccacttcaccgccgccagcgtggccgacgaccagcccagcatcttcgaggtggtggcccaggacagcctgatgaccgccgtgagacccgccctgcagcacgtggtgaaggtgctggccgagagcaaccccacccactacggcttcctgtggagatggttcgacgagatcttcaccctgctggacctgctgctgcagcagcactacctgagcagaaccagcgccagcttcagcgagaacttctacggcctgaagagaatcgtgatgggcgacacccacaagagccagagactggccagcgccggcctgcccaagcagcagctgtggaagagcatcatgttcctggtgctgctgccctacctgaaggtgaagctggagaagctggtgagcagcctgagagaggaggacgagtacagcatccacccccccagcagcagatggaagagattctacagagccttcctggccgcctaccccttcgtgaacatggcctgggagggctggttcctggtgcagcagctgagatacatcctgggcaaggcccagcaccacagccccctgctgagactggccggcgtgcagctgggcagactgaccgtgcaggacatccaggccctggagcacaagcccgccaaggccagcatgatgcagcagcccgccagaagcgtgagcgagaagatcaacagcgccctgaagaaggccgtgggcggcgtggccctgagcctgagcaccggcctgagcgtgggcgtgttcttcctgcagttcctggactggtggtacagcagcgagaaccaggagaccatcaagagcctgaccgccctgcccaccccccccccccccgtgcacctggactacaacagcgacagccccctgctgcccaagatgaagaccgtgtgccccaagaagaagaagaagaaggagagaaagaagaagaaggagagaaagaaggagagaagatag

SEQ ID NO: 20778 - DNA, 588 bp, Artificial Sequence
  Description of Artificial Sequence: Synthetic coding sequence
atggcccccgccgccagcagactgagagccgaggccggcctgggcgccctgcccagaagagccctggcccagtacctgctgttcctgagactgtaccccgtgctgaccaaggccgccaccagcggcatcctgagcgccctgggcaacttcctggcccagatgatcgagaagaagagaaagaaggagaacagcagaagcctggacgtgggcggccccctgagatacgccgtgtacggcttcttcttcaccggccccctgagccacttcttctacttcttcatggagcactggatcccccccgaggtgcccctggccggcctgagaagactgctgctggacagactggtgttcgcccccgccttcctgatgctgttcttcctgatcatgaacttcctggagggcaaggacgccagcgccttcgccgccaagatgagaggcggcttctggcccgccctgagaatgaactggagagtgtggacccccctgcagttcatcaacatcaactacgtgcccctgaagttcagagtgctgttcgccaacctggccgccctgttctggtacgcctacctggccagcctgggcaagtag

SEQ ID NO: 20779 - DNA, 504 bp, Artificial Sequence
  Description of Artificial Sequence: Synthetic coding sequence
atgcccttcaccggcgagagaagactgagcctgagaagacaggacgagggcggcctgctggccggcgccgaggacgagctggccggcgtggacgccaccaccgtgcaccagcaccagctgagacccagcgaggtgcccggcgccctgagacagcccggcagcagcgtgctggtgtgcctgcccggcctgctgggcgaggtgaccaccgccggcagaaccagcggcgccctgtggacctgggtgtggggcagccacccccccagcgagagcagaaccaaccccgtgagaatgagcctgaccctgaaccaggccagaaccaccgtgagcgaccagagagccgaggaggagagaggcatctggggcagaagagccggcgtgcaggccggccccctgcagagccagggccacgccgcccacctgccccaccaggccttccccgtgcccagaggctggctgcccggcgagggcccccacagcgaccccgccggcagcggcgccggctag

SEQ ID NO: 20780 - DNA, 216 bp, Artificial Sequence
  Description of Artificial Sequence: Synthetic coding sequence
atggccgcccccccccagctgagagccctgctggtggtggtgaacgccctgctgagaaagagaagataccacgccgccctggccgtgctgaagggcttcagaaacggcgccgtgtacggcgccaagatcagagccccccacgccctggtgatgaccttcctgttcagaaacggcagaagcacctgcacctgctgccacgccagctgcctgccctag

SEQ ID NO: 20781 - DNA, 639 bp, Artificial Sequence
  Description of Artificial Sequence: Synthetic coding sequence
atggccgcccccccccagctgagagccctgctggtggtggtgaacgccctgctgagaaagagaagataccacgccgccctggccgtgctgaagggcttcagaaacggcgccgtgtacggcgccaagatcagagccccccacgccctggtgatgaccttcctgttcagaaacggcagcctgcaggagaagctgtgggccatcctgcaggccacctacatccacagctggaacctggccagattcgtgttcacctacaagggcctgagagccctgcagagctacatccagggcaagacctaccccgcccacgccttcctggccgccttcctgggcggcatcctggtgttcggcgagaacaacaacatcaacagccagatcaacatgtacctgctgagcagagtgctgttcgccctgagcagactggccgtggagaagggctacatccccgagcccagatgggaccccttccccctgctgaccgccgtggtgtggggcctggtgctgtggctgttcgagtaccacagaagcaccctgcagcccagcctgcagagcagcatgacctacctgtacgaggacagcaacgtgtggcacgacatcagcgacttcctggtgtacaacaagagcagacccagcaactag

SEQ ID NO: 20782 - DNA, 528 bp, Artificial Sequence
  Description of Artificial Sequence: Synthetic coding sequence
atgatcagatgcggcctggcctgcgagagatgcagatggatcctgcccctgctgctgctgagcgaccacggccagaccagcagcctgtggtggaagtgcagccaggagggcggcggcagcggcagctacgaggagggctgccagagcctgatggagtacgcctggggcagagccgccgccgccatgctgttctgcggcttcatcatcctggtgatctgcttcatcctgagcttcttcgccctgtgcggcccccagatgctggtgttcctgagagtgatcggcggcctgctggccctggccgccgtgttccagatcatcagcctggtgatctaccccgtgaagtacacccagaccttcaccctgcacgccaaccccgccgtgacctacatctacaactgggcctacggcttcggctgggccgccaccatcatcctgatcggctgcgccttcttcttctgctgcctgcccaactacgaggacgacctgctgggcaacgccaagcccagatacttctacaccagcgcctag

SEQ ID NO: 20783 - DNA, 582 bp, Artificial Sequence
  Description of Artificial Sequence: Synthetic coding sequence
atgatcagatgcggcctggcctgcgagagatgcagatggatcctgcccctgctgctgctgagcgccatcgccttcgacatcatcgccctggccggcagaggctggctgcagagcagcgaccacggccagaccagcagcctgtggtggaagtgcagccaggagggcggcggcagcggcagctacgaggagggctgccagagcctgatggagtacgcctggggcagagccgccgccgccatgctgttctgcggcttcatcatcctggtgatctgcttcatcctgagcttcttcgccctgtgcggcccccagatgctggtgttcctgagagtgatcggcggcctgctggccctggccgccgtgttccagatcatcagcctggtgatctaccccgtgaagtacacccagaccttcaccctgcacgccaaccccgccgtgacctacatctacaactgggcctacggcttcggctgggccgccaccatcatcctgatcggctgcgccttcttcttctgctgcctgcccaactacgaggacgacctgctgggcaacgccaagcccagatacttctacaccagcgcctag

SEQ ID NO: 20784 - DNA, 1674 bp, Artificial Sequence
  Description of Artificial Sequence: Synthetic coding sequence
atggccgcccccatgctgagatggggctgcagaggcagaagatgggccttcgccagagtggacggcggcagctgccacagaagaggcgcccccaccggcagcaccagcaaccagatcagaggcgagagcagcgtggcccagcagcccctgcacaccgcccagaagaccagaaagggcgagcacaagtgggccgccgtggtgggcctggagatccacgcccagatcagcagcaacagcaagctgttcagcggcagccaggtgagattcagcgccccccccaacagcctggtgagcttcttcgacgccagcctgcccggcaccctgcccgtgctgaacagaagatgcgtggaggccgccgtgatgaccggcctggccctgaactgccacatcaacaagaagagcctgttcgacagaaagcactacttctacgccgacctgcccgccggctaccagatcacccagcagagactgcccatcgccgtgaacggcagcctgatctacggcgtgtgcgccggcaagaagcagagccaggtgatccccaagaccgtgagaatcaagcagatccagctggagcaggacagcggcaagagcctgcacgacaacctgagaagccagaccctgatcgacctgaacagagccggcgtgggcctgctggaggtggtgctggagcccgacatgagctgcggcgaggaggccgccaccgccgtgagagagctgcagctgatcctgcaggccctgggcaccagccaggccaacatggccgagggccagctgagagtggacgccaacatcagcgtgcaccaccccggcgagcccctgggcgtgagaaccgaggtgaagaacctgaacagcatcagattcctggccaaggccatcgactacgagatccagagacagatcaacgagctggagaacggcggcgagatcctgaacgagaccagaagcttccaccacaagctgggctgcaccatgagcatgagagacaaggagggcaagcaggactacagattcatgcccgagcccaacctgccccccctggtgctgtacgacgccaccagcctgcccgccggcgccgacccccagcaggtgatcaacatcgaccagatcagagagaccctgcccgagctgcccagcgtgaccagagagaagctggtgcagcagtacggcatgctgctggagcacagcttcaccctgctgaacgaggtgggcctgctggagttcttccagaacgtgatcaaggagaccagagccgagcccaagaaggtgaccagctgggtgctgaacaccttcctgggctacctgaagcagcagaacctggccgtgagcgagagccccgtgacccccagcgccctggccgagctgctggacctgctggacagcagaaccatcagcagcagcgccgccaagcaggtgttcgaggagctgtggaagagagagggcaagacccccggccagatcgtgagcgagaagcagctggagctgatgcaggaccagggcgccctggagcagctgtgccacagcgtgatggaggcccacccccaggtggtgatggacgtgaagaacagaaaccccagagccatcaacaagctgatcggcctggtgagaaaggccacccagagcagagccgaccccgtgatgatcaaggagatcctggagaagaagctgagcctgtag

SEQ ID NO: 20785 - DNA, 786 bp, Artificial Sequence
  Description of Artificial Sequence: Synthetic coding sequence
atgcacggcatcggccccagcggcagcttcaccgagttcctggaccccttccagagagtgatccagcccgaggagatctggctgtacaagaaccccctggtgcagagcgacaacatccccaccagactgatgttcgccatcagcttcctgacccccctggccgtgatctgcgtggtgaagatcatcagaagaaccgacaagaccgagatcaaggaggccttcctggccgtgagcctggccctggccctgaacggcgtgtgcaccaacaccatcaagctgatcgtgggcagacccagacccgacttcttctacagatgcttccccgacggcgtgatgaacagcgagatgcactgcaccggcgaccccgacctggtgagcgagggcagaaagagcttccccagcatccacagcagcttcgccttcagcggcctgggcttcaccaccttctacctggccggcaagctgcactgcttcaccgagagcggcagaggcaagagctggagactgtgcgccgccatcctgcccctgtactgcgccatgatgatcgccctgagcagaatgtgcgactacaagcaccactggcaggacagcttcgtgggcggcgtgatcggcctgatcttcgcctacatctgctacagacagcactacccccccctggccaacaccgcctgccacaagccctacgtgagcctgagagtgcccgccagcctgaagaaggaggagagacccaccgccgacagcgcccccagcctgcccctggagggcatcaccgagggccccgtgtag

SEQ ID NO: 20786 - DNA, 291 bp, Artificial Sequence
  Description of Artificial Sequence: Synthetic coding sequence
atgagagagctggccatcgagatcggcgtgagagccctgctgttcggcgtgttcgtgttcaccgagttcctggaccccttccagagagtgatccagcccgaggagatctggctgtacaagaaccccctggtgcagagcgacaacatccccaccagactgatgttcatccccctgtgggtggagagcagcgccagcttcctgcacaccttcgccaccgacagcaccatcctgctgtggcccacccagctggccatcaaccccaccctggtgtgcgagagccagccccactag

SEQ ID NO: 20787 - DNA, 816 bp, Artificial Sequence
  Description of Artificial Sequence: Synthetic coding sequence
atgagagagctggccatcgagatcggcgtgagagccctgctgttcggcgtgttcgtgttcaccgagttcctggaccccttccagagagtgatccagcccgaggagatctggctgtacaagaaccccctggtgcagagcgacaacatccccaccagactgatgttcgccatcagcttcctgacccccctggccgtgatctgcgtggtgaagatcatcagaagaaccgacaagaccgagatcaaggaggccttcctggccgtgagcctggccctggccctgaacggcgtgtgcaccaacaccatcaagctgatcgtgggcagacccagacccgacttcttctacagatgcttccccgacggcgtgatgaacagcgagatgcactgcaccggcgaccccgacctggtgagcgagggcagaaagagcttccccagcatccacagcagcttcgccttcagcggcctgggcttcaccaccttctacctggccggcaagctgcactgcttcaccgagagcggcagaggcaagagctggagactgtgcgccgccatcctgcccctgtactgcgccatgatgatcgccctgagcagaatgtgcgactacaagcaccactggcaggacagcttcgtgggcggcgtgatcggcctgatcttcgcctacatctgctacagacagcactacccccccctggccaacaccgcctgccacaagccctacgtgagcctgagagtgcccgccagcctgaagaaggaggagagacccaccgccgacagcgcccccagcctgcccctggagggcatcaccgagggccccgtgtag

SEQ ID NO: 20788 - DNA, 804 bp, Artificial Sequence
  Description of Artificial Sequence: Synthetic coding sequence
atgagagagctggccatcgagatcggcgtgagagccctgctgttcggcgtgttcgtgttcaccgagttcctggaccccttccagagagtgatccagcccgaggagatctggctgtacaagaaccccctggtgcagagcgacaacatccccaccagactgatgttcgccatcagcttcctgacccccctggccgtgatctgcgtggtgaagatcatcagaagaaccgacaagaccgagatcaaggaggccttcctggccgtgagcctggccctggccctgaacggcgtgtgcaccaacaccatcaagctgatcgtgggcagacccagacccgacttcttctacagatgcttccccgacggcgtgatgaacagcgagatgcactgcaccggcgaccccgacctggtgagcgagggcagaaagagcttccccagcatccacagcagcttcgccttcagcggcctgggcttcaccaccttctacctggccggcaagctgcactgcttcaccgagagcggcagaggcaagagctggagactgtgcgccgccatcctgcccctgtactgcgccatgatgatcgccctgagcagaatgtgcgactacaagcaccactggcaggacagcttcgtgggcggcgtgatcggcctgatcttcgcctacatctgctacagacagcactacccccccctggccaacaccgcctgccacaagccctacgtgagcctgagagtgcccgccagcctgaagaaggaggagagacccaccgccgacagcgcccccagcctgcccctggagggcatcacctag

SEQ ID NO: 20789 - DNA, 627 bp, Artificial Sequence
  Description of Artificial Sequence: Synthetic coding sequence
atgagagagctggccatcgagatcggcgtgagagccctgctgttcggcgtgttcgtgttcaccgagttcctggaccccttccagagagtgatccagcccgaggagatctggctgtacaagaaccccctggtgcagagcgacaacatccccaccagactgatgttcgccatcagcttcctgacccccctggccgtgatctgcgtggtgaagatcatcagaagaaccgacaagaccgagatcaaggaggccttcctggtggccttcagcggcctgggcttcaccaccttctacctggccggcaagctgcactgcttcaccgagagcggcagaggcaagagctggagactgtgcgccgccatcctgcccctgtactgcgccatgatgatcgccctgagcagaatgtgcgactacaagcaccactggcaggacagcttcgtgggcggcgtgatcggcctgatcttcgcctacatctgctacagacagcactacccccccctggccaacaccgcctgccacaagccctacgtgagcctgagagtgcccgccagcctgaagaaggaggagagacccaccgccgacagcgcccccagcctgcccctggagggcatcaccgagggccccgtgtag

SEQ ID NO: 20790 - DNA, 702 bp, Artificial Sequence
  Description of Artificial Sequence: Synthetic coding sequence
atgagagagctggccatcgagatcggcgtgagagccctgctgttcggcgtgttcgtgttcaccgagttcctggaccccttccagagagtgatccagcccgaggagatctggctgtacaagaaccccctggtgcagagcgacaacatccccaccagactgatgttcgccatcagcttcctgacccccctggccgtgatctgcgtggtgaagatcatcagaagaaccgacaagaccgagatcaaggaggccttcctggccgtgagcctggccctggccctgaacggcgtgtgcaccaacaccatcaagctgatcgtgggcagacccagacccgacttcttctacagatgcttccccgacggcgtgatgaacagcgagatgcactgcaccggcgaccccgacctggtgagcgagggcagaaagagcttccccagcatccacagcagcttcgccttcagcggcctgggcttcaccaccttctacctggccggcaagctgcactgcttcaccgagagcggcagaggcaagagctggagactgtgcgccgccatcctgcccctgtactgcgccatgatgatcgccctgagcagaatgtgcgactacaagcaccactggcaggtgggctgctgcgtgtggcagggcccccagagccacctgcccagcgccgccaaccccagactgtgcctgggcaccagcgagccctag

SEQ ID NO: 20791 - DNA, 456 bp, Artificial Sequence
  Description of Artificial Sequence: Synthetic coding sequence
atgcccgccagccagagcagagccagagccagagacagaaacaacgtgctgaacagagccgagttcctgagcctgaaccagccccccaagggcggccccgagcccagaagcagcggcagaaaggccagcggccccagcgcccagcccccccccgccggcgacggcgccagagagagaagacagagccagcagctgcccgaggaggactgcatgcagctgaaccccagcttcaagggcatcgccttcaacagcctgctggccatcgacatctgcatgagcaagagactgggcgtgtgcgccggcagagccgccagctgggccagcgccagaagcatggtgaagctgatcggcatcaccggccacggcatcccctggatcggcggcaccatcctgtgcctggtgaagagcagcaccctggccggccaggaggtgctgatgaacctgctgctggactag

SEQ ID NO: 20792 - DNA, 816 bp, Artificial Sequence
  Description of Artificial Sequence: Synthetic coding sequence
atgcccgccagccagagcagagccagagccagagacagaaacaacgtgctgaacagagccgagttcctgagcctgaaccagccccccaagggcggccccgagcccagaagcagcggcagaaaggccagcggccccagcgcccagcccccccccgccggcgacggcgccagagagagaagacagagccagcagctgcccgaggaggactgcatgcagctgaaccccagcttcaagggcatcgccttcaacagcctgctggccatcgacatctgcatgagcaagagactgggcgtgtgcgccggcagagccgccagctgggccagcgccagaagcatggtgaagctgatcggcatcaccggccacggcatcccctggatcggcggcaccatcctgtgcctggtgaagagcagcaccctggccggccaggaggtgctgatgaacctgctgctggccctgctgctggacatcatgaccgtggccggcgtgcagaagctgatcaagagaagaggcccctacgagaccagccccagcctgctggactacctgaccatggacatctacgccttccccgccggccacgccagcagagccgccatggtgagcaagttcttcctgagccacctggtgctggccgtgcccctgagagtgctgctggtgctgtgggccctgtgcgtgggcctgagcagagtgatgatcggcagacaccacgtgaccgacgtgctgagcggcttcgtgatcggctacctgcagttcagactggtggagctggtgtggatgcccagcagcacctgccagatgctgatcagcgcctggtag

SEQ ID NO: 20793 - DNA, 858 bp, Artificial Sequence
  Description of Artificial Sequence: Synthetic coding sequence
atgttcgacaagaccagactgccctacgtggccctggacgtgctgtgcgtgctgctggccagcatgcccatggccgtgctgaagctgggccagatctaccccttccagagaggcttcttctgcaaggacaacagcatcaactacccctaccacgacagcaccgtgaccagcaccgtgctgatcctggtgggcgtgggcctgcccatcagcagcatcatcctgggcgagaccctgagcgtgtactgcaacctgctgcacagcaacagcttcatcagaaacaactacatcgccaccatctacaaggccatcggcaccttcctgttcggcgccgccgccagccagagcctgaccgacatcgccaagtacagcatcggcagactgagaccccacttcctggacgtgtgcgaccccgactggagcaagatcaactgcagcgacggctacatcgagtactacatctgcagaggcaacgccgagagagtgaaggagggcagactgagcttctacagcggccacagcagcttcagcatgtactgcatgctgttcgtggccctgtacctgcaggccagaatgaagggcgactgggccagactgctgagacccaccctgcagttcggcctggtggccgtgagcatctacgtgggcctgagcagagtgagcgactacaagcaccactggagcgacgtgctgaccggcctgatccagggcgccctggtggccatcctggtggccgtgtacgtgagcgacttcttcaaggagagaaccagcttcaaggagagaaaggaggaggacagccacaccaccctgcacgagacccccaccaccggcaaccactaccccagcaaccaccagccctag

SEQ ID NO: 20794 - DNA, 855 bp, Artificial Sequence
  Description of Artificial Sequence: Synthetic coding sequence
atgttcgacaagaccagactgccctacgtggccctggacgtgctgtgcgtgctgctggccggcctgcccttcgccatcctgaccagcagacacacccccttccagagaggcgtgttctgcaacgacgagagcatcaagtacccctacaaggaggacaccatcccctacgccctgctgggcggcatcatcatccccttcagcatcatcgtgatcatcctgggcgagaccctgagcgtgtactgcaacctgctgcacagcaacagcttcatcagaaacaactacatcgccaccatctacaaggccatcggcaccttcctgttcggcgccgccgccagccagagcctgaccgacatcgccaagtacagcatcggcagactgagaccccacttcctggacgtgtgcgaccccgactggagcaagatcaactgcagcgacggctacatcgagtactacatctgcagaggcaacgccgagagagtgaaggagggcagactgagcttctacagcggccacagcagcttcagcatgtactgcatgctgttcgtggccctgtacctgcaggccagaatgaagggcgactgggccagactgctgagacccaccctgcagttcggcctggtggccgtgagcatctacgtgggcctgagcagagtgagcgactacaagcaccactggagcgacgtgctgaccggcctgatccagggcgccctggtggccatcctggtggccgtgtacgtgagcgacttcttcaaggagagaaccagcttcaaggagagaaaggaggaggacagccacaccaccctgcacgagacccccaccaccggcaaccactaccccagcaaccaccagccctag

SEQ ID NO: 20795 - DNA, 936 bp, Artificial Sequence
  Description of Artificial Sequence: Synthetic coding sequence
atgcagaactacaagtacgacaaggccatcgtgcccgagagcaagaacggcggcagccccgccctgaacaacaaccccagaagaagcggcagcaagagagtgctgctgatctgcctggacctgttctgcctgttcatggccggcctgcccttcctgatcatcgagaccagcaccatcaagccctaccacagaggcttctactgcaacgacgagagcatcaagtaccccctgaagaccggcgagaccatcaacgacgccgtgctgtgcgccgtgggcatcgtgatcgccatcctggccatcatcaccggcgagttctacagaatctactacctgaagaagagcagaagcaccatccagaacccctacgtggccgccctgtacaagcaggtgggctgcttcctgttcggctgcgccatcagccagagcttcaccgacatcgccaaggtgagcatcggcagactgagaccccacttcctgagcgtgtgcaaccccgacttcagccagatcaactgcagcgagggctacatccagaactacagatgcagaggcgacgacagcaaggtgcaggaggccagaaagagcttcttcagcggccacgccagcttcagcatgtacaccatgctgtacctggtgctgtacctgcaggccagattcacctggagaggcgccagactgctgagacccctgctgcagttcaccctgatcatgatggccttctacaccggcctgagcagagtgagcgaccacaagcaccaccccagcgacgtgctggccggcttcgcccagggcgccctggtggcctgctgcatcgtgttcttcgtgagcgacctgttcaagaccaagaccaccctgagcctgcccgcccccgccatcagaaaggagatcctgagccccgtggacatcatcgacagaaacaaccaccacaacatgatgtag

SEQ ID NO: 20796 - DNA, 867 bp, Artificial Sequence
  Description of Artificial Sequence: Synthetic coding sequence
atgcagagaagatgggtgttcgtgctgctggacgtgctgtgcctgctggtggccagcctgcccttcgccatcctgaccctggtgaacgccccctacaagagaggcttctactgcggcgacgacagcatcagatacccctacagacccgacaccatcacccacggcctgatggccggcgtgaccatcaccgccaccgtgatcctggtgagcgccggcgaggcctacctggtgtacaccgacagactgtacagcagaagcgacttcaacaactacgtggccgccgtgtacaaggtgctgggcaccttcctgttcggcgccgccgtgagccagagcctgaccgacctggccaagtacatgatcggcagactgagacccaacttcctggccgtgtgcgaccccgactggagcagagtgaactgcagcgtgtacgtgcagctggagaaggtgtgcagaggcaaccccgccgacgtgaccgaggccagactgagcttctacagcggccacagcagcttcggcatgtactgcatggtgttcctggccctgtacgtgcaggccagactgtgctggaagtgggccagactgctgagacccaccgtgcagttcttcctggtggccttcgccctgtacgtgggctacaccagagtgagcgactacaagcaccactggagcgacgtgctggtgggcctgctgcagggcgccctggtggccgccctgaccgtgtgctacatcagcgacttcttcaaggccagacccccccagcactgcctgaaggaggaggagctggagagaaagcccagcctgagcctgaccctgaccctgggcgaggccgaccacaaccactacggctacccccacagcagcagctag

SEQ ID NO: 20797 - DNA, 930 bp, Artificial Sequence
  Description of Artificial Sequence: Synthetic coding sequence
atgggcgtggccagaggccccggcagcagaggccagcaccccccccccagacagcaggaggtgtgcgccgagggccccagagccagactgcaccccgccccccccggcctgggcgccagcctgcccttcgccatcctgaccctggtgaacgccccctacaagagaggcttctactgcggcgacgacagcatcagatacccctacagacccgacaccatcacccacggcctgatggccggcgtgaccatcaccgccaccgtgatcctggtgagcgccggcgaggcctacctggtgtacaccgacagactgtacagcagaagcgacttcaacaactacgtggccgccgtgtacaaggtgctgggcaccttcctgttcggcgccgccgtgagccagagcctgaccgacctggccaagtacatgatcggcagactgagacccaacttcctggccgtgtgcgaccccgactggagcagagtgaactgcagcgtgtacgtgcagctggagaaggtgtgcagaggcaaccccgccgacgtgaccgaggccagactgagcttctacagcggccacagcagcttcggcatgtactgcatggtgttcctggccctgtacgtgcaggccagactgtgctggaagtgggccagactgctgagacccaccgtgcagttcttcctggtggccttcgccctgtacgtgggctacaccagagtgagcgactacaagcaccactggagcgacgtgctggtgggcctgctgcagggcgccctggtggccgccctgaccgtgtgctacatcagcgacttcttcaaggccagacccccccagcactgcctgaaggaggaggagctggagagaaagcccagcctgagcctgaccctgaccctgggcgaggccgaccacaaccactacggctacccccacagcagcagctag

SEQ ID NO: 20798 - DNA, 699 bp, Artificial Sequence
  Description of Artificial Sequence: Synthetic coding sequence
atggccggcgtgaccatcaccgccaccgtgatcctggtgagcgccggcgaggcctacctggtgtacaccgacagactgtacagcagaagcgacttcaacaactacgtggccgccgtgtacaaggtgctgggcaccttcctgttcggcgccgccgtgagccagagcctgaccgacctggccaagtacatgatcggcagactgagacccaacttcctggccgtgtgcgaccccgactggagcagagtgaactgcagcgtgtacgtgcagctggagaaggtgtgcagaggcaaccccgccgacgtgaccgaggccagactgagcttctacagcggccacagcagcttcggcatgtactgcatggtgttcctggccctgtacgtgcaggccagactgtgctggaagtgggccagactgctgagacccaccgtgcagttcttcctggtggccttcgccctgtacgtgggctacaccagagtgagcgactacaagcaccactggagcgacgtgctggtgggcctgctgcagggcgccctggtggccgccctgaccgtgtgctacatcagcgacttcttcaaggccagacccccccagcactgcctgaaggaggaggagctggagagaaagcccagcctgagcctgaccctgaccctgggcgaggccgaccacaaccactacggctacccccacagcagcagctag

SEQ ID NO: 20799 - DNA, 711 bp, Artificial Sequence
  Description of Artificial Sequence: Synthetic coding sequence
atgaagagaagcggcaaccccggcgccgaggtgaccaacagcagcgtggccggccccgactgctgcggcggcctgggcaacatcgacttcagacaggccgacttctgcgtgatgaccagactgctgggctacgtggaccccctggaccccagcttcgtggccgccgtgatcaccatcaccttcaaccccctgtactggaacgtggtggccagatgggagcacaagaccagaaagctgagcagagccttcggcagcccctacctggcctgctacagcctgagcgtgaccatcctgctgctgaacttcctgagaagccactgcttcacccaggccatgctgagccagcccagaatggagagcctggacacccccgccgcctacagcctgggcctggccctgctgggcctgggcgtggtgctggtgctgagcagcttcttcgccctgggcttcgccggcaccttcctgggcgactacttcggcatcctgaaggaggccagagtgaccgtgttccccttcaacatcctggacaaccccatgtactggggcagcaccgccaactacctgggctgggccatcatgcacgccagccccaccggcctgctgctgaccgtgctggtggccctgacctacatcgtggccctgctgtacgaggagcccttcaccgccgagatctacagacagaaggccagcggcagccacaagagaagctag

SEQ ID NO: 20800 - DNA, 699 bp, Artificial Sequence
  Description of Artificial Sequence: Synthetic coding sequence
atgaagagaagcggcaaccccggcgccgaggtgaccaacagcagcgtggccggccccgactgctgcggcggcctgggcaacatcgacttcagacaggccgacttctgcgtgatgaccagactgctgggctacgtggaccccctggaccccagcttcgtggccgccgtgatcaccatcaccttcaaccccctgtactggaacgtggtggccagatgggagcacaagaccagaaagctgagcagagccttcggcagcccctacctggcctgctacagcctgagcgtgaccatcctgctgctgaacttcctgagaagccactgcttcacccaggccatgctgagccagcccagaatggagagcctggacacccccgccgcctacagcctgggcctggccctgctgggcctgggcgtggtgctggtgctgagcagcttcttcgccctgggcttcgccggcaccttcctgggcgactacttcggcatcctgaaggaggccagagtgaccgtgttccccttcaacatcctggacaaccccatgtactggggcagcaccgccaactacctgggctgggccatcatccccgcccccgccggcgccgtgggcagcgaggccagacagccccacggccccgcccccgacggcgccggcggcccccacctgcacagcggcagccccatcagaagagccctgcacagatag

SEQ ID NO: 20801 - DNA, 600 bp, Artificial Sequence
  Description of Artificial Sequence: Synthetic coding sequence
atgaccagactgctgggctacgtggaccccctggaccccagcttcgtggccgccgtgatcaccatcaccttcaaccccctgtactggaacgtggtggccagatgggagcacaagaccagaaagctgagcagagccttcggcagcccctacctggcctgctacagcctgagcgtgaccatcctgctgctgaacttcctgagaagccactgcttcacccaggccatgctgagccagcccagaatggagagcctggacacccccgccgcctacagcctgggcctggccctgctgggcctgggcgtggtgctggtgctgagcagcttcttcgccctgggcttcgccggcaccttcctgggcgactacttcggcatcctgaaggaggccagagtgaccgtgttccccttcaacatcctggacaaccccatgtactggggcagcaccgccaactacctgggctgggccatcatgcacgccagccccaccggcctgctgctgaccgtgctggtggccctgacctacatcgtggccctgctgtacgaggagcccttcaccgccgagatctacagacagaaggccagcggcagccacaagagaagctag

SEQ ID NO: 20802 - DNA, 600 bp, Artificial Sequence; identical to SEQ ID NO: 20801
  Description of Artificial Sequence: Synthetic coding sequence

SEQ ID NO: 20803 - DNA, 642 bp, Artificial Sequence
  Description of Artificial Sequence: Synthetic coding sequence
atgaagagaagcggcaaccccggcgccgaggtgaccaacagcagcgtggccggccccgactgctgcggcggcctgggcaacatcgacttcagacaggccgacttctgcgtgatgaccagactgctgggctacgtggaccccctggaccccagcttcgtggccgccgtgatcaccatcaccttcaaccccctgtactggaacgtggtggccagatgggagcacaagaccagaaagctgagcagagccttcggcagcccctacctggcctgctacagcctgagcgtgaccatcctgctgctgaacttcctgagaagccactgcttcacccaggccatgctgagccagcccagaatggagagcctggacacccccgccgcctacagcctgggcctggccctgctgggcctgggcgtggtgctggtgctgagcagcttcttcgccctgggcttcgccggcaccttcctgggcgactacttcggcatcctgaaggaggccagagtgaccgtgttccccttcaacatcctggacaaccccatgtactggggcagcaccgccaactacctgggctgggccatcatcctgtgcccctgcggcagataccccttcccccagagaggccccagagccatgagagaggcctag

SEQ ID NO: 20804 - DNA, 636 bp, Artificial Sequence
  Description of Artificial Sequence: Synthetic coding sequence
atgaagagaagcggcaaccccggcgccgaggccgacttctgcgtgatgaccagactgctgggctacgtggaccccctggaccccagcttcgtggccgccgtgatcaccatcaccttcaaccccctgtactggaacgtggtggccagatgggagcacaagaccagaaagctgagcagagccttcggcagcccctacctggcctgctacagcctgagcgtgaccatcctgctgctgaacttcctgagaagccactgcttcacccaggccatgctgagccagcccagaatggagagcctggacacccccgccgcctacagcctgggcctggccctgctgggcctgggcgtggtgctggtgctgagcagcttcttcgccctgggcttcgccggcaccttcctgggcgactacttcggcatcctgaaggaggccagagtgaccgtgttccccttcaacatcctggacaaccccatgtactggggcagcaccgccaactacctgggctgggccatcatcagccccgcccccgccggcgccgtgggcagcgaggccagacagccccacggccccgcccccgacggcgccggcggcccccacctgcacagcggcagccccatcagaagagccctgcacagatag

SEQ ID NO: 20805 - DNA, 684 bp, Artificial Sequence
  Description of Artificial Sequence: Synthetic coding sequence
atgggctggaccatgagactggtgaccgccgccctgctgctgggcctgatgatggtggtgaccggcgacgaggacgagaacagcccctgcgcccacgaggccctgctggacgaggacaccctgttctgccagggcctggaggtgttctaccccgagctgggcaacatcggctgcaaggtggtgcccgactgcaacaactacagacagaagatcaccagctggatggagcccatcgtgaagttccccggcgccgtggacggcgccacctacatcctggtgatggtggaccccgacgcccccagcagagccgagcccagacagagattctggagacactggctggtgaccgacatcaagggcgccgacctgaagaagggcaagatccagggccaggagctgagcgcctaccaggcccccagcccccccgcccacagcggcttccacagataccagttcttcgtgtacctgcaggagggcaaggtgatcagcctgctgcccaaggagaacaagaccagaggcagctggaagatggacagattcctgaacagattccacctgggcgagcccgaggccagcacccagttcatgacccagaactaccaggacagccccaccctgcaggcccccagagagagagccagcgagcccaagcacaagaaccaggccgagatcgccgcctgctag

SEQ ID NO: 20806 - DNA, 1671 bp, Artificial Sequence
  Description of Artificial Sequence: Synthetic coding sequence
atggccgtggccgccgccgccgccgccggccccgtgttctggagaagactgctgggcctgctgcccggcagacccggcctggccgccctgctgggcagactgagcgacagactgggcagaaacagagacagacagagaagaagaagcccctggctgctgctggcccccctgctgagccccgccgtgccccaggtgaccagccccccctgctgcctgtgccccgagggcgtgcacagattccagtggatcagaaacctggtgcccgagttcggcgtgagcagcagccacgtgagagtgctgagcagccccgccgagttcttcgagctgatgaagggccagatcagagtggccaagagaagagtggtgatggccagcctgtacctgggcaccggccccctggagcaggagctggtggactgcctggagagcaccctggagaagagcctgcaggccaagttccccagcaacctgaaggtgagcatcctgctggacttcaccagaggcagcagaggcagaaagaacagcagaaccatgctgctgcccctgctgagaagattccccgagcaggtgagagtgagcctgttccacaccccccacctgagaggcctgctgagactgctgatccccgagagattcaacgagaccatcggcctgcagcacatcaaggtgtacctgttcgacaacagcgtgatcctgagcggcgccaacctgagcgacagctacttcaccaacagacaggacagatacgtgttcctgcaggactgcgccgagatcgccgacttcttcaccgagctggtggacgccgtgggcgacgtgagcctgcagctgcagggcgacgacaccgtgcaggtggtggacggcatggtgcacccctacaagggcgacagagccgagtactgcaaggccgccaacaagagagtgatggacgtgatcaacagcgccagaaccagacagcagatgctgcacgcccagaccttccacagcaacagcctgctgacccaggaggacgccgccgccgccggcgacagaagacccgcccccgacacctggatctaccccctgatccagatgaagcccttcgagatccagatcgacgagatcgtgaccgagaccctgctgaccgaggccgagagaggcgccaaggtgtacctgaccaccggctacttcaacctgacccaggcctacatggacctggtgctgggcaccagagccgagtaccagatcctgctggccagccccgaggtgaacggcttcttcggcgccaagggcgtggccggcgccatccccgccgcctacgtgcacatcgagagacagttcttcagcgaggtgtgcagcctgggccagcaggagagagtgcagctgcaggagtactggagaagaggctggaccttccacgccaagggcctgtggctgtacctggccggcagcagcctgccctgcctgaccctgatcggcagccccaacttcggctacagaagcgtgcacagagacctggaggcccagatcgccatcgtgaccgagaaccaggccctgcagcagcagctgcaccaggagcaggagcagctgtacctgagaagcggcgtggtgagcagcgccaccttcgagcagcccagcagacaggtgaagctgtgggtgaagatggtgacccccctgatcaagaacttcttctag

SEQ ID NO: 20807 - DNA, 1266 bp, Artificial Sequence
  Description of Artificial Sequence: Synthetic coding sequence
atgaaggtggactgcctggagagcaccctggagaagagcctgcaggccaagttccccagcaacctgaaggtgagcatcctgctggacttcaccagaggcagcagaggcagaaagaacagcagaaccatgctgctgcccctgctgagaagattccccgagcaggtgagagtgagcctgttccacaccccccacctgagaggcctgctgagactgctgatccccgagagattcaacgagaccatcggcctgcagcacatcaaggtgtacctgttcgacaacagcgtgatcctgagcggcgccaacctgagcgacagctacttcaccaacagacaggacagatacgtgttcctgcaggactgcgccgagatcgccgacttcttcaccgagctggtggacgccgtgggcgacgtgagcctgcagctgcagggcgacgacaccgtgcaggtggtggacggcatggtgcacccctacaagggcgacagagccgagtactgcaaggccgccaacaagagagtgatggacgtgatcaacagcgccagaaccagacagcagatgctgcacgcccagaccttccacagcaacagcctgctgacccaggaggacgccgccgccgccggcgacagaagacccgcccccgacacctggatctaccccctgatccagatgaagcccttcgagatccagatcgacgagatcgtgaccgagaccctgctgaccgaggccgagagaggcgccaaggtgtacctgaccaccggctacttcaacctgacccaggcctacatggacctggtgctgggcaccagagccgagtaccagatcctgctggccagccccgaggtgaacggcttcttcggcgccaagggcgtggccggcgccatccccgccgcctacgtgcacatcgagagacagttcttcagcgaggtgtgcagcctgggccagcaggagagagtgcagctgcaggagtactggagaagaggctggaccttccacgccaagggcctgtggctgtacctggccggcagcagcctgccctgcctgaccctgatcggcagccccaacttcggctacagaagcgtgcacagagacctggaggcccagatcgccatcgtgaccgagaaccaggccctgcagcagcagctgcaccaggagcaggagcagctgtacctgagaagcggcgtggtgagcagcgccaccttcgagcagcccagcagacaggtgaagctgtgggtgaagatggtgacccccctgatcaagaacttcttctag

SEQ ID NO: 20808 - DNA, 807 bp, Artificial Sequence
  Description of Artificial Sequence: Synthetic coding sequence
atgaaggtggactgcctggagagcaccctggagaagagcctgcaggccaagttccccagcaacctgaaggtgagcatcctgctggacttcaccagaggcagcagaggcagaaagaacagcagaaccatgctgctgcccctgctgagaagattccccgagcaggtgagagtgagcctgttccacaccccccacctgagaggcctgctgagactgctgatccccgagagattcaacgagaccatcggcctgcagcacatcaaggtgtacctgttcgacaacagcgtgatcctgagcggcgccaacctgagcgacagctacttcaccaacagacaggacagatacgtgttcctgcaggactgcgccgagatcgccgacttcttcaccgagctggtggacgccgtgggcgacgtgagcctgcagctgcagggcgacgacaccgtgcaggtggtggacggcatggtgcacccctacaagggcgacagagccgagtactgcaaggccgccaacaagagagtgatggacgtgatcaacagcgccagaaccagacagcagatgctgcacgcccagaccttccacagcaacagcctgctgacccaggaggacgccgccgccgccggcgacagaagacccgcccccgacacctggatctaccccctgatccagatgaagcccttcgagatccagatcgacgagatcgtgaccgagaccctgctgaccgaggccgagagaggcgccaaggtgtacctgaccaccggctacttcaacctgacccaggcctacatgcccggcctgggccacagcggctag

SEQ ID NO: 20809 - DNA, 900 bp, Artificial Sequence
  Description of Artificial Sequence: Synthetic coding sequence
atgccctacaccacctacctggtggagaagggcgccagccacagcttcgtggccgaggccaagccccccaccgtgaccatgcccagaatcaaggccctgatgaccggcagcctgcccggcttcgtggacgtgatcagaaacctgaacagccccgccctgctggaggacagcgtgatcagacaggccaaggccgccggcaagagaatcgtgttctacggcgacgagacctgggtgaagctgttccccaagcacttcgtggagtacgacggcaccaccagcttcttcgtgagcgactacaccgaggtggacaacaacgtgaccagacacctggacaaggtgctgaagagaggcgactgggacatcctgatcctgcactacctgggcctggaccacatcggccacatcagcggccccaacagccccctgatcggccagaagctgagcgagatggacagcgtgctgatgaagatccacaccagcctgcagagcaaggagagagagacccccctgcccaacctgctggtgctgtgcggcgaccacggcatgagcgagaccggcagccacggcgccagcagcaccgaggaggtgaacacccccctgatcctgatcagcagcgccttcgagagaaagcccggcgacatcagacaccccaagcacgtgcagcagaccgacgtggccgccaccctggccatcgccctgggcctgcccatccccaaggacagcgtgggcagcctgctgttccccgtggtggagggcagacccatgagagagcagctgagattcctgcacctgaacaccgtgcagctgagcaagctgctgcaggagaacgtgcccagctacgagaagggcagccaccccgcccccgcccagagacccaccggcaccgcccagaagggctag

SEQ ID NO: 20810 - DNA, 2928 bp, Artificial Sequence
  Description of Artificial Sequence: Synthetic coding sequence
atgagactgggcagcggcaccttcgccacctgctgcgtggccatcgaggtgctgggcatcgccgtgttcctgagaggcttcttccccgcccccgtgagaagcagcgccagagccgagcacggcgccgagccccccgcccccgagcccagcgccggcgccagcagcaactggaccaccctgcccccccccctgttcagcaaggtggtgatcgtgctgatcgacgccctgagagacgacttcgtgttcggcagcaagggcgtgaagttcatgccctacaccacctacctggtggagaagggcgccagccacagcttcgtggccgaggccaagccccccaccgtgaccatgcccagaatcaaggccctgatgaccggcagcctgcccggcttcgtggacgtgatcagaaacctgaacagccccgccctgctggaggacagcgtgatcagacaggccaaggccgccggcaagagaatcgtgttctacggcgacgagacctgggtgaagctgttccccaagcacttcgtggagtacgacggcaccaccagcttcttcgtgagcgactacaccgaggtggacaacaacgtgaccagacacctggacaaggtgctgaagagaggcgactgggacatcctgatcctgcactacctgggcctggaccacatcggccacatcagcggccccaacagccccctgatcggccagaagctgagcgagatggacagcgtgctgatgaagatccacaccagcctgcagagcaaggagagagagacccccctgcccaacctgctggtgctgtgcggcgaccacggcatgagcgagaccggcagccacggcgccagcagcaccgaggaggtgaacacccccctgatcctgatcagcagcgccttcgagagaaagcccggcgacatcagacaccccaagcacgtgcagcagaccgacgtggccgccaccctggccatcgccctgggcctgcccatccccaaggacagcgtgggcagcctgctgttccccgtggtggagggcagacccatgagagagcagctgagattcctgcacctgaacaccgtgcagctgagcaagctgctgcaggagaacgtgcccagctacgagaaggaccccggcttcgagcagttcaagatgagcgagagactgcacggcaactggatcagactgtacctggaggagaagcacagcgaggtgctgttcaacctgggcagcaaggtgctgagacagtacctggacgccctgaagaccctgagcctgagcctgagcgcccaggtggcccagtacgacatctacagcatgatggtgctgaccctgctgctgctgagcgtgccccaggccctgagaagaaaggccgagctggaggtgcccctgagcagccccggcttcagcctgctgttctacctggtgatcctggtgctgagcgccgtgcacgtgatcgtgtgcaccagcgccgagagcagctgctacttctgcggcctgagctggctggccgccggcggcgtgatggtgctggccagcgccctgctgtgcgtgatcgtgagcgtgctgaccaacgtgctggtgggcggcaacacccccagaaagaaccccatgcaccccagcagcagatggagcgagctggacctgctgatcctgctgggcaccgccggccacgtgctgagcctgggcgccagcagcttcgtggaggaggagcaccagacctggtacttcctggtgaacaccctgtgcctggccctgagccaggagacctacagaaactacttcctgggcgacgacggcgagcccccctgcggcctgtgcgtggagcagggccacgacggcgccaccgccgcctggcaggacggccccggctgcgacgtgctggagagagacaagggccacggcagccccagcaccagcgaggtgctgagaggcagagagaagtggatggtgctggccagcccctggctgatcctggcctgctgcagactgctgagaagcctgaaccagaccggcgtgcagtgggcccacagacccgacctgggccactggctgaccagcagcgaccacaaggccgagctgagcgtgctggccgccctgagcctgctggtggtgttcgtgctggtgcagagaggctgcagccccgtgagcaaggccgccctggccctgggcctgctgggcgtgtactgctacagagccgccatcggcagcgtgagattcccctggagacccgacagcaaggacatcagcaagggcatcatcgaggccagattcgtgtacgtgttcgtgctgggcatcctgttcaccggcaccaaggacctgctgaagagccaggtgatcgccgccgacttcaagctgaagaccgtgggcctgtgggagatctacagcggcctggtgctgctggccgccctgctgttcagaccccacaacctgcccgtgctggccttcagcctgctgatccagaccctgatgaccaagttcatctggaagcccctgagacacgacgccgccgagatcaccgtgatgcactactggttcggccaggccttcttctacttccagggcaacagcaacaacatcgccaccgtggacatcagcgccggcttcgtgggcctggacacctacgtggagatccccgccgtgctgctgaccgccttcggcacctacgccggccccgtgctgtgggccagccacctggtgcacttcctgagcagcgagaccagaagcggcagcgccctgagccacgcctgcttctgctacgccctgatctgcagcatccccgtgttcacctacatcgtgctggtgaccagcctgagataccacctgttcatctggagcgtgttcagccccaagctgctgtacgagggcatgcacctgctgatcaccgccgccgtgtgcgtgttcttcaccgccatggaccagaccagactgacccagagctag

SEQ ID NO: 20811 - DNA, 2553 bp, Artificial Sequence
  Description of Artificial Sequence: Synthetic coding sequence
atgagactgggcagcggcaccttcgccacctgctgcgtggccatcgaggtgctgggcatcgccgtgttcctgagaggcttcttccccgcccccgtgagaagcagcgccagagccgagcacggcgccgagccccccgcccccgagcccagcgccggcgccagcagcaactggaccaccctgcccccccccctgttcagcaaggtggtgatcgtgctgatcgacgccctgagagacgacttcgtgttcggcagcaagggcgtgaagttcatgccctacaccacctacctggtggagaagggcgccagccacagcttcgtggccgaggccaagccccccaccgtgaccatgcccagaatcaaggagagagagacccccctgcccaacctgctggtgctgtgcggcgaccacggcatgagcgagaccggcagccacggcgccagcagcaccgaggaggtgaacacccccctgatcctgatcagcagcgccttcgagagaaagcccggcgacatcagacaccccaagcacgtgcagcagaccgacgtggccgccaccctggccatcgccctgggcctgcccatccccaaggacagcgtgggcagcctgctgttccccgtggtggagggcagacccatgagagagcagctgagattcctgcacctgaacaccgtgcagctgagcaagctgctgcaggagaacgtgcccagctacgagaaggaccccggcttcgagcagttcaagatgagcgagagactgcacggcaactggatcagactgtacctggaggagaagcacagcgaggtgctgttcaacctgggcagcaaggtgctgagacagtacctggacgccctgaagaccctgagcctgagcctgagcgcccaggtggcccagtacgacatctacagcatgatggtgggcaccgtggtggtgctggaggtgctgaccctgctgctgctgagcgtgccccaggccctgagaagaaaggccgagctggaggtgcccctgagcagccccggcttcagcctgctgttctacctggtgatcctggtgctgagcgccgtgcacgtgatcgtgtgcaccagcgccgagagcagctgctacttctgcggcctgagctggctggccgccggcggcgtgatggtgctggccagcgccctgctgtgcgtgatcgtgagcgtgctgaccaacgtgctggtgggcggcaacacccccagaaagaaccccatgcaccccagcagcagatggagcgagctggacctgctgatcctgctgggcaccgccggccacgtgctgagcctgggcgccagcagcttcgtggaggaggagcaccagacctggtacttcctggtgaacaccctgtgcctggccctgagccaggagacctacagaaactacttcctgggcgacgacggcgagcccccctgcggcctgtgcgtggagcagggccacgacggcgccaccgccgcctggcaggacggccccggctgcgacgtgctggagagagacaagggccacggcagccccagcaccagcgaggtgctgagaggcagagagaagtggatggtgctggccagcccctggctgatcctggcctgctgcagactgctgagaagcctgaaccagaccggcgtgcagtgggcccacagacccgacctgggccactggctgaccagcagcgaccacaaggccgagctgagcgtgctggccgccctgagcctgctggtggtgttcgtgctggtgcagagaggctgcagccccgtgagcaaggccgccctggccctgggcctgctgggcgtgtactgctacagagccgccatcggcagcgtgagattcccctggagacccgacagcaaggacatcagcaagggcatcatcgaggccagattcgtgtacgtgttcgtgctgggcatcctgttcaccggcaccaaggacctgctgaagagccaggtgatcgccgccgacttcaagctgaagaccgtgggcctgtgggagatctacagcggcctggtgctgctggccgccctgctgttcagaccccacaacctgcccgtgctggccttcagcctgctgatccagaccctgatgaccaagttcatctggaagcccctgagacacgacgccgccgagatcaccgtgatgcactactggttcggccaggccttcttctacttccagggcaacagcaacaacatcgccaccgtggacatcagcgccggcttcgtgggcctggacacctacgtggagatccccgccgtgctgctgaccgccttcggcacctacgccggccccgtgctgtgggccagccacctggtgcacttcctgagcagcgagaccagaagcggcagcgccctgagccacgcctgcttctgctacgccctgatctgcagcatccccgtgttcacctacatcgtgctggtgaccagcctgagataccacctgttcatctggagcgtgttcagccccaagctgctgtacgagggcatgcacctgctgatcaccgccgccgtgtgcgtgttcttcaccgccatggaccagaccagactgacccagagctag

SEQ ID NO: 20812 - DNA, 2952 bp, Artificial Sequence
  Description of Artificial Sequence: Synthetic coding sequence
atgagactgggcagcggcaccttcgccacctgctgcgtggccatcgaggtgctgggcatcgccgtgttcctgagaggcttcttccccgcccccgtgagaagcagcgccagagccgagcacggcgccgagccccccgcccccgagcccagcgccggcgccagcagcaactggaccaccctgcccccccccctgttcagcaaggtggtgatcgtgctgatcgacgccctgagagacgacttcgtgttcggcagcaagggcgtgaagttcatgccctacaccacctacctggtggagaagggcgccagccacagcttcgtggccgaggccaagccccccaccgtgaccatgcccagaatcaaggccctgatgaccggcagcctgcccggcttcgtggacgtgatcagaaacctgaacagccccgccctgctggaggacagcgtgatcagacaggccaaggccgccggcaagagaatcgtgttctacggcgacgagacctgggtgaagctgttccccaagcacttcgtggagtacgacggcaccaccagcttcttcgtgagcgactacaccgaggtggacaacaacgtgaccagacacctggacaaggtgctgaagagaggcgactgggacatcctgatcctgcactacctgggcctggaccacatcggccacatcagcggccccaacagccccctgatcggccagaagctgagcgagatggacagcgtgctgatgaagatccacaccagcctgcagagcaaggagagagagacccccctgcccaacctgctggtgctgtgcggcgaccacggcatgagcgagaccggcagccacggcgccagcagcaccgaggaggtgaacacccccctgatcctgatcagcagcgccttcgagagaaagcccggcgacatcagacaccccaagcacgtgcagcagaccgacgtggccgccaccctggccatcgccctgggcctgcccatccccaaggacagcgtgggcagcctgctgttccccgtggtggagggcagacccatgagagagcagctgagattcctgcacctgaacaccgtgcagctgagcaagctgctgcaggagaacgtgcccagctacgagaaggaccccggcttcgagcagttcaagatgagcgagagactgcacggcaactggatcagactgtacctggaggagaagcacagcgaggtgctgttcaacctgggcagcaaggtgctgagacagtacctggacgccctgaagaccctgagcctgagcctgagcgcccaggtggcccagtacgacatctacagcatgatggtgggcaccgtggtggtgctggaggtgctgaccctgctgctgctgagcgtgccccaggccctgagaagaaaggccgagctggaggtgcccctgagcagccccggcttcagcctgctgttctacctggtgatcctggtgctgagcgccgtgcacgtgatcgtgtgcaccagcgccgagagcagctgctacttctgcggcctgagctggctggccgccggcggcgtgatggtgctggccagcgccctgctgtgcgtgatcgtgagcgtgctgaccaacgtgctggtgggcggcaacacccccagaaagaaccccatgcaccccagcagcagatggagcgagctggacctgctgatcctgctgggcaccgccggccacgtgctgagcctgggcgccagcagcttcgtggaggaggagcaccagacctggtacttcctggtgaacaccctgtgcctggccctgagccaggagacctacagaaactacttcctgggcgacgacggcgagcccccctgcggcctgtgcgtggagcagggccacgacggcgccaccgccgcctggcaggacggccccggctgcgacgtgctggagagagacaagggccacggcagccccagcaccagcgaggtgctgagaggcagagagaagtggatggtgctggccagcccctggctgatcctggcctgctgcagactgctgagaagcctgaaccagaccggcgtgcagtgggcccacagacccgacctgggccactggctgaccagcagcgaccacaaggccgagctgagcgtgctggccgccctgagcctgctggtggtgttcgtgctggtgcagagaggctgcagccccgtgagcaaggccgccctggccctgggcctgctgggcgtgtactgctacagagccgccatcggcagcgtgagattcccctggagacccgacagcaaggacatcagcaagggcatcatcgaggccagattcgtgtacgtgttcgtgctgggcatcctgttcaccggcaccaaggacctgctgaagagccaggtgatcgccgccgacttcaagctgaagaccgtgggcctgtgggagatctacagcggcctggtgctgctggccgccctgctgttcagaccccacaacctgcccgtgctggccttcagcctgctgatccagaccctgatgaccaagttcatctggaagcccctgagacacgacgccgccgagatcaccgtgatgcactactggttcggccaggccttcttctacttccagggcaacagcaacaacatcgccaccgtggacatcagcgccggcttcgtgggcctggacacctacgtggagatccccgccgtgctgctgaccgccttcggcacctacgccggccccgtgctgtgggccagccacctggtgcacttcctgagcagcgagaccagaagcggcagcgccctgagccacgcctgcttctgctacgccctgatctgcagcatccccgtgttcacctacatcgtgctggtgaccagcctgagataccacctgttcatctggagcgtgttcagccccaagctgctgtacgagggcatgcacctgctgatcaccgccgccgtgtgcgtgttcttcaccgccatggaccagaccagactgacccagagctag

SEQ ID NO: 20813 - DNA, 426 bp, Artificial Sequence
  Description of Artificial Sequence: Synthetic coding sequence
atgcactactggttcggccaggccttcttctacttccagggcaacagcaacaacatcgccaccgtggacatcagcgccggcttcgtgggcctggacacctacgtggagatccccgccgtgctgctgaccgccttcggcacctacgccggccccgtgctgtgggccagccacctggtgcacttcctgagcagcgagaccagaagcggcagcgccctgagccacgcctgcttctgctacgccctgatctgcagcatccccgtgttcacctacatcgtgctggtgaccagcctgagataccacctgttcatctggagcgtgttcagccccaagctgctgtacgagggcatgcacctgctgatcaccgccgccgtgtgcgtgttcttcacctggatcaagcccgacagccacagcctgagactgagctag

SEQ ID NO: 20814 - DNA, 900 bp, Artificial Sequence; identical to SEQ ID NO: 20809
  Description of Artificial Sequence: Synthetic coding sequence

SEQ ID NO: 20815 - DNA, 1026 bp, Artificial Sequence
  Description of Artificial Sequence: Synthetic coding sequence
atgaccggcagcctgcccggcttcgtggacgtgatcagaaacctgaacagccccgccctgctggaggacagcgtgatcagacaggccaaggccgccggcaagagaatcgtgttctacggcgacgagacctgggtgaagctgttccccaagcacttcgtggagtacgacggcaccaccagcttcttcgtgagcgactacaccgaggtggacaacaacgtgaccagacacctggacaaggtgctgaagagaggcgactgggacatcctgatcctgcactacctgggcctggaccacatcggccacatcagcggccccaacagccccctgatcggccagaagctgagcgagatggacagcgtgctgatgaagatccacaccagcctgcagagcaaggagagagagacccccctgcccaacctgctggtgctgtgcggcgaccacggcatgagcgagaccggcagccacggcgccagcagcaccgaggaggtgaacacccccctgatcctgatcagcagcgccttcgagagaaagcccggcgacatcagacaccccaagcacgtgcagcagaccgacgtggccgccaccctggccatcgccctgggcctgcccatccccaaggacagcgtgggcagcctgctgttccccgtggtggagggcagacccatgagagagcagctgagattcctgcacctgaacaccgtgcagctgagcaagctgctgcaggagaacgtgcccagctacgagaaggaccccggcttcgagcagttcaagatgagcgagagactgcacggcaactggatcagactgtacctggaggagaagcacagcgaggtgctgttcaacctgggcagcaaggtgctgagacagtacctggacgccctgaagaccctgagcctgagcctgagcgcccaggtggcccagttcagcccctgcagctgcagcgccagccacagacactgcgccgagagactgagctggaagagccactgccacctgctgggcttcctgtgcagcttcatctggtag

SEQ ID NO: 20816 - DNA, 2019 bp, Artificial Sequence
  Description of Artificial Sequence: Synthetic coding sequence
atgcagaaggccagcgtgctgctgttcctggcctgggtgtgcttcctgttctacgccggcatcgccctgttcaccagcggcttcctgctgaccagactggagctgaccaaccacagcagctgccaggagccccccggccccggcagcctgccctggggcagccagggcaagcccggcgcctgctggatggccagcagattcagcagagtggtgctggtgctgatcgacgccctgagattcgacttcgcccagccccagcacagccacgtgcccagagagccccccgtgagcctgcccttcctgggcaagctgagcagcctgcagagaatcctggagatccagccccaccacgccagactgtacagaagccaggtggacccccccaccaccaccatgcagagactgaaggccctgaccaccggcagcctgcccaccttcatcgacgccggcagcaacttcgccagccacgccatcgtggaggacaacctgatcaagcagctgaccagcgccggcagaagagtggtgttcatgggcgacgacacctggaaggacctgttccccggcgccttcagcaaggccttcttcttccccagcttcaacgtgagagacctggacaccgtggacaacggcatcctggagcacctgtaccccaccatggacagcggcgagtgggacgtgctgatcgcccacttcctgggcgtggaccactgcggccacaagcacggcccccaccaccccgagatggccaagaagctgagccagatggaccaggtgatccagggcctggtggagagactggagaacgacaccctgctggtggtggccggcgaccacggcatgaccaccaacggcgaccacggcggcgacagcgagctggaggtgagcgccgccctgttcctgtacagccccaccgccgtgttccccagcaccccccccgaggagcccgaggtgatcccccaggtgagcctggtgcccaccctggccctgctgctgggcctgcccatccccttcggcaacatcggcgaggtgatggccgagctgttcagcggcggcgaggacagccagccccacagcagcgccctggcccaggccagcgccctgcacctgaacgcccagcaggtgagcagattcctgcacacctacagcgccgccacccaggacctgcaggccaaggagctgcaccagctgcagaacctgttcagcaaggccagcgccgactaccagtggctgctgcagagccccaagggcgccgaggccaccctgcccaccgtgatcgccgagctgcagcagttcctgagaggcgccagagccatgtgcatcgagagctgggccagattcagcctgagcttcctgctgctgcacctgctggccgccggcatccccgtgaccacccccggccccttcaccgtgccctggcaggccgtgagcgcctgggccctgatggccacccagaccttctacagcaccggccaccagcccgtgttccccgccatccactggcacgccgccttcgtgggcttccccgagggccacggcagctgcacctggctgcccgccctgctggtgggcgccaacaccttcgccagccacctgctgttcgccgtgggctgccccctgctgctgctgtggcccttcctgtgcgagagccagggcctgagaaagagacagcagccccccggcaacgaggccgacgccagagtgagacccgaggaggaggaggagcccctgatggagatgagactgagagacgccccccagcacttctacgccgccctgctgcagctgggcctgaagtacctgttcatcctgggcatccagatcctggcctgcgccctggccgccagcatcctgagaagacacctgatggtgtggaaggtgttcgcccccaagttcatcttcgaggccgtgggcttcatcgtgagcagcgtgggcctgctgctgggcatcgccctggtgatgagagtggacggcgccgtgagcagctggttcagacagctgttcctggcccagcagagatag

SEQ ID NO: 20817 - DNA, 3270 bp, Artificial Sequence
  Description of Artificial Sequence: Synthetic coding sequence
atgcagaaggccagcgtgctgctgttcctggcctgggtgtgcttcctgttctacgccggcatcgccctgttcaccagcggcttcctgctgaccagactggagctgaccaaccacagcagctgccaggagccccccggccccggcagcctgccctggggcagccagggcaagcccggcgcctgctggatggccagcagattcagcagagtggtgctggtgctgatcgacgccctgagattcgacttcgcccagccccagcacagccacgtgcccagagagccccccgtgagcctgcccttcctgggcaagctgagcagcctgcagagaatcctggagatccagccccaccacgccagactgtacagaagccaggtggacccccccaccaccaccatgcagagactgaaggccctgaccaccggcagcctgcccaccttcatcgacgccggcagcaacttcgccagccacgccatcgtggaggacaacctgatcaagcagctgaccagcgccggcagaagagtggtgttcatgggcgacgacacctggaaggacctgttccccggcgccttcagcaaggccttcttcttccccagcttcaacgtgagagacctggacaccgtggacaacggcatcctggagcacctgtaccccaccatggacagcggcgagtgggacgtgctgatcgcccacttcctgggcgtggaccactgcggccacaagcacggcccccaccaccccgagatggccaagaagctgagccagatggaccaggtgatccagggcctggtggagagactggagaacgacaccctgctggtggtggccggcgaccacggcatgaccaccaacggcgaccacggcggcgacagcgagctggaggtgagcgccgccctgttcctgtacagccccaccgccgtgttccccagcaccccccccgaggagcccgaggtgatcccccaggtgagcctggtgcccaccctggccctgctgctgggcctgcccatccccttcggcaacatcggcgaggtgatggccgagctgttcagcggcggcgaggacagccagccccacagcagcgccctggcccaggccagcgccctgcacctgaacgcccagcaggtgagcagattcctgcacacctacagcgccgccacccaggacctgcaggccaaggagctgcaccagctgcagaacctgttcagcaaggccagcgccgactaccagtggctgctgcagagccccaagggcgccgaggccaccctgcccaccgtgatcgccgagctgcagcagttcctgagaggcgccagagccatgtgcatcgagagctgggccagattcagcctggtgagaatggccggcggcaccgccctgctggccgccagctgcttcatctgcctgctggccagccagtgggccatcagccccggcttccccttctgccccctgctgctgacccccgtggcctggggcctggtgggcgccatcgcctacgccggcctgctgggcaccatcgagctgaagctggacctggtgctgctgggcgccgtggccgccgtgagcagcttcctgcccttcctgtggaaggcctgggccggctggggcagcaagagacccctggccaccctgttccccatccccggccccgtgctgctgctgctgctgttcagactggccgtgttcttcagcgacagcttcgtggtggccgaggccagagccacccccttcctgctgggcagcttcatcctgctgctggtggtgcagctgcactgggagggccagctgctgccccccaagctgctgaccatgcccagactgggcaccagcgccaccaccaacccccccagacacaacggcgcctacgccctgagactgggcatcggcctgctgctgtgcaccagactggccggcctgttccacagatgccccgaggagacccccgtgtgccacagcagcccctggctgagccccctggccagcatggtgggcggcagagccaagaacctgtggtacggcgcctgcgtggccgccctggtggccctgctggccgccgtgagactgtggctgagaagatacggcaacctgaagagccccgagccccccatgctgttcgtgagatggggcctgcccctgatggccctgggcaccgccgcctactgggccctggccagcggcgccgacgaggccccccccagactgagagtgctggtgagcggcgccagcatggtgctgcccagagccgtggccggcctggccgccagcggcctggccctgctgctgtggaagcccgtgaccgtgctggtgaaggccggcgccggcgcccccagaaccagaaccgtgctgacccccttcagcggcccccccaccagccaggccgacctggactacgtggtgccccagatctacagacacatgcaggaggagttcagaggcagactggagagaaccaagagccagggccccctgaccgtggccgcctaccagctgggcagcgtgtacagcgccgccatggtgaccgccctgaccctgctggccttccccctgctgctgctgcacgccgagagaatcagcctggtgttcctgctgctgttcctgcagagcttcctgctgctgcacctgctggccgccggcatccccgtgaccacccccggccccttcaccgtgccctggcaggccgtgagcgcctgggccctgatggccacccagaccttctacagcaccggccaccagcccgtgttccccgccatccactggcacgccgccttcgtgggcttccccgagggccacggcagctgcacctggctgcccgccctgctggtgggcgccaacaccttcgccagccacctgctgttcgccgtgggctgccccctgctgctgctgtggcccttcctgtgcgagagccagggcctgagaaagagacagcagccccccggcaacgaggccgacgccagagtgagacccgaggaggaggaggagcccctgatggagatgagactgagagacgccccccagcacttctacgccgccctgctgcagctgggcctgaagtacctgttcatcctgggcatccagatcctggcctgcgccctggccgccagcatcctgagaagacacctgatggtgtggaaggtgttcgcccccaagttcatcttcgaggccgtgggcttcatcgtgagcagcgtgggcctgctgctgggcatcgccctggtgatgagagtggacggcgccgtgagcagctggttcagacagctgttcctggcccagcagagatag

SEQ ID NO: 20818 - DNA, 2019 bp, Artificial Sequence; identical to SEQ ID NO: 20816
  Description of Artificial Sequence: Synthetic coding sequence

SEQ ID NO: 20819 - DNA, 3270 bp, Artificial Sequence; identical to SEQ ID NO: 20817
  Description of Artificial Sequence: Synthetic coding sequence

SEQ ID NO: 20820 - DNA, 2283 bp, Artificial Sequence
  Description of Artificial Sequence: Synthetic coding sequence
atggtgctgaaggccttcttccccacctgctgcgtgagcaccgacagcggcctgctggtgggcagatgggtgcccgagcagagcagcgccgtggtgctggccgtgctgcacttccccttcatccccatccaggtgaagcagctgctggcccaggtgagacaggccagccaggtgggcgtggccgtgctgggcacctggtgccactgcagacaggagcccgaggagagcctgggcagattcctggagagcctgggcgccgtgttcccccacgagccctggctgagactgtgcagagagagaggcggcaccttctggagctgcgaggccacccacagacaggcccccaccgcccccggcgcccccggcgaggaccaggtgatgctgatcttctacgaccagagacaggtgctgctgagccagctgcacctgcccaccgtgctgcccgacagacaggccggcgccaccaccgccagcaccggcggcctggccgccgtgttcgacaccgtggccagaagcgaggtgctgttcagaagcgacagattcgacgagggccccgtgagactgagccactggcagagcgagggcgtggaggccagcatcctggccgagctggccagaagagccagcggccccatctgcctgctgctggccagcctgctgagcctggtgagcgccgtgagcgcctgcagagtgttcaagctgtggcccctgagcttcctgggcagcaagctgagcacctgcgagcagctgagacacagactggagcacctgaccctgatcttcagcaccagaaaggccgagaaccccgcccagctgatgagaaaggccaacaccgtggccagcgtgctgctggacgtggccctgggcctgatgctgctgagctggctgcacggcagaagcagaatcggccacctggccgacgccctggtgcccgtggccgaccacgtggccgaggagctgcagcacctgctgcagtggctgatgggcgcccccgccggcctgaagatgaacagagccctggaccaggtgctgggcagattcttcctgtaccacatccacctgtggatcagctacatccacctgatgagccccttcgtggagcacatcctgtggcacgtgggcctgagcgcctgcctgggcctgaccgtggccctgagcctgctgagcgacatcatcgccctgctgaccttccacatctactgcttctacgtgtacggcgccagactgtactgcctgaagatccacggcctgagcagcctgtggagactgttcagaggcaagaagtggaacgtgctgagacagagagtggacagctgcagctacgacctggaccagctgttcatcggcaccctgctgttcaccatcctgctgttcctgctgcccaccaccgccctgtactacctggtgttcaccctgctgagactgctggtggtggccgtgcagggcctgatccacctgctggtggacctgatcaacagcctgcccctgtacagcctgggcctgagactgtgcagaccctacagactggccgacaagcccaccgccctgcagcccagaggcgcccacctgccccccccccagctgtggctgcccccccaggccctgctgggcagacccgtgccccaggccgtgccctggggcgcccacctgcccctggaggccgagagaggccaggccggcctgagagagctgctggccagactggcccccccccacggccacagccagcccagcgccctgcccggctggcaccagctgagctggagaatgagctgcgccctgtggaccctgctgtgcgcccccgagcacggcagaccctgctaccacaccctgggcctggaggtgatcggcagcgagcagatgtggggctggcccgccagactggccgccctgcaccactggcactgcctgccctgggaccccctgcccacctgctgcggccaccacggcggcgagcacagcaaccccagatgccccgagcactgccccatgcccaccctgtgcacccaggtgcagagagtgagacccccccagcagccccaggtggagggctggagcccctggggcctgcccagcggcagcgccctggccgtgggcgtggagggcccctgccaggacgagccccccagccccagacaccccctggcccccagcgccgagcagcaccccgccagcggcggcctgaagcagagcctgacccccgtgcccagcggccccggccccagcctgcccgagccccacggcgtgtacctgagaatgttccccggcgaggtggccctgtag

SEQ ID NO: 20821 - DNA, 447 bp, Artificial Sequence
  Description of Artificial Sequence: Synthetic coding sequence
atggtgctgaaggccttcttccccacctgctgcgtgagcaccgacagcggcctgctggtgggcagatgggtgcccgagcagagcagcgccgtggtgctggccgtgctgcacttccccttcatccccatccaggtgaagcagctgctggcccaggtgagacaggccagccaggtgggcgtggccgtgctgggcacctggtgccactgcagacaggagcccgaggagagcctgggcagattcctggagagcctgggcgccgtgttcccccacgagccctggctgagactgtgcagagagagaggcggcaccttctggagctgcgaggccacccacagacaggcccccaccgcccccggcgcccccggcgaggaccaggtgatgctgatcttctacgaccagagacaggtgctgctgagccagctgcacctgcccaccgtgctgccctag

SEQ ID NO: 20822 - DNA, 1746 bp, Artificial Sequence
  Description of Artificial Sequence: Synthetic coding sequence
atggtgctgaaggccttcttccccacctgctgcgtgagcaccgacagcggcctgctggtgggcagatgggtgcccgagcagagcagcgccgtggtgctggccgtgctgcacttccccttcatccccatccaggtgaagcagctgctggcccaggtgagacaggccagccaggtgggcgtggccgtgctgggcacctggtgccactgcagacaggagcccgaggagagcctgggcagattcctggagagcctgggcgccgtgttcccccacgagccctggctgagactgtgcagagagagaggcggcaccttctggagctgcgaggccacccacagacaggcccccaccgcccccggcgcccccggcgaggaccaggtgatgctgatcttctacgaccagagacaggtgctgctgagccagctgcacctgcccaccgtgctgcccgacagacaggccggcgccaccaccgccagcaccggcggcctggccgccgtgttcgacaccgtggccagaagcgaggtgctgttcagaagcgacagattcgacgagggccccgtgagactgagccactggcagagcgagggcgtggaggccagcatcctggccgagctggccagaagagccagcggccccatctgcctgctgctggccagcctgctgagcctggtgagcgccgtgagcgcctgcagagtgttcaagctgtggcccctgagcttcctgggcagcaagctgagcacctgcgagcagctgagacacagactggagcacctgaccctgatcttcagcaccagaaaggccgagaaccccgcccagctgatgagaaaggccaacaccgtggccagcgtgctgctggacgtggccctgggcctgatgctgctgagctggctgcacggcagaagcagaatcggccacctggccgacgccctggtgcccgtggccgaccacgtggccgaggagctgcagcacctgctgcagtggctgatgggcgcccccgccggcctgaagatgaacagagccctggaccaggtgctgggcagattcttcctgtaccacatccacctgtggatcagctacatccacctgatgagccccttcgtggagcacatcctgtggcacgtgggcctgagcgcctgcctgggcctgaccgtggccctgagcctgctgagcgacatcatcgccctgctgaccttccacatctactgcttctacgtgtacggcgccagactgtactgcctgaagatccacggcctgagcagcctgtggagactgttcagaggcaagaagtggaacgtgctgagacagagagtggacagctgcagctacgacctggaccagctgttcatcggcaccctgctgttcaccatcctgctgttcctgctgcccaccaccgccctgtactacctggtgttcaccctgctgagactgctggtggtggccgtgcagggcctgatccacctgctggtggacctgatcaacagcctgcccctgtacagcctgggcctgagactgtgcagaccctacagactggccgccggcgtgaagttcagagtgctgagacacgaggccggcagacccctgagactgctgatgcagatcaaccccctgccctacagcagagtggtgcacacctacagactgcccagctgcggctgccaccccaagcacagctggggcgccctgtgcagaaagctgttcctgggcgagctgatctacccctggagacagagaggcgacaagcaggactag

SEQ ID NO: 20823 - DNA, 756 bp, Artificial Sequence
  Description of Artificial Sequence: Synthetic coding sequence
atggtgctgaaggccttcttccccacctgctgcgtgagcaccgacagcggcctgctggtgggcagatgggtgcccgagcagagcagcgccgtggtgctggccgtgctgcacttccccttcatccccatccaggtgaagcagctgctggcccaggtgagacaggccagccaggtgggcgtggccgtgctgggcacctggtgccactgcagacaggagcccgaggagagcctgggcagattcctggagagcctgggcgccgtgttcccccacgagccctggctgagactgtgcagagagagaggcggcaccttctggagctgcgaggccacccacagacaggcccccaccgcccccggcgcccccggcgaggaccaggtgatgctgatcttctacgaccagagacaggtgctgctgagccagctgcacctgcccaccgtgctgcccgacagacaggccggcgccaccaccgccagcaccggcggcctggccgccgtgttcgacaccgtggccagaagcgaggtgctgttcagaagcgacagattcgacgagggccccgtgagactgagccactggcagagcgagggcgtggaggccagcatcctggccgagctggccagaagagccagcggccccatctgcctgctgctggccagcctgctgagcctggtgagcgccgtgagcgcctgcagagtgttcaagctgtggcccctgagcttcctgggcagcaagctgagcacctgcgagcagctgagatag

SEQ ID NO: 20824 - DNA, 1746 bp, Artificial Sequence; identical to SEQ ID NO: 20822
  Description of Artificial Sequence: Synthetic coding sequence

SEQ ID NO: 20825 - DNA, 945 bp, Artificial Sequence
  Description of Artificial Sequence: Synthetic coding sequence
atggtgctgaaggccttcttccccacctgctgcgtgagcaccgacagcggcctgctggtgggcagatgggtgcccgagcagagcagcgccgtggtgctggccgtgctgcacttccccttcatccccatccaggtgaagcagctgctggcccaggtgagacaggccagccaggtgggcgtggccgtgctgggcacctggtgccactgcagacaggagcccgaggagagcctgggcagattcctggagagcctgggcgccgtgttcccccacgagccctggctgagactgtgcagagagagaggcggcaccttctggagctgcgaggccacccacagacaggcccccaccgcccccggcgcccccggcgaggaccaggtgatgctgatcttctacgaccagagacaggtgctgctgagccagctgcacctgcccaccgtgctgcccgacagacaggccggcgccaccaccgccagcaccggcggcctggccgccgtgttcgacaccgtggccagaagcgaggtgctgttcagaagcgacagattcgacgagggccccgtgagactgagccactggcagagcgagggcgtggaggccagcatcctggccgagctggccagaagagccagcggccccatctgcctgctgctggccagcctgctgagcctggtgagcgccgtgagcgcctgcagagtgttcaagctgtggcccctgagcttcctgggcagcaagctgagcacctgcgagcagctgagacacagactggagcacctgaccctgatcttcagcaccagaaaggccgagaaccccgcccagctgatgagaaaggccaacaccgtggccagcgtgctgctggacgtggccctgggcctgatgctgctgagctggctgcacggcagaagcagaatcggccacctggccgacgccctggtgcccgtggccgactag

SEQ ID NO: 20826 - DNA, 339 bp, Artificial Sequence
  Description of Artificial Sequence: Synthetic coding sequence
atggtgctgaaggccttcttccccacctgctgcgtgagcaccgacagcggcctgctggtgggcagatgggtgcccgagcagagcagcgccgtggtgctggccgtgctgcacttccccttcatccccatccaggtgaagcagctgctggcccaggtgagacaggccagccaggtgggcgtggccgtgctgggcacctggtgccactgcagacaggagcccgaggagagcctgggcagattcctggagagcctgggcgccgtgttcccccacgagccctggctgagactgtgcagagagagaggcggcaccttctggagctgcgaggccacccacagatag

SEQ ID NO: 20827 - DNA, 1725 bp, Artificial Sequence
  Description of Artificial Sequence: Synthetic coding sequence
atgtggtgggccctgagaccccccggcatcctgccccccggcatggtgctgaaggccttcttccccacctgctgcgtgagcaccgacagcggcctgctggtgggcagatgggtgcccgagcagagcagcgccgtggtgctggccgtgctgcacttccccttcatccccatccaggtgaagcagctgctggcccaggtgagacaggccagccaggtgggcgtggccgtgctgggcacctggtgccactgcagacaggagcccgaggagagcctgggcagattcctggagagcctgggcgccgtgttcccccacgagccctggctgagactgtgcagagagagaggcggcaccttctggagctgcgaggccacccacagacaggcccccaccgcccccggcgcccccggcgaggaccaggtgatgctgatcttctacgaccagagacaggtgctgctgagccagctgcacctgcccaccgtgctgcccgacagacaggccggcgccaccaccgccagcaccggcggcctggccgccgtgttcgacaccgtggccagaagcgaggtgctgttcagaagcgacagattcgacgagggccccgtgagactgagccactggcagagcgagggcgtggaggccagcatcctggccgagctggccagaagagccagcggccccatctgcctgctgctggccagcctgctgagcctggtgagcgccgtgagcgcctgcagagtgttcaagctgtggcccctgagcttcctgggcagcaagctgagcacctgcgagcagctgagacacagactggagcacctgaccctgatcttcagcaccagaaaggccgagaaccccgcccagctgatgagaaaggccaacaccgtggccagcgtgctgctggacgtggccctgggcctgatgctgctgagctggctgcacggcagaagcagaatcggccacctggccgacgccctggtgcccgtggccgaccacgtggccgaggagctgcagcacctgctgcagtggctgatgggcgcccccgccggcctgaagatgaacagagccctggaccaggtgctgggcagattcttcctgtaccacatccacctgtggatcagctacatccacctgatgagccccttcgtggagcacatcctgtggcacgtgggcctgagcgcctgcctgggcctgaccgtggccctgagcctgctgagcgacatcatcgccctgctgaccttccacatctactgcttctacgtgtacggcgccagactgtactgcctgaagatccacggcctgagcagcctgtggagactgttcagaggcaagaagtggaacgtgctgagacagagagtggacagctgcagctacgacctggaccagctgttcatcggcaccctgctgttcaccatcctgctgttcctgctgcccaccaccgccctgtactacctggtgttcaccctgctgagactgctggtggtggccgtgcagggcctgatccacctgctggtggacctgatcaacagcctgcccctgtacagcctgggcctgagactgtgcagaccctacagactggccggcagcgagccctggagacccgaggccaccggcctgtgcagcagcgccctgggcttcagcggcctgggcagcctgaactgcagacccggcgccaagagaggcaaggtgagaggcaccagaagccagcagggcggccaccaccccctggcctag

SEQ ID NO: 20828 - DNA, 900 bp, Artificial Sequence
  Description of Artificial Sequence: Synthetic coding sequence
atggtgctgaaggccttcttccccacctgctgcgtgagcaccgacagcggcctgctggtgggcagatgggtgcccgagcagagcagcgccgtggtgctggccgtgctgcacttccccttcatccccatccaggtgaagcagctgctggcccaggtgagacaggccagccaggtgggcgtggccgtgctgggcacctggtgccactgcagacaggagcccgaggagagcctgggcagattcctggagagcctgggcgccgtgttcccccacgagccctggctgagactgtgcagagagagaggcggcaccttctggagctgcgaggccacccacagacaggcccccaccgcccccggcgcccccggcgaggaccaggtgatgctgatcttctacgaccagagacaggtgctgctgagccagctgcacctgcccaccgtgctgcccgacagacaggccggcgccaccaccgccagcaccggcggcctggccgccgtgttcgacaccgtggccagaagcgaggtgctgttcagaagcgacagattcgacgagggccccgtgagactgagccactggcagagcgagggcgtggaggccagcatcctggccgagctggccagaagagccagcggccccatctgcctgctgctggccagcctgctgagcctggtgagcgccgtgagcgcctgcagagtgttcaagctgtggcccctgagcttcctgggcagcaagctgagcacctgcgagcagctgagacacagactggagcacctgaccctgatcttcagcaccagaaaggccgagaaccccgcccagctgatgagatgcggccccgccctggtgagcgccggcctgggcgcctgccccctggcccccagccccagccccagcgcccccagatag

SEQ ID NO: 20829 - DNA, 480 bp, Artificial Sequence
  Description of Artificial Sequence: Synthetic coding sequence
cagcccttcctgaacgccctgggcgccgccctgctgtgcggcctgagcgacagcctgctgtgcaacgtgggcggcgagagccccctgacccagctgccccccgccaccatctggacctgcaccgccagccccatgagcagcacccagtggagccccggctgggaccccgtgctgcccccctgcaccctgtgcagcaccttctacagcacctgcctgagcctgcacacccacagatgcaccttcagaaccagaatggccctgcagtggccccccatgcccagcatcgtgcccgccggcgtgggcagcctggtgtacaacgtggacagcaagacctacaacgccagcgtgctgcccgtgagagtggaggtggacatggtgagatggagatgcagctggcacagctgcggctgcagcctgggcctgctgagccccagctgcctgcagaacgcctgcttccagggcctgagagtgaagggctag

SEQ ID NO: 20830 - DNA, 1668 bp, Artificial Sequence
  Description of Artificial Sequence: Synthetic coding sequence
atggccgccgccggcgccgccgccacccacctggaggtggccagaggcaagagagccgccctgttcttcgccgccgtggccatcgtgctgggcctgcccctgtggtggaagaccaccgagacctacagagccagcctgccctacagccagatcagcggcctgaacgccctgcagctgagactgatggtgcccgtgaccgtggtgttcaccagagagagcgtgcccctggacgaccaggagaagctgcccttcaccgtggtgcacgagagagagatccccctgaagtacaagatgaagatcaagtgcagattccagaaggcctacagaagagccctggaccacgaggaggaggccctgagcagcggcagcgtgcaggaggccgaggccatgctggacgagccccaggagcaggccgagggcagcctgaccgtgtacgtgatcagcgagcacagcagcctgctgccccaggacatgatgagctacatcggccccaagagaaccgccgtggtgagaggcatcatgcacagagaggccttcaacatcatcggcagaagaatcgtgcaggtggcccaggccatgagcctgaccgaggacgtgctggccgccgccctggccgaccacctgcccgaggacaagtggagcgccgagaagagaagacccctgaagagcagcctgggctacgagatcaccttcagcctgctgaaccccgaccccaagagccacgacgtgtactgggacatcgagggcgccgtgagaagatacgtgcagcccttcctgaacgccctgggcgccgccggcaacttcagcgtggacagccagatcctgtactacgccatgctgggcgtgaaccccagattcgacagcgccagcagcagctactacctggacatgcacagcctgccccacgtgatcaaccccgtggagagcagactgggcagcagcgccgccagcctgtaccccgtgctgaacttcctgctgtacgtgcccgagctggcccacagccccctgtacatccaggacaaggacggcgcccccgtggccaccaacgccttccacagccccagatggggcggcatcatggtgtacaacgtggacagcaagacctacaacgccagcgtgctgcccgtgagagtggaggtggacatggtgagagtgatggaggtgttcctggcccagctgagactgctgttcggcatcgcccagccccagctgccccccaagtgcctgctgagcggccccaccagcgagggcctgatgacctgggagctggacagactgctgtgggccagaagcgtggagaacctggccaccgccaccaccaccctgaccagcctggcccagctgctgggcaagatcagcaacatcgtgatcaaggacgacgtggccagcgaggtgtacaaggccgtggccgccgtgcagaagagcgccgaggagctggccagcggccacctggccagcgccttcgtggccagccaggaggccgtgaccagcagcgagctggccttcttcgaccccagcctgctgcacctgctgtacttccccgacgaccagaagttcgccatctacatccccctgttcctgcccatggccgtgcccatcctgctgagcctggtgaagatcttcctggagaccagaaagagctggagaaagcccgagaagaccgactag

SEQ ID NO: 20831 - DNA, 1644 bp, Artificial Sequence
  Description of Artificial Sequence: Synthetic coding sequence
atgcccagcgaggtggccagaggcaagagagccgccctgttcttcgccgccgtggccatcgtgctgggcctgcccctgtggtggaagaccaccgagacctacagagccagcctgccctacagccagatcagcggcctgaacgccctgcagctgagactgatggtgcccgtgaccgtggtgttcaccagagagagcgtgcccctggacgaccaggagaagctgcccttcaccgtggtgcacgagagagagatccccctgaagtacaagatgaagatcaagtgcagattccagaaggcctacagaagagccctggaccacgaggaggaggccctgagcagcggcagcgtgcaggaggccgaggccatgctggacgagccccaggagcaggccgagggcagcctgaccgtgtacgtgatcagcgagcacagcagcctgctgccccaggacatgatgagctacatcggccccaagagaaccgccgtggtgagaggcatcatgcacagagaggccttcaacatcatcggcagaagaatcgtgcaggtggcccaggccatgagcctgaccgaggacgtgctggccgccgccctggccgaccacctgcccgaggacaagtggagcgccgagaagagaagacccctgaagagcagcctgggctacgagatcaccttcagcctgctgaaccccgaccccaagagccacgacgtgtactgggacatcgagggcgccgtgagaagatacgtgcagcccttcctgaacgccctgggcgccgccggcaacttcagcgtggacagccagatcctgtactacgccatgctgggcgtgaaccccagattcgacagcgccagcagcagctactacctggacatgcacagcctgccccacgtgatcaaccccgtggagagcagactgggcagcagcgccgccagcctgtaccccgtgctgaacttcctgctgtacgtgcccgagctggcccacagccccctgtacatccaggacaaggacggcgcccccgtggccaccaacgccttccacagccccagatggggcggcatcatggtgtacaacgtggacagcaagacctacaacgccagcgtgctgcccgtgagagtggaggtggacatggtgagagtgatggaggtgttcctggcccagctgagactgctgttcggcatcgcccagccccagctgccccccaagtgcctgctgagcggccccaccagcgagggcctgatgacctgggagctggacagactgctgtgggccagaagcgtggagaacctggccaccgccaccaccaccctgaccagcctggcccagctgctgggcaagatcagcaacatcgtgatcaaggacgacgtggccagcgaggtgtacaaggccgtggccgccgtgcagaagagcgccgaggagctggccagcggccacctggccagcgccttcgtggccagccaggaggccgtgaccagcagcgagctggccttcttcgaccccagcctgctgcacctgctgtacttccccgacgaccagaagttcgccatctacatccccctgttcctgcccatggccgtgcccatcctgctgagcctggtgaagatcttcctggagaccagaaagagctggagaaagcccgagaagaccgactag

SEQ ID NO: 20832 - DNA, 1485 bp, Artificial Sequence
  Description of Artificial Sequence: Synthetic coding sequence
atggtgcccgtgaccgtggtgttcaccagagagagcgtgcccctggacgaccaggagaagctgcccttcaccgtggtgcacgagagagagatccccctgaagtacaagatgaagatcaagtgcagattccagaaggcctacagaagagccctggaccacgaggaggaggccctgagcagcggcagcgtgcaggaggccgaggccatgctggacgagccccaggagcaggccgagggcagcctgaccgtgtacgtgatcagcgagcacagcagcctgctgccccaggacatgatgagctacatcggccccaagagaaccgccgtggtgagaggcatcatgcacagagaggccttcaacatcatcggcagaagaatcgtgcaggtggcccaggccatgagcctgaccgaggacgtgctggccgccgccctggccgaccacctgcccgaggacaagtggagcgccgagaagagaagacccctgaagagcagcctgggctacgagatcaccttcagcctgctgaaccccgaccccaagagccacgacgtgtactgggacatcgagggcgccgtgagaagatacgtgcagcccttcctgaacgccctgggcgccgccggcaacttcagcgtggacagccagatcctgtactacgccatgctgggcgtgaaccccagattcgacagcgccagcagcagctactacctggacatgcacagcctgccccacgtgatcaaccccgtggagagcagactgggcagcagcgccgccagcctgtaccccgtgctgaacttcctgctgtacgtgcccgagctggcccacagccccctgtacatccaggacaaggacggcgcccccgtggccaccaacgccttccacagccccagatggggcggcatcatggtgtacaacgtggacagcaagacctacaacgccagcgtgctgcccgtgagagtggaggtggacatggtgagagtgatggaggtgttcctggcccagctgagactgctgttcggcatcgcccagccccagctgccccccaagtgcctgctgagcggccccaccagcgagggcctgatgacctgggagctggacagactgctgtgggccagaagcgtggagaacctggccaccgccaccaccaccctgaccagcctggcccagctgctgggcaagatcagcaacatcgtgatcaaggacgacgtggccagcgaggtgtacaaggccgtggccgccgtgcagaagagcgccgaggagctggccagcggccacctggccagcgccttcgtggccagccaggaggccgtgaccagcagcgagctggccttcttcgaccccagcctgctgcacctgctgtacttccccgacgaccagaagttcgccatctacatccccctgttcctgcccatggccgtgcccatcctgctgagcctggtgaagatcttcctggagaccagaaagagctggagaaagcccgagaagaccgactag

SEQ ID NO: 20833 - DNA, 1431 bp, Artificial Sequence
  Description of Artificial Sequence: Synthetic coding sequence
atggccgccgccatgcccctggccctgctggtgctgctgctgctgggccccggcggctggtgcctggccgagccccccagagacagcctgagagaggagctggtgatcacccccctgcccagcggcgacgtggccgccaccttccagttcagaaccagatgggacagcgagctgcagagagagggcgacaccgaccactacttcctgagatacgccgtgctgcccagagaggtggtgtgcaccgagaacctgaccccctggaagaagctgctgccctgcagcagcaaggccggcctgagcgtgctgctgaaggccgacagactgttccacaccagctaccacagccaggccgtgcacatcagacccgtgtgcagaaacgccagatgcaccagcatcagctgggagctgagacagaccctgagcgtggtgttcgacgccttcatcaccggccagggcaagaaggactggagcctgttcagaatgttcagcagaaccctgaccgagccctgccccctggccagcgagagcagagtgtacgtggacatcaccacctacaaccaggacaacgagaccctggaggtgcaccccccccccaccaccacctaccaggacgtgatcctgggcaccagaaagacctacgccatctacgacctgctggacaccgccatgatcaacaacagcagaaacctgaacatccagctgaagtggaagagaccccccgagaacgaggccccccccgtgcccttcctgcacgcccagagatacgtgagcggctacggcctgcagaagggcgagctgagcaccctgctgtacaacacccacccctacagagccttccccgtgctgctgctggacaccgtgccctggtacctgagactgtacgtgcacaccctgaccatcaccagcaagggcaaggagaacaagcccagctacatccactaccagcccgcccaggacagactgcagccccacctgctggagatgctgatccagctgcccgccaacagcgtgaccaaggtgagcatccagttcgagagagccctgctgaagtggaccgagtacacccccgaccccaaccacggcttctacgtgagccccagcgtgctgagcgccctggtgcccagcatggtggccgccaagcccgtggactgggaggagagccccctgttcaacagcctgttccccgtgagcgacggcagcaactacttcgtgagactgtacaccgagcccctgctggtgaacctgcccacccccgacttcagcatgccctacaacgtgatctgcctgacctgcaccgtggtggccgtgtgctacggcagcttctacaacctgctgaccagaaccttccacatcgaggagcccagaaccggcggcctggccaagagactggccaacctgatcagaagagccagaggcgtgccccccctgtag

SEQ ID NO: 20834 - DNA, 1737 bp, Artificial Sequence
  Description of Artificial Sequence: Synthetic coding sequence
atggccgccgccatgcccctggccctgctggtgctgctgctgctgggccccggcggctggtgcctggccgagccccccagagacagcctgagagaggagctggtgatcacccccctgcccagcggcgacgtggccgccaccttccagttcagaaccagatgggacagcgagctgcagagagagggcgtgagccactacagactgttccccaaggccctgggccagctgatcagcaagtacagcctgagagagctgcacctgagcttcacccagggcttctggagaaccagatactggggcccccccttcctgcaggcccccagcggcgccgagctgtgggtgtggttccaggacaccgtgaccgacgtggacaagagctggaaggagctgagcaacgtgctgagcggcatcttctgcgccagcctgaacttcatcgacagcaccaacaccgtgacccccaccgccagcttcaagcccctgggcctggccaacgacaccgaccactacttcctgagatacgccgtgctgcccagagaggtggtgtgcaccgagaacctgaccccctggaagaagctgctgccctgcagcagcaaggccggcctgagcgtgctgctgaaggccgacagactgttccacaccagctaccacagccaggccgtgcacatcagacccgtgtgcagaaacgccagatgcaccagcatcagctgggagctgagacagaccctgagcgtggtgttcgacgccttcatcaccggccagggcaagaaggactggagcctgttcagaatgttcagcagaaccctgaccgagccctgccccctggccagcgagagcagagtgtacgtggacatcaccacctacaaccaggacaacgagaccctggaggtgcaccccccccccaccaccacctaccaggacgtgatcctgggcaccagaaagacctacgccatctacgacctgctggacaccgccatgatcaacaacagcagaaacctgaacatccagctgaagtggaagagaccccccgagaacgaggccccccccgtgcccttcctgcacgcccagagatacgtgagcggctacggcctgcagaagggcgagctgagcaccctgctgtacaacacccacccctacagagccttccccgtgctgctgctggacaccgtgccctggtacctgagactgtacgtgcacaccctgaccatcaccagcaagggcaaggagaacaagcccagctacatccactaccagcccgcccaggacagactgcagccccacctgctggagatgctgatccagctgcccgccaacagcgtgaccaaggtgagcatccagttcgagagagccctgctgaagtggaccgagtacacccccgaccccaaccacggcttctacgtgagccccagcgtgctgagcgccctggtgcccagcatggtggccgccaagcccgtggactgggaggagagccccctgttcaacagcctgttccccgtgagcgacggcagcaactacttcgtgagactgtacaccgagcccctgctggtgaacctgcccacccccgacttcagcatgccctacaacgtgatctgcctgacctgcaccgtggtggccgtgtgctacggcagcttctacaacctgctgaccagaaccttccacatcgaggagcccagaaccggcggcctggccaagagactggccaacctgatcagaagagccagaggcgtgccccccctgtag

SEQ ID NO: 20835 - DNA, 1155 bp, Artificial Sequence
  Description of Artificial Sequence: Synthetic coding sequence
atggccgccgccatgcccctggccctgctggtgctgctgctgctgggccccggcggctggtgcctggccgagccccccagagacagcctgagagaggagctggtgatcacccccctgcccagcggcgacgtggccgccaccttccagttcagaaccagatgggacagcgagctgcagagagagggcgactggagcctgttcagaatgttcagcagaaccctgaccgagccctgccccctggccagcgagagcagagtgtacgtggacatcaccacctacaaccaggacaacgagaccctggaggtgcaccccccccccaccaccacctaccaggacgtgatcctgggcaccagaaagacctacgccatctacgacctgctggacaccgccatgatcaacaacagcagaaacctgaacatccagctgaagtggaagagaccccccgagaacgaggccccccccgtgcccttcctgcacgcccagagatacgtgagcggctacggcctgcagaagggcgagctgagcaccctgctgtacaacacccacccctacagagccttccccgtgctgctgctggacaccgtgccctggtacctgagactgtacgtgcacaccctgaccatcaccagcaagggcaaggagaacaagcccagctacatccactaccagcccgcccaggacagactgcagccccacctgctggagatgctgatccagctgcccgccaacagcgtgaccaaggtgagcatccagttcgagagagccctgctgaagtggaccgagtacacccccgaccccaaccacggcttctacgtgagccccagcgtgctgagcgccctggtgcccagcatggtggccgccaagcccgtggactgggaggagagccccctgttcaacagcctgttccccgtgagcgacggcagcaactacttcgtgagactgtacaccgagcccctgctggtgaacctgcccacccccgacttcagcatgccctacaacgtgatctgcctgacctgcaccgtggtggccgtgtgctacggcagcttctacaacctgctgaccagaaccttccacatcgaggagcccagaaccggcggcctggccaagagactggccaacctgatcagaagagccagaggcgtgccccccctgtag

SEQ ID NO: 20836 - DNA, 1536 bp, Artificial Sequence
  Description of Artificial Sequence: Synthetic coding sequence
atggccgccgccatgcccctggccctgctggtgctgctgctgctgggccccggcggctggtgcctggccgagccccccagagacagcctgagagaggagctggtgatcacccccctgcccagcggcgacgtggccgccaccttccagttcagaaccagatgggacagcgagctgcagagagagggcgtgagccactacagactgttccccaaggccctgggccagctgatcagcaagtacagcctgagagagctgcacctgagcttcacccagggcttctggagaaccagatactggggcccccccttcctgcaggcccccagcggcgccgagctgtgggtgtggttccaggacaccgtgaccgacgtggacaagagctggaaggagctgagcaacgtgctgagcggcatcttctgcgccagcctgaacttcatcgacagcaccaacaccgtgacccccaccgccagcttcaagcccctgggcctggccaacgacaccgaccactacttcctgagatacgccgtgctgcccagagaggtggtgtgcaccgagaacctgaccccctggaagaagctgctgccctgcagcagcaaggccggcctgagcgtgctgctgaaggccgacagactgttccacaccagctaccacagccaggccgtgcacatcagacccgtgtgcagaaacgccagatgcaccagcatcagctgggagctgagacagaccctgagcgtggtgttcgacgccttcatcaccggccagggcaagaaggactggagcctgttcagaatgttcagcagaaccctgaccgagccctgccccctggccagcgagagcagagtgtacgtggacatcaccacctacaaccaggacaacgagaccctggaggtgcaccccccccccaccaccacctaccaggacgtgatcctgggcaccagaaagacctacgccatctacgacctgctggacaccgccatgatcaacaacagcagaaacctgaacatccagctgaagtggaagagaccccccgagaacggctacatccactaccagcccgcccaggacagactgcagccccacctgctggagatgctgatccagctgcccgccaacagcgtgaccaaggtgagcatccagttcgagagagccctgctgaagtggaccgagtacacccccgaccccaaccacggcttctacgtgagccccagcgtgctgagcgccctggtgcccagcatggtggccgccaagcccgtggactgggaggagagccccctgttcaacagcctgttccccgtgagcgacggcagcaactacttcgtgagactgtacaccgagcccctgctggtgaacctgcccacccccgacttcagcatgccctacaacgtgatctgcctgacctgcaccgtggtggccgtgtgctacggcagcttctacaacctgctgaccagaaccttccacatcgaggagcccagaaccggcggcctggccaagagactggccaacctgatcagaagagccagaggcgtgccccccctgtag

SEQ ID NO: 20837 - DNA, 1272 bp, Artificial Sequence
  Description of Artificial Sequence: Synthetic coding sequence
atgtggatcaacctgggcagaagcagcgtgatgagcagccagggcagcagcgcccccctgagcaccagcagcaccccccccacccagagcctgcccctgccccccagcaacccctgggtgtggcccatggccggcctgagcgtgctgctgaaggccgacagactgttccacaccagctaccacagccaggccgtgcacatcagacccgtgtgcagaaacgccagatgcaccagcatcagctgggagctgagacagaccctgagcgtggtgttcgacgccttcatcaccggccagggcaagaaggactggagcctgttcagaatgttcagcagaaccctgaccgagccctgccccctggccagcgagagcagagtgtacgtggacatcaccacctacaaccaggacaacgagaccctggaggtgcaccccccccccaccaccacctaccaggacgtgatcctgggcaccagaaagacctacgccatctacgacctgctggacaccgccatgatcaacaacagcagaaacctgaacatccagctgaagtggaagagaccccccgagaacgaggccccccccgtgcccttcctgcacgcccagagatacgtgagcggctacggcctgcagaagggcgagctgagcaccctgctgtacaacacccacccctacagagccttccccgtgctgctgctggacaccgtgccctggtacctgagactgtacgtgcacaccctgaccatcaccagcaagggcaaggagaacaagcccagctacatccactaccagcccgcccaggacagactgcagccccacctgctggagatgctgatccagctgcccgccaacagcgtgaccaaggtgagcatccagttcgagagagccctgctgaagtggaccgagtacacccccgaccccaaccacggcttctacgtgagccccagcgtgctgagcgccctggtgcccagcatggtggccgccaagcccgtggactgggaggagagccccctgttcaacagcctgttccccgtgagcgacggcagcaactacttcgtgagactgtacaccgagcccctgctggtgaacctgcccacccccgacttcagcatgccctacaacgtgatctgcctgacctgcaccgtggtggccgtgtgctacggcagcttctacaacctgctgaccagaaccttccacatcgaggagcccagaaccggcggcctggccaagagactggccaacctgatcagaagagccagaggcgtgccccccctgtag

SEQ ID NO: 20838 - DNA, 1569 bp, Artificial Sequence
  Description of Artificial Sequence: Synthetic coding sequence
atggccgccgccatgcccctggccctgctggtgctgctgctgctgggccccggcggctggtgcctggccgagccccccagagacagcctgagagaggagctggtgatcacccccctgcccagcggcgacgtggccgccaccttccagttcagaaccagatgggacagcgagctgcagagagagggcgtgagccactacagactgttccccaaggccctgggccagctgatcagcaagtacagcctgagagagctgcacctgagcttcacccagggcttctggagaaccagatactggggcccccccttcctgcaggcccccagcgacaccgaccactacttcctgagatacgccgtgctgcccagagaggtggtgtgcaccgagaacctgaccccctggaagaagctgctgccctgcagcagcaaggccggcctgagcgtgctgctgaaggccgacagactgttccacaccagctaccacagccaggccgtgcacatcagacccgtgtgcagaaacgccagatgcaccagcatcagctgggagctgagacagaccctgagcgtggtgttcgacgccttcatcaccggccagggcaagaaggactggagcctgttcagaatgttcagcagaaccctgaccgagccctgccccctggccagcgagagcagagtgtacgtggacatcaccacctacaaccaggacaacgagaccctggaggtgcaccccccccccaccaccacctaccaggacgtgatcctgggcaccagaaagacctacgccatctacgacctgctggacaccgccatgatcaacaacagcagaaacctgaacatccagctgaagtggaagagaccccccgagaacgaggccccccccgtgcccttcctgcacgcccagagatacgtgagcggctacggcctgcagaagggcgagctgagcaccctgctgtacaacacccacccctacagagccttccccgtgctgctgctggacaccgtgccctggtacctgagactgtacgtgcacaccctgaccatcaccagcaagggcaaggagaacaagcccagctacatccactaccagcccgcccaggacagactgcagccccacctgctggagatgctgatccagctgcccgccaacagcgtgaccaaggtgagcatccagttcgagagagccctgctgaagtggaccgagtacacccccgaccccaaccacggcttctacgtgagccccagcgtgctgagcgccctggtgcccagcatggtggccgccaagcccgtggactgggaggagagccccctgttcaacagcctgttccccgtgagcgacggcagcaactacttcgtgagactgtacaccgagcccctgctggtgaacctgcccacccccgacttcagcatgccctacaacgtgatctgcctgacctgcaccgtggtggccgtgtgctacggcagcttctacaacctgctgaccagaaccttccacatcgaggagcccagaaccggcggcctggccaagagactggccaacctgatcagaagagccagaggcgtgccccccctgtag

SEQ ID NO: 20839 - DNA, 951 bp, Artificial Sequence
  Description of Artificial Sequence: Synthetic coding sequence
atgttcagcagaaccctgaccgagccctgccccctggccagcgagagcagagtgtacgtggacatcaccacctacaaccaggacaacgagaccctggaggtgcaccccccccccaccaccacctaccaggacgtgatcctgggcaccagaaagacctacgccatctacgacctgctggacaccgccatgatcaacaacagcagaaacctgaacatccagctgaagtggaagagaccccccgagaacgaggccccccccgtgcccttcctgcacgcccagagatacgtgagcggctacggcctgcagaagggcgagctgagcaccctgctgtacaacacccacccctacagagccttccccgtgctgctgctggacaccgtgccctggtacctgagactgtacgtgcacaccctgaccatcaccagcaagggcaaggagaacaagcccagctacatccactaccagcccgcccaggacagactgcagccccacctgctggagatgctgatccagctgcccgccaacagcgtgaccaaggtgagcatccagttcgagagagccctgctgaagtggaccgagtacacccccgaccccaaccacggcttctacgtgagccccagcgtgctgagcgccctggtgcccagcatggtggccgccaagcccgtggactgggaggagagccccctgttcaacagcctgttccccgtgagcgacggcagcaactacttcgtgagactgtacaccgagcccctgctggtgaacctgcccacccccgacttcagcatgccctacaacgtgatctgcctgacctgcaccgtggtggccgtgtgctacggcagcttctacaacctgctgaccagaaccttccacatcgaggagcccagaaccggcggcctggccaagagactggccaacctgatcagaagagccagaggcgtgccccccctgtag

SEQ ID NO: 20840 - DNA, 345 bp, Artificial Sequence
  Description of Artificial Sequence: Synthetic coding sequence
atgctgagcggcgccagatgcagactggccagcgccctgagaggcaccagagccccccccagcgccgtggccagaagatgcctgcacgccagcggcagcagacccctggccgacagaggcaagaagaccgaggagccccccagagacttcgaccccgccctgctggagttcctggtgtgccccctgagcaagaagcccctgagatacgaggccagcaccaacgagctgatcaacgaggagctgggcatcgcctaccccatcatcgacggcatccccaacatgatcccccaggccgccagaatgaccagacagagcaagaagcaggaggaggtggagcagagatag

SEQ ID NO: 20841 - DNA, 216 bp, Artificial Sequence
  Description of Artificial Sequence: Synthetic coding sequence
atgttcctgagcctgcccaccctgaccgtgctgatccccctggtgagcctggccggcctgttctacagcgccagcgtggaggagaacttcccccagggctgcaccagcaccgccagcctgtgcttctacagcctgctgctgcccatcaccatccccgtgtacgtgttcttccacctgtggacctggatgggcatcaagctgttcagacacaactag

SEQ ID NO: 20842 - DNA, 4032 bp, Artificial Sequence
  Description of Artificial Sequence: Synthetic coding sequence
atgatcatcaaggagtacagaatccccctgcccatgaccgtggaggagtacagaatcgcccagctgtacatgatccagaagaagagcagaaacgagacctacggcgagggcagcggcgtggagatcctggagaacagaccctacaccgacggccccggcggcagcggccagtacacccacaaggtgtaccacgtgggcatgcacatccccagctggttcagaagcatcctgcccaaggccgccctgagagtggtggaggagagctggaacgcctacccctacaccagaaccagattcacctgccccttcgtggagaagttcagcatcgacatcgagaccttctacaagaccgacgccggcgagaaccccgacgtgttcaacctgagccccgtggagaagaaccagctgaccatcgacttcatcgacatcgtgaaggaccccgtgccccacaacgagtacaagaccgaggaggaccccaagctgttccagagcaccaagacccagagaggccccctgagcgagaactggatcgaggagtacaagaagcaggtgttccccatcatgtgcgcctacaagctgtgcaaggtggagttcagatactggggcatgcagagcaagatcgagagattcatccacgacaccggcctgagaagagtgatggtgagagcccacagacaggcctggtgctggcaggacgagtggtacggcctgagcatggagaacatcagagagctggagaaggaggcccagctgatgctgagcagaaagatggcccagttcaacgaggacggcgaggaggccaccgagctggtgaagcacgaggccgtgagcgaccagaccagcggcgagccccccgagcccagcagcagcaacggcgagcccctggtgggcagaggcctgaagaagcagtggagcaccagcagcaagagcagcagaagcagcaagagaggcgccagccccagcagacacagcatcagcgagtggagaatgcagagcatcgccagagacagcgacgagagcagcgacgacgagttcttcgacgcccacgaggacctgagcgacaccgaggagatgttccccaaggacatcaccaagtggagcagcaacgacctgatggacaagatcgagagccccgagcccgaggacacccaggacggcctgtacagacagggcgcccccgagttcagagtggccagcagcgtggagcagctgaacatcatcgaggacgaggtgagccagcccctggccgccccccccagcaagatccacgtgctgctgctggtgctgcacggcggcaccatcctggacaccggcgccggcgaccccagcagcaagaagggcgacgccaacaccatcgccaacgtgttcgacaccgtgatgagagtgcactaccccagcgccctgggcagactggccatcagactggtgccctgcccccccgtgtgcagcgacgccttcgccctggtgagcaacctgagcccctacagccacgacgagggctgcctgagcagcagccaggaccacatccccctggccgccctgcccctgctggccaccagcagcccccagtaccaggaggccgtggccaccgtgatccagagagccaacctggcctacggcgacttcatcaagagccaggagggcatgaccttcaacggccaggtgtgcctgatcggcgactgcgtgggcggcatcctggccttcgacgccctgtgctacagcaaccagcccgtgagcgagagccagagcagcagcagaagaggcagcgtggtgagcatgcaggacaacgacctgctgagccccggcatcctgatgaacgccgcccactgctgcggcggcggcggcggcggcggcggcggcggcggcagcagcggcggcggcggcagcagcggcggcagcagcctggagagcagcagacacctgagcagaagcaacgtggacatccccagaagcaacggcaccgaggaccccaagagacagctgcccagaaagagaagcgacagcagcacctacgagctggacaccatccagcagcaccaggccttcctgagcagcctgcacgccagcgtgctgagaaccgagccctgcagcagacacagcagcagcagcaccatgctggacggcaccggcgccctgggcagattcgacttcgagatcaccgacctgttcctgttcggctgccccctgggcctggtgctggccctgagaaagaccgtgatccccgccctggacgtgttccagctgagacccgcctgccagcaggtgtacaacctgttccaccccgccgaccccagcgccagcagactggagcccctgctggagagaagattccacgccctgccccccttcagcgtgcccagataccagagataccccctgggcgacggctgcagcaccctgctggtggagaccgtgcagagaaaccccgagctggtgctggagggcggccccctggcccccctgccccacggcgacggcttcctggagaccagcatgcccgtgcccgcccccacctggcaggacggccccagacccggctgcgccgagagcgacgtgctgcagacccacaacgccgccttccaggagcacggcgcccccagcagccccggcaccgcccccgccagcagaggcttcagaagagccagcgagatcagcatcgccagccaggtgagcggcatggccgagagctacaccgccagcagcatcgcccagatcgccgccaagtggtggggccagaagagaatcgactacgccctgtactgccccgacgccctgaccgccttccccaccgtggccctgccccacctgttccacgccagctactgggagagcaccgacgtggtgagcttcctgctgagacaggtgatgagacacgacaacagcagcatcctggagctggacggcaaggaggtgagcgtgttcacccccagcaagcccagagagaagtggcagagaaagagaacccacgtgaagctgagaaacgtgaccgccaaccacagaatcaacgacgccctggccaacgaggacggcccccaggtgctgaccggcagattcatgtacggccccctggacatggtgaccctgaccggcgagaaggtggacgtgcacatcatgacccagccccccagcggcgagtggctgtacctggacaccctggtgaccaacaacagcggcagagtgagctacaccatccccgagagccacagactgggcgtgggcgtgtaccccatcaagatggtggtgagaggcgaccacaccttcgccgacagctacatcaccgtgctgcccaagggcaccgagttcgtggtgttcagcatcgacggcagcttcgccgccagcgtgagcatcatgggcagcgaccccaaggtgagagccggcgccgtggacgtggtgagacactggcaggacctgggctacctgatcatctacgtgaccggcagacccgacatgcagaagcagagagtggtggcctggctggcccagcacaacttcccccacggcgtggtgagcttctgcgacggcctggtgcacgaccccctgagacacaaggccaacttcctgaagctgctgatcagcgagctgcacctgagagtgcacgccgcctacggcagcaccaaggacgtggccgtgtacagcgccatcagcctgagccccatgcagatctacatcgtgggcagacccaccaagaagctgcagcagcagtgccagttcatcaccgacggctacgccgcccacctggcccagctgaagtacagccacagagccagacccgccagaaacaccgccaccagaatggccctgagaaagggcagcttcggcctgcccggccagggcgacttcctgagaagcagaaaccacctgctgagaaccatcagcgcccagcccagcggccccagccacagacacgagagaacccagagccaggccgacggcgagcagagaggccagagaagcatgagcgtggccgccggctgctggggcagagccatgaccggcagactggagcccggcgccgccgccggccccaagtag

SEQ ID NO: 20843 - DNA, 4050 bp, Artificial Sequence
  Description of Artificial Sequence: Synthetic coding sequence
atgatcatcaaggagtacagaatccccctgcccatgaccgtggaggagtacagaatcgcccagctgtacatgatccagaagaagagcagaaacgagacctacggcgagggcagcggcgtggagatcctggagaacagaccctacaccgacggccccggcggcagcggccagtacacccacaaggtgtaccacgtgggcatgcacatccccagctggttcagaagcatcctgcccaaggccgccctgagagtggtggaggagagctggaacgcctacccctacaccagaaccagattcacctgccccttcgtggagaagttcagcatcgacatcgagaccttctacaagaccgacgccggcgagaaccccgacgtgttcaacctgagccccgtggagaagaaccagctgaccatcgacttcatcgacatcgtgaaggaccccgtgccccacaacgagtacaagaccgaggaggaccccaagctgttccagagcaccaagacccagagaggccccctgagcgagaactggatcgaggagtacaagaagcaggtgttccccatcatgtgcgcctacaagctgtgcaaggtggagttcagatactggggcatgcagagcaagatcgagagattcatccacgacaccggcctgagaagagtgatggtgagagcccacagacaggcctggtgctggcaggacgagtggtacggcctgagcatggagaacatcagagagctggagaaggaggcccagctgatgctgagcagaaagatggcccagttcaacgaggacggcgaggaggccaccgagctggtgaagcacgaggccgtgagcgaccagaccagcggcgagccccccgagcccagcagcagcaacggcgagcccctggtgggcagaggcctgaagaagcagtggagcaccagcagcaagagcagcagaagcagcaagagaggcgccagccccagcagacacagcatcagcgagtggagaatgcagagcatcgccagagacagcgacgagagcagcgacgacgagttcttcgacgcccacgaggacctgagcgacaccgaggagatgttccccaaggacatcaccaagtggagcagcaacgacctgatggacaagatcgagagccccgagcccgaggacacccaggacggcctgtacagacagggcgcccccgagttcagagtggccagcagcgtggagcagctgaacatcatcgaggacgaggtgagccagcccctggccgccccccccagcaagatccacgtgctgctgctggtgctgcacggcggcaccatcctggacaccggcgccggcgaccccagcagcaagaagggcgacgccaacaccatcgccaacgtgttcgacaccgtgatgagagtgcactaccccagcgccctgggcagactggccatcagactggtgccctgcccccccgtgtgcagcgacgccttcgccctggtgagcaacctgagcccctacagccacgacgagggctgcctgagcagcagccaggaccacatccccctggccgccctgcccctgctggccaccagcagcccccagtaccaggaggccgtggccaccgtgatccagagagccaacctggcctacggcgacttcatcaagagccaggagggcatgaccttcaacggccaggtgtgcctgatcggcgactgcgtgggcggcatcctggccttcgacgccctgtgctacagcaaccagcccgtgagcgagagccagagcagcagcagaagaggcagcgtggtgagcatgcaggacaacgacctgctgagccccggcatcctgatgaacgccgcccactgctgcggcggcggcggcggcggcggcggcggcggcggcagcagcggcggcggcggcagcagcggcggcagcagcctggagagcagcagacacctgagcagaagcaacgtggacatccccagaagcaacggcaccgaggaccccaagagacagctgcccagaaagagaagcgacagcagcacctacgagctggacaccatccagcagcaccaggccttcctgagcagcctgcacgccagcgtgctgagaaccgagccctgcagcagacacagcagcagcagcaccatgctggacggcaccggcgccctgggcagattcgacttcgagatcaccgacctgttcctgttcggctgccccctgggcctggtgctggccctgagaaagaccgtgatccccgccctggacgtgttccagctgagacccgcctgccagcaggtgtacaacctgttccaccccgccgaccccagcgccagcagactggagcccctgctggagagaagattccacgccctgccccccttcagcgtgcccagataccagagataccccctgggcgacggctgcagcaccctgctggccgacgtgctgcagacccacaacgccgccttccaggagcacggcgcccccagcagccccggcaccgcccccgccagcagaggcttcagaagagccagcgagatcagcatcgccagccaggtgagcggcatggccgagagctacaccgccagcagcatcgcccagaaggcccccgacgccctgagccacacccccagcgtgagaagactgagcctgctggccctgcccgcccccagccccaccacccccggcccccacccccccgccagaaaggccagccccggcctggagagagcccccggcctgcccgagctggacatcggcgaggtggccgccaagtggtggggccagaagagaatcgactacgccctgtactgccccgacgccctgaccgccttccccaccgtggccctgccccacctgttccacgccagctactgggagagcaccgacgtggtgagcttcctgctgagacaggtgatgagacacgacaacagcagcatcctggagctggacggcaaggaggtgagcgtgttcacccccagcaagcccagagagaagtggcagagaaagagaacccacgtgaagctgagaaacgtgaccgccaaccacagaatcaacgacgccctggccaacgaggacggcccccaggtgctgaccggcagattcatgtacggccccctggacatggtgaccctgaccggcgagaaggtggacgtgcacatcatgacccagccccccagcggcgagtggctgtacctggacaccctggtgaccaacaacagcggcagagtgagctacaccatccccgagagccacagactgggcgtgggcgtgtaccccatcaagatggtggtgagaggcgaccacaccttcgccgacagctacatcaccgtgctgcccaagggcaccgagttcgtggtgttcagcatcgacggcagcttcgccgccagcgtgagcatcatgggcagcgaccccaaggtgagagccggcgccgtggacgtggtgagacactggcaggacctgggctacctgatcatctacgtgaccggcagacccgacatgcagaagcagagagtggtggcctggctggcccagcacaacttcccccacggcgtggtgagcttctgcgacggcctggtgcacgaccccctgagacacaaggccaacttcctgaagctgctgatcagcgagctgcacctgagagtgcacgccgcctacggcagcaccaaggacgtggccgtgtacagcgccatcagcctgagccccatgcagatctacatcgtgggcagacccaccaagaagctgcagcagcagtgccagttcatcaccgacggctacgccgcccacctggcccagctgaagtacagccacagagccagacccgccagaaacaccgccaccagaatggccctgagaaagggcagcttcggcctgcccggccagggcgacttcctgagaagcagaaaccacctgctgagaaccatcagcgcccagcccagcggccccagccacagacacgagagaacccagagccaggccgacggcgagcagagaggccagagaagcatgagcgtggccgccggctgctggggcagagccatgaccggcagactggagcccggcgccgccgccggccccaagtag

SEQ ID NO: 20844 - DNA, 3213 bp, Artificial Sequence
  Description of Artificial Sequence: Synthetic coding sequence
atgatcatcaaggagtacagaatccccctgcccatgaccgtggaggagtacagaatcgcccagctgtacatgatccagaagaagagcagaaacgagacctacggcgagggcagcggcgtggagatcctggagaacagacccttctggagaatgcagagcatcgccagagacagcgacgagagcagcgacgacgagttcttcgacgcccacgaggacctgagcgacaccgaggagatgttccccaaggacatcaccaagtggagcagcaacgacctgatggacaagatcgagagccccgagcccgaggacacccaggacggcctgtacagacagggcgcccccgagttcagagtggccagcagcgtggagcagctgaacatcatcgaggacgaggtgagccagcccctggccgccccccccagcaagatccacgtgctgctgctggtgctgcacggcggcaccatcctggacaccggcgccggcgaccccagcagcaagaagggcgacgccaacaccatcgccaacgtgttcgacaccgtgatgagagtgcactaccccagcgccctgggcagactggccatcagactggtgccctgcccccccgtgtgcagcgacgccttcgccctggtgagcaacctgagcccctacagccacgacgagggctgcctgagcagcagccaggaccacatccccctggccgccctgcccctgctggccaccagcagcccccagtaccaggaggccgtggccaccgtgatccagagagccaacctggcctacggcgacttcatcaagagccaggagggcatgaccttcaacggccaggtgtgcctgatcggcgactgcgtgggcggcatcctggccttcgacgccctgtgctacagcaaccagcccgtgagcgagagccagagcagcagcagaagaggcagcgtggtgagcatgcaggacaacgacctgctgagccccggcatcctgatgaacgccgcccactgctgcggcggcggcggcggcggcggcggcggcggcggcagcagcggcggcggcggcagcagcggcggcagcagcctggagagcagcagacacctgagcagaagcaacgtggacatccccagaagcaacggcaccgaggaccccaagagacagctgcccagaaagagaagcgacagcagcacctacgagctggacaccatccagcagcaccaggccttcctgagcagcctgcacgccagcgtgctgagaaccgagccctgcagcagacacagcagcagcagcaccatgctggacggcaccggcgccctgggcagattcgacttcgagatcaccgacctgttcctgttcggctgccccctgggcctggtgctggccctgagaaagaccgtgatccccgccctggacgtgttccagctgagacccgcctgccagcaggtgtacaacctgttccaccccgccgaccccagcgccagcagactggagcccctgctggagagaagattccacgccctgccccccttcagcgtgcccagataccagagataccccctgggcgacggctgcagcaccctgctggccgacgtgctgcagacccacaacgccgccttccaggagcacggcgcccccagcagccccggcaccgcccccgccagcagaggcttcagaagagccagcgagatcagcatcgccagccaggtgagcggcatggccgagagctacaccgccagcagcatcgcccagaaggcccccgacgccctgagccacacccccagcgtgagaagactgagcctgctggccctgcccgcccccagccccaccacccccggcccccacccccccgccagaaaggccagccccggcctggagagagcccccggcctgcccgagctggacatcggcgaggtggccgccaagtggtggggccagaagagaatcgactacgccctgtactgccccgacgccctgaccgccttccccaccgtggccctgccccacctgttccacgccagctactgggagagcaccgacgtggtgagcttcctgctgagacaggtgatgagacacgacaacagcagcatcctggagctggacggcaaggaggtgagcgtgttcacccccagcaagcccagagagaagtggcagagaaagagaacccacgtgaagctgagaaacgtgaccgccaaccacagaatcaacgacgccctggccaacgaggacggcccccaggtgctgaccggcagattcatgtacggccccctggacatggtgaccctgaccggcgagaaggtggacgtgcacatcatgacccagccccccagcggcgagtggctgtacctggacaccctggtgaccaacaacagcggcagagtgagctacaccatccccgagagccacagactgggcgtgggcgtgtaccccatcaagatggtggtgagaggcgaccacaccttcgccgacagctacatcaccgtgctgcccaagggcaccgagttcgtggtgttcagcatcgacggcagcttcgccgccagcgtgagcatcatgggcagcgaccccaaggtgagagccggcgccgtggacgtggtgagacactggcaggacctgggctacctgatcatctacgtgaccggcagacccgacatgcagaagcagagagtggtggcctggctggcccagcacaacttcccccacggcgtggtgagcttctgcgacggcctggtgcacgaccccctgagacacaaggccaacttcctgaagctgctgatcagcgagctgcacctgagagtgcacgccgcctacggcagcaccaaggacgtggccgtgtacagcgccatcagcctgagccccatgcagatctacatcgtgggcagacccaccaagaagctgcagcagcagtgccagttcatcaccgacggctacgccgcccacctggcccagctgaagtacagccacagagccagacccgccagaaacaccgccaccagaatggccctgagaaagggcagcttcggcctgcccggccagggcgacttcctgagaagcagaaaccacctgctgagaaccatcagcgcccagcccagcggccccagccacagacacgagagaacccagagccaggccgacggcgagcagagaggccagagaagcatgagcgtggccgccggctgctggggcagagccatgaccggcagactggagcccggcgccgccgccggccccaagtag

SEQ ID NO: 20845 - DNA, 48 bp, Artificial Sequence
  Description of Artificial Sequence: Synthetic coding sequence
atgatcatcaaggagtacagaatccccctgcccatgaccgtggagtag

SEQ ID NO: 20846 - DNA, 126 bp, Artificial Sequence
  Description of Artificial Sequence: Synthetic coding sequence
atgatcatcaaggagtacagaatccccctgcccatgaccgtggaggagtacagaatcgcccagctgtacatgatccagaagaagagcagaaacgagacctacggcgagggcagcggcgtggagtag

SEQ ID NO: 20847 - DNA, 4050 bp, Artificial Sequence; identical to SEQ ID NO: 20843
  Description of Artificial Sequence: Synthetic coding sequence

SEQ ID NO: 20848 - DNA, 1251 bp, Artificial Sequence
  Description of Artificial Sequence: Synthetic coding sequence
atgagcagcaactgcaccagcaccaccgccgtggccgtggcccccctgagcgccagcaagaccaagaccaagaagaagcacttcgtgtgccagaaggtgaagctgttcagagccagcgagcccatcctgagcgtgctgatgtggggcgtgaaccacaccatcaacgagctgagcaacgtgcccgtgcccgtgatgctgatgcccgacgacttcaaggcctacagcaagatcaaggtggacaaccacctgttcaacaaggagaacctgcccagcagattcaagttcaaggagtactgccccatggtgttcagaaacctgagagagagattcggcatcgacgaccaggactaccagaacagcgtgaccagaagcgcccccatcaacagcgacagccagggcagatgcggcaccagattcctgaccacctacgacagaagattcgtgatcaagaccgtgagcagcgaggacgtggccgagatgcacaacatcctgaagaagtaccaccagttcatcgtggagtgccacggcaacaccctgctgccccagttcctgggcatgtacagactgaccgtggacggcgtggagacctacatggtggtgaccagaaacgtgttcagccacagactgaccgtgcacagaaagtacgacctgaagggcagcaccgtggccagagaggccagcgacaaggagaaggccaaggacctgcccaccttcaaggacaacgacttcctgaacgagggccagaagctgcacgtgggcgaggagagcaagaagaacttcctggagaagctgaagagagacgtggagttcctggcccagctgaagatcatggactacagcctgctggtgggcatccacgacgtggacagagccgagcaggaggagatggaggtggaggagagagccgaggacgaggagtgcgagaacgacggcgtgggcggcaacctgctgtgcagctacggcaccccccccgacagccccggcaacctgctgagcttccccagattcttcggccccggcgagttcgaccccagcgtggacgtgtacgccatgaagagccacgagagcagccccaagaaggaggtgtacttcatggccatcatcgacatcctgaccccctacgacaccaagaagaaggccgcccacgccgccaagaccgtgaagcacggcgccggcgccgagatcagcaccgtgaaccccgagcagtacagcaagagattcaacgagttcatgagcaacatcctgacctag

SEQ ID NO: 20849 - DNA, 834 bp, Artificial Sequence
  Description of Artificial Sequence: Synthetic coding sequence
atgagcagcaactgcaccagcaccaccgccgtggccgtggcccccctgagcgccagcaagaccaagaccaagaagaagcacttcgtgtgccagaaggtgaagctgttcagagccagcgagcccatcctgagcgtgctgatgtggggcgtgaaccacaccatcaacgagctgagcaacgtgcccgtgcccgtgatgctgatgcccgacgacttcaaggcctacagcaagatcaaggtggacaaccacctgttcaacaaggagaacctgcccagcagattcaagttcaaggagtactgccccatggtgttcagaaacctgagagagagattcggcatcgacgaccaggactaccagaacagcgtgaccagaagcgcccccatcaacagcgacagccagggcagatgcggcaccagattcctgaccacctacgacagaagattcgtgatcaagaccgtgagcagcgaggacgtggccgagatgcacaacatcctgaagaagtaccaccagttcatcgtggagtgccacggcaacaccctgctgccccagttcctgggcatgtacagactgaccgtggacggcgtggagacctacatggtggtgaccagaaacgtgttcagccacagactgaccgtgcacagaaagtacgacctgaagggcagcaccgtggccagagaggccagcgacaaggagaaggccaaggacctgcccaccttcaaggacaacgacttcctgaacgagggccagaagctgcacgtgggcgaggagagcaagaagaacttcctggagaagctgaagagagacgtggaggagatcctggtgctgagccccggctag

SEQ ID NO: 20850 - DNA, 1830 bp, Artificial Sequence
  Description of Artificial Sequence: Synthetic coding sequence
atgtggagactgcccggcgccagagccgccctgagagtgatcagaaccgccgtggagaagctgagcagagccgaggccggcagccagaccgccgccggcgccatggagagagccgtggtgagatgcgtgcccagcgagcccaagctgagcctgagcttcgccctggccgacggcagccacaagaacatgcagagagaccagagcgagcccctgggcagagtgctgagcagaatcgccaccaacgccctgaagggccacgccaaggccgccgccgccaagaagagcagaaagagcagacccaacgccagcggcggcgccgcctgcagcggccccggccccgagcccgccgtgttctgcgagcccgtggtgaagctgtactacagagaggaggccgtggccgaggacgtgctgaacgtggacgcctggcaggacggcgccgtgctgcagatcggcgacgtgaagtacaaggtggagagaaacccccccgccttcaccgagctgcagctgcccagatacatcatggccggcttccccgtgtgccccaagctgagcctggagttcggcgaccccgccagcagcctgttcagatggtacaaggaggccaagcccggcgccgccgagcccgaggtgggcgtgcccagcagcctgagccccagcagccccagcagcagctggaccgagaccgacgtggaggagagagtgtacacccccagcaacgccgacatcggcctgagactgaagctgcactgcacccccggcgacggccagagattcggccacagcagagagctggagagcgtgtgcgtggtggaggccggccccggcacctgcaccttcgaccacagacacctgtacaccaagaaggtgaccgaggacgccctgatcagaaccgtgagctacaacatcctggccgacacctacgcccagaccgagttcagcagaaccgtgctgtacccctactgcgccccctacgccctggagctggactacagacagaacctgatccagaaggagctgaccggctacaacgccgacgtgatctgcctgcaggaggtggacagagccgtgttcagcgacagcctggtgcccgccctggaggccttcggcctggagggcgtgttcagaatcaagcagcacgagggcctggccaccttctacagaaagagcaagttcagcctgctgagccagcacgacatcagcttctacgaggccctggagagcgaccccctgcacaaggagctgctggagaagctggtgctgtaccccagcgcccaggagaaggtgctgcagagaagcagcgtgctgcaggtgagcgtgctgcagagcaccaaggacagcagcaagagaatctgcgtggccaacacccacctgtactggcaccccaagggcggctacatcagactgatccagatggccgtggccctggcccacatcagacacgtgagctgcgacctgtaccccggcatccccgtgatcttctgcggcgacttcaacagcacccccagcaccggcatgtaccacttcgtgatcaacggcagcatccccgaggaccacgaggactgggccagcaacggcgaggaggagagatgcaacatgagcctgacccacttcttcaagctgaagagcgcctgcggcgagcccgcctacaccaactacgtgggcggcttccacggctgcctggactacatcttcatcgacctgaacgccctggaggtggagcaggtgatccccctgcccagccacgaggaggtgaccacccaccaggccctgcccagcgtgagccaccccagcgaccacatcgccctggtgtgcgacctgaagtggaagtag

SEQ ID NO: 20851 - DNA, 1419 bp, Artificial Sequence
  Description of Artificial Sequence: Synthetic coding sequence
atgtggagactgcccggcgccagagccgccctgagagtgatcagaaccgccgtggagaagctgagcagagccgaggccggcagccagaccgccgccggcgccatggagagagccgtggtgagatgcgtgcccagcgagcccaagctgagcctgagcttcgccctggccgacggcagccacaagaacatgcagagagaccagagcgagcccctgggcagagtgctgagcagaatcgccaccaacgccctgaagggccacgccaaggccgccgccgccaagaagagcagaaagagcagacccaacgccagcggcggcgccgcctgcagcggccccggccccgagcccgccgtgttctgcgagcccgtggtgaagctgtactacagagaggaggccgtggccgaggacgtgctgaacgtggacgcctggcaggacggcgccgtgctgcagatcggcgacgtgaagtacaaggtggagagaaacccccccgccttcaccgagctgcagctgcccagatacatcatggccggcttccccgtgtgccccaagctgagcctggagttcggcgaccccgccagcagcctgttcagatggtacaaggaggccaagcccggcgccgccgagcccgaggtgggcgtgcccagcagcctgagccccagcagccccagcagcagctggaccgagaccgacgtggaggagagagtgtacacccccagcaacgccgacatcggcctgagactgaagctgcactgcacccccggcgacggccagagattcggccacagcagagagctggagagcgtgtgcgtggtggaggccggccccggcacctgcaccttcgaccacagacacctgtacaccaagaaggtgaccgaggacgccctgatcagaaccgtgagctacaacatcctggccgacacctacgcccagaccgagttcagcagaaccgtgctgtacccctactgcgccccctacgccctggagctggactacagacagaacctgatccagaaggagctgaccggctacaacgccgacgtgatctgcctgcaggaggtggacagagccgtgttcagcgacagcctggtgcccgccctggaggccttcggcctggagggcgtgttcagaatcaagcagcacgagggcctggccaccttctacagaaagagcaagttcagcctgctgagccagcacgacatcagcttctacgaggccctggagagcgaccccctgcacaaggagctgctggagaagctggtgctgtaccccagcgcccaggagaaggtgctgcagagaagcagcgtgctgcaggtgagcgtgctgcagagcaccaaggacagcagcaagagaatctgcgtggccaacacccacctgtactggcaccccaagggcagattctacctggtgagccaggtgacctag

SEQ ID NO: 20852 - DNA, 2826 bp, Artificial Sequence
  Description of Artificial Sequence: Synthetic coding sequence
atgggccaggcctgcggccacagcatcctgtgcagaagccagcagtaccccgccgccagacccgccgagcccagaggccagcaggtgttcctgaagcccgacgagccccccccccccccccagccctgcgccgacagcctgcaggacgccctgctgagcctgggcagcgtgatcgacatcagcggcctgcagagagccgtgaaggaggccctgagcgccgtgctgcccagagtggagaccgtgtacacctacctgctggacggcgagagccagctggtgtgcgaggaccccccccacgagctgccccaggagggcaaggtgagagaggccatcatcagccagaagagactgggctgcaacggcctgggcttcagcgacctgcccggcaagcccctggccagactggtggcccccctggcccccgacacccaggtgctggtgatgcccctggccgacaaggaggccggcgccgtggccgccgtgatcctggtgcactgcggccagctgagcgacaacgaggagtggagcctgcaggccgtggagaagcacaccctggtggccctgagaagagtgcaggtgctgcagcagagaggccccagagaggcccccagagccgtgcagaacccccccgagggcaccgccgaggaccagaagggcggcgccgcctacaccgacagagacagaaagatcctgcagctgtgcggcgagctgtacgacctggacgccagcagcctgcagctgaaggtgctgcagtacctgcagcaggagaccagagccagcagatgctgcctgctgctggtgagcgaggacaacctgcagctgagctgcaaggtgatcggcgacaaggtgctgggcgaggaggtgagcttccccctgaccggctgcctgggccaggtggtggaggacaagaagagcatccagctgaaggacctgaccagcgaggacgtgcagcagctgcagagcatgctgggctgcgagctgcaggccatgctgtgcgtgcccgtgatcagcagagccaccgaccaggtggtggccctggcctgcgccttcaacaagctggagggcgacctgttcaccgacgaggacgagcacgtgatccagcactgcttccactacaccagcaccgtgctgaccagcaccctggccttccagaaggagcagaagctgaagtgcgagtgccaggccctgctgcaggtggccaagaacctgttcacccacctggacgacgtgagcgtgctgctgcaggagatcatcaccgaggccagaaacctgagcaacgccgagatctgcagcgtgttcctgctggaccagaacgagctggtggccaaggtgttcgacggcggcgtggtggacgacgagagctacgagatcagaatccccgccgaccagggcatcgccggccacgtggccaccaccggccagatcctgaacatccccgacgcctacgcccaccccctgttctacagaggcgtggacgacagcaccggcttcagaaccagaaacatcctgtgcttccccatcaagaacgagaaccaggaggtgatcggcgtggccgagctggtgaacaagatcaacggcccctggttcagcaagttcgacgaggacctggccaccgccttcagcatctactgcggcatcagcatcgcccacagcctgctgtacaagaaggtgaacgaggcccagtacagaagccacctggccaacgagatgatgatgtaccacatgaaggtgagcgacgacgagtacaccaagctgctgcacgacggcatccagcccgtggccgccatcgacagcaacttcgccagcttcacctacacccccagaagcctgcccgaggacgacaccagcatggccatcctgagcatgctgcaggacatgaacttcatcaacaactacaagatcgactgccccaccctggccagattctgcctgatggtgaagaagggctacagagaccccccctaccacaactggatgcacgccttcagcgtgagccacttctgctacctgctgtacaagaacctggagctgaccaactacctggaggacatcgagatcttcgccctgttcatcagctgcatgtgccacgacctggaccacagaggcaccaacaacagcttccaggtggccagcaagagcgtgctggccgccctgtacagcagcgagggcagcgtgatggagagacaccacttcgcccaggccatcgccatcctgaacacccacggctgcaacatcttcgaccacttcagcagaaaggactaccagagaatgctggacctgatgagagacatcatcctggccaccgacctggcccaccacctgagaatcttcaaggacctgcagaagatggccgaggtgggctacgacagaaacaacaagcagcaccacagactgctgctgtgcctgctgatgaccagctgcgacctgagcgaccagaccaagggctggaagaccaccagaaagatcgccgagctgatctacaaggagttcttcagccagggcgacctggagaaggccatgggcaacagacccatggagatgatggacagagagaaggcctacatccccgagctgcagatcagcttcatggagcacatcgccatgcccatctacaagctgctgcaggacctgttccccaaggccgccgagctgtacgagagagtggccagcaacagagagcactggaccaaggtgagccacaagttcaccatcagaggcctgcccagcaacaacagcctggacttcctggacgaggagtacgaggtgcccgacctggacggcaccagagcccccatcaacggctgctgcagcctggacgccgagtag

SEQ ID NO: 20853 - DNA, 2058 bp, Artificial Sequence
  Description of Artificial Sequence: Synthetic coding sequence
atggtgctggtgctgcaccacatcctgatcgccgtggtgcagttcctgagaagaggccagcaggtgttcctgaagcccgacgagccccccccccccccccagccctgcgccgacagcctgcaggacgccctgctgagcctgggcagcgtgatcgacatcagcggcctgcagagagccgtgaaggaggccctgagcgccgtgctgcccagagtggagaccgtgtacacctacctgctggacggcgagagccagctggtgtgcgaggaccccccccacgagctgccccaggagggcaaggtgagattcaccgacgaggacgagcacgtgatccagcactgcttccactacaccagcaccgtgctgaccagcaccctggccttccagaaggagcagaagctgaagtgcgagtgccaggccctgctgcaggtggccaagaacctgttcacccacctggacgacgtgagcgtgctgctgcaggagatcatcaccgaggccagaaacctgagcaacgccgagatctgcagcgtgttcctgctggaccagaacgagctggtggccaaggtgttcgacggcggcgtggtggacgacgagagctacgagatcagaatccccgccgaccagggcatcgccggccacgtggccaccaccggccagatcctgaacatccccgacgcctacgcccaccccctgttctacagaggcgtggacgacagcaccggcttcagaaccagaaacatcctgtgcttccccatcaagaacgagaaccaggaggtgatcggcgtggccgagctggtgaacaagatcaacggcccctggttcagcaagttcgacgaggacctggccaccgccttcagcatctactgcggcatcagcatcgcccacagcctgctgtacaagaaggtgaacgaggcccagtacagaagccacctggccaacgagatgatgatgtaccacatgaaggtgagcgacgacgagtacaccaagctgctgcacgacggcatccagcccgtggccgccatcgacagcaacttcgccagcttcacctacacccccagaagcctgcccgaggacgacaccagcatggccatcctgagcatgctgcaggacatgaacttcatcaacaactacaagatcgactgccccaccctggccagattctgcctgatggtgaagaagggctacagagaccccccctaccacaactggatgcacgccttcagcgtgagccacttctgctacctgctgtacaagaacctggagctgaccaactacctggaggacatcgagatcttcgccctgttcatcagctgcatgtgccacgacctggaccacagaggcaccaacaacagcttccaggtggccagcaagagcgtgctggccgccctgtacagcagcgagggcagcgtgatggagagacaccacttcgcccaggccatcgccatcctgaacacccacggctgcaacatcttcgaccacttcagcagaaaggactaccagagaatgctggacctgatgagagacatcatcctggccaccgacctggcccaccacctgagaatcttcaaggacctgcagaagatggccgaggtgggctacgacagaaacaacaagcagcaccacagactgctgctgtgcctgctgatgaccagctgcgacctgagcgaccagaccaagggctggaagaccaccagaaagatcgccgagctgatctacaaggagttcttcagccagggcgacctggagaaggccatgggcaacagacccatggagatgatggacagagagaaggcctacatccccgagctgcagatcagcttcatggagcacatcgccatgcccatctacaagctgctgcaggacctgttccccaaggccgccgagctgtacgagagagtggccagcaacagagagcactggaccaaggtgagccacaagttcaccatcagaggcctgcccagcaacaacagcctggacttcctggacgaggagtacgaggtgcccgacctggacggcaccagagcccccatcaacggctgctgcagcctggacgccgagtag

SEQ ID NO: 20854 - DNA, 2853 bp, Artificial Sequence
  Description of Artificial Sequence: Synthetic coding sequence
atgagctacatcctgaagatgcccggcacctgcctgcccggcgagggcaccacctacgagctgccccccagcagcctgcaccccagcagcgcccccgtgaccagcggcggcacctgccccgccctgctgaccgaggccggctgggaggcccccatcatggccttcaccgaggccgccagcgccgtgggccccagctggacccacagcagagccagcgtgagcagcaccgtgaagaccgagagaagaagaagagtgctgcaggcctgcggcatggtgagaagaggccagcaggtgttcctgaagcccgacgagccccccccccccccccagccctgcgccgacagcctgcaggacgccctgctgagcctgggcagcgtgatcgacatcagcggcctgcagagagccgtgaaggaggccctgagcgccgtgctgcccagagtggagaccgtgtacacctacctgctggacggcgagagccagctggtgtgcgaggaccccccccacgagctgccccaggagggcaaggtgagagaggccatcatcagccagaagagactgggctgcaacggcctgggcttcagcgacctgcccggcaagcccctggccagactggtggcccccctggcccccgacacccaggtgctggtgatgcccctggccgacaaggaggccggcgccgtggccgccgtgatcctggtgcactgcggccagctgagcgacaacgaggagtggagcctgcaggccgtggagaagcacaccctggtggccctgagaagagtgcaggtgctgcagcagagaggccccagagaggcccccagagccgtgcagaacccccccgagggcaccgccgaggaccagaagggcggcgccgcctacaccgacagagacagaaagatcctgcagctgtgcggcgagctgtacgacctggacgccagcagcctgcagctgaaggtgctgcagtacctgcagcaggagaccagagccagcagatgctgcctgctgctggtgagcgaggacaacctgcagctgagctgcaaggtgatcggcgacaaggtgctgggcgaggaggtgagcttccccctgaccggctgcctgggccaggtggtggaggacaagaagagcatccagctgaaggacctgaccagcgaggacgtgcagcagctgcagagcatgctgggctgcgagctgcaggccatgctgtgcgtgcccgtgatcagcagagccaccgaccaggtggtggccctggcctgcgccttcaacaagctggagggcgacctgttcaccgacgaggacgagcacgtgatccagcactgcttccactacaccagcaccgtgctgaccagcaccctggccttccagaaggagcagaagctgaagtgcgagtgccaggccctgctgcaggtggccaagaacctgttcacccacctggacgacgtgagcgtgctgctgcaggagatcatcaccgaggccagaaacctgagcaacgccgagatctgcagcgtgttcctgctggaccagaacgagctggtggccaaggtgttcgacggcggcgtggtggacgacgagagctacgagatcagaatccccgccgaccagggcatcgccggccacgtggccaccaccggccagatcctgaacatccccgacgcctacgcccaccccctgttctacagaggcgtggacgacagcaccggcttcagaaccagaaacatcctgtgcttccccatcaagaacgagaaccaggaggtgatcggcgtggccgagctggtgaacaagatcaacggcccctggttcagcaagttcgacgaggacctggccaccgccttcagcatctactgcggcatcagcatcgcccacagcctgctgtacaagaaggtgaacgaggcccagtacagaagccacctggccaacgagatgatgatgtaccacatgaaggtgagcgacgacgagtacaccaagctgctgcacgacggcatccagcccgtggccgccatcgacagcaacttcgccagcttcacctacacccccagaagcctgcccgaggacgacaccagcatggccatcctgagcatgctgcaggacatgaacttcatcaacaactacaagatcgactgccccaccctggccagattctgcctgatggtgaagaagggctacagagaccccccctaccacaactggatgcacgccttcagcgtgagccacttctgctacctgctgtacaagaacctggagctgaccaactacctggaggacatcgagatcttcgccctgttcatcagctgcatgtgccacgacctggaccacagaggcaccaacaacagcttccaggtggccagcaagagcgtgctggccgccctgtacagcagcgagggcagcgtgatggagagacaccacttcgcccaggccatcgccatcctgaacacccacggctgcaacatcttcgaccacttcagcagaaaggactaccagagaatgctggacctgatgagagacatcatcctggccaccgacctggcccaccacctgagaatcttcaaggacctgcagaagatggccgaggtgggctacgacagaaacaacaagcagcaccacagactgctgctgtgcctgctgatgaccagctgcgacctgagcgaccagaccaagggctggaagaccaccagaaagatcgccgagctgatctacaaggagttcttcagccagggcgacctggagaaggccatgggcaacagacccatggagatgatggacagagagaaggcctacatccccgagctgcagatcagcttcatggagcacatcgccatgcccatctacaagctgctgcaggacctgttccccaaggcctag

SEQ ID NO: 20855 - DNA, 2799 bp, Artificial Sequence
  Description of Artificial Sequence: Synthetic coding sequence
atgaagaagcagagaatccaggagggcaagagcctggcccacagaagaggccagcaggtgttcctgaagcccgacgagccccccccccccccccagccctgcgccgacagcctgcaggacgccctgctgagcctgggcagcgtgatcgacatcagcggcctgcagagagccgtgaaggaggccctgagcgccgtgctgcccagagtggagaccgtgtacacctacctgctggacggcgagagccagctggtgtgcgaggaccccccccacgagctgccccaggagggcaaggtgagagaggccatcatcagccagaagagactgggctgcaacggcctgggcttcagcgacctgcccggcaagcccctggccagactggtggcccccctggcccccgacacccaggtgctggtgatgcccctggccgacaaggaggccggcgccgtggccgccgtgatcctggtgcactgcggccagctgagcgacaacgaggagtggagcctgcaggccgtggagaagcacaccctggtggccctgagaagagtgcaggtgctgcagcagagaggccccagagaggcccccagagccgtgcagaacccccccgagggcaccgccgaggaccagaagggcggcgccgcctacaccgacagagacagaaagatcctgcagctgtgcggcgagctgtacgacctggacgccagcagcctgcagctgaaggtgctgcagtacctgcagcaggagaccagagccagcagatgctgcctgctgctggtgagcgaggacaacctgcagctgagctgcaaggtgatcggcgacaaggtgctgggcgaggaggtgagcttccccctgaccggctgcctgggccaggtggtggaggacaagaagagcatccagctgaaggacctgaccagcgaggacgtgcagcagctgcagagcatgctgggctgcgagctgcaggccatgctgtgcgtgcccgtgatcagcagagccaccgaccaggtggtggccctggcctgcgccttcaacaagctggagggcgacctgttcaccgacgaggacgagcacgtgatccagcactgcttccactacaccagcaccgtgctgaccagcaccctggccttccagaaggagcagaagctgaagtgcgagtgccaggccctgctgcaggtggccaagaacctgttcacccacctggacgacgtgagcgtgctgctgcaggagatcatcaccgaggccagaaacctgagcaacgccgagatctgcagcgtgttcctgctggaccagaacgagctggtggccaaggtgttcgacggcggcgtggtggacgacgagagctacgagatcagaatccccgccgaccagggcatcgccggccacgtggccaccaccggccagatcctgaacatccccgacgcctacgcccaccccctgttctacagaggcgtggacgacagcaccggcttcagaaccagaaacatcctgtgcttccccatcaagaacgagaaccaggaggtgatcggcgtggccgagctggtgaacaagatcaacggcccctggttcagcaagttcgacgaggacctggccaccgccttcagcatctactgcggcatcagcatcgcccacagcctgctgtacaagaaggtgaacgaggcccagtacagaagccacctggccaacgagatgatgatgtaccacatgaaggtgagcgacgacgagtacaccaagctgctgcacgacggcatccagcccgtggccgccatcgacagcaacttcgccagcttcacctacacccccagaagcctgcccgaggacgacaccagcatggccatcctgagcatgctgcaggacatgaacttcatcaacaactacaagatcgactgccccaccctggccagattctgcctgatggtgaagaagggctacagagaccccccctaccacaactggatgcacgccttcagcgtgagccacttctgctacctgctgtacaagaacctggagctgaccaactacctggaggacatcgagatcttcgccctgttcatcagctgcatgtgccacgacctggaccacagaggcaccaacaacagcttccaggtggccagcaagagcgtgctggccgccctgtacagcagcgagggcagcgtgatggagagacaccacttcgcccaggccatcgccatcctgaacacccacggctgcaacatcttcgaccacttcagcagaaaggactaccagagaatgctggacctgatgagagacatcatcctggccaccgacctggcccaccacctgagaatcttcaaggacctgcagaagatggccgaggtgggctacgacagaaacaacaagcagcaccacagactgctgctgtgcctgctgatgaccagctgcgacctgagcgaccagaccaagggctggaagaccaccagaaagatcgccgagctgatctacaaggagttcttcagccagggcgacctggagaaggccatgggcaacagacccatggagatgatggacagagagaaggcctacatccccgagctgcagatcagcttcatggagcacatcgccatgcccatctacaagctgctgcaggacctgttccccaaggccgccgagctgtacgagagagtggccagcaacagagagcactggaccaaggtgagccacaagttcaccatcagaggcctgcccagcaacaacagcctggacttcctggacgaggagtacgaggtgcccgacctggacggcaccagagcccccatcaacggctgctgcagcctggacgccgagtag

SEQ ID NO: 20856 - DNA, 2805 bp, Artificial Sequence
  Description of Artificial Sequence: Synthetic coding sequence
atggtgctggtgctgcaccacatcctgatcgccgtggtgcagttcctgagaagaggccagcaggtgttcctgaagcccgacgagccccccccccccccccagccctgcgccgacagcctgcaggacgccctgctgagcctgggcagcgtgatcgacatcagcggcctgcagagagccgtgaaggaggccctgagcgccgtgctgcccagagtggagaccgtgtacacctacctgctggacggcgagagccagctggtgtgcgaggaccccccccacgagctgccccaggagggcaaggtgagagaggccatcatcagccagaagagactgggctgcaacggcctgggcttcagcgacctgcccggcaagcccctggccagactggtggcccccctggcccccgacacccaggtgctggtgatgcccctggccgacaaggaggccggcgccgtggccgccgtgatcctggtgcactgcggccagctgagcgacaacgaggagtggagcctgcaggccgtggagaagcacaccctggtggccctgagaagagtgcaggtgctgcagcagagaggccccagagaggcccccagagccgtgcagaacccccccgagggcaccgccgaggaccagaagggcggcgccgcctacaccgacagagacagaaagatcctgcagctgtgcggcgagctgtacgacctggacgccagcagcctgcagctgaaggtgctgcagtacctgcagcaggagaccagagccagcagatgctgcctgctgctggtgagcgaggacaacctgcagctgagctgcaaggtgatcggcgacaaggtgctgggcgaggaggtgagcttccccctgaccggctgcctgggccaggtggtggaggacaagaagagcatccagctgaaggacctgaccagcgaggacgtgcagcagctgcagagcatgctgggctgcgagctgcaggccatgctgtgcgtgcccgtgatcagcagagccaccgaccaggtggtggccctggcctgcgccttcaacaagctggagggcgacctgttcaccgacgaggacgagcacgtgatccagcactgcttccactacaccagcaccgtgctgaccagcaccctggccttccagaaggagcagaagctgaagtgcgagtgccaggccctgctgcaggtggccaagaacctgttcacccacctggacgacgtgagcgtgctgctgcaggagatcatcaccgaggccagaaacctgagcaacgccgagatctgcagcgtgttcctgctggaccagaacgagctggtggccaaggtgttcgacggcggcgtggtggacgacgagagctacgagatcagaatccccgccgaccagggcatcgccggccacgtggccaccaccggccagatcctgaacatccccgacgcctacgcccaccccctgttctacagaggcgtggacgacagcaccggcttcagaaccagaaacatcctgtgcttccccatcaagaacgagaaccaggaggtgatcggcgtggccgagctggtgaacaagatcaacggcccctggttcagcaagttcgacgaggacctggccaccgccttcagcatctactgcggcatcagcatcgcccacagcctgctgtacaagaaggtgaacgaggcccagtacagaagccacctggccaacgagatgatgatgtaccacatgaaggtgagcgacgacgagtacaccaagctgctgcacgacggcatccagcccgtggccgccatcgacagcaacttcgccagcttcacctacacccccagaagcctgcccgaggacgacaccagcatggccatcctgagcatgctgcaggacatgaacttcatcaacaactacaagatcgactgccccaccctggccagattctgcctgatggtgaagaagggctacagagaccccccctaccacaactggatgcacgccttcagcgtgagccacttctgctacctgctgtacaagaacctggagctgaccaactacctggaggacatcgagatcttcgccctgttcatcagctgcatgtgccacgacctggaccacagaggcaccaacaacagcttccaggtggccagcaagagcgtgctggccgccctgtacagcagcgagggcagcgtgatggagagacaccacttcgcccaggccatcgccatcctgaacacccacggctgcaacatcttcgaccacttcagcagaaaggactaccagagaatgctggacctgatgagagacatcatcctggccaccgacctggcccaccacctgagaatcttcaaggacctgcagaagatggccgaggtgggctacgacagaaacaacaagcagcaccacagactgctgctgtgcctgctgatgaccagctgcgacctgagcgaccagaccaagggctggaagaccaccagaaagatcgccgagctgatctacaaggagttcttcagccagggcgacctggagaaggccatgggcaacagacccatggagatgatggacagagagaaggcctacatccccgagctgcagatcagcttcatggagcacatcgccatgcccatctacaagctgctgcaggacctgttccccaaggccgccgagctgtacgagagagtggccagcaacagagagcactggaccaaggtgagccacaagttcaccatcagaggcctgcccagcaacaacagcctggacttcctggacgaggagtacgaggtgcccgacctggacggcaccagagcccccatcaacggctgctgcagcctggacgccgagtag

SEQ ID NO: 20857 - DNA, 3426 bp, Artificial Sequence
  Description of Artificial Sequence: Synthetic coding sequence
atggccgtgcccggcgacgccgccagagtgagagacaagcccgtgcacagcggcgtgagccaggcccccaccgccggcagagactgccaccacagagccgaccccgccagccccagagacagcggctgcagaggctgctggggcgacctggtgctgcagcccctgagaagcagcagaaagctgagcagcgccctgtgcgccggcagcctgagcttcctgctggccctgctggtgagactggtgagaggcgaggtgggctgcgacctggagcagtgcaaggaggccgccgccgccgaggaggaggaggccgcccccggcgccgagggcggcgtgttccccggccccagaggcggcgcccccggcggcggcgccagactgagcccctggctgcagcccagcgccctgctgttcagcctgctgtgcgccttcttctggatgggcctgtacctgctgagagccggcgtgagactgcccctggccgtggccctgctggccgcctgctgcggcggcgaggccctggtgcagatcggcctgggcgtgggcgaggaccacctgctgagcctgcccgccgccggcgtggtgctgagctgcctggccgccgccacctggctggtgctgagactgagactgggcgtgctgatgatcgccctgaccagcgccgtgagaaccgtgagcctgatcagcctggagagattcaaggtggcctggagaccctacctggcctacctggccggcgtgctgggcatcctgctggccagatacgtggagcagatcctgccccagagcgccgaggccgcccccagagagcacctgggcagccagctgatcgccggcaccaaggaggacatccccgtgttcaagagaagaagaagaagcagcagcgtggtgagcgccgagatgagcggctgcagcagcaagagccacagaagaaccagcctgccctgcatccccagagagcagctgatgggccacagcgagtgggaccacaagagaggccccagaggcagccagagcagcggcaccagcatcaccgtggacatcgccgtgatgggcgaggcccacggcctgatcaccgacctgctggccgaccccagcctgccccccaacgtgtgcaccagcctgagagccgtgagcaacctgctgagcacccagctgaccttccaggccatccacaagcccagagtgaaccccgtgaccagcctgagcgagaactacacctgcagcgacagcgaggagagcagcgagaaggacaagctggccatccccaagagactgagaagaagcctgccccccggcctgctgagaagagtgagcagcacctggaccaccaccaccagcgccaccggcctgcccaccctggagcccgcccccgtgagaagagacagaagcaccagcatcaagctgcaggaggcccccagcagcagccccgacagctggaacaaccccgtgatgatgaccctgaccaagagcagaagcttcaccagcagctacgccatcagcgccgccaaccacgtgaaggccaagaagcagagcagacccggcgccctggccaagatcagccccctgagcagcccctgcagcagccccctgcagggcacccccgccagcagcctggtgagcaagatcagcgccgtgcagttccccgagagcgccgacaccaccgccaagcagagcctgggcagccacagagccctgacctacacccagagcgcccccgacctgagcccccagatcctgaccccccccgtgatctgcagcagctgcggcagaccctacagccagggcaaccccgccgacgagcccctggagagaagcggcgtggccaccagaacccccagcagaaccgacgacaccgcccaggtgaccagcgactacgagaccaacaacaacagcgacagcagcgacatcgtgcagaacgaggacgagaccgagtgcctgagagagcccctgagaaaggccagcgcctgcagcacctacgcccccgagaccatgatgttcctggacaagcccatcctggcccccgagcccctggtgatggacaacctggacagcatcatggagcagctgaacacctggaacttccccatcttcgacctggtggagaacatcggcagaaagtgcggcagaatcctgagccaggtgagctacagactgttcgaggacatgggcctgttcgaggccttcaagatccccatcagagagttcatgaactacttccacgccctggagatcggctacagagacatcccctaccacaacagaatccacgccaccgacgtgctgcacgccgtgtggtacctgaccacccagcccatccccggcctgagcaccgtgatcaacgaccacggcagcaccagcgacagcgacagcgacagcggcttcacccacggccacatgggctacgtgttcagcaagacctacaacgtgaccgacgacaagtacggctgcctgagcggcaacatccccgccctggagctgatggccctgtacgtggccgccgccatgcacgactacgaccaccccggcagaaccaacgccttcctggtggccaccagcgccccccaggccgtgctgtacaacgacagaagcgtgctggagaaccaccacgccgccgccgcctggaacctgttcatgagcagacccgagtacaacttcctgatcaacctggaccacgtggagttcaagcacttcagattcctggtgatcgaggccatcctggccaccgacctgaagaagcacttcgacttcgtggccaagttcaacggcaaggtgaacgacgacgtgggcatcgactggaccaacgagaacgacagactgctggtgtgccagatgtgcatcaagctggccgacatcaacggccccgccaagtgcaaggagctgcacctgcagtggaccgacggcatcgtgaacgagttctacgagcagggcgacgaggaggccagcctgggcctgcccatcagccccttcatggacagaagcgccccccagctggccaacctgcaggagagcttcatcagccacatcgtgggccccctgtgcaacagctacgacagcgccggcctgatgcccggcaagtgggtggaggacagcgacgagagcggcgacaccgacgaccccgaggaggaggaggaggaggcccccgcccccaacgaggaggagacctgcgagaacaacgagagccccaagaagaagaccttcaagagaagaaagatctactgccagatcacccagcacctgctgcagaaccacaagatgtggaagaaggtgatcgaggaggagcagagactggccggcatcgagaaccagagcctggaccagaccccccagagccacagcagcgagcagatccaggccatcaaggaggaggaggaggagaagggcaagcccagaggcgaggagatccccacccagaagcccgaccagtag

SEQ ID NO: 20858 - DNA, 2670 bp, Artificial Sequence
  Description of Artificial Sequence: Synthetic coding sequence
atggccgagagaggcagactgggcctgcccggcgcccccggcgccctgaacacccccgtgcccatgaacctgttcgccacctgggaggtggacggcagcagccccagctgcgtgcccagactgtgcagcctgaccctgaagaagctggtggtgttcaaggagctggagaaggagctgatcagcgtggtgatcgccgtgaagatgcagggcagcaagagaatcctgagaagccacgagatcgtgctgccccccagcggccaggtggagaccgacctggccctgaccttcagcctgcagtacccccacttcctgaagagagagggcaacaagctgcagatcatgctgcagagaagaaagagatacaagaacagaaccatcctgggctacaagaccctggccgccggcagcatcagcatggccgaggtgatgcagcaccccagcgagggcggccaggtgctgagcctgtgcagcagcatcaaggaggcccccgtgaaggccgccgagatctggatcgccagcctgagcagccagcccatcgaccacgaggacagcaccatgcaggccggccccaaggccaagagcaccgacaactacagcgaggaggagtacgagagcttcagcagcgagcaggaggccagcgacgacgccgtgcagggccaggacctggacgaggacgacttcgacgtgggcaagcccaagaagcagagaagaagcatcgtgagaaccaccagcatgaccagacagcagaacttcaagcagaaggtggtggccctgctgagaagattcaaggtgagcgacgaggtgctggacagcgagcaggaccccgccgagcacatccccgaggccgaggaggacctggacctgctgtacgacaccctggacatggagcaccccagcgacagcggccccgacatggaggacgacgacagcgtgctgagcacccccaagcccaagctgagaccctacttcgagggcctgagccacagcagcagccagaccgagatcggcagcatccacagcgccagaagccacaaggagccccccagccccgccgacgtgcccgagaagaccagaagcctgggcggcagacagcccagcgacagcgtgagcgacaccgtggccctgggcgtgcccggccccagagagcaccccggccagcccgaggacagccccgaggccgaggccagcaccctggacgtgttcaccgagagactgccccccagcggcagaatcaccaagaccgagagcctggtgatccccagcaccagaagcgagggcaagcaggccggcagaagaggcagaagcaccagcctgaaggagagacaggccgccagaccccagaacgagagagccaacagcctggacaacgagagatgccccgacgccagaagccagctgcagatccccagaaagaccgtgtacgaccagctgaaccacatcctgatcagcgacgaccagctgcccgagaacatcatcctggtgaacaccagcgactggcagggccagttcctgagcgacgtgctgcagagacacaccctgcccgtggtgtgcacctgcagccccgccgacgtgcaggccgccttcagcaccatcgtgagcagaatccagagatactgcaactgcaacagccagccccccacccccgtgaagatcgccgtggccggcgcccagcactacctgagcgccatcctgagactgttcgtggagcagctgagccacaagacccccgactggctgggctacatgagattcctggtgatccccctgggcagccaccccgtggccagatacctgggcagcgtggactacagatacaacaacttcttccaggacctggcctggagagacctgttcaacaagctggaggcccagagcgccgtgcaggacacccccgacatcgtgagcagaatcacccagtacatcgccggcgccaactgcgcccaccagctgcccatcgccgaggccatgctgacctacaagcagaagagccccgacgaggagagcagccagaagttcatccccttcgtgggcgtggtgaaggtgggcatcgtggagcccagcagcgccaccagcggcgacagcgacgacgccgcccccagcggcagcggcaccctgagcagcaccccccccagcgccagccccgccgccaaggaggccagccccaccccccccagcagccccagcgtgagcggcggcctgagcagccccagccagggcgtgggcgccgagctgatgggcctgcaggtggactactggaccgccgcccagcccgccgacagaaagagagacgccgagaagaaggacctgcccgtgaccaagaacaccctgaagtgcaccttcagaagcctgcaggtgagcagactgcccagcagcggcgaggccgccgccacccccaccatgagcatgaccgtggtgaccaaggagaagaacaagaaggtgatgttcctgcccaagaaggccaaggacaaggacgtggagagcaagagccagtgcatcgagggcatcagcagactgatctgcaccgccagacagcagcagaacatgctgagagtgctgatcgacggcgtggagtgcagcgacgtgaagttcttccagctggccgcccagtggagcagccacgtgaagcacttccccatctgcatcttcggccacagcaaggccaccttctag

SEQ ID NO: 20859 - DNA, 2682 bp, Artificial Sequence
  Description of Artificial Sequence: Synthetic coding sequence
atggccgagagaggcagactgggcctgcccggcgcccccggcgccctgaacacccccgtgcccatgaacctgttcgccacctgggaggtggacggcagcagccccagctgcgtgcccagactgtgcagcctgaccctgaagaagctggtggtgttcaaggagctggagaaggagctgatcagcgtggtgatcgccgtgaagatgcagggcagcaagagaatcctgagaagccacgagatcgtgctgccccccagcggccaggtggagaccgacctggccctgaccttcagcctgcagtacccccacttcctgaagagagagggcaacaagctgcagatcatgctgcagagaagaaagagatacaagaacagaaccatcctgggctacaagaccctggccgccggcagcatcagcatggccgaggtgatgcagcaccccagcgagggcggccaggtgctgagcctgtgcagcagcatcaaggaggcccccgtgaaggccgccgagatctggatcgccagcctgagcagccagcccatcgaccacgaggacagcaccatgcaggccggccccaaggccaagagcaccgacaactacagcgaggaggagtacgagagcttcagcagcgagcaggaggccagcgacgacgccgtgcagggccaggacctggacgaggacgacttcgacgtgggcaagcccaagaagcagagaagaagcatcgtgagaaccaccagcatgaccagacagcagaacttcaagcagaaggtggtggccctgctgagaagattcaaggtgagcgacgaggtgctggacagcgagcaggaccccgccgagcacatccccgaggccgaggaggacctggacctgctgtacgacaccctggacatggagcaccccagcgacagcggccccgacatggaggacgacgacagcgtgctgagcacccccaagcccaagctgagaccctacttcgagggcctgagccacagcagcagccagaccgagatcggcagcatccacagcgccagaagccacaaggagccccccagccccgccgacgtgcccgagaagaccagaagcctgggcggcagacagcccagcgacagcgtgagcgacaccgtggccctgggcgtgcccggccccagagagcaccccggccagcccgaggacagccccgaggccgaggccagcaccctggacgtgttcaccgagagactgccccccagcggcagaatcaccaagaccgagagcctggtgatccccagcaccagaagcgagggcaagcaggccggcagaagaggcagaagcaccagcctgaaggagagacaggccgccagaccccagaacgagagagccaacagcctggacaacgagagatgccccgacgccagaagccagctgcaggtgcagctgcagatccccagaaagaccgtgtacgaccagctgaaccacatcctgatcagcgacgaccagctgcccgagaacatcatcctggtgaacaccagcgactggcagggccagttcctgagcgacgtgctgcagagacacaccctgcccgtggtgtgcacctgcagccccgccgacgtgcaggccgccttcagcaccatcgtgagcagaatccagagatactgcaactgcaacagccagccccccacccccgtgaagatcgccgtggccggcgcccagcactacctgagcgccatcctgagactgttcgtggagcagctgagccacaagacccccgactggctgggctacatgagattcctggtgatccccctgggcagccaccccgtggccagatacctgggcagcgtggactacagatacaacaacttcttccaggacctggcctggagagacctgttcaacaagctggaggcccagagcgccgtgcaggacacccccgacatcgtgagcagaatcacccagtacatcgccggcgccaactgcgcccaccagctgcccatcgccgaggccatgctgacctacaagcagaagagccccgacgaggagagcagccagaagttcatccccttcgtgggcgtggtgaaggtgggcatcgtggagcccagcagcgccaccagcggcgacagcgacgacgccgcccccagcggcagcggcaccctgagcagcaccccccccagcgccagccccgccgccaaggaggccagccccaccccccccagcagccccagcgtgagcggcggcctgagcagccccagccagggcgtgggcgccgagctgatgggcctgcaggtggactactggaccgccgcccagcccgccgacagaaagagagacgccgagaagaaggacctgcccgtgaccaagaacaccctgaagtgcaccttcagaagcctgcaggtgagcagactgcccagcagcggcgaggccgccgccacccccaccatgagcatgaccgtggtgaccaaggagaagaacaagaaggtgatgttcctgcccaagaaggccaaggacaaggacgtggagagcaagagccagtgcatcgagggcatcagcagactgatctgcaccgccagacagcagcagaacatgctgagagtgctgatcgacggcgtggagtgcagcgacgtgaagttcttccagctggccgcccagtggagcagccacgtgaagcacttccccatctgcatcttcggccacagcaaggccaccttctag

SEQ ID NO: 20860 - DNA, 2715 bp, Artificial Sequence
  Description of Artificial Sequence: Synthetic coding sequence
atggccgagagaggcagactgggcctgcccggcgcccccggcgccctgaacacccccgtgcccatgaacctgttcgccacctgggaggtggacggcagcagccccagctgcgtgcccagactgtgcagcctgaccctgaagaagctggtggtgttcaaggagctggagaaggagctgatcagcgtggtgatcgccgtgaagatgcagggcagcaagagaatcctgagaagccacgagatcgtgctgccccccagcggccaggtggagaccgacctggccctgaccttcagcctgcagtacccccacttcctgaagagagagggcaacaagctgcagatcatgctgcagagaagaaagagatacaagaacagaaccatcctgggctacaagaccctggccgccggcagcatcagcatggccgaggtgatgcagcaccccagcgagggcggccaggtgctgagcctgtgcagcagcatcaaggaggcccccgtgaaggccgccgagatctggatcgccagcctgagcagccagcccatcgaccacgaggacagcaccatgcaggccggccccaaggccaagagcaccgacaactacagcgaggaggagtacgagagcttcagcagcgagcaggaggccagcgacgacgccgtgcagggccaggacctggacgaggacgacttcgacgtgggcaagcccaagaagcagagaagaagcatcgtgagaaccaccagcatgaccagacagcagaacttcaagcagaaggtggtggccctgctgagaagattcaaggtgagcgacgaggtgctggacagcgagcaggaccccgccgagcacatccccgaggccgaggaggacctggacctgctgtacgacaccctggacatggagcaccccagcgacagcggccccgacatggaggacgacgacagcgtgctgagcacccccaagcccaagctgagaccctacttcgagggcctgagccacagcagcagccagaccgagatcggcagcatccacagcgccagaagccacaaggagccccccagccccgccgacgtgcccgagaagaccagaagcctgggcggcagacagcccagcgacagcgtgagcgacaccgtggccctgggcgtgcccggccccagagagcaccccggccagcccgaggacagccccgaggccgaggccagcaccctggacgtgttcaccgagagactgccccccagcggcagaatcaccaagaccgagagcctggtgatccccagcaccagaagcgagggcaagcaggccggcagaagaggcagaagcaccagcctgaaggagagacaggccgccagaccccagaacgagagagccaacagcctggacaacgagagatgccccgacgccagaagccagctgcaggtgcagctgcagatccccagaaagaccgtgtacgaccagctgaaccacatcctgatcagcgacgaccagctgcccgagaacatcatcctggtgaacaccagcgactggcagggccagttcctgagcgacgtgctgcagagacacaccctgcccgtggtgtgcacctgcagccccgccgacgtgcaggccgccttcagcaccatcgtgagcagaatccagagatactgcaactgcaacagccagccccccacccccgtgaagatcgccgtggccggcgcccagcactacctgagcgccatcctgagactgttcgtggagcagctgagccacaagacccccgactggctgggctacatgagattcctggtgatccccctgggcagccaccccgtggccagatacctgggcagcgtggactacagatacaacaacttcttccaggacctggcctggagagacctgttcaacaagctggaggcccagagcgccgtgcaggacacccccgacatcgtgagcagaatcacccagtacatcgccggcgccaactgcgcccaccagctgcccatcgccgaggccatgctgacctacaagcagaagagaaagaagcacttccacttcgacttcaccctgagccccgacgaggagagcagccagaagttcatccccttcgtgggcgtggtgaaggtgggcatcgtggagcccagcagcgccaccagcggcgacagcgacgacgccgcccccagcggcagcggcaccctgagcagcaccccccccagcgccagccccgccgccaaggaggccagccccaccccccccagcagccccagcgtgagcggcggcctgagcagccccagccagggcgtgggcgccgagctgatgggcctgcaggtggactactggaccgccgcccagcccgccgacagaaagagagacgccgagaagaaggacctgcccgtgaccaagaacaccctgaagtgcaccttcagaagcctgcaggtgagcagactgcccagcagcggcgaggccgccgccacccccaccatgagcatgaccgtggtgaccaaggagaagaacaagaaggtgatgttcctgcccaagaaggccaaggacaaggacgtggagagcaagagccagtgcatcgagggcatcagcagactgatctgcaccgccagacagcagcagaacatgctgagagtgctgatcgacggcgtggagtgcagcgacgtgaagttcttccagctggccgcccagtggagcagccacgtgaagcacttccccatctgcatcttcggccacagcaaggccaccttctag

SEQ ID NO: 20861 - DNA, 768 bp, Artificial Sequence
  Description of Artificial Sequence: Synthetic coding sequence
atggccttcagacaggccctgcagctggccgcctgcggcctggccggcggcagcgccgccgtgctgttcagcgccgtggccgtgggcaagcccagagccggcggcgacgccgagcccagacccgccgagccccccgcctgggccggcggcgccagacccggccccggcgtgtgggaccccaactgggacagaagagagcccctgagcctgatcaacgtgagaaagagaaacgtggagagcggcgaggaggagctggccagcaagctggaccactacaaggccaaggccaccagacacatcttcctgatcagacacagccagtaccacgtggacggcagcctggagaaggacagaaccctgacccccctgggcagagagcaggccgagctgaccggcctgagactggccagcctgggcctgaagttcaacaagatcgtgcacagcagcatgaccagagccatcgagaccaccgacatcatcagcagacacctgcccggcgtgtgcaaggtgagcaccgacctgctgagagagggcgcccccatcgagcccgacccccccgtgagccactggaagcccgaggccgtgcagtactacgaggacggcgccagaatcgaggccgccttcagaaactacatccacagagccgacgccagacaggaggaggacagctacgagatcttcatctgccacgccaacgtgatcagatacatcgtgtgcagcatcccccccctgctgagcgccggcgacttcgtgctgctgggcagctag

SEQ ID NO: 20862 - DNA, 870 bp, Artificial Sequence
  Description of Artificial Sequence: Synthetic coding sequence
atggccttcagacaggccctgcagctggccgcctgcggcctggccggcggcagcgccgccgtgctgttcagcgccgtggccgtgggcaagcccagagccggcggcgacgccgagcccagacccgccgagccccccgcctgggccggcggcgccagacccggccccggcgtgtgggaccccaactgggacagaagagagcccctgagcctgatcaacgtgagaaagagaaacgtggagagcggcgaggaggagctggccagcaagctggaccactacaaggccaaggccaccagacacatcttcctgatcagacacagccagtaccacgtggacggcagcctggagaaggacagaaccctgacccccctgggcagagagcaggccgagctgaccggcctgagactggccagcctgggcctgaagttcaacaagatcgtgcacagcagcatgaccagagccatcgagaccaccgacatcatcagcagacacctgcccggcgtgtgcaaggtgagcaccgacctgctgagagagggcgcccccatcgagcccgacccccccgtgagccactggaagcccgaggccgtgcagtactacgaggacggcgccagaatcgaggccgccttcagaaactacatccacagagccgacgccagacaggaggaggacagctacgagatcttcatctgccacgccaacgtgatcagatacatcgtgtgcagagccctgcagttcccccccgagggctggctgagactgagcctgaacaacggcagcatcacccacctggtgatcagacccaacggcagagtggccctgagaaccctgggcgacaccggcttcatgccccccgacaagatcaccagaagctag

SEQ ID NO: 20863 - DNA, 2418 bp, Artificial Sequence
  Description of Artificial Sequence: Synthetic coding sequence
atggccgccagcggcgtgcccagaggctgcgacatcctgatcgtgtacagccccgacgccgaggagtggtgccagtacctgcagaccctgttcctgagcagcagacaggtgagaagccagaagatcctgacccacagactgggccccgaggccagcttcagcgccgaggacctgagcctgttcctgagcaccagatgcgtggtggtgctgctgagcgccgagctggtgcagcacttccacaagcccgccctgctgcccctgctgcagagagccttccaccccccccacagagtggtgagactgctgtgcggcgtgagagacagcgaggagttcctggacttcttccccgactgggcccactggcaggagctgacctgcgacgacgagcccgagacctacgtggccgccgtgaagaaggccatcagcgaggacagcggctgcgacagcgtgaccgacaccgagcccgaggacgagaaggtggtgagctacagcaagcagcagaacctgcccaccgtgaccagccccggcaacctgatggtggtgcagcccgacagaatcagatgcggcgccgagaccaccgtgtacgtgatcgtgagatgcaagctggacgacagagtggccaccgaggccgagttcagccccgaggacagccccagcgtgagaatggaggccaaggtggagaacgagtacaccatcagcgtgaaggcccccaacctgagcagcggcaacgtgagcctgaagatctacagcggcgacctggtggtgtgcgagaccgtgatcagctactacaccgacatggaggagatcggcaacctgctgagcaacgccgccaaccccgtggagttcatgtgccaggccttcaagatcgtgccctacaacaccgagaccctggacaagctgctgaccgagagcctgaagaacaacatccccgccagcggcctgcacctgttcggcatcaaccagctggaggaggaggacatgatgaccaaccagagagacgaggagctgcccaccctgctgcacttcgccgccaagtacggcctgaagaacctgaccgccctgctgctgacctgccccggcgccctgcaggcctacagcgtggccaacaagcacggccactaccccaacaccatcgccgagaagcacggcttcagagacctgagacagttcatcgacgagtacgtggagaccgtggacatgctgaagagccacatcaaggaggagctgatgcacggcgaggaggccgacgccgtgtacgagagcatggcccacctgagcaccgacctgctgatgaagtgcagcctgaaccccggctgcgacgaggacctgtacgagagcatggccgccttcgtgcccgccgccaccgaggacctgtacgtggagatgctgcaggccagcaccagcaaccccatccccggcgacggcttcagcagagccaccaaggacagcatgatcagaaagttcctggagggcaacagcatgggcatgaccaacctggagagagaccagtgccacctgggccaggaggaggacgtgtaccacaccgtggacgacgacgaggccttcagcgtggacctggccagcagaccccccgtgcccgtgcccagacccgagaccaccgcccccggcgcccaccagctgcccgacaacgagccctacatcttcaaggtgttcgccgagaagagccaggagagacccggcaacttctacgtgagcagcgagagcatcagaaagggcccccccgtgagaccctggagagacagaccccagagcagcatctacgaccccttcgccggcatgaagacccccggccagagacagctgatcaccctgcaggagcaggtgaagctgggcatcgtgaacgtggacgaggccgtgctgcacttcaaggagtggcagctgaaccagaagaagagaagcgagagcttcagattccagcaggagaacctgaagagactgagagacagcatcaccagaagacagagagagaagcagaagagcggcaagcagaccgacctggagatcaccgtgcccatcagacacagccagcacctgcccgccaaggtggagttcggcgtgtacgagagcggccccagaaagagcgtgatcccccccagaaccgagctgagaagaggcgactggaagaccgacagcaccagcagcaccgccagcagcaccagcaacagaagcagcaccagaagcctgctgagcgtgagcagcggcatggagggcgacaacgaggacaacgaggtgcccgaggtgaccagaagcagaagccccggccccccccaggtggacggcacccccaccatgagcctggagagaccccccagagtgccccccagagccgccagccagagaccccccaccagagagaccttccacccccccccccccgtgccccccagaggcagatag

SEQ ID NO: 20864 - DNA, 1215 bp, Artificial Sequence
  Description of Artificial Sequence: Synthetic coding sequence
atgagattcttcaccagcgtggcctgctacggcagctgcctgttcgccagcgagctgctgatcagatgcaaggactggctgaagggcagacccgccctgttcaccgccctgctggcctgcgtgctgtacctgtgcgagtggaccggcgccaagcacgtgcccggcagcagctacgtggagatgctgcaggccagcaccagcaaccccatccccggcgacggcttcagcagagccaccaaggacagcatgatcagaaagttcctggagggcaacagcatgggcatgaccaacctggagagagaccagtgccacctgggccaggaggaggacgtgtaccacaccgtggacgacgacgaggccttcagcgtggacctggccagcagaccccccgtgcccgtgcccagacccgagaccaccgcccccggcgcccaccagctgcccgacaacgagccctacatcttcaaggtgttcgccgagaagagccaggagagacccggcaacttctacgtgagcagcgagagcatcagaaagggcccccccgtgagaccctggagagacagaccccagagcagcatctacgaccccttcgccggcatgaagacccccggccagagacagctgatcaccctgcaggagcaggtgaagctgggcatcgtgaacgtggacgaggccgtgctgcacttcaaggagtggcagctgaaccagaagaagagaagcgagagcttcagattccagcaggagaacctgaagagactgagagacagcatcaccagaagacagagagagaagcagaagagcggcaagcagaccgacctggagatcaccgtgcccatcagacacagccagcacctgcccgccaaggtggagttcggcgtgtacgagagcggccccagaaagagcgtgatcccccccagaaccgagctgagaagaggcgactggaagaccgacagcaccagcagcaccgccagcagcaccagcaacagaagcagcaccagaagcctgctgagcgtgagcagcggcatggagggcgacaacgaggacaacgaggtgcccgaggtgaccagaagcagaagccccggccccccccaggtggacggcacccccaccatgagcctggagagaccccccagagtgccccccagagccgccagccagagaccccccaccagagagaccttccacccccccccccccgtgccccccagaggcagatag

SEQ ID NO: 20865 - DNA, 1884 bp, Artificial Sequence
  Description of Artificial Sequence: Synthetic coding sequence
atggtggtgcagcccgacagaatcagatgcggcgccgagaccaccgtgtacgtgatcgtgagatgcaagctggacgacagagtggccaccgaggccgagttcagccccgaggacagccccagcgtgagaatggaggccaaggtggagaacgagtacaccatcagcgtgaaggcccccaacctgagcagcggcaacgtgagcctgaagatctacagcggcgacctggtggtgtgcgagaccgtgatcagctactacaccgacatggaggagatcggcaacctgctgagcaacgccgccaaccccgtggagttcatgtgccaggccttcaagatcgtgccctacaacaccgagaccctggacaagctgctgaccgagagcctgaagaacaacatccccgccagcggcctgcacctgttcggcatcaaccagctggaggaggaggacatgatgaccaaccagagagacgaggagctgcccaccctgctgcacttcgccgccaagtacggcctgaagaacctgaccgccctgctgctgacctgccccggcgccctgcaggcctacagcgtggccaacaagcacggccactaccccaacaccatcgccgagaagcacggcttcagagacctgagacagttcatcgacgagtacgtggagaccgtggacatgctgaagagccacatcaaggaggagctgatgcacggcgaggaggccgacgccgtgtacgagagcatggcccacctgagcaccgacctgctgatgaagtgcagcctgaaccccggctgcgacgaggacctgtacgagagcatggccgccttcgtgcccgccgccaccgaggacctgtacgtggagatgctgcaggccagcaccagcaaccccatccccggcgacggcttcagcagagccaccaaggacagcatgatcagaaagttcctggagggcaacagcatgggcatgaccaacctggagagagaccagtgccacctgggccaggaggaggacgtgtaccacaccgtggacgacgacgaggccttcagcgtggacctggccagcagaccccccgtgcccgtgcccagacccgagaccaccgcccccggcgcccaccagctgcccgacaacgagccctacatcttcaaggtgttcgccgagaagagccaggagagacccggcaacttctacgtgagcagcgagagcatcagaaagggcccccccgtgagaccctggagagacagaccccagagcagcatctacgaccccttcgccggcatgaagacccccggccagagacagctgatcaccctgcaggagcaggtgaagctgggcatcgtgaacgtggacgaggccgtgctgcacttcaaggagtggcagctgaaccagaagaagagaagcgagagcttcagattccagcaggagaacctgaagagactgagagacagcatcaccagaagacagagagagaagcagaagagcggcaagcagaccgacctggagatcaccgtgcccatcagacacagccagcacctgcccgccaaggtggagttcggcgtgtacgagagcggccccagaaagagcgtgatcccccccagaaccgagctgagaagaggcgactggaagaccgacagcaccagcagcaccgccagcagcaccagcaacagaagcagcaccagaagcctgctgagcgtgagcagcggcatggagggcgacaacgaggacaacgaggtgcccgaggtgaccagaagcagaagccccggccccccccaggtggacggcacccccaccatgagcctggagagaccccccagagtgccccccagagccgccagccagagaccccccaccagagagaccttccacccccccccccccgtgccccccagaggcagatag

SEQ ID NO: 20866 - DNA, 408 bp, Artificial Sequence
  Description of Artificial Sequence: Synthetic coding sequence
atggcctgcggcctggtggccagcaacctgaacctgaagcccggcgagtgcctgagagtgagaggcgaggtggcccccgacgccaagagcttcgtgctgaacctgggcaaggacagcaacaacctgtgcctgcacttcaaccccagattcaacgcccacggcgacgccaacaccatcgtgtgcaacagcaaggacggcggcgcctggggcaccgagcagagagaggccgtgttccccttccagcccggcagcgtggccgaggtgtgcatcaccttcgaccaggccaacctgaccgtgaagctgcccgacggctacgagttcaagttccccaacagactgaacctggaggccatcaactacatggccgccgacggcgacttcaagatcaagtgcgtggccttcgactag

SEQ ID NO: 20867 - DNA, 705 bp, Artificial Sequence
  Description of Artificial Sequence: Synthetic coding sequence
atgctgctggcctgggtgcaggccttcctggtgagcaacatgctgctggccgaggcctacggcagcggcggctgcttctgggacaacggccacctgtacagagaggaccagaccagccccgcccccggcctgagatgcctgaactggctggacgcccagagcggcctggccagcgcccccgtgagcggcgccggcaaccacagctactgcagaaaccccgacgaggaccccagaggcccctggtgctacgtgagcggcgaggccggcgtgcccgagaagagaccctgcgaggacctgagatgccccgagaccaccagccaggccctgcccgccttcaccaccgagatccaggaggccagcgagggccccggcgccgacgaggtgcaggtgttcgcccccgccaacgccctgcccgccagaagcgaggccgccgccgtgcagcccgtgatcggcatcagccagagagtgagaatgaacagcaaggagaagaaggacctgggcaccctgggctacgtgctgggcatcaccatgatggtgatcatcatcgccatcggcgccggcatcatcctgggctacagctacaagagaagcgtggccagcctgctgggccccctgagaagaagaggcggcagatacaccaagagcaacttcgtggccttcctgcccaagagaaagcaggacgtggagaaccagctgaagatgtag

SEQ ID NO: 20868 - DNA, 726 bp, Artificial Sequence
  Description of Artificial Sequence: Synthetic coding sequence
atgctgctggcctgggtgcaggccttcctggtgagcaacatgctgctggccgaggcctacggcagcggcggctgcttctgggacaacggccacctgtacagagaggaccagaccagccccgcccccggcctgagatgcctgaactggctggacgcccagagcggcctggccagcgcccccgtgagcggcgccggcaaccacagctactgcagaaaccccggcgaggacctgagatgccccgagaccaccagccaggccctgcccgccttcaccaccgagatccaggaggccagcgagggccccggcgccgacgaggtgcaggtgttcgcccccgccaacgccctgcccgccagaagcgaggccgccgccgtgcagcccgtgatcggcatcagccagagagtgagaatgaacagcaaggagaagaaggacctgggcaccctgggctacgtgctgggcatcaccatgatggtgatcatcatcgccatcggcgccggcatcatcctgggctacagctacaagagaggcaaggacctgaaggagcagcacgaccagaaggtgtgcgagagagagatgcagagaatcaccctgcccctgagcgccttcaccaaccccacctgcgagatcgtggacgagaagaccgtggtggtgcacaccagccagacccccgtggacccccaggagggcaccacccccctgatgggccaggccggcacccccggcgcctag

SEQ ID NO: 20869 - DNA, 522 bp, Artificial Sequence
  Description of Artificial Sequence: Synthetic coding sequence
atgctgctggcctgggtgcaggccttcctggtgagcaacatgctgctggccgaggcctacggcagcggcggctgcttctgggacaacggccacctgtacagagaggaccagaccagccccgcccccggcctgagatgcctgaactggctggacgcccagagcggcctggccagcgcccccgtgagcggcgccggcaaccacagctactgcagaaaccccgacgaggaccccagaggcccctggtgctacgtgagcggcgaggccggcgtgcccgagaagagaccctgcgaggacctgagatgccccgagaccaccagccaggccctgcccgccttcaccaccgagatccaggaggccagcgagggccccggcgccgacgaggtgcaggtgttcgcccccgccaacgccctgcccgccagaagcgaggccgccgccgtgcagcccgtgatcggcatcagccagagagtgagaatgaacagcaaggagaagaaggacctgggcaccctgggcggcagaatctag

SEQ ID NO: 20870 - DNA, 555 bp, Artificial Sequence
  Description of Artificial Sequence: Synthetic coding sequence
atgctgctggcctgggtgcaggccttcctggtgagcaacatgctgctggccgaggcctacggcagcggcgagaccaccagccaggccctgcccgccttcaccaccgagatccaggaggccagcgagggccccggcgccgacgaggtgcaggtgttcgcccccgccaacgccctgcccgccagaagcgaggccgccgccgtgcagcccgtgatcggcatcagccagagagtgagaatgaacagcaaggagaagaaggacctgggcaccctgggctacgtgctgggcatcaccatgatggtgatcatcatcgccatcggcgccggcatcatcctgggctacagctacaagagaggcaaggacctgaaggagcagcacgaccagaaggtgtgcgagagagagatgcagagaatcaccctgcccctgagcgccttcaccaaccccacctgcgagatcgtggacgagaagaccgtggtggtgcacaccagccagacccccgtggacccccaggagggcaccacccccctgatgggccaggccggcacccccggcgcctag

SEQ ID NO: 20871 - DNA, 2538 bp, Artificial Sequence
  Description of Artificial Sequence: Synthetic coding sequence
cagttcgtgcagcccgaggagagaagacagggcagcctgctgggccccggcctgcccagccacgccctgggcaccctggccaaggtggccggcagacaggacgccgccccccccggcggcagcgccgccagcgaggagagagaggagggccccagcgtggaggccctggccgtgagcaaggccgactgctacgtgcagctgtggctgcccaccgccagccccagccccgcccagaccagaatcgtggccaactgcagcgaccccgagtggaacgagaccttccactaccagatccacggcgccgtgaagaacgtgctggagctgaccctgtacgacaaggacatcctgggcagcgaccagctgagcctgctgctgttcgacctgagaagcctgaagtgcggccagccccacaagcacaccttccccctgaaccaccaggacagccaggagctgcaggtggagttcgtgctggagaagagccaggtgcccgccagcgaggtgatcaccaacggcgtgctggtggcccacccctgcctgagaatccagggcaccctgagaggcgacggcaccgcccccagagaggagtacggcagcagacagctgcagctggccgtgcccggcgcctacgagaagccccagctgctgcccctgcagccccccaccgagcccggcctgccccccaccttcaccttccacgtgaaccccgtgctgagcagcagactgcacgtggagctgatggagctgctggccgccgtgcagagcggccccagcgccgagctggaggcccagaccagcaagctgggcgagggcggcatcctgctgagcagcctgcccctgggccaggaggagcagtgcagcgtggccctgggcgagggccaggaggtggccctgagcatgaaggtggagatgagcagcggcgacctggacctgagactgggcttcgacctgagcgacggcgagcaggagttcctggacagaagaaagcaggtggtgagcaaggccctgcagcaggtgctgggcctgagcgaggccctggacagcggccaggtgcccgtggtggccgtgctgggcagcggcggcggcaccagagccatgagcagcctgtacggcagcctggccggcctgcaggagctgggcctgctggacaccgtgacctacctgagcggcgtgagcggcagcacctggtgcatcagcaccctgtacagagaccccgcctggagccaggtggccctgcagggccccatcgagagagcccaggtgcacgtgtgcagcagcaagatgggcgccctgagcaccgagagactgcagtactacacccaggagctgggcgtgagagagagaagcggccacagcgtgagcctgatcgacctgtggggcctgctggtggagtacctgctgtaccaggaggagaaccccgccaagctgagcgaccagcaggaggccgtgagacagggccagaacccctaccccatctacaccagcgtgaacgtgagaaccaacctgagcggcgaggacttcgccgagtggtgcgagttcaccccctacgaggtgggcttccccaagtacggcgcctacgtgcccaccgagctgttcggcagcgagctgttcatgggcagactgctgcagctgcagcccgagcccagaatctgctacctgcagggcatgtggggcagcgccttcgccaccagcctggacgagatcttcctgaagaccgccggcagcggcctgagcttcctggagtggtacagaggcagcgtgaacatcaccgacgactgccagaagccccagctgcacaaccccagcagactgagaaccagactgctgaccccccagggccccttcagccaggccgtgctggacatcttcaccagcagattcaccagcgcccagagcttcaacttcaccagaggcctgtgcctgcacaaggactacgtggccggcagagagttcgtggcctggaaggacacccaccccgacgccttccccaaccagctgacccccatgagagactgcctgtacctggtggacggcggcttcgccatcaacagccccttccccctggccctgctgccccagagagccgtggacctgatcctgagcttcgactacagcctggaggcccccttcgaggtgctgaagatgaccgagaagtactgcctggacagaggcatccccttccccagcatcgaggtgggccccgaggacatggaggaggccagagagtgctacctgttcgccaaggccgaggaccccagaagccccatcgtgctgcacttccccctggtgaacagaaccttcagaacccacctggcccccggcgtggagagacagaccgccgaggagaaggccttcggcgacttcgtgatcaacagacccgacaccccctacggcatgatgaacttcacctacgagccccaggacttctacagactggtggccctgagcagatacaacgtgctgaacaacgtggagaccctgaagtgcgccctgcagctggccctggacagacaccaggccagagagagagccggcgcctag

SEQ ID NO: 20872 - DNA, 1365 bp, Artificial Sequence
  Description of Artificial Sequence: Synthetic coding sequence
atgctgtgggccctgtggcccagatggctggccgacaagatgctgcccctgctgggcgccgtgctgctgcagaagagagagaagagaggccccctgtggagacactggagaagagagacctacccctactacgacctgcaggtgaaggtgctgagagccaccaacatcagaggcaccgacctgctgagcaaggccgactgctacgtgcagctgtggctgcccaccgccagccccagccccgcccagaccagaatcgtggccaactgcagcgaccccgagtggaacgagaccttccactaccagatccacggcgccgtgaagaacgtgctggagctgaccctgtacgacaaggacatcctgggcagcgaccagctgagcctgctgctgttcgacctgagaagcctgaagtgcggccagccccacaagcacaccttccccctgaaccaccaggacagccaggagctgcaggtggagttcgtgctggagaagagccaggtgcccgccagcgaggtgatcaccaacggcgtgctggtggcccacccctgcctgagaatccagggcaccctgagaggcgacggcaccgcccccagagaggagtacggcagcagacagctgcagctggccgtgcccggcgcctacgagaagccccagctgctgcccctgcagccccccaccgagcccggcctgccccccaccttcaccttccacgtgaaccccgtgctgagcagcagactgcacgtggagctgatggagctgctggccgccgtgcagagcggccccagcgccgagctggaggcccagaccagcaagctgggcgagggcggcatcctgctgagcagcctgcccctgggccaggaggagcagtgcagcgtggccctgggcgagggccaggaggtggccctgagcatgaaggtggagatgagcagcggcgacctggacctgagactgggcttcgacctgagcgacggcgagcaggagttcctggacagaagaaagcaggtggtgagcaaggccctgcagcaggtgctgggcctgagcgaggccctggacagcggccaggtgcccgtggtggccgtgctgggcagcggcggcggcaccagagccatgagcagcctgtacggcagcctggccggcctgcaggagctgggcctgctggacaccgtgacctacctgagcggcgtgagcggcagcacctggtgcatcagcaccctgtacagagaccccgcctggagccaggtggccctgcagggccccatcgagagagcccaggtgcacgtgtgcagcagcaaggtgggcgacgtgagagtgagcccctgccagctgcccagactgcacagcagcaacctggaccacagcctgtggtag

SEQ ID NO: 20873 - DNA, 2550 bp, Artificial Sequence
  Description of Artificial Sequence: Synthetic coding sequence
atgctgtgggccctgtggcccagatggctggccgacaagatgctgcccctgctgggcgccgtgctgctgcagaagagagagaagagaggccccctgtggagacactggagaagagagacctacccctactacgacctgcaggtgaaggtgctgagagccaccaacatcagaggcaccgacctgctgagcaaggccgactgctacgtgcagctgtggctgcccaccgccagccccagccccgcccagaccagaatcgtggccaactgcagcgaccccgagtggaacgagaccttccactaccagatccacggcgccgtgaagaacgtgctggagctgaccctgtacgacaaggacatcctgggcagcgaccagctgagcctgctgctgttcgacctgagaagcctgaagtgcggccagccccacaagcacaccttccccctgaaccaccaggacagccaggagctgcaggtggagttcgtgctggagaagagccaggtgcccgccagcgaggtgatcaccaacggcgtgctggtggcccacccctgcctgagaatccagggcaccctgagaggcgacggcaccgcccccagagaggagtacggcagcagacagctgcagctggccgtgcccggcgcctacgagaagccccagctgctgcccctgcagccccccaccgagcccggcctgccccccaccttcaccttccacgtgaaccccgtgctgagcagcagactgcacgtggagctgatggagctgctggccgccgtgcagagcggccccagcgccgagctggaggcccagaccagcaagctgggcgagggcggcatcctgctgagcagcctgcccctgggccaggaggagcagtgcagcgtggccctgggcgagggccaggaggtggccctgagcatgaaggtggagatgagcagcggcgacctggacctgagactgggcttcgacctgagcgacggcgagcaggagttcctggacagaagaaagcaggtggtgagcaaggccctgcagcaggtgctgggcctgagcgaggccctggacagcggccaggtgcccgtggtggccgtgctgggcagcggcggcggcaccagagccatgagcagcctgtacggcagcctggccggcctgcaggagctgggcctgctggacaccgtgacctacctgagcggcgtgagcggcagcacctggtgcatcagcaccctgtacagagaccccgcctggagccaggtggccctgcagggccccatcgagagagcccaggtgcacgtgtgcagcagcaagatgggcgccctgagcaccgagagactgcagtactacacccaggagctgggcgtgagagagagaagcggccacagcgtgagcctgatcgacctgtggggcctgctggtggagtacctgctgtaccaggaggagaaccccgccaagctgagcgaccagcaggaggccgtgagacagggccagaacccctaccccatctacaccagcgtgaacgtgagaaccaacctgagcggcgaggacttcgccgagtggtgcgagttcaccccctacgaggtgggcttccccaagtacggcgcctacgtgcccaccgagctgttcggcagcgagctgttcatgggcagactgctgcagctgcagcccgagcccagaatctgctacctgcagggcatgtggggcagcgccttcgccaccagcctggacgagatcttcctgaagaccgccggcagcggcctgagcttcctggagtggtacagaggcagcgtgaacatcaccgacgactgccagaagccccagctgcacaaccccagcagactgagaaccagactgctgaccccccagggccccttcagccaggccgtgctggacatcttcaccagcagattcaccagcgcccagagcttcaacttcaccagaggcctgtgcctgcacaaggactacgtggccggcagagagttcgtggcctggaaggacacccaccccgacgccttccccaaccagctgacccccatgagagactgcctgtacctggtggacggcggcttcgccatcaacagccccttccccctggccctgctgccccagagagccgtggacctgatcctgagcttcgactacagcctggaggcccccttcgaggtgctgaagatgaccgagaagtactgcctggacagaggcatccccttccccagcatcgaggtgggccccgaggacatggaggaggccagagagtgctacctgttcgccaaggccgaggaccccagaagccccatcgtgctgcacttccccctggtgaacagaaccttcagaacccacctggcccccggcgtggagagacagaccgccgaggagaaggccttcggcgacttcgtgatcaacagacccgacaccccctacggcatgatgaacttcacctacgagccccaggacttctacagactggtggccctgagcagatacaacgtgctgaacaacgtggagaccctgaagtgcgccctgcagctggccctggacagacaccaggccagagagagagccggcgcctag

SEQ ID NO: 20874 - DNA, 2556 bp, Artificial Sequence
  Description of Artificial Sequence: Synthetic coding sequence
atgctgtgggccctgtggcccagatggctggccgacaagatgctgcccctgctgggcgccgtgctgctgcagaagagagagaagagaggccccctgtggagacactggagaagagagacctacccctactacgacctgcaggtgaaggtgctgagagccaccaacatcagaggcaccgacctgctgagcaaggccgactgctacgtgcagctgtggctgcccaccgccagccccagccccgcccagaccagaatcgtggccaactgcagcgaccccgagtggaacgagaccttccactaccagatccacggcgccgtgaagaacgtgctggagctgaccctgtacgacaaggacatcctgggcagcgaccagctgagcctgctgctgttcgacctgagaagcctgaagtgcggccagccccacaagcacaccttccccctgaaccaccaggacagccaggagctgcaggtggagttcgtgctggagaagagccaggtgcccgccagcgaggtgatcaccaacggcgtgctggtggcccacccctgcctgagaatccagggcaccctgagaggcgacggcaccgcccccagagaggagtacggcagcagacagctgcagctggccgtgcccggcgcctacgagaagccccagctgctgcccctgcagccccccaccgagcccggcctgccccccaccttcaccttccacgtgaaccccgtgctgagcagcagactgcacgtggagctgatggagctgctggccgccgtgcagagcggccccagcgccgagctggaggcccagaccagcaagctgggcgagggcggcatcctgctgagcagcctgcccctgggccaggaggagcagtgcagcgtggccctgggcgagggccaggaggtggccctgagcatgaaggtggagatgagcagcggcgacctggacctgagactgggcttcgacctgagcgacggcgagcaggagttcctggacagaagaaagcaggtggtgagcaaggccctgcagcaggtgctgggcctgagcgaggccctggacagcggccagacccaggtgcccgtggtggccgtgctgggcagcggcggcggcaccagagccatgagcagcctgtacggcagcctggccggcctgcaggagctgggcctgctggacaccgtgacctacctgagcggcgtgagcggcagcacctggtgcatcagcaccctgtacagagaccccgcctggagccaggtggccctgcagggccccatcgagagagcccaggtgcacgtgtgcagcagcaagatgggcgccctgagcaccgagagactgcagtactacacccaggagctgggcgtgagagagagaagcggccacagcgtgagcctgatcgacctgtggggcctgctggtggagtacctgctgtaccaggaggagaaccccgccaagctgagcgaccagcaggaggccgtgagacagggccagaacccctaccccatctacaccagcgtgaacgtgagaaccaacctgagcggcgaggacttcgccgagtggtgcgagttcaccccctacgaggtgggcttccccaagtacggcgcctacgtgcccaccgagctgttcggcagcgagctgttcatgggcagactgctgcagctgcagcccgagcccagaatctgctacctgcagggcatgtggggcagcgccttcgccaccagcctggacgagatcttcctgaagaccgccggcagcggcctgagcttcctggagtggtacagaggcagcgtgaacatcaccgacgactgccagaagccccagctgcacaaccccagcagactgagaaccagactgctgaccccccagggccccttcagccaggccgtgctggacatcttcaccagcagattcaccagcgcccagagcttcaacttcaccagaggcctgtgcctgcacaaggactacgtggccggcagagagttcgtggcctggaaggacacccaccccgacgccttccccaaccagctgacccccatgagagactgcctgtacctggtggacggcggcttcgccatcaacagccccttccccctggccctgctgccccagagagccgtggacctgatcctgagcttcgactacagcctggaggcccccttcgaggtgctgaagatgaccgagaagtactgcctggacagaggcatccccttccccagcatcgaggtgggccccgaggacatggaggaggccagagagtgctacctgttcgccaaggccgaggaccccagaagccccatcgtgctgcacttccccctggtgaacagaaccttcagaacccacctggcccccggcgtggagagacagaccgccgaggagaaggccttcggcgacttcgtgatcaacagacccgacaccccctacggcatgatgaacttcacctacgagccccaggacttctacagactggtggccctgagcagatacaacgtgctgaacaacgtggagaccctgaagtgcgccctgcagctggccctggacagacaccaggccagagagagagccggcgcctag

SEQ ID NO: 20875 - DNA, 2598 bp, Artificial Sequence
  Description of Artificial Sequence: Synthetic coding sequence
atgctgtgggccctgtggcccagatggctggccgacaagatgctgcccctgctgggcgccgtgctgctgcagaagagagagaagagaggccccctgtggagacactggagaagagagacctacccctactacgacctgcaggtgaaggtgctgagagccaccaacatcagaggcaccgacctgctgagcaaggccgactgctacgtgcagctgtggctgcccaccgccagccccagccccgcccagaccagaatcgtggccaactgcagcgaccccgagtggaacgagaccttccactaccagatccacggcgccgtgaagaacgtgctggagctgaccctgtacgacaaggacatcctgggcagcgaccagctgagcctgctgctgttcgacctgagaagcctgaagtgcggccagccccacaagcacaccttccccctgaaccaccaggacagccaggagctgcaggtggagttcgtgctggagaagagccaggtgcccgccagcgaggtgatcaccaacggcgtgctggtggcccacccctgcctgagaatccagggcaccctgagaggcgacggcaccgcccccagagaggagtacggcagcagacagctgcagctggccgtgcccggcgcctacgagaagccccagctgctgcccctgcagccccccaccgagcccggcctgccccccaccttcaccttccacgtgaaccccgtgctgagcagcagactgcacgtggagctgatggagctgctggccgccgtgcagagcggccccagcgccgagctggaggcccagaccagcaagctgggcgagggcggcatcctgctgagcagcctgcccctgggccaggaggagcagtgcagcgtggccctgggcgagggccaggaggtggccctgagcatgaaggtggagatgagcagcggcgacctggacctgagactgggcttcgacctgagcgacggcgagcaggagttcctggacagaagaaagcaggtggtgagcaaggccctgcagcaggtgctgggcctgagcgaggccctggacagcggccaggtgcccgtggtggccgtgctgggcagcggcggcggcaccagagccatgagcagcctgtacggcagcctggccggcctgcaggagctgggcctgctggacaccgtgacctacctgagcggcgtgagcggcagcacctggtgcatcagcaccctgtacagagaccccgcctggagccaggtggccctgcagggccccatcgagagagcccaggtgcacgtgtgcagcagcaagatgggcgccctgagcaccgagagactgcagtactacacccaggagctgggcgtgagagagagaagcggccacagcgtgagcctgatcgacctgtggggcctgctggtggagtacctgctgtaccaggaggagaaccccgccaagctgagcgaccagcaggaggccgtgagacagggccagaacccctaccccatctacaccagcgtgaacgtgagaaccaacctgagcggcgaggacttcgccgagtggtgcgagttcaccccctacgaggtgggcttccccaagtacggcgcctacgtgcccaccgagctgttcggcagcgagctgttcatgggcagactgctgcagctgcagcccgagcccagaatctgctacctgcagggcatgtggggcagcgccttcgccaccagcctggacgagatcttcctgaagaccgccggcagcggcctgagcttcctggagtggtacagaggcagcgtgaacatcaccgacgactgccagaagccccagctgcacaaccccagcagactgagaaccagactgctgaccccccagggccccttcagccaggccgtgctggacatcttcaccagcagattcaccagcgcccagagcttcaacttcaccagaggcctgtgcctgcacaaggactacgtggccggcagagagttcgtggcctggaaggacacccaccccgacgccttccccaaccagctgacccccatgagagactgcctgtacctggtggacggcggcttcgccatcaacagccccttccccctggccctgctgccccagagagccgtggacctgatcctgagcttcgactacagcctggaggcccccttcgaggtgctgaagatgaccgagaagtactgcctggacagaggcatccccttccccagcatcgaggtgggccccgaggacatggaggaggccagagagtgctacctgttcgccaaggccgaggaccccagaagccccatcgtgctgcacttccccctggtgaacagaaccttcagaacccacctggcccccggcgtggagagacagaccgccgaggagaaggccttcggcgacttcgtgatcaacagacccgacaccccctacggcatgatgaacttcacctacgagccccaggacttctacagactggtggccctgagcagatacaacgtgctgaacaacgtggagaccctgaagtgcgcccaccccagacacagaagaaccagcgagggccccagcccccagacccacaccgagcagggcctgagagccctgagaagccagctgagcagcctgcactag

SEQ ID NO: 20876 - DNA, 1770 bp, Artificial Sequence
  Description of Artificial Sequence: Synthetic coding sequence
atggtgggccagatgtactgctaccccggcagccacctggccagagccctgaccagagccctggccctggccctggtgctggccctgctggtgggccccttcctgagcggcctggccggcgccatccccgcccccggcggcagatgggccagagacggccaggtgccccccgccagcagaagcagaagcgtgctgctggacgtgagcgccggccagctgctgatggtggacggcagacaccccgacgccgtggcctgggccaacctgaccaacgccatcagagagaccggctgggccttcctggagctgggcaccagcggccagtacaacgacagcctgcaggcctacgccgccggcgtggtggaggccgccgtgagcgaggagctgatctacatgcactggatgaacaccgtggtgaactactgcggccccttcgagtacgaggtgggctactgcgagagactgaagagcttcctggaggccaacctggagtggatgcaggaggagatggagagcaaccccgacagcccctactggcaccaggtgagactgaccctgctgcagctgaagggcctggaggacagctacgagggcagagtgagcttccccgccggcaagttcaccatcaagcccctgggcttcctgctgctgcagctgagcggcgacctggaggacctggagctggccctgaacaagaccaagatcaagcccagcctgggcagcggcagctgcagcgccctgatcaagctgctgcccggccagagcgacctgctggtggcccacaacacctggaacaactaccagcacatgctgagagtgatcaagaagtactggctgcagttcagagagggcccctggggcgactaccccctggtgcccggcaacaagctggtgttcagcagctaccccggcaccatcttcagctgcgacgacttctacatcctgggcagcggcctggtgaccctggagaccaccatcggcaacaagaaccccgccctgtggaagtacgtgagacccagaggctgcgtgctggagtgggtgagaaacatcgtggccaacagactggccagcgacggcgccacctgggccgacatcttcaagagattcaacagcggcacctacaacaaccagtggatgatcgtggactacaaggccttcatccccggcggccccagccccggcagcagagtgctgaccatcctggagcagatccccggcatggtggtggtggccgacaagaccagcgagctgtaccagaagacctactgggccagctacaacatccccagcttcgagaccgtgttcaacgccagcggcctgcaggccctggtggcccagtacggcgactggttcagctacgacggcagccccagagcccagatcttcagaagaaaccagagcctggtgcaggacatggacagcatggtgagactgatgagatacaacgacttcctgcacgaccccctgagcctgtgcaaggcctgcaacccccagcccaacggcgagaacgccatcagcgccagaagcgacctgaaccccgccaacggcagctaccccttccaggccctgagacagagaagccacggcggcatcgacgtgaaggtgaccagcatgagcctggccagaatcctgagcctgctggccgccagcggccccacctgggaccaggtgccccccttccagtggagcaccagccccttcagcggcctgctgcacatgggccagcccgacctgtggaagttcgcccccgtgaaggtgagctgggactag

SEQ ID NO: 20877 - DNA, 1674 bp, Artificial Sequence
  Description of Artificial Sequence: Synthetic coding sequence
atggtgggccagatgtactgctaccccggcagccacctggccagagccctgaccagagccctggccctggccctggtgctggccctgctggtgggccccttcctgagcggcctggccggcgccatccccgcccccggcggcagatgggccagagacggccaggtgccccccgccagcagaagcagaagcgtgctgctggacgtgagcgccggccagctgctgatggtggacggcagacaccccgacgccgtggcctgggccaacctgaccaacgccatcagagagaccggctgggccttcctggagctgggcaccagcggccagtacaacgacagcctgcaggcctacgccgccggcgtggtggaggccgccgtgagcgaggagctgatctacatgcactggatgaacaccgtggtgaactactgcggccccttcgagtacgaggtgggctactgcgagagactgaagagcttcctggaggccaacctggagtggatgcaggaggagatggagagcaaccccgacagcccctactggcaccaggtgagactgaccctgctgcagctgaagggcctggaggacagctacgagggcagagtgagcttccccgccggcaagttcaccatcaagcccctgggcttcctgctgctgcagctgagcggcgacctggaggacctggagctggccctgaacaagaccaagatcaagcccagcctgggcagcggcagctgcagcgccctgatcaagctgctgcccggccagagcgacctgctggtggcccacaacacctggaacaactaccagcacatgctgagagtgatcaagaagtactggctgcagttcagagagggcccctggggcgactaccccctggtgcccggcaacaagctggtgttcagcagctaccccggcaccatcttcagctgcgacgacttctacatcctgggcagcggcctggtgaccctggagaccaccatcggcaacaagaaccccgccctgtggaagtacgtgagacccagaggctgcgtgctggagtgggtgagaaacatcgtggccaacagactggccagcgacggcgccacctgggccgacatcttcaagagattcaacagcggcaccggcatggtggtggtggccgacaagaccagcgagctgtaccagaagacctactgggccagctacaacatccccagcttcgagaccgtgttcaacgccagcggcctgcaggccctggtggcccagtacggcgactggttcagctacgacggcagccccagagcccagatcttcagaagaaaccagagcctggtgcaggacatggacagcatggtgagactgatgagatacaacgacttcctgcacgaccccctgagcctgtgcaaggcctgcaacccccagcccaacggcgagaacgccatcagcgccagaagcgacctgaaccccgccaacggcagctaccccttccaggccctgagacagagaagccacggcggcatcgacgtgaaggtgaccagcatgagcctggccagaatcctgagcctgctggccgccagcggccccacctgggaccaggtgccccccttccagtggagcaccagccccttcagcggcctgctgcacatgggccagcccgacctgtggaagttcgcccccgtgaaggtgagctgggactag

SEQ ID NO: 20878 - DNA, 1473 bp, Artificial Sequence
  Description of Artificial Sequence: Synthetic coding sequence
atgaagcccaagctgatgtaccaggagctgaaggtgcccgccgaggagcccgccaacgagctgcccatgaacgagatcgaggcctggaaggccgccgagaagaaggccagatgggtgctgctggtgctgatcctggccgtggtgggcttcggcgccctgatgacccagctgttcctgtgggagtacggcgacctgcacctgttcggccccaaccagagacccgccccctgctacgacccctgcgaggccgtgctggtggagagcatccccgagggcctggacttccccaacgccagcaccggcaaccccagcaccagccaggcctggctgggcctgctggccggcgcccacagcagcctggacatcgccagcttctactggaccctgaccaacaacgacacccacacccaggagcccagcgcccagcagggcgaggaggtgctgagacagctgcagaccctggcccccaagggcgtgaacgtgagaatcgccgtgagcaagcccagcggcccccagccccaggccgacctgcaggccctgctgcagagcggcgcccaggtgagaatggtggacatgcagaagctgacccacggcgtgctgcacaccaagttctgggtggtggaccagacccacttctacctgggcagcgccaacatggactggagaagcctgacccaggtgaaggagctgggcgtggtgatgtacaactgcagctgcctggccagagacctgaccaagatcttcgaggcctactggttcctgggccaggccggcagcagcatccccagcacctggcccagattctacgacaccagatacaaccaggagacccccatggagatctgcctgaacggcacccccgccctggcctacctggccagcgcccccccccccctgtgccccagcggcagaacccccgacctgaaggccctgctgaacgtggtggacaacgccagaagcttcatctacgtggccgtgatgaactacctgcccaccctggagttcagccacccccacagattctggcccgccatcgacgacggcctgagaagagccacctacgagagaggcgtgaaggtgagactgctgatcagctgctggggccacagcgagcccagcatgagagccttcctgctgagcctggccgccctgagagacaaccacacccacagcgacatccaggtgaagctgttcgtggtgcccgccgacgaggcccaggccagaatcccctacgccagagtgaaccacaacaagtacatggtgaccgagagagccacctacatcggcaccagcaactggagcggcaactacttcaccgagaccgccggcaccagcctgctggtgacccagaacggcagaggcggcctgagaagccagctggaggccatcttcctgagagactgggacagcccctacagccacgacctggacaccagcgccgacagcgtgggcaacgcctgcagactgctgtag

SEQ ID NO: 20879 - DNA, 534 bp, Artificial Sequence
  Description of Artificial Sequence: Synthetic coding sequence
atgaagcccaagctgatgtaccaggagctgaaggtgcccgccgaggagcccgccaacgagctgcccatgaacgagatcgaggcctggaaggccgccgagaagaaggccagatgggtgctgctggtgctgatcctggccgtggtgggcttcggcgccctgatgacccagctgttcctgtgggagtacggcgacctgcacctgttcggccccaaccagagacccgccccctgctacgacccctgcgaggccgtgctggtggagagcatccccgagggcctggacttccccaacgccagcaccggcaaccccagcaccagccaggcctggctgggcctgctggccggcgcccacagcagcctggacatcgccagcttctactggaccctgaccaacaacgacacccacacccaggagcccagcgcccagcagggcgaggaggtgctgagacagctgcagaccctggcccccaagggcgtgaacgtgagaatcgccgtgagcaagcccagcggcccccagccccaggccgacctgtag

SEQ ID NO: 20880 - DNA, 390 bp, Artificial Sequence
  Description of Artificial Sequence: Synthetic coding sequence
atgaagcccaagctgatgtaccaggagctgaaggtgcccgccgaggagcccgccaacgagctgcccatgaacgagatcgaggcctggaaggccgccgagaagaaggccagatgggtgctgctggtgctgatcctggccgtggtgggcttcggcgccctgatgacccagctgttcctgtgggagtacggcgacctgcacctgttcggccccaaccagagacccgccccctgctacgacccctgcgaggccgtgctggtggagagcatccccgagggcctggacttccccaacgccagcaccggcaaccccagcaccagccaggcctggctgggcctgctggccggcgcccacagcagcctggacatcgccagcttctactggaccctgtag

SEQ ID NO: 20881 - DNA, 1473 bp, Artificial Sequence; identical to SEQ ID NO: 20878
  Description of Artificial Sequence: Synthetic coding sequence

SEQ ID NO: 20882 - DNA, 1473 bp, Artificial Sequence; identical to SEQ ID NO: 20878
  Description of Artificial Sequence: Synthetic coding sequence

SEQ ID NO: 20883 - DNA, 1473 bp, Artificial Sequence; identical to SEQ ID NO: 20878
  Description of Artificial Sequence: Synthetic coding sequence

SEQ ID NO: 20884 - DNA, 1473 bp, Artificial Sequence; identical to SEQ ID NO: 20878
  Description of Artificial Sequence: Synthetic coding sequence

SEQ ID NO: 20885 - DNA, 1209 bp, Artificial Sequence
  Description of Artificial Sequence: Synthetic coding sequence
atgaagcccaagctgatgtaccaggagctgaaggtgcccgccgaggagcccgccaacgagctgcccatgaacgagatcgaggcctggaaggccgccgagaagaaggccagatgggtgctgctggtgctgatcctggccgtggtgggcttcggcgccctgatgacccagctgttcctgtgggagtacggcgacctgcacctgttcggccccaaccagagacccgccccctgctacgacccctgcgaggccgtgctggtggagagcatccccgagggcctgctggccggcgcccacagcagcctggacatcgccagcttctactggaccctgaccaacaacgacacccacacccaggagcccagcgcccagcagggcgaggaggtgctgagacagctgcagaccctggcccccaagggcgtgaacgtgagaatcgccgtgagcaagcccagcggcccccagccccaggccgacctgcaggccctgctgcagagcggcgcccaggtgagaatggtggacatgcagaagctgacccacggcgtgctgcacaccaagttctgggtggtggaccagacccacttctacctgggcagcgccaacatggactggagaagcctgacccaggtgaaggagctgggcgtggtgatgtacaactgcagctgcctggccagagacctgaccaagatcttcgaggcctactggttcctgggccaggccggcagcagcatccccagcacctggcccagattctacgacaccagatacaaccaggagacccccatggagatctgcctgaacggcacccccgccctggcctacctggccagcgcccccccccccctgtgccccagcggcagaacccccgacctgaaggccctgctgaacgtggtggacaacgccagaagcttcatctacgtggccgtgatgaactacctgcccaccctggagttcagccacccccacagattctggcccgccatcgacgacggcctgagaagagccacctacgagagaggcgtgaaggtgagactgctgatcagctgctggggccacagcgagcccagcatgagagccttcctgctgagcctggccgccctgagagacaaccacacccacagcgacatccaggtgaagctgttcgtggtgcccgccgacgaggcccaggccctgagccccgccctgccccccctgcccccccccccccccgcctag

SEQ ID NO: 20886 - DNA, 1521 bp, Artificial Sequence
  Description of Artificial Sequence: Synthetic coding sequence
atgctgaagcccctgtggaaggccgccgtggcccccacctggccctgcagcatgccccccagaagaccctgggacagagaggccggcaccctgcaggtgctgggcgccctggccgtgctgtggctgggcagcgtggccctgatctgcctgctgtggcaggtgcccagaccccccacctggggccaggtgcagcccaaggacgtgcccagaagctgggagcacggcagcagccccgcctgggagcccctggaggccgaggccagacagcagagagacagctgccagctggtgctggtggagagcatcccccaggacctgcccagcgccgccggcagccccagcgcccagcccctgggccaggcctggctgcagctgctggacaccgcccaggagagcgtgcacgtggccagctactactggagcctgaccggccccgacatcggcgtgaacgacagcagcagccagctgggcgaggccctgctgcagaagctgcagcagctgctgggcagaaacatcagcctggccgtggccaccagcagccccaccctggccagaaccagcaccgacctgcaggtgctggccgccagaggcgcccacgtgagacaggtgcccatgggcagactgaccagaggcgtgctgcacagcaagttctgggtggtggacggcagacacatctacatgggcagcgccaacatggactggagaagcctgacccaggtgaaggagctgggcgccgtgatctacaactgcagccacctggcccaggacctggagaagaccttccagacctactgggtgctgggcgtgcccaaggccgtgctgcccaagacctggccccagaacttcagcagccacttcaacagattccagcccttccacggcctgttcgacggcgtgcccaccaccgcctacttcagcgccagcccccccgccctgtgcccccagggcagaaccagagacctggaggccctgctggccgtgatgggcagcgcccaggagttcatctacgccagcgtgatggagtacttccccaccaccagattcagccacccccccagatactggcccgtgctggacaacgccctgagagccgccgccttcggcaagggcgtgagagtgagactgctggtgggctgcggcctgaacaccgaccccaccatgttcccctacctgagaagcctgcaggccctgagcaaccccgccgccaacgtgagcgtggacgtgaaggtgttcatcgtgcccgtgggcaaccacagcaacatccccttcagcagagtgaaccacagcaagttcatggtgaccgagaaggccgcctacatcggcaccagcaactggagcgaggactacttcagcagcaccgccggcgtgggcctggtggtgacccagagccccggcgcccagcccgccggcgccaccgtgcaggagcagctgagacagctgttcgagagagactggagcagcagatacgccgtgggcctggacggccaggcccccggccaggactgcgtgtggcagggctag

SEQ ID NO: 20887 - DNA, 1542 bp, Artificial Sequence
  Description of Artificial Sequence: Synthetic coding sequence
atgcccggctgccccgtgcagatgctgaagcccctgtggaaggccgccgtggcccccacctggccctgcagcatgccccccagaagaccctgggacagagaggccggcaccctgcaggtgctgggcgccctggccgtgctgtggctgggcagcgtggccctgatctgcctgctgtggcaggtgcccagaccccccacctggggccaggtgcagcccaaggacgtgcccagaagctgggagcacggcagcagccccgcctgggagcccctggaggccgaggccagacagcagagagacagctgccagctggtgctggtggagagcatcccccaggacctgcccagcgccgccggcagccccagcgcccagcccctgggccaggcctggctgcagctgctggacaccgcccaggagagcgtgcacgtggccagctactactggagcctgaccggccccgacatcggcgtgaacgacagcagcagccagctgggcgaggccctgctgcagaagctgcagcagctgctgggcagaaacatcagcctggccgtggccaccagcagccccaccctggccagaaccagcaccgacctgcaggtgctggccgccagaggcgcccacgtgagacaggtgcccatgggcagactgaccagaggcgtgctgcacagcaagttctgggtggtggacggcagacacatctacatgggcagcgccaacatggactggagaagcctgacccaggtgaaggagctgggcgccgtgatctacaactgcagccacctggcccaggacctggagaagaccttccagacctactgggtgctgggcgtgcccaaggccgtgctgcccaagacctggccccagaacttcagcagccacttcaacagattccagcccttccacggcctgttcgacggcgtgcccaccaccgcctacttcagcgccagcccccccgccctgtgcccccagggcagaaccagagacctggaggccctgctggccgtgatgggcagcgcccaggagttcatctacgccagcgtgatggagtacttccccaccaccagattcagccacccccccagatactggcccgtgctggacaacgccctgagagccgccgccttcggcaagggcgtgagagtgagactgctggtgggctgcggcctgaacaccgaccccaccatgttcccctacctgagaagcctgcaggccctgagcaaccccgccgccaacgtgagcgtggacgtgaaggtgttcatcgtgcccgtgggcaaccacagcaacatccccttcagcagagtgaaccacagcaagttcatggtgaccgagaaggccgcctacatcggcaccagcaactggagcgaggactacttcagcagcaccgccggcgtgggcctggtggtgacccagagccccggcgcccagcccgccggcgccaccgtgcaggagcagctgagacagctgttcgagagagactggagcagcagatacgccgtgggcctggacggccaggcccccggccaggactgcgtgtggcagggctag

SEQ ID NO: 20888 - DNA, 1425 bp, Artificial Sequence
  Description of Artificial Sequence: Synthetic coding sequence
atgagccagcagaagtgcatcgtgatcttcgccctggtgtgctgcttcgccatcctggtggccctgatcttcagcgccgtggacatcatgggcgaggacgaggacggcctgagcgagaagaactgccagaacaagtgcagaatcgccctggtggagaacatccccgagggcctgaactacagcgagaacgcccccttccacctgagcctgttccagggctggatgaacctgctgaacatggccaagaagagcgtggacatcgtgagcagccactgggacctgaaccacacccaccccagcgcctgccagggccagagactgttcgagaagctgctgcagctgaccagccagaacatcgagatcaagctggtgagcgacgtgaccgccgacagcaaggtgctggaggccctgaagctgaagggcgccgaggtgacctacatgaacatgaccgcctacaacaagggcagactgcagagcagcttctggatcgtggacaagcagcacgtgtacatcggcagcgccggcctggactggcagagcctgggccagatgaaggagctgggcgtgatcttctacaactgcagctgcctggtgctggacctgcagagaatcttcgccctgtacagcagcctgaagttcaagagcagagtgccccagacctggagcaagagactgtacggcgtgtacgacaacgagaagaagctgcagctgcagctgaacgagaccaagagccaggccttcgtgagcaacagccccaagctgttctgccccaagaacagaagcttcgacatcgacgccatctacagcgtgatcgacgacgccaagcagtacgtgtacatcgccgtgatggactacctgcccatcagcagcaccagcaccaagagaacctactggcccgacctggacgccaagatcagagaggccctggtgctgagaagcgtgagagtgagactgctgctgagcttctggaaggagaccgaccccctgaccttcaacttcatcagcagcctgaaggccatctgcaccgagatcgccaactgcagcctgaaggtgaagttcttcgacctggagagagagaacgcctgcgccaccaaggagcagaagaaccacaccttccccagactgaacagaaacaagtacatggtgaccgacggcgccgcctacatcggcaacttcgactgggtgggcaacgacttcacccagaacgccggcaccggcctggtgatcaaccaggccgacgtgagaaacaacagaagcatcatcaagcagctgaaggacgtgttcgagagagactggtacagcccctacgccaagaccctgcagcccaccaagcagcccaactgcagcagcctgttcaagctgaagcccctgagcaacaagaccgccaccgacgacaccggcggcaaggaccccagaaacgtgtag

SEQ ID NO: 20889 - DNA, 1335 bp, Artificial Sequence
  Description of Artificial Sequence: Synthetic coding sequence
atgagaatggacagccagaagaagatcgccaagatcaacgtgggcaagagaatcgccctggtggagaacatccccgagggcctgaactacagcgagaacgcccccttccacctgagcctgttccagggctggatgaacctgctgaacatggccaagaagagcgtggacatcgtgagcagccactgggacctgaaccacacccaccccagcgcctgccagggccagagactgttcgagaagctgctgcagctgaccagccagaacatcgagatcaagctggtgagcgacgtgaccgccgacagcaaggtgctggaggccctgaagctgaagggcgccgaggtgacctacatgaacatgaccgcctacaacaagggcagactgcagagcagcttctggatcgtggacaagcagcacgtgtacatcggcagcgccggcctggactggcagagcctgggccagatgaaggagctgggcgtgatcttctacaactgcagctgcctggtgctggacctgcagagaatcttcgccctgtacagcagcctgaagttcaagagcagagtgccccagacctggagcaagagactgtacggcgtgtacgacaacgagaagaagctgcagctgcagctgaacgagaccaagagccaggccttcgtgagcaacagccccaagctgttctgccccaagaacagaagcttcgacatcgacgccatctacagcgtgatcgacgacgccaagcagtacgtgtacatcgccgtgatggactacctgcccatcagcagcaccagcaccaagagaacctactggcccgacctggacgccaagatcagagaggccctggtgctgagaagcgtgagagtgagactgctgctgagcttctggaaggagaccgaccccctgaccttcaacttcatcagcagcctgaaggccatctgcaccgagatcgccaactgcagcctgaaggtgaagttcttcgacctggagagagagaacgcctgcgccaccaaggagcagaagaaccacaccttccccagactgaacagaaacaagtacatggtgaccgacggcgccgcctacatcggcaacttcgactgggtgggcaacgacttcacccagaacgccggcaccggcctggtgatcaaccaggccgacgtgagaaacaacagaagcatcatcaagcagctgaaggacgtgttcgagagagactggtacagcccctacgccaagaccctgcagcccaccaagcagcccaactgcagcagcctgttcaagctgaagcccctgagcaacaagaccgccaccgacgacaccggcggcaaggaccccagaaacgtgtag

SEQ ID NO: 20890 - DNA, 1611 bp, Artificial Sequence
  Description of Artificial Sequence: Synthetic coding sequence
atggagatcagacagcacgagtggctgagcgccagcccccacgagggcttcgagcagatgagactgaagagcagacccaaggagcccagccccagcctgaccagagtgggcgccaacttctacagcagcgtgaagcagcaggactacagcgccagcgtgtggctgagaagaaaggacaagctggagcacagccagcagaagtgcatcgtgatcttcgccctggtgtgctgcttcgccatcctggtggccctgatcttcagcgccgtggacatcatgggcgaggacgaggacggcctgagcgagaagaactgccagaacaagtgcagaatcgccctggtggagaacatccccgagggcctgaactacagcgagaacgcccccttccacctgagcctgttccagggctggatgaacctgctgaacatggccaagaagagcgtggacatcgtgagcagccactgggacctgaaccacacccaccccagcgcctgccagggccagagactgttcgagaagctgctgcagctgaccagccagaacatcgagatcaagctggtgagcgacgtgaccgccgacagcaaggtgctggaggccctgaagctgaagggcgccgaggtgacctacatgaacatgaccgcctacaacaagggcagactgcagagcagcttctggatcgtggacaagcagcacgtgtacatcggcagcgccggcctggactggcagagcctgggccagatgaaggagctgggcgtgatcttctacaactgcagctgcctggtgctggacctgcagagaatcttcgccctgtacagcagcctgaagttcaagagcagagtgccccagacctggagcaagagactgtacggcgtgtacgacaacgagaagaagctgcagctgcagctgaacgagaccaagagccaggccttcgtgagcaacagccccaagctgttctgccccaagaacagaagcttcgacatcgacgccatctacagcgtgatcgacgacgccaagcagtacgtgtacatcgccgtgatggactacctgcccatcagcagcaccagcaccaagagaacctactggcccgacctggacgccaagatcagagaggccctggtgctgagaagcgtgagagtgagactgctgctgagcttctggaaggagaccgaccccctgaccttcaacttcatcagcagcctgaaggccatctgcaccgagatcgccaactgcagcctgaaggtgaagttcttcgacctggagagagagaacgcctgcgccaccaaggagcagaagaaccacaccttccccagactgaacagaaacaagtacatggtgaccgacggcgccgcctacatcggcaacttcgactgggtgggcaacgacttcacccagaacgccggcaccggcctggtgatcaaccaggccgacgtgagaaacaacagaagcatcatcaagcagctgaaggacgtgttcgagagagactggtacagcccctacgccaagaccctgcagcccaccaagcagcccaactgcagcagcctgttcaagctgaagcccctgagcaacaagaccgccaccgacgacaccggcggcaaggaccccagaaacgtgtag

SEQ ID NO: 20891 - DNA, 759 bp, Artificial Sequence
  Description of Artificial Sequence: Synthetic coding sequence
atgggcagactgagctggcaggtggccgccgccgccgccgtgggcctggccctgaccctggaggccctgccctgggtgctgagatggctgagaagcagaagaagaagacccagaagagaggccctgttcttccccagccaggtgacctgcaccgaggccctgctgagagcccccggcgccgagctggccgagctgcccgagggctgcccctgcggcctgccccacggcgagagcgccctgagcagactgctgagagccctgctggccgccagagccagcctggacctgtgcctgttcgccttcagcagcccccagctgggcagagccgtgcagctgctgcaccagagaggcgtgagagtgagagtggtgaccgactgcgactacatggccctgaacggcagccagatcggcctgctgagaaaggccggcatccaggtgagacacgaccaggaccccggctacatgcaccacaagttcgccatcgtggacaagagagtgctgatcaccggcagcctgaactggaccacccaggccatccagaacaacagagagaacgtgctgatcaccgaggacgacgagtacgtgagactgttcctggaggagttcgagagaatctgggagcagttcaaccccaccaagtacaccttcttcccccccaagaagagccacggcagctgcgccccccccgtgagcagagccggcggcagactgctgagctggcacagaacctgcggcaccagcagcgagagccagacctag

SEQ ID NO: 20892 - DNA, 528 bp, Artificial Sequence
  Description of Artificial Sequence: Synthetic coding sequence
atgggcagactgagctggcaggtggccgccgccgccagaggcgccgtgctgcccgtgagcggcgacctgtacagaggccccgccgccggcagcggcagaggcgccggcagagcccccagaggcctgcccgtgagacccgcccccagaagagagagagccaagccccccgccgcctgccccgccggcagacccagacagcccggcagcctgcccgtgagactgctgcagcccgccgccggccccagaagagccgtggccgcccccgcctggggcgccagcgccggcagacacagactgagactgcacggcccccagagactggccaacagaagcgccgcccagggcagagaccccggccccgccagaagcagacccagactgcacgccagccaggtgtgccacagaggccaggagggcgcccaccactggctggcccagctggaccacgccagccaccccgagcagcagggcgagtgcagccaccacggcggcagaagagtgagagccgccttcagcggcagaatctag

SEQ ID NO: 20893 - DNA, 678 bp, Artificial Sequence
  Description of Artificial Sequence: Synthetic coding sequence
atggtgagccacagcgagctgagaaagctgttctacagcgccgacgccgtgtgcttcgacgtggacagcaccgtgatcagagaggagggcatcgacgagctggccaagatctgcggcgtggaggacgccgtgagcgagatgaccagaagagccatgggcggcgccgtgcccttcaaggccgccctgaccgagagactggccctgatccagcccagcagagagcaggtgcagagactgatcgccgagcagcccccccacctgacccccggcatcagagagctggtgagcagactgcaggagagaaacgtgcaggtgttcctgatcagcggcggcttcagaagcatcgtggagcacgtggccagcaagctgaacatccccgccaccaacgtgttcgccaacagactgaagttctacttcaacggcgagtacgccggcttcgacgagacccagcccaccgccgagagcggcggcaagggcaaggtgatcaagctgctgaaggagaagttccacttcaagaagatcatcatgatcggcgacggcgccaccgacatggaggcctgcccccccgccgacgccttcatcggcttcggcggcaacgtgatcagacagcaggtgaaggacaacgccaagtggtacatcaccgacttcgtggagctgctgggcgagctggaggagtag

SEQ ID NO: 20894 - DNA, 678 bp, Artificial Sequence; identical to SEQ ID NO: 20893
  Description of Artificial Sequence: Synthetic coding sequence

SEQ ID NO: 20895 - DNA, 9 bp, Artificial Sequence
  Description of Artificial Sequence: Synthetic coding sequence
atggtgtag

SEQ ID NO: 20896 - DNA, 9 bp, Artificial Sequence
  Description of Artificial Sequence: Synthetic coding sequence
atggtgtag

SEQ ID NO: 20897 - DNA, 141 bp, Artificial Sequence
  Description of Artificial Sequence: Synthetic coding sequence
atggtgagccacagcgagctgagaaagctgttctacagcgccgacgccgtgtgcttcgacgtggacagcaccgtgatcagagaggagggcatcgacgagctggccaagatctgcggcgtggaggacgccgtgagcgagtag

SEQ ID NO: 20898 - DNA, 141 bp, Artificial Sequence; identical to SEQ ID NO: 20897
  Description of Artificial Sequence: Synthetic coding sequence

SEQ ID NO: 20899 - DNA, 564 bp, Artificial Sequence
  Description of Artificial Sequence: Synthetic coding sequence
atggtgagccacagcgagctgagaaagctgttctacagcgccgacgccgtgtgcttcgacgtggacagcaccgtgatcagagaggagggcatcgacgagctggccaagatctgcggcgtggaggacgccgtgagcgagatgaccagaagagccatgggcggcgccgtgcccttcaaggccgccctgaccgagagactggccctgatccagcccagcagagagcaggtgcagagactgatcgccgagcagcccccccacctgacccccggcatcagagagctggtgagcagactgcaggagagaaacgtgcaggtgttcctgatcagcggcggcttcagaagcatcgtggagcacgtggccagcaagctgaacatccccgccaccaacgtgttcgccaacagactgaagttctacttcaacggcgagtacgccggcttcgacgagacccagcccaccgccgagagcggcggcaagggcaaggtgatcaagctgctgaaggagaagttccacttcaagaagatcatcatgatcggcgacggcgccaccgacatggaggcctgctag

SEQ ID NO: 20900 - DNA, 33 bp, Artificial Sequence
  Description of Artificial Sequence: Synthetic coding sequence
atggtgagccacagcgagctgagaaagctgtag

SEQ ID NO: 20901 - DNA, 678 bp, Artificial Sequence; identical to SEQ ID NO: 20893
  Description of Artificial Sequence: Synthetic coding sequence

SEQ ID NO: 20902 - DNA, 1047 bp, Artificial Sequence
  Description of Artificial Sequence: Synthetic coding sequence
atgaagaccgccgagaacatcagaggcaccggcagcgacggccccagaaagagaggcctgtgcgtgctgtgcggcctgcccgccgccggcaagagcaccttcgccagagccctggcccacagactgcagcaggagcagggctgggccatcggcgtggtggcctacgacgacgtgatgcccgacgccttcctggccggcgccagagccagacccgcccccagccagtggaagctgctgagacaggagctgctgaagtacctggagtacttcctgatggccgtgatcaacggctgccagatgagcgtgccccccaacagaaccgaggccatgtgggaggacttcatcacctgcctgaaggaccaggacctgatcttcagcgccgccttcgaggcccagagctgctacctgctgaccaagaccgccgtgagcagacccctgttcctggtgctggacgacaacttctactaccagagcatgagatacgaggtgtaccagctggccagaaagtacagcctgggcttctgccagctgttcctggactgccccctggagacctgcctgcagagaaacggccagagaccccaggccctgccccccgagaccatccacctgatgggcagaaagctggagaagcccaaccccgagaagaacgcctgggagcacaacagcctgaccatccccagccccgcctgcgccagcgaggccagcctggaggtgaccgacctgctgctgaccgccctggagaaccccgtgaagtacgccgaggacaacatggagcagaaggacaccgacagaatcatctgcagcaccaacatcctgcacaagaccgaccagaccctgagaagaatcgtgagccagaccatgaaggaggccaagggcaaccaggaggccttcagcgagatgaccttcaagcagagatgggtgagagccaaccacgccgccatctggagaatcatcctgggcaacgagcacatcaagtgcagaagcgccaaggtgggctggctgcagtgctgcagaatcgagaagagacccctgagcaccggctag

SEQ ID NO: 20903 - DNA, 870 bp, Artificial Sequence
  Description of Artificial Sequence: Synthetic coding sequence
atgaagaccgccgagaacatcagaggcaccggcagcgacggccccagaaagagaggcctgtgcgtgctgtgcggcctgcccgccgccggcaagagcaccttcgccagagccctggcccacagactgcagcaggagcagggctgggccatcggcgtggtggcctacgacgacgtgatgcccgacgccttcctggccggcgccagagccagacccgcccccagccagtggaagctgctgagacaggagctgctgaagtacctggagtacttcctgatggccgtgatcaacggctgccagatgagcgtgccccccaacagaaccgaggccatgtgggaggacttcatcacctgcctgaaggaccaggacctgatcttcagcgccgccttcgaggcccagagctgctacctgctgaccaagaccgccgtgagcagacccctgttcctggtgctggacgacaacttctactaccagagcatgagatacgaggtgtaccagctggccagaaagtacagcctgggcttctgccagctgttcctggactgccccctggagacctgcctgcagagaaacggccagagaccccaggccctgccccccgagaccatccacctgatgggcagaaagctggagaagcccaaccccgagaagaacgcctgggagcacaacagcctgaccatccccagccccgcctgcgccagcgaggccagcctggaggtgaccgacctgctgctgaccgccctggagaaccccgtgaagtacgccgaggacaacatggagcagaaggtgaacttccagtgcaagttcaacgtgaacgagaaggagcagctgttcgtgggcagaagcttcgagcccaacatcaagtgcgagtag

SEQ ID NO: 20904 - DNA, 1080 bp, Artificial Sequence
  Description of Artificial Sequence: Synthetic coding sequence
tgaatgaagaccgccgagaacatcagaggcaccggcagcgacggccccagaaagagaggcctgtgcgtgctgtgcggcctgcccgccgccggcaagagcaccttcgccagagccctggcccacagactgcagcaggagcagggctgggccatcggcgtggtggcctacgacgacgtgatgcccgacgccttcctggccggcgccagagccagacccgcccccagccagtggaagctgctgagacaggagctgctgaagtacctggagtacttcctgatggccgtgatcaacggctgccagatgagcgtgccccccaacagaaccgaggccatgtgggaggacttcatcacctgcctgaaggaccaggacctgatcttcagcgccgccttcgaggcccagagctgctacctgctgaccaagaccgccgtgagcagacccctgttcctggtgctggacgacaacttctactaccagagcatgagatacgaggtgtaccagctggccagaaagtacagcctgggcttctgccagctgttcctggactgccccctggagacctgcctgcagagaaacggccagagaccccaggccctgccccccgagaccatccacctgatgggcagaaagctggagaagcccaaccccgagaagaacgcctgggagcacaacagcctgaccatccccagccccgcctgcgccagcgaggccagcctggaggtgaccgacctgctgctgaccgccctggagaaccccgtgaagtacgccgaggacaacatggagcagaaggacaccgacagaatcatctgcagcaccaacatcctgcacaagaccgaccagaccctgagaagaatcgtgagccagaccatgaaggaggccaaggacgagcaggtgctgccccacaacctgaagctgctggccgaggagctgaacaagctgaaggccgagttcctggaggacctgaagcagggcaacaagaagtacctgtgcttccagcagaccatcgacatccccgacgtgatcagcttcttccactacgagaaggacaacatcgtgcagaagtacttcagcaagcagcactag

SEQ ID NO: 20905 - DNA, 7566 bp, Artificial Sequence
  Description of Artificial Sequence: Synthetic coding sequence
atggagccccacgtgctgggcgccgtgctgtactggctgctgctgccctgcgccctgctggccgcctgcctgctgagattcagcggcctgagcctggtgtacctgctgttcctgctgctgctgccctggttccccggccccaccagatgcggcctgcagggccacaccggcagactgctgagagccctgctgggcctgagcctgctgttcctggtggcccacctggccctgcagatctgcctgcacatcgtgcccagactggaccagctgctgggccccagctgcagcagatgggagaccctgagcagacacatcggcgtgaccagactggacctgaaggacatccccaacgccatcagactggtggcccccgacctgggcatcctggtggtgagcagcgtgtgcctgggcatctgcggcagactggccagaaacaccagacagagcccccaccccagagagctggacgacgacgagagagacgtggacgccagccccaccgccggcctgcaggaggccgccaccctggcccccaccagaagaagcagactggccgccagattcagagtgaccgcccactggctgctggtggccgccggcagagtgctggccgtgaccctgctggccctggccggcatcgcccaccccagcgccctgagcagcgtgtacctgctgctgttcctggccctgtgcacctggtgggcctgccacttccccatcagcaccagaggcttcagcagactgtgcgtggccgtgggctgcttcggcgccggccacctgatctgcctgtactgctaccagatgcccctggcccaggccctgctgccccccgccggcatctgggccagagtgctgggcctgaaggacttcgtgggccccaccaactgcagcagcccccacgccctggtgctgaacaccggcctggactggcccgtgtacgccagccccggcgtgctgctgctgctgtgctacgccaccgccagcctgagaaagctgagagcctacagacccagcggccagagaaaggaggccgccaagggctacgaggccagagagctggagctggccgagctggaccagtggccccaggagagagagagcgaccagcacgtggtgcccaccgcccccgacaccgaggccgacaactgcatcgtgcacgagctgaccggccagagcagcgtgctgagaagacccgtgagacccaagagagccgagcccagagaggccagccccctgcacagcctgggccacctgatcatggaccagagctacgtgtgcgccctgatcgccatgatggtgtggagcatcacctaccacagctggctgaccttcgtgctgctgctgtgggcctgcctgatctggaccgtgagaagcagacaccagctggccatgctgtgcagcccctgcatcctgctgtacggcatgaccctgtgctgcctgagatacgtgtgggccatggacctgagacccgagctgcccaccaccctgggccccgtgagcctgagacagctgggcctggagcacaccagatacccctgcctggacctgggcgccatgctgctgtacaccctgaccttctggctgctgctgagacagttcgtgaaggagaagctgctgaagtgggccgagagccccgccgccctgaccgaggtgaccgtggccgacaccgagcccaccagaacccagaccctgctgcagagcctgggcgagctggtgaagggcgtgtacgccaagtactggatctacgtgtgcgccggcatgttcatcgtggtgagcttcgccggcagactggtggtgtacaagatcgtgtacatgttcctgttcctgctgtgcctgaccctgttccaggtgtactacagcctgtggagaaagctgctgaaggccttctggtggctggtggtggcctacaccatgctggtgctgatcgccgtgtacaccttccagttccaggacttccccgcctactggagaaacctgaccggcttcaccgacgagcagctgggcgacctgggcctggagcagttcagcgtgagcgagctgttcagcagcatcctggtgcccggcttcttcctgctggcctgcatcctgcagctgcactacttccacagacccttcatgcagctgaccgacatggagcacgtgagcctgcccggcaccagactgcccagatgggcccacagacaggacgccgtgagcggcacccccctgctgagagaggagcagcaggagcaccagcagcagcagcaggaggaggaggaggaggaggaggacagcagagacgagggcctgggcgtggccaccccccaccaggccacccaggtgcccgagggcgccgccaagtggggcctggtggccgagagactgctggagctggccgccggcttcagcgacgtgctgagcagagtgcaggtgttcctgagaagactgctggagctgcacgtgttcaagctggtggccctgtacaccgtgtgggtggccctgaaggaggtgagcgtgatgaacctgctgctggtggtgctgtgggccttcgccctgccctaccccagattcagacccatggccagctgcctgagcaccgtgtggacctgcgtgatcatcgtgtgcaagatgctgtaccagctgaaggtggtgaacccccaggagtacagcagcaactgcaccgagcccttccccaacagcaccaacctgctgcccaccgagatcagccagagcctgctgtacagaggccccgtggaccccgccaactggttcggcgtgagaaagggcttccccaacctgggctacatccagaaccacctgcaggtgctgctgctgctggtgttcgaggccatcgtgtacagaagacaggagcactacagaagacagcaccagctggcccccctgcccgcccaggccgtgttcgccagcggcaccagacagcagctggaccaggacctgctgggctgcctgaagtacttcatcaacttcttcttctacaagttcggcctggagatctgcttcctgatggccgtgaacgtgatcggccagagaatgaacttcctggtgaccctgcacggctgctggctggtggccatcctgaccagaagacacagacaggccatcgccagactgtggcccaactactgcctgttcctggccctgttcctgctgtaccagtacctgctgtgcctgggcatgccccccgccctgtgcatcgactacccctggagatggagcagagccgtgcccatgaacagcgccctgatcaagtggctgtacctgcccgacttcttcagagcccccaacagcaccaacctgatcagcgacttcctgctgctgctgtgcgccagccagcagtggcaggtgttcagcgccgagagaaccgaggagtggcagagaatggccggcgtgaacaccgacagactggagcccctgagaggcgagcccaaccccgtgcccaacttcatccactgcagaagctacctggacatgctgaaggtggccgtgttcagatacctgttctggctggtgctggtggtggtgttcgtgaccggcgccaccagaatcagcatcttcggcctgggctacctgctggcctgcttctacctgctgctgttcggcaccgccctgctgcagagagacaccagagccagactggtgctgtgggactgcctgatcctgtacaacgtgaccgtgatcatcagcaagaacatgctgagcctgctggcctgcgtgttcgtggagcagatgcagaccggcttctgctgggtgatccagctgttcagcctggtgtgcaccgtgaagggctactacgaccccaaggagatgatggacagagaccaggactgcctgctgcccgtggaggaggccggcatcatctgggacagcgtgtgcttcttcttcctgctgctgcagagaagagtgttcctgagccactactacctgcacgtgagagccgacctgcaggccaccgccctgctggccagcagaggcttcgccctgtacaacgccgccaacctgaagagcatcgacttccacagaagaatcgaggagaagagcctggcccagctgaagagacagatggagagaatcagagccaagcaggagaagcacagacagggcagagtggacagaagcagaccccaggacaccctgggccccaaggaccccggcctggagcccggccccgacagccccggcggcagcagcccccccagaagacagtggtggagaccctggctggaccacgccaccgtgatccacagcggcgactacttcctgttcgagagcgacagcgaggaggaggaggaggccgtgcccgaggaccccagacccagcgcccagagcgccttccagctggcctaccaggcctgggtgaccaacgcccaggccgtgctgagaagaagacagcaggagcaggagcaggccagacaggagcaggccggccagctgcccaccggcggcggccccagccaggaggtggagcccgccgagggccccgaggaggccgccgccggcagaagccacgtggtgcagagagtgctgagcaccgcccagttcctgtggatgctgggccaggccctggtggacgagctgaccagatggctgcaggagttcaccagacaccacggcaccatgagcgacgtgctgagagccgagagatacctgctgacccaggagctgctgcagggcggcgaggtgcacagaggcgtgctggaccagctgtacaccagccaggccgaggccaccctgcccggccccaccgaggcccccaacgcccccagcaccgtgagcagcggcctgggcgccgaggagcccctgagcagcatgaccgacgacatgggcagccccctgagcaccggctaccacaccagaagcggcagcgaggaggccgtgaccgaccccggcgagagagaggccggcgccagcctgtaccagggcctgatgagaaccgccagcgagctgctgctggacagaagactgagaatccccgagctggaggaggccgagctgttcgccgagggccagggcagagccctgagactgctgagagccgtgtaccagtgcgtggccgcccacagcgagctgctgtgctacttcatcatcatcctgaaccacatggtgaccgccagcgccggcagcctggtgctgcccgtgctggtgttcctgtgggccatgctgagcatccccagacccagcaagagattctggatgaccgccatcgtgttcaccgagatcgccgtggtggtgaagtacctgttccagttcggcttcttcccctggaacagccacgtggtgctgagaagatacgagaacaagccctacttcccccccagaatcctgggcctggagaagaccgacggctacatcaagtacgacctggtgcagctgatggccctgttcttccacagaagccagctgctgtgctacggcctgtgggaccacgaggaggacagccccagcaaggagcacgacaagagcggcgaggaggagcagggcgccgaggagggccccggcgtgcccgccgccaccaccgaggaccacatccaggtggaggccagagtgggccccaccgacggcacccccgagccccaggtggagctgagacccagagacaccagaagaatcagcctgagattcagaagaagaaagaaggagggccccgccagaaagggcgccgccgccatcgaggccgaggacagagaggaggaggagggcgaggaggagaaggaggcccccaccggcagagagaagagacccagcagaagcggcggcagagtgagagccgccggcagaagactgcagggcttctgcctgagcctggcccagggcacctacagacccctgagaagattcttccacgacatcctgcacaccaagtacagagccgccaccgacgtgtacgccctgatgttcctggccgacgtggtggacttcatcatcatcatcttcggcttctgggccttcggcaagcacagcgccgccaccgacatcaccagcagcctgagcgacgaccaggtgcccgaggccttcctggtgatgctgctgatccagttcagcaccatggtggtggacagagccctgtacctgagaaagaccgtgctgggcaagctggccttccaggtggccctggtgctggccatccacctgtggatgttcttcatcctgcccgccgtgaccgagagaatgttcaaccagaacgtggtggcccagctgtggtacttcgtgaagtgcatctacttcgccctgagcgcctaccagatcagatgcggctaccccaccagaatcctgggcaacttcctgaccaagaagtacaaccacctgaacctgttcctgttccagggcttcagactggtgcccttcctggtggagctgagagccgtgatggactgggtgtggaccgacaccaccctgagcctgagcagctggatgtgcgtggaggacatctacgccaacatcttcatcatcaagtgcagcagagagaccgagaagaagtacccccagcccaagggccagaagaagaagaagatcgtgaagtacggcatgggcggcctgatcatcctgttcctgatcgccatcatctggttccccctgctgttcatgagcctggtgagaagcgtggtgggcgtggtgaaccagcccatcgacgtgaccgtgaccctgaagctgggcggctacgagcccctgttcaccatgagcgcccagcagcccagcatcatccccttcaccgcccaggcctacgaggagctgagcagacagttcgacccccagcccctggccatgcagttcatcagccagtacagccccgaggacatcgtgaccgcccagatcgagggcagcagcggcgccctgtggagaatcagcccccccagcagagcccagatgaagagagagctgtacaacggcaccgccgacatcaccctgagattcacctggaacttccagagagacctggccaagggcggcaccgtggagtacgccaacgagaagcacatgctggccctggcccccaacagcaccgccagaagacagctggccagcctgctggagggcaccagcgaccagagcgtggtgatccccaacctgttccccaagtacatcagagcccccaacggccccgaggccaaccccgtgaagcagctgcagcccaacgaggaggccgactacctgggcgtgagaatccagctgagaagagagcagggcgccggcgccaccggcttcctggagtggtgggtgatcgagctgcaggagtgcagaaccgactgcaacctgctgcccatggtgatcttcagcgacaaggtgagcccccccagcctgggcttcctggccggctacggcatcatgggcctgtacgtgagcatcgtgctggtgatcggcaagttcgtgagaggcttcttcagcgagatcagccacagcatcatgttcgaggagctgccctgcgtggacagaatcctgaagctgtgccaggacatcttcctggtgagagagaccagagagctggagctggaggaggagctgtacgccaagctgatcttcctgtacagaagccccgagaccatgatcaagtggaccagagagaaggagtag

SEQ ID NO: 20906 - DNA, 1122 bp, Artificial Sequence
  Description of Artificial Sequence: Synthetic coding sequence
atgaagatctgccccttcagcagcaagagcagcatcgtgctggccctgaagttcagaagcctgatccacttcgagaagtacccccagcccaagggccagaagaagaagaagatcgtgaagtacggcatgggcggcctgatcatcctgttcctgatcgccatcatctggttccccctgctgttcatgagcctggtgagaagcgtggtgggcgtggtgaaccagcccatcgacgtgaccgtgaccctgaagctgggcggctacgagcccctgttcaccatgagcgcccagcagcccagcatcatccccttcaccgcccaggcctacgaggagctgagcagacagttcgacccccagcccctggccatgcagttcatcagccagtacagccccgaggacatcgtgaccgcccagatcgagggcagcagcggcgccctgtggagaatcagcccccccagcagagcccagatgaagagagagctgtacaacggcaccgccgacatcaccctgagattcacctggaacttccagagagacctggccaagggcggcaccgtggagtacgccaacgagaagcacatgctggccctggcccccaacagcaccgccagaagacagctggccagcctgctggagggcaccagcgaccagagcgtggtgatccccaacctgttccccaagtacatcagagcccccaacggccccgaggccaaccccgtgaagcagctgcagcccaacgaggaggccgactacctgggcgtgagaatccagctgagaagagagcagggcgccggcgccaccggcttcctggagtggtgggtgatcgagctgcaggagtgcagaaccgactgcaacctgctgcccatggtgatcttcagcgacaagcaccacggcgccgtgagagtgcacagagccggccacagacaggtgagagccagaatcctgcagagagacctggccctgcactacgtgagaggcgccgccgtgagaggcccccacccccaggccctgcccggccacctgcccggcgccggcgacagcggcgccggcgccggcggcggcgtggtgagacaggcccacctgcccctgcccctgaccggcgaccacgaccaggtggacagctag

SEQ ID NO: 20907 - DNA, 7404 bp, Artificial Sequence
  Description of Artificial Sequence: Synthetic coding sequence
tgaaccggcagactgctgagagccctgctgggcctgagcctgctgttcctggtggcccacctggccctgcagatctgcctgcacatcgtgcccagactggaccagctgctgggccccagctgcagcagatgggagaccctgagcagacacatcggcgtgaccagactggacctgaaggacatccccaacgccatcagactggtggcccccgacctgggcatcctggtggtgagcagcgtgtgcctgggcatctgcggcagactggccagaaacaccagacagagcccccaccccagagagctggacgacgacgagagagacgtggacgccagccccaccgccggcctgcaggaggccgccaccctggcccccaccagaagaagcagactggccgccagattcagagtgaccgcccactggctgctggtggccgccggcagagtgctggccgtgaccctgctggccctggccggcatcgcccaccccagcgccctgagcagcgtgtacctgctgctgttcctggccctgtgcacctggtgggcctgccacttccccatcagcaccagaggcttcagcagactgtgcgtggccgtgggctgcttcggcgccggccacctgatctgcctgtactgctaccagatgcccctggcccaggccctgctgccccccgccggcatctgggccagagtgctgggcctgaaggacttcgtgggccccaccaactgcagcagcccccacgccctggtgctgaacaccggcctggactggcccgtgtacgccagccccggcgtgctgctgctgctgtgctacgccaccgccagcctgagaaagctgagagcctacagacccagcggccagagaaaggaggccgccaagggctacgaggccagagagctggagctggccgagctggaccagtggccccaggagagagagagcgaccagcacgtggtgcccaccgcccccgacaccgaggccgacaactgcatcgtgcacgagctgaccggccagagcagcgtgctgagaagacccgtgagacccaagagagccgagcccagagaggccagccccctgcacagcctgggccacctgatcatggaccagagctacgtgtgcgccctgatcgccatgatggtgtggagcatcacctaccacagctggctgaccttcgtgctgctgctgtgggcctgcctgatctggaccgtgagaagcagacaccagctggccatgctgtgcagcccctgcatcctgctgtacggcatgaccctgtgctgcctgagatacgtgtgggccatggacctgagacccgagctgcccaccaccctgggccccgtgagcctgagacagctgggcctggagcacaccagatacccctgcctggacctgggcgccatgctgctgtacaccctgaccttctggctgctgctgagacagttcgtgaaggagaagctgctgaagtgggccgagagccccgccgccctgaccgaggtgaccgtggccgacaccgagcccaccagaacccagaccctgctgcagagcctgggcgagctggtgaagggcgtgtacgccaagtactggatctacgtgtgcgccggcatgttcatcgtggtgagcttcgccggcagactggtggtgtacaagatcgtgtacatgttcctgttcctgctgtgcctgaccctgttccaggtgtactacagcctgtggagaaagctgctgaaggccttctggtggctggtggtggcctacaccatgctggtgctgatcgccgtgtacaccttccagttccaggacttccccgcctactggagaaacctgaccggcttcaccgacgagcagctgggcgacctgggcctggagcagttcagcgtgagcgagctgttcagcagcatcctggtgcccggcttcttcctgctggcctgcatcctgcagctgcactacttccacagacccttcatgcagctgaccgacatggagcacgtgagcctgcccggcaccagactgcccagatgggcccacagacaggacgccgtgagcggcacccccctgctgagagaggagcagcaggagcaccagcagcagcagcaggaggaggaggaggaggaggaggacagcagagacgagggcctgggcgtggccaccccccaccaggccacccaggtgcccgagggcgccgccaagtggggcctggtggccgagagactgctggagctggccgccggcttcagcgacgtgctgagcagagtgcaggtgttcctgagaagactgctggagctgcacgtgttcaagctggtggccctgtacaccgtgtgggtggccctgaaggaggtgagcgtgatgaacctgctgctggtggtgctgtgggccttcgccctgccctaccccagattcagacccatggccagctgcctgagcaccgtgtggacctgcgtgatcatcgtgtgcaagatgctgtaccagctgaaggtggtgaacccccaggagtacagcagcaactgcaccgagcccttccccaacagcaccaacctgctgcccaccgagatcagccagagcctgctgtacagaggccccgtggaccccgccaactggttcggcgtgagaaagggcttccccaacctgggctacatccagaaccacctgcaggtgctgctgctgctggtgttcgaggccatcgtgtacagaagacaggagcactacagaagacagcaccagctggcccccctgcccgcccaggccgtgttcgccagcggcaccagacagcagctggaccaggacctgctgggctgcctgaagtacttcatcaacttcttcttctacaagttcggcctggagatctgcttcctgatggccgtgaacgtgatcggccagagaatgaacttcctggtgaccctgcacggctgctggctggtggccatcctgaccagaagacacagacaggccatcgccagactgtggcccaactactgcctgttcctggccctgttcctgctgtaccagtacctgctgtgcctgggcatgccccccgccctgtgcatcgactacccctggagatggagcagagccgtgcccatgaacagcgccctgatcaagtggctgtacctgcccgacttcttcagagcccccaacagcaccaacctgatcagcgacttcctgctgctgctgtgcgccagccagcagtggcaggtgttcagcgccgagagaaccgaggagtggcagagaatggccggcgtgaacaccgacagactggagcccctgagaggcgagcccaaccccgtgcccaacttcatccactgcagaagctacctggacatgctgaaggtggccgtgttcagatacctgttctggctggtgctggtggtggtgttcgtgaccggcgccaccagaatcagcatcttcggcctgggctacctgctggcctgcttctacctgctgctgttcggcaccgccctgctgcagagagacaccagagccagactggtgctgtgggactgcctgatcctgtacaacgtgaccgtgatcatcagcaagaacatgctgagcctgctggcctgcgtgttcgtggagcagatgcagaccggcttctgctgggtgatccagctgttcagcctggtgtgcaccgtgaagggctactacgaccccaaggagatgatggacagagaccaggactgcctgctgcccgtggaggaggccggcatcatctgggacagcgtgtgcttcttcttcctgctgctgcagagaagagtgttcctgagccactactacctgcacgtgagagccgacctgcaggccaccgccctgctggccagcagaggcttcgccctgtacaacgccgccaacctgaagagcatcgacttccacagaagaatcgaggagaagagcctggcccagctgaagagacagatggagagaatcagagccaagcaggagaagcacagacagggcagagtggacagaagcagaccccaggacaccctgggccccaaggaccccggcctggagcccggccccgacagccccggcggcagcagcccccccagaagacagtggtggagaccctggctggaccacgccaccgtgatccacagcggcgactacttcctgttcgagagcgacagcgaggaggaggaggaggccgtgcccgaggaccccagacccagcgcccagagcgccttccagctggcctaccaggcctgggtgaccaacgcccaggccgtgctgagaagaagacagcaggagcaggagcaggccagacaggagcaggccggccagctgcccaccggcggcggccccagccaggaggtggagcccgccgagggccccgaggaggccgccgccggcagaagccacgtggtgcagagagtgctgagcaccgcccagttcctgtggatgctgggccaggccctggtggacgagctgaccagatggctgcaggagttcaccagacaccacggcaccatgagcgacgtgctgagagccgagagatacctgctgacccaggagctgctgcagggcggcgaggtgcacagaggcgtgctggaccagctgtacaccagccaggccgaggccaccctgcccggccccaccgaggcccccaacgcccccagcaccgtgagcagcggcctgggcgccgaggagcccctgagcagcatgaccgacgacatgggcagccccctgagcaccggctaccacaccagaagcggcagcgaggaggccgtgaccgaccccggcgagagagaggccggcgccagcctgtaccagggcctgatgagaaccgccagcgagctgctgctggacagaagactgagaatccccgagctggaggaggccgagctgttcgccgagggccagggcagagccctgagactgctgagagccgtgtaccagtgcgtggccgcccacagcgagctgctgtgctacttcatcatcatcctgaaccacatggtgaccgccagcgccggcagcctggtgctgcccgtgctggtgttcctgtgggccatgctgagcatccccagacccagcaagagattctggatgaccgccatcgtgttcaccgagatcgccgtggtggtgaagtacctgttccagttcggcttcttcccctggaacagccacgtggtgctgagaagatacgagaacaagccctacttcccccccagaatcctgggcctggagaagaccgacggctacatcaagtacgacctggtgcagctgatggccctgttcttccacagaagccagctgctgtgctacggcctgtgggaccacgaggaggacagccccagcaaggagcacgacaagagcggcgaggaggagcagggcgccgaggagggccccggcgtgcccgccgccaccaccgaggaccacatccaggtggaggccagagtgggccccaccgacggcacccccgagccccaggtggagctgagacccagagacaccagaagaatcagcctgagattcagaagaagaaagaaggagggccccgccagaaagggcgccgccgccatcgaggccgaggacagagaggaggaggagggcgaggaggagaaggaggcccccaccggcagagagaagagacccagcagaagcggcggcagagtgagagccgccggcagaagactgcagggcttctgcctgagcctggcccagggcacctacagacccctgagaagattcttccacgacatcctgcacaccaagtacagagccgccaccgacgtgtacgccctgatgttcctggccgacgtggtggacttcatcatcatcatcttcggcttctgggccttcggcaagcacagcgccgccaccgacatcaccagcagcctgagcgacgaccaggtgcccgaggccttcctggtgatgctgctgatccagttcagcaccatggtggtggacagagccctgtacctgagaaagaccgtgctgggcaagctggccttccaggtggccctggtgctggccatccacctgtggatgttcttcatcctgcccgccgtgaccgagagaatgttcaaccagaacgtggtggcccagctgtggtacttcgtgaagtgcatctacttcgccctgagcgcctaccagatcagatgcggctaccccaccagaatcctgggcaacttcctgaccaagaagtacaaccacctgaacctgttcctgttccagggcttcagactggtgcccttcctggtggagctgagagccgtgatggactgggtgtggaccgacaccaccctgagcctgagcagctggatgtgcgtggaggacatctacgccaacatcttcatcatcaagtgcagcagagagaccgagaagaagtacccccagcccaagggccagaagaagaagaagatcgtgaagtacggcatgggcggcctgatcatcctgttcctgatcgccatcatctggttccccctgctgttcatgagcctggtgagaagcgtggtgggcgtggtgaaccagcccatcgacgtgaccgtgaccctgaagctgggcggctacgagcccctgttcaccatgagcgcccagcagcccagcatcatccccttcaccgcccaggcctacgaggagctgagcagacagttcgacccccagcccctggccatgcagttcatcagccagtacagccccgaggacatcgtgaccgcccagatcgagggcagcagcggcgccctgtggagaatcagcccccccagcagagcccagatgaagagagagctgtacaacggcaccgccgacatcaccctgagattcacctggaacttccagagagacctggccaagggcggcaccgtggagtacgccaacgagaagcacatgctggccctggcccccaacagcaccgccagaagacagctggccagcctgctggagggcaccagcgaccagagcgtggtgatccccaacctgttccccaagtacatcagagcccccaacggccccgaggccaaccccgtgaagcagctgcagcccaacgaggaggccgactacctgggcgtgagaatccagctgagaagagagcagggcgccggcgccaccggcttcctggagtggtgggtgatcgagctgcaggagtgcagaaccgactgcaacctgctgcccatggtgatcttcagcgacaaggtgagcccccccagcctgggcttcctggccggctacggcatcatgggcctgtacgtgagcatcgtgctggtgatcggcaagttcgtgagaggcttcttcagcgagatcagccacagcatcatgttcgaggagctgccctgcgtggacagaatcctgaagctgtgccaggacatcttcctggtgagagagaccagagagctggagctggaggaggagctgtacgccaagctgatcttcctgtacagaagccccgagaccatgatcaagtggaccagagagaaggagtag

SEQ ID NO: 20908 - DNA, 1665 bp, Artificial Sequence
  Description of Artificial Sequence: Synthetic coding sequence
atgcccgactacagaaccagagccctgttcgtgcagagcaccctgggcgacagcgccggccccgagctgcagctgctgagcatcgtgcccggcagagacctgcagcccagcgacagcttcaccgccagcagcagccccccccccagcgtgtggagcgagctggagcacatcagaggcaagagcgaggccaccaccgagctgaagagacccagcctgcccggcagcatccacagctgcctgtgcggcgtgtggtgcggcgtgggcaagagaacccccagcagcctggtgagcagcctgcaggacctggagctgctgggccagagacagagacagctgtggatggagagcacccccagacccccctacaaccccttcctggtgccctgcacccccgtgggcaagctgagcgccgagcacggcggccccaccagaaagatgccccccagcgccagcgccgtggacttcttccagctgttcgtgcccgacaacgtgctgaagaacatggtggtgcagaccaacatgtacgccaagaagttccaggagagattcggcagcgacggcgcctgggtggaggtgaccctgaccgagatgaaggccttcctgggctacatgatcagcaccagcatcagccactgcgagagcgtgctgagcatctggagcggcggcttctacagcaacagaagcctggccctggtgatgagccaggccagattcgagaagatcctgaagtacttccacgtggtggccttcagaagcagccagaccacccacggcctgtacaaggtgcagcccttcctggacagcctgcagaacagcttcgacagcgccttcagacccagccagacccaggtgctgcacgagcccctgatcgacgaggaccccgtgttcatcgccacctgcaccgagagagagctgagaaagagaaagaagagaaagttcagcctgtgggtgagacagtgcagcagcaccggcttcatcatccagatctacgtgcacctgaaggagggcggcggccccgacggcctggacgccctgaagaacaagccccagctgcacagcatggtggccagaagcctgtgcagaaacgccgccggcaagaactacatcatcttcaccggccccagcatcaccagcctgaccctgttcgaggagttcgagaagcagggcatctactgctgcggcctgctgagagccagaaagagcgactgcaccggcctgcccctgagcatgctgaccaaccccgccaccccccccgccagaggccagtaccagatcaagatgaagggcaacatgagcctgatctgctggtacaacaagggccacttcagattcctgaccaacgcctacagccccgtgcagcagggcgtgatcatcaagagaaagagcggcgagatcccctgccccctggccgtggaggccttcgccgcccacctgagctacatctgcagatacgacgacaagtacagcaagtacttcatcagccacaagcccaacaagacctggcagcaggtgttctggttcgccatcagcatcgccatcaacaacgcctacatcctgtacaagatgagcgacgcctaccacgtgaagagatacagcagagcccagttcggcgagagactggtgagagagctgctgggcctggaggacgccagccccacccactag

SEQ ID NO: 20909 - DNA, 1368 bp, Artificial Sequence
  Description of Artificial Sequence: Synthetic coding sequence
atgcccgactacagaaccagagccctgttcgtgcagagcaccctgggcgacagcgccggccccgagctgcagctgctgagcatcgtgcccggcagagacctgcagcccagcgacagcttcaccggccccaccagaaagatgccccccagcgccagcgccgtggacttcttccagctgttcgtgcccgacaacgtgctgaagaacatggtggtgcagaccaacatgtacgccaagaagttccaggagagattcggcagcgacggcgcctgggtggaggtgaccctgaccgagatgaaggccttcctgggctacatgatcagcaccagcatcagccactgcgagagcgtgctgagcatctggagcggcggcttctacagcaacagaagcctggccctggtgatgagccaggccagattcgagaagatcctgaagtacttccacgtggtggccttcagaagcagccagaccacccacggcctgtacaaggtgcagcccttcctggacagcctgcagaacagcttcgacagcgccttcagacccagccagacccaggtgctgcacgagcccctgatcgacgaggaccccgtgttcatcgccacctgcaccgagagagagctgagaaagagaaagaagagaaagttcagcctgtgggtgagacagtgcagcagcaccggcttcatcatccagatctacgtgcacctgaaggagggcggcggccccgacggcctggacgccctgaagaacaagccccagctgcacagcatggtggccagaagcctgtgcagaaacgccgccggcaagaactacatcatcttcaccggccccagcatcaccagcctgaccctgttcgaggagttcgagaagcagggcatctactgctgcggcctgctgagagccagaaagagcgactgcaccggcctgcccctgagcatgctgaccaaccccgccaccccccccgccagaggccagtaccagatcaagatgaagggcaacatgagcctgatctgctggtacaacaagggccacttcagattcctgaccaacgcctacagccccgtgcagcagggcgtgatcatcaagagaaagagcggcgagatcccctgccccctggccgtggaggccttcgccgcccacctgagctacatctgcagatacgacgacaagtacagcaagtacttcatcagccacaagcccaacaagacctggcagcaggtgttctggttcgccatcagcatcgccatcaacaacgcctacatcctgtacaagatgagcgacgcctaccacgtgaagagatacagcagagcccagttcggcgagagactggtgagagagctgctgggcctggaggacgccagccccacccactag

SEQ ID NO: 20910 - DNA, 3114 bp, Artificial Sequence
  Description of Artificial Sequence: Synthetic coding sequence
atgagcccccccctgtgccccctgctgctgctggccgtgggcctgagactggccggcaccctgaaccccagcgaccccaacacctgcagcttctgggagagcttcaccaccaccaccaaggagagccacagcagacccttcagcctgctgcccagcgagccctgcgagagaccctgggagggcccccacacctgcccccagcccaccgtggtgtacagaaccgtgtacagacaggtggtgaagaccgaccacagacagagactgcagtgctgccacggcttctacgagagcagaggcttctgcgtgcccctgtgcgcccaggagtgcgtgcacggcagatgcgtggcccccaaccagtgccagtgcgtgcccggctggagaggcgacgactgcagcagcgagtgcgcccccggcatgtggggcccccagtgcgacaagccctgcagctgcggcaacaacagcagctgcgaccccaagagcggcgtgtgcagctgccccagcggcctgcagccccccaactgcctgcagccctgcacccccggctactacggccccgcctgccagttcagatgccagtgccacggcgccccctgcgacccccagaccggcgcctgcttctgccccgccgagagaaccggccccagctgcgacgtgagctgcagccagggcaccagcggcttcttctgccccagcacccacagctgccagaacggcggcgtgttccagaccccccagggcagctgcagctgcccccccggctggatgggcaccatctgcagcctgccctgccccgagggcttccacggccccaactgcagccaggagtgcagatgccacaacggcggcctgtgcgacagattcaccggccagtgcagatgcgcccccggctacaccggcgacagatgcagagaggagtgccccgtgggcagattcggccaggactgcgccgagacctgcgactgcgcccccgacgccagatgcttccccgccaacggcgcctgcctgtgcgagcacggcttcaccggcgacagatgcaccgacagactgtgccccgacggcttctacggcctgagctgccaggccccctgcacctgcgacagagagcacagcctgagctgccaccccatgaacggcgagtgcagctgcctgcccggctgggccggcctgcactgcaacgagagctgcccccaggacacccacggccccggctgccaggagcactgcctgtgcctgcacggcggcgtgtgccaggccaccagcggcctgtgccagtgcgcccccggctacaccggcccccactgcgccagcctgtgcccccccgacacctacggcgtgaactgcagcgccagatgcagctgcgagaacgccatcgcctgcagccccatcgacggcgagtgcgtgtgcaaggagggctggcagagaggcaactgcagcgtgccctgcccccccggcacctggggcttcagctgcaacgccagctgccagtgcgcccacgaggccgtgtgcagcccccagaccggcgcctgcacctgcacccccggctggcacggcgcccactgccagctgccctgccccaagggccagttcggcgagggctgcgccagcagatgcgactgcgaccacagcgacggctgcgaccccgtgcacggcagatgccagtgccaggccggctggatgggcgccagatgccacctgagctgccccgagggcctgtggggcgtgaactgcagcaacacctgcacctgcaagaacggcggcacctgcctgcccgagaacggcaactgcgtgtgcgcccccggcttcagaggccccagctgccagagaagctgccagcccggcagatacggcaagagatgcgtgccctgcaagtgcgccaaccacagcttctgccaccccagcaacggcacctgctactgcctggccggctggaccggccccgactgcagccagccctgcccccccggccactggggcgagaactgcgcccagacctgccagtgccaccacggcggcacctgccacccccaggacggcagctgcatctgccccctgggctggaccggccaccactgcctggagggctgccccctgggcaccttcggcgccaactgcagccagccctgccagtgcggccccggcgagaagtgccaccccgagaccggcgcctgcgtgtgcccccccggccacagcggcgccccctgcagaatcggcatccaggagcccttcaccgtgatgcccaccacccccgtggcctacaacagcctgggcgccgtgatcggcatcgccgtgctgggcagcctggtggtggccctggtggccctgttcatcggctacagacactggcagaagggcaaggagcaccaccacctggccgtggcctacagcagcggcagactggacggcagcgagtacgtgatgcccgacgtgccccccagctacagccactactacagcaaccccagctaccacaccctgagccagtgcagccccaacccccccccccccaacaaggtgcccggccccctgttcgccagcctgcagaaccccgagagacccggcggcgcccagggccacgacaaccacaccaccctgcccgccgactggaagcacagaagagagcccccccccggccccctggacagaggcagcagcagactggacagaagctacagctacagctacagcaacggccccggccccttctacaacaagggcctgatcagcgaggaggagctgggcgccagcgtggccagcctgagcagcgagaacccctacgccaccatcagagacctgcccagcctgcccggcggccccagagagagcagctacatggagatgaagggcccccccagcggcagcccccccagacagcccccccagttctgggacagccagagaagaagacagccccagccccagagagacagcggcacctacgagcagcccagccccctgatccacgacagagacagcgtgggcagccagccccccctgccccccggcctgccccccggccactacgacagccccaagaacagccacatccccggccactacgacctgccccccgtgagacacccccccagcccccccctgagaagacaggacagatag

SEQ ID NO: 20911 - DNA, 3114 bp, Artificial Sequence; identical to SEQ ID NO: 20910
  Description of Artificial Sequence: Synthetic coding sequence

SEQ ID NO: 20912 - DNA, 522 bp, Artificial Sequence
  Description of Artificial Sequence: Synthetic coding sequence
atgagcccccccctgtgccccctgctgctgctggccgtgggcctgagactggccggcaccctgaaccccagcgaccccaacacctgcagcttctgggagagcttcaccaccaccaccaaggagagccacagcagacccttcagcctgctgcccagcgagccctgcgagagaccctgggagggcccccacacctgcccccagcccaccgtggtgtacagaaccgtgtacagacaggtggtgaagaccgaccacagacagagactgcagtgctgccacggcttctacgagagcagaggcttctgcgtgcccctgtgcgcccaggagtgcgtgcacggcagatgcgtggcccccaaccagtgccagtgcgtgcccggctggagaggcgacgactgcagcagcgagtgcgcccccggcatgtggggcccccagtgcgacaagccctgcagctgcggcaacaacagcagctgcgaccccaagagcggcgtgtgcagctgccccagcggcctgcagccccccaactag

SEQ ID NO: 20913 - DNA, 2316 bp, Artificial Sequence
  Description of Artificial Sequence: Synthetic coding sequence
atggaggaggacaagctgctgagcgccgtgcccgaggagggcgacgccaccagagaccccggccccgagcccgaggaggagcccggcgtgagaaacggcatggccagcgagggcctgaacagcagcctgtgcagccccggccacgagagaagaggcacccccgccgacaccgaggagcccaccaaggaccccgacgtggccttccacggcctgagcctgggcctgagcctgaccaacggcctggccctgggccccgacctgaacatcctggaggacagcgccgagagcagaccctggagagccggcgtgctggccgagggcgacaacgccagcagaagcctgtaccccgacgccgaggacccccagctgggcctggacggccccggcgagcccgacgtgagagacggcttcagcgccaccttcgagaagatcctggagagcgagctgctgagaggcacccagtacagcagcctggacagcctggacggcctgagcctgaccgacgagagcgacagctgcgtgagcttcgaggcccccctgacccccctgatccagcagagagccagagacagccccgagcccggcgccggcctgggcatcggcgacatggccttcgagggcgacatgggcgccgccggcggcgacggcgagctgggcagccccctgagaagaagcatcagcagcagcagaagcgagaacgtgctgagcagactgagcctgatggccatgcccaacggcttccacgaggacggcccccagggccccggcggcgacgaggacgacgacgaggaggacaccgacaagctgctgaacagcgccagcgaccccagcctgaaggacggcctgagcgacagcgacagcgagctgagcagcagcgagggcctggagcccggcagcgccgaccccctggccaacggctgccagggcgtgagcgaggccgcccacagactggccagaagactgtaccacctggagggcttccagagatgcgacgtggccagacagctgggcaagaacaacgagttcagcagactggtggccggcgagtacctgagcttcttcgacttcagcggcctgaccctggacggcgccctgagaaccttcctgaaggccttccccctgatgggcgagacccaggagagagagagagtgctgacccacttcagcagaagatactgccagtgcaaccccgacgacagcaccagcgaggacggcatccacaccctgacctgcgccctgatgctgctgaacaccgacctgcacggccacaacatcggcaagaagatgagctgccagcagttcatcgccaacctggaccagctgaacgacggccaggacttcgccaaggacctgctgaagaccctgtacaacagcatcaagaacgagaagctggagtgggccatcgacgaggacgagctgagaaagagcctgagcgagctggtggacgacaagttcggcaccggcaccaagaaggtgaccagaatcctggacggcggcaaccccttcctggacgtgccccaggccctgagcgccaccacctacaagcacggcgtgctgaccagaaagacccacgccgacatggacggcaagagaacccccagaggcagaagaggctggaagaagttctacgccgtgctgaagggcaccatcctgtacctgcagaaggacgagtacagacccgacaaggccctgagcgagggcgacctgaagaacgccatcagagtgcaccacgccctggccaccagagccagcgactacagcaagaagagcaacgtgctgaagctgaagaccgccgactggagagtgttcctgttccaggcccccagcaaggaggagatgctgagctggatcctgagaatcaacctggtggccgccatcttcagcgcccccgccttccccgccgccgtgagcagcatgaagaagttctgcagacccctgctgcccagctgcaccaccagactgtgccaggaggagcagctgagaagccacgagaacaagctgagacagctgaccgccgagctggccgagcacagatgccaccccgtggagagaggcatcaagagcaaggaggccgaggagtacagactgaaggagcactacctgaccttcgagaagagcagatacgagacctacatccacctgctggccatgaagatcaaggtgggcagcgacgacctggagagaatcgaggccagactggccaccctggagggcgacgaccccagcctgagaaagacccacagcagccccgccctgagccagggccacgtgaccggcagcaagaccaccaaggacgccaccggccccgacacctag

SEQ ID NO: 20914 - DNA, 2601 bp, Artificial Sequence
  Description of Artificial Sequence: Synthetic coding sequence
atggaggaggaggacaccaagagagaggtgcccaaggaggacggcgtgggcgacgtgcagcacttcgacagcagcaagatcatggaggagcacagctacatccagaaggagctggacctgcagaacggcagcctggaggaggacagcgtggtgcacagcgtggagaacgacagccagaacatgatggagagcctgagccccaagaagtacagcagcagcctgagattcaaggccaacggcgactacagcggcagctacctgaccctgagccagcccgtgcccgccaagagaagccccagccccctgggcaccagcgtgagaagcagccccagcctggccaagatccagggcagcaagcagttcagctacgacggcaccgacaagaacatccccatgaagccccccacccccctgctgaacaccaccagcagcctgagcggctaccccctgggcagagccgacttcgaccactacaccggcagagacagcgagagagccctgagactgagcgagaagcccccctacagcaagtacagcagcagacacaagagccacgacaacgtgtacagcctgggcggcctggagggcagaaaggccagcggcagcctgctggccatgtggaacggcagcagcctgagcgacgccggccccccccccatcagcagaagcggcgccgccagcatgcccagcagccccaagcaggccagaaagatgagcatccaggacagcctggccctgcagcccaagctgaccagacacaaggagctggccagcgagaacatcaacctgagaaccagaaagtacagcagcagcagcctgagccacatgggcgcctacagcagaagcctgcccagactgtacagagccaccgagaaccagctgacccccctgagcctgccccccagaaacagcctgggcaacagcaagagaaccaagctgggcgagaaggacctgccccacagcgtgatcgacaacgacaactacctgaacttcagcagcctgagcagcggcgccctgccctacaagaccagcgccagcgagggcaacccctacgtgagcagcaccctgagcgtgcccgccagccccagagtggccagaaagatgctgctggccagcaccagcagctgcgccagcgacgacttcgaccaggccagctacgtgggcaccaaccccagccacagcctgctggccggcgagagcgacagagtgttcgccaccagaagaaacttcagctgcggcagcgtggagttcgacgaggccgacctggagagcctgagacaggccagcggcaccccccagcccgccctgagagagagaaagagcagcatcagcagcatcagcggcagagacgacctgatggactaccacagaagacagagagaggagagactgagagagcaggagatggagagactggagagacagagactggagaccatcctgagcctgtgcgccgagtacaccaagcccgacagcagactgagcaccggcaccaccgtggaggacgtgcagaagatcaacaaggagctggagaagctgcagctgagcgacgaggagagcgtgttcgaggaggccctgatgagccccgacaccagatacagatgccacagaaaggacagcctgcccgacgccgacctggccagctgcggcagcctgagccagagcagcgccagcttcttcacccccagaagcaccagaaacgacgagctgctgagcgacctgaccagaaccccccccccccccagcagcaccttccccaaggccagcagcgagagcagctacctgagcatcctgcccaagacccccgagggcatcagcgaggagcagagaagccaggagctggccgccatggaggagaccagaatcgtgatcctgaacaacctggaggagctgaagcagaagatcaaggacatcaacgaccagatggacgagagcttcagagagctggacatggagtgcgccctgctggacggcgagcagaagagcgagaccaccgagctgatgaaggagaaggagatcctggaccacctgaacagaaagatcgccgagctggagaagaacatcgtgggcgagaagaccaaggacgccgacctgctggacgtggagagcaagcacttcgaggacctggagttccagcagctggagcacgagagcagactggacgaggagaaggagaacctgacccagcagctgctgagagaggtggccgagtaccagagaaacatcgtgagcagaaaggagaagatcagcgccctgaagaagcaggccaaccacatcgtgcagcaggcccagagagagcaggaccacttcgtgaaggagaagaacaacctgatcatgatgctgcagagagagaaggagaacctgtgcaacctggagaagaagtacagcagcctgagcggcggcaagggcttccccgtgaaccccaacaccctgaaggagggctacatcagcgtgaacgagatcaacgagccctgcggcaacagcaccaacctgagccccagcacccagttccccgccgacgccgacgccgtggccaccgagcccgccaccgccgtgctggccagccagccccagagcaaggagcacttccagggcccctag

SEQ ID NO: 20915 - DNA, 3714 bp, Artificial Sequence
  Description of Artificial Sequence: Synthetic coding sequence
atggaggaggaggacaccaagagagaggtgcccaaggaggacggcgtgggcgacgtgcagcacttcgacagcagcaagatcatggaggagcacagctacatccagaaggagctggacctgcagaacggcagcctggaggaggacagcgtggtgcacagcgtggagaacgacagccagaacatgatggagagcctgagccccaagaagtacagcagcagcctgagattcaaggccaacggcgactacagcggcagctacctgaccctgagccagcccgtgcccgccaagagaagccccagccccctgggcaccagcgtgagaagcagccccagcctggccaagatccagggcagcaagcagttcagctacgacggcaccgacaagaacatccccatgaagccccccacccccctgctgaacaccaccagcagcctgagcggctaccccctgggcagagccgacttcgaccactacaccggcagagacagcgagagagccctgagactgagcgagaagcccccctacagcaagtacagcagcagacacaagagccacgacaacgtgtacagcctgggcggcctggagggcagaaaggccagcggcagcctgctggccatgtggaacggcagcagcctgagcgacgccggccccccccccatcagcagaagcggcgccgccagcatgcccagcagccccaagcaggccagaaagatgagcatccaggacagcctggccctgcagcccaagctgaccagacacaaggagctggccagcgagaacatcaacctgagaaccagaaagtacagcagcagcagcctgagccacatgggcgcctacagcagaagcctgcccagactgtacagagccaccgagaaccagctgacccccctgagcctgccccccagaaacagcctgggcaacagcaagagaaccaagctgggcgagaaggacctgccccacagcgtgatcgacaacgacaactacctgaacttcagcagcctgagcagcggcgccctgccctacaagaccagcgccagcgagggcaacccctacgtgagcagcaccctgagcgtgcccgccagccccagagtggccagaaagatgctgctggccagcaccagcagctgcgccagcgacgacttcgaccaggccagctacgtgggcaccaaccccagccacagcctgctggccggcgagagcgacagagtgttcgccaccagaagaaacttcagctgcggcagcgtggagttcgacgaggccgacctggagagcctgagacaggccagcggcaccccccagcccgccctgagagagagaaagagcagcatcagcagcatcagcggcagagacgacctgatggactaccacagaagacagagagaggagagactgagagagcaggagatggagagactggagagacagagactggagaccatcctgagcctgtgcgccgagtacaccaagcccgacagcagactgagcaccggcaccaccgtggaggacgtgcagaagatcaacaaggagctggagaagctgcagctgagcgacgaggagagcgtgttcgaggaggccctgatgagccccgacaccagatacagatgccacagaaaggacagcctgcccgacgccgacctggccagctgcggcagcctgagccagagcagcgccagcttcttcacccccagaagcaccagaaacgacgagctgctgagcgacctgaccagaaccccccccccccccagcagcaccttccccaaggccagcagcgagagcagctacctgagcatcctgcccaagacccccgagggcatcagcgaggagcagagaagccaggagctggccgccatggaggagaccagaatcgtgatcctgaacaacctggaggagctgaagcagaagatcaaggacatcaacgaccagatggacgagagcttcagagagctggacatggagtgcgccctgctggacggcgagcagaagagcgagaccaccgagctgatgaaggagaaggagatcctggaccacctgaacagaaagatcgccgagctggagaagaacatcgtgggcgagaagaccaaggacgccgacctgctggacgtggagagcaagcacttcgaggacctggagttccagcagctggagcacgagagcagactggacgaggagaaggagaacctgacccagcagctgctgagagaggtggccgagtaccagagaaacatcgtgagcagaaaggagaagatcagcgccctgaagaagcaggccaaccacatcgtgcagcaggcccagagagagcaggaccacttcgtgaaggagaagaacaacctgatcatgatgctgcagagagagaaggagaacctgtgcaacctggagaagaagtacagcagcctgagcggcggcaagggcttccccgtgaaccccaacaccctgaaggagggctacatcagcgtgaacgagatcaacgagccctgcggcaacagcaccaacctgagccccagcacccagttccccgccgacgccgacgccgtggccaccgagcccgccaccgccgtgctggccagccagccccagagcaaggagcacttcagaagcctggaggagagaaagaagcagcacaaggagggcctgtacctgagcgacaccctgcccagaaagaagaccaccagcagcatcagcccccacttcagcagcgccaccatgggcagaagcatcacccccaaggcccacctgcccctgggccagagcaacagctgcggcagcgtgctgccccccagcctggccgccatggccaaggacagcgagagcagaagaatgctgagaggctacaaccaccagcagatgagcgagggccacagacagaagagcgagttctacaacagaaccgccagcgagagcaacgtgtacctgaacagcttccactaccccgaccacagctacaaggaccaggccttcgacaccctgagcctggacagcagcgacagcatggagaccagcatcagcgcctgcagccccgacaacatcagcagcgccagcaccagcaacatcgccagaatcgaggagatggagagactgctgaagcaggcccacgccgagaagaccagactgctggagagcagagagagagagatggaggccaagaagagagccctggaggaggagaagagaagaagagagatcctggagaagagactgcaggaggagaccagccagagacagaagctgatcgagaaggaggtgaagatcagagagagacagagagcccaggccagacccctgaccagatacctgcccgtgagaaaggaggacttcgacctgagaagccacgtggagaccgccggccacaacatcgacacctgctaccacgtgagcatcaccgagaagacctgcagaggcttcctgatcaagatgggcggcaagatcaagacctggaagaagagatggttcgtgttcgacagaaacaagagaaccttcagctactacgccgacaagcacgagaccaagctgaagggcgtgatctacttccaggccatcgaggaggtgtactacgaccacctgaagaacgccaacaagagccccaaccccctgctgaccttcagcgtgaagacccacgacagaatctactacatggtggcccccagccccgaggccatgagaatctggatggacgtgatcgtgaccggcgccgagggctacacccacttcctgctgtag

SEQ ID NO: 20916 - DNA, 3762 bp, Artificial Sequence
  Description of Artificial Sequence: Synthetic coding sequence
atggaggagcacagctacatccagaaggagctggacctgcagaacggcagcctggaggaggacagcgtggtgcacagcgtggagaacgacagccagaacatgatggagagcctgagccccaagaagtacagcagcagcctgagattcaaggccaacggcgactacagcggcagctacctgaccctgagccagcccgtgcccgccaagagaagccccagccccctgggcaccagcgtgagaagcagccccagcctggccaagatccagggcagcaagcagttcagctacgacggcaccgacaagaacatccccatgaagccccccacccccctgctgaacaccaccagcagcctgagcggctaccccctgggcagagccgacttcgaccactacaccggcagagacagcgagagagccctgagactgagcgagaagcccccctacagcaagtacagcagcagacacaagagccacgacaacgtgtacagcctgggcggcctggagggcagaaaggccagcggcagcctgctggccatgtggaacggcagcagcctgagcgacgccggccccccccccatcagcagaagcggcgccgccagcatgcccagcagccccaagcaggccagaaagatgagcatccaggacagcctggccctgcagcccaagctgaccagacacaaggagctggccagcgagaacatcaacctgagaaccagaaagtacagcagcagcagcctgagccacatgggcgcctacagcagaagcctgcccagactgtacagagccaccgagaaccagctgacccccctgagcctgccccccagaaacagcctgggcaacagcaagagaaccaagctgggcgagaaggacctgccccacagcgtgatcgacaacgacaactacctgaacttcagcagcctgagcagcggcgccctgccctacaagaccagcgccagcgagggcaacccctacgtgagcagcaccctgagcgtgcccgccagccccagagtggccagaaagatgctgctggccagcaccagcagctgcgccagcgacgacttcgaccaggccagctacgtgggcaccaaccccagccacagcctgctggccggcgagagcgacagagtgttcgccaccagaagaaacttcagctgcggcagcgtggagttcgacgaggccgacctggagagcctgagacaggccagcggcaccccccagcccgccctgagagagagaaagagcagcatcagcagcatcagcggcagagacgacctgatggactaccacagaagacagagagaggagagactgagagagcaggagatggagagactggagagacagagactggagaccatcctgagcctgtgcgccgagtacaccaagcccgacagcagactgagcaccggcaccaccgtggaggacgtgcagaagatcaacaaggagctggagaagctgcagctgagcgacgaggagagcgtgttcgaggaggccctgatgagccccgacaccagatacagatgccacagaaaggacagcctgcccgacgccgacctggccagctgcggcagcctgagccagagcagcgccagcttcttcacccccagaagcaccagaaacgacgagctgctgagcgacctgaccagaaccccccccccccccagcagcaccttccccaaggccagcagcgagagcagctacctgagcatcctgcccaagacccccgagggcatcagcgaggagcagagaagccaggagctggccgccatggaggagaccagaatcgtgatcctgaacaacctggaggagctgaagcagaagatcaaggacatcaacgaccagatggacgagagcttcagagagctggacatggagtgcgccctgctggacggcgagcagaagagcgagaccaccgagctgatgaaggagaaggagatcctggaccacctgaacagaaagatcgccgagctggagaagaacatcgtgggcgagaagaccaaggagaaggtgaagctggacgccgagagagagaagctggagagactgcaggagctgtacagcgagcagaagacccagctggacaactgccccgagagcatgagagagcagctgcagcagcagctgaagagagacgccgacctgctggacgtggagagcaagcacttcgaggacctggagttccagcagctggagcacgagagcagactggacgaggagaaggagaacctgacccagcagctgctgagagaggtggccgagtaccagagaaacatcgtgagcagaaaggagaagatcagcgccctgaagaagcaggccaaccacatcgtgcagcaggcccagagagagcaggaccacttcgtgaaggagaagaacaacctgatcatgatgctgcagagagagaaggagaacctgtgcaacctggagaagaagtacagcagcctgagcggcggcaagggcttccccgtgaaccccaacaccctgaaggagggctacatcagcgtgaacgagatcaacgagccctgcggcaacagcaccaacctgagccccagcacccagttccccgccgacgccgacgccgtggccaccgagcccgccaccgccgtgctggccagccagccccagagcaaggagcacttcagaagcctggaggagagaaagaagcagcacaaggagggcctgtacctgagcgacaccctgcccagaaagaagaccaccagcagcatcagcccccacttcagcagcgccaccatgggcagaagcatcacccccaaggcccacctgcccctgggccagagcaacagctgcggcagcgtgctgccccccagcctggccgccatggccaaggacagcgagagcagaagaatgctgagaggctacaaccaccagcagatgagcgagggccacagacagaagagcgagttctacaacagaaccgccagcgagagcaacgtgtacctgaacagcttccactaccccgaccacagctacaaggaccaggccttcgacaccctgagcctggacagcagcgacagcatggagaccagcatcagcgcctgcagccccgacaacatcagcagcgccagcaccagcaacatcgccagaatcgaggagatggagagactgctgaagcaggcccacgccgagaagaccagactgctggagagcagagagagagagatggaggccaagaagagagccctggaggaggagaagagaagaagagagatcctggagaagagactgcaggaggagaccagccagagacagaagctgatcgagaaggaggtgaagatcagagagagacagagagcccaggccagacccctgaccagatacctgcccgtgagaaaggaggacttcgacctgagaagccacgtggagaccgccggccacaacatcgacacctgctaccacgtgagcatcaccgagaagacctgcagaggcttcctgatcaagatgggcggcaagatcaagacctggaagaagagatggttcgtgttcgacagaaacaagagaaccttcagctactacgccgacaagcacgagaccaagctgaagggcgtgatctacttccaggccatcgaggaggtgtactacgaccacctgaagaacgccaacaagagccccaaccccctgctgaccttcagcgtgaagacccacgacagaatctactacatggtggcccccagccccgaggccatgagaatctggatggacgtgatcgtgaccggcgccgagggctacacccacttcctgctgtag

SEQ ID NO: 20917 - DNA, 3633 bp, Artificial Sequence
  Description of Artificial Sequence: Synthetic coding sequence
atggaggagcacagctacatccagaaggagctggacctgcagaacggcagcctggaggaggacagcgtggtgcacagcgtggagaacgacagccagaacatgatggagagcctgagccccaagaagtacagcagcagcctgagattcaaggccaacggcgactacagcggcagctacctgaccctgagccagcccgtgcccgccaagagaagccccagccccctgggcaccagcgtgagaagcagccccagcctggccaagatccagggcagcaagcagttcagctacgacggcaccgacaagaacatccccatgaagccccccacccccctgctgaacaccaccagcagcctgagcggctaccccctgggcagagccgacttcgaccactacaccggcagagacagcgagagagccctgagactgagcgagaagcccccctacagcaagtacagcagcagacacaagagccacgacaacgtgtacagcctgggcggcctggagggcagaaaggccagcggcagcctgctggccatgtggaacggcagcagcctgagcgacgccggccccccccccatcagcagaagcggcgccgccagcatgcccagcagccccaagcaggccagaaagatgagcatccaggacagcctggccctgcagcccaagctgaccagacacaaggagctggccagcgagaacatcaacctgagaaccagaaagtacagcagcagcagcctgagccacatgggcgcctacagcagaagcctgcccagactgtacagagccaccgagaaccagctgacccccctgagcctgccccccagaaacagcctgggcaacagcaagagaaccaagctgggcgagaaggacctgccccacagcgtgatcgacaacgacaactacctgaacttcagcagcctgagcagcggcgccctgccctacaagaccagcgccagcgagggcaacccctacgtgagcagcaccctgagcgtgcccgccagccccagagtggccagaaagatgctgctggccagcaccagcagctgcgccagcgacgacttcgaccaggccagctacgtgggcaccaaccccagccacagcctgctggccggcgagagcgacagagtgttcgccaccagaagaaacttcagctgcggcagcgtggagttcgacgaggccgacctggagagcctgagacaggccagcggcaccccccagcccgccctgagagagagaaagagcagcatcagcagcatcagcggcagagacgacctgatggactaccacagaagacagagagaggagagactgagagagcaggagatggagagactggagagacagagactggagaccatcctgagcctgtgcgccgagtacaccaagcccgacagcagactgagcaccggcaccaccgtggaggacgtgcagaagatcaacaaggagctggagaagctgcagctgagcgacgaggagagcgtgttcgaggaggccctgatgagccccgacaccagatacagatgccacagaaaggacagcctgcccgacgccgacctggccagctgcggcagcctgagccagagcagcgccagcttcttcacccccagaagcaccagaaacgacgagctgctgagcgacctgaccagaaccccccccccccccagcagcaccttccccaaggccagcagcgagagcagctacctgagcatcctgcccaagacccccgagggcatcagcgaggagcagagaagccaggagctggccgccatggaggagaccagaatcgtgatcctgaacaacctggaggagctgaagcagaagatcaaggacatcaacgaccagatggacgagagcttcagagagctggacatggagtgcgccctgctggacggcgagcagaagagcgagaccaccgagctgatgaaggagaaggagatcctggaccacctgaacagaaagatcgccgagctggagaagaacatcgtgggcgagaagaccaaggacgccgacctgctggacgtggagagcaagcacttcgaggacctggagttccagcagctggagcacgagagcagactggacgaggagaaggagaacctgacccagcagctgctgagagaggtggccgagtaccagagaaacatcgtgagcagaaaggagaagatcagcgccctgaagaagcaggccaaccacatcgtgcagcaggcccagagagagcaggaccacttcgtgaaggagaagaacaacctgatcatgatgctgcagagagagaaggagaacctgtgcaacctggagaagaagtacagcagcctgagcggcggcaagggcttccccgtgaaccccaacaccctgaaggagggctacatcagcgtgaacgagatcaacgagccctgcggcaacagcaccaacctgagccccagcacccagttccccgccgacgccgacgccgtggccaccgagcccgccaccgccgtgctggccagccagccccagagcaaggagcacttcagaagcctggaggagagaaagaagcagcacaaggagggcctgtacctgagcgacaccctgcccagaaagaagaccaccagcagcatcagcccccacttcagcagcgccaccatgggcagaagcatcacccccaaggcccacctgcccctgggccagagcaacagctgcggcagcgtgctgccccccagcctggccgccatggccaaggacagcgagagcagaagaatgctgagaggctacaaccaccagcagatgagcgagggccacagacagaagagcgagttctacaacagaaccgccagcgagagcaacgtgtacctgaacagcttccactaccccgaccacagctacaaggaccaggccttcgacaccctgagcctggacagcagcgacagcatggagaccagcatcagcgcctgcagccccgacaacatcagcagcgccagcaccagcaacatcgccagaatcgaggagatggagagactgctgaagcaggcccacgccgagaagaccagactgctggagagcagagagagagagatggaggccaagaagagagccctggaggaggagaagagaagaagagagatcctggagaagagactgcaggaggagaccagccagagacagaagctgatcgagaaggaggtgaagatcagagagagacagagagcccaggccagacccctgaccagatacctgcccgtgagaaaggaggacttcgacctgagaagccacgtggagaccgccggccacaacatcgacacctgctaccacgtgagcatcaccgagaagacctgcagaggcttcctgatcaagatgggcggcaagatcaagacctggaagaagagatggttcgtgttcgacagaaacaagagaaccttcagctactacgccgacaagcacgagaccaagctgaagggcgtgatctacttccaggccatcgaggaggtgtactacgaccacctgaagaacgccaacaagagccccaaccccctgctgaccttcagcgtgaagacccacgacagaatctactacatggtggcccccagccccgaggccatgagaatctggatggacgtgatcgtgaccggcgccgagggctacacccacttcctgctgtag

SEQ ID NO: 20918 - DNA, 3762 bp, Artificial Sequence; identical to SEQ ID NO: 20916
  Description of Artificial Sequence: Synthetic coding sequence

SEQ ID NO: 20919 - DNA, 3633 bp, Artificial Sequence; identical to SEQ ID NO: 20917
  Description of Artificial Sequence: Synthetic coding sequence

SEQ ID NO: 20920 - DNA, 3348 bp, Artificial Sequence
  Description of Artificial Sequence: Synthetic coding sequence
atggaggagcacagctacatccagaaggagctggacctgcagaacggcagcctggaggaggacagcgtggtgcacagcgtggagaacgacagccagaacatgatggagagcctgagccccaagaagtacagcagcagcctgagattcaaggccaacggcgactacagcggcagctacctgaccctgagccagcccgtgcccgccaagagaagccccagccccctgggcaccagcgtgagaagcagccccagcctggccaagatccagggcagcaagcagttcagctacgacggcaccgacaagaacatccccatgaagccccccacccccctgctgaacaccaccagcagcctgagcggctaccccctgggcagagccgacttcgaccactacaccggcagagacagcgagagagccctgagactgagcgagaagcccccctacagcaagtacagcagcagacacaagagccacgacaacgtgtacagcctgggcggcctggagggcagaaaggccagcggcagcctgctggccatgtggaacggcagcagcctgagcgacgccggccccccccccatcagcagaagcggcgccgccagcatgcccagcagccccaagcaggccagaaagatgagcatccaggacagcctggccctgcagcccaagctgaccagacacaaggagctggccagcgagaacatcaacctgagaaccagaaagtacagcagcagcagcctgagccacatgggcgcctacagcagaagcctgcccagactgtacagagccaccgagaaccagctgacccccctgagcctgccccccagaaacagcctgggcaacagcaagagaaccaagctgggcgagaaggacctgccccacagcgtgatcgacaacgacaactacctgaacttcagcagcctgagcagcggcgccctgccctacaagaccagcgccagcgagggcaacccctacgtgagcagcaccctgagcgtgcccgccagccccagagtggccagaaagatgctgctggccagcaccagcagctgcgccagcgacgacttcgaccaggccagctacgtgggcaccaaccccagccacagcctgctggccggcgagagcgacagagtgttcgccaccagaagaaacttcagctgcggcagcgtggagttcgacgaggccgacctggagagcctgagacaggccagcggcaccccccagcccgccctgagagagagaaagagcagcatcagcagcatcagcggcagagacgacctgatggactaccacagaagacagagagaggagagactgagagagcaggagatggagagactggagagacagagactggagaccatcctgagcctgtgcgccgagtacaccaagcccgacagcagactgagcaccggcaccaccgtggaggacgtgcagaagatcaacaaggagctggagaagctgcagctgagcgacgaggagagcgtgttcgaggaggccctgatgagccccgacaccagatacagatgccacagaaaggacagcctgcccgacgccgacctggccagctgcggcagcctgagccagagcagcgccagcttcttcacccccagaagcaccagaaacgacgagctgctgagcgacctgaccagaaccccccccccccccagcagcaccttccccaaggccagcagcgagagcagctacctgagcatcctgcccaagacccccgagggcatcagcgaggagcagagaagccaggagctggccgccatggaggagaccagaatcgtgatcctgaacaacctggaggagctgaagcagaagatcaaggacatcaacgaccagatggacgagagcttcagagagctggacatggagtgcgccctgctggacggcgagcagaagagcgagaccaccgagctgatgaaggagaaggagatcctggaccacctgaacagaaagatcgccgagctggagaagaacatcgtgggcgagaagaccaaggacgccgacctgctggacgtggagagcaagcacttcgaggacctggagttccagcagctggagcacgagagcagactggacgaggagaaggagaacctgacccagcagctgctgagagaggtggccgagtaccagagaaacatcgtgagcagaaaggagaagatcagcgccctgaagaagcaggccaaccacatcgtgcagcaggcccagagagagcaggaccacttcgtgaaggagaagaacaacctgatcatgatgctgcagagagagaaggagaacctgtgcaacctggagaagaagtacagcagcctgagcggcggcaagggcttccccgtgaaccccaacaccctgaaggagggctacatcagcgtgaacgagatcaacgagccctgcggcaacagcaccaacctgagccccagcacccagttccccgccgacgccgacgccgtggccaccgagcccgccaccgccgtgctggccagccagccccagagcaaggagcacttcagaagcctggaggagagaaagaagcagcacaaggagggcctgtacctgagcgacaccctgcccagaaagaagaccaccagcagcatcagcccccacttcagcagcgccaccatgggcagaagcatcacccccaaggcccacctgcccctgggccagagcaacagctgcggcagcgtgctgccccccagcctggccgccatggccaaggacagcgagagcagaagaatgctgagaggctacaaccaccagcagatgagcgagggccacagacagaagagcgagttctacaacagaaccgccagcgagagcaacgtgtacctgaacagcttccactaccccgaccacagctacaaggaccaggccttcgacaccctgagcctggacagcagcgacagcatggagaccagcatcagcgcctgcagccccgacaacatcagcagcgccagcaccagcaacatcgccagaatcgaggagatggagagactgctgaagcaggcccacgccgagaagaccagactgctggagagcagagagagagagatggaggccaagaagagagccctggaggaggagaagagaagaagagagatcctggagaagagactgcaggaggagaccagccagagacagaagctgatcgagaaggaggtgaagatcagagagagacagagagcccaggccagacccctgaccagatacctgcccgtgagaaaggaggacttcgacctgagaagccacgtggagaccgccggccacaacatcgacacctgctaccacgtgagcatcaccgagaagacctgcagaggcttcctgatcaagatgggcggcaagatcaagtag

SEQ ID NO: 20921 - DNA, 5616 bp, Artificial Sequence
  Description of Artificial Sequence: Synthetic coding sequence
atgcccagcgtgtgcctgctgctgctgctgttcctggccgtgggcggcgccctgggcaacagacccttcagagccttcgtggtgaccgacaccaccctgacccacctggccgtgcacagagtgaccggcgaggtgttcgtgggcgccgtgaacagagtgttcaagctggcccccaacctgaccgagctgagagcccacgtgaccggccccgtggaggacaacgccagatgctaccccccccccagcatgagagtgtgcgcccacagactggcccccgtggacaacatcaacaagctgctgctgatcgactacgccgccagaagactggtggcctgcggcagcatctggcagggcatctgccagttcctgagactggacgacctgttcaagctgggcgagccccaccacagaaaggagcactacctgagcggcgcccaggagcccgacagcatggccggcgtgatcgtggagcagggccagggccccagcaagctgttcgtgggcaccgccgtggacggcaagagcgagtacttccccaccctgagcagcagaaagctgatcagcgacgaggacagcgccgacatgttcagcctggtgtaccaggacgagttcgtgagcagccagatcaagatccccagcgacaccctgagcctgtaccccgccttcgacatctactacatctacggcttcgtgagcgccagcttcgtgtacttcctgaccctgcagctggacacccagcagaccctgctggacaccgccggcgagaagttcttcaccagcaagatcgtgagaatgtgcgccggcgacagcgagttctacagctacgtggagttccccatcggctgcagctggagaggcgtggagtacagactggtgcagagcgcccacctggccaagcccggcctgctgctggcccaggccctgggcgtgcccgccgacgaggacgtgctgttcaccatcttcagccagggccagaagaacagagccagcccccccagacagaccatcctgtgcctgttcaccctgagcaacatcaacgcccacatcagaagaagaatccagagctgctacagaggcgagggcaccctggccctgccctggctgctgaacaaggagctgccctgcatcaacacccccatgcagatcaacggcaacttctgcggcctggtgctgaaccagcccctgggcggcctgcacgtgatcgagggcctgcccctgctggccgacagcaccgacggcatggccagcgtggccgcctacacctacagacagcacagcgtggtgttcatcggcaccagaagcggcagcctgaagaaggtgagagtggacggcttccaggacgcccacctgtacgagaccgtgcccgtggtggacggcagccccatcctgagagacctgctgttcagccccgaccacagacacatctacctgctgagcgagaagcaggtgagccagctgcccgtggagacctgcgagcagtaccagagctgcgccgcctgcctgggcagcggcgacccccactgcggctggtgcgtgctgagacacagatgctgcagagagggcgcctgcctgggcgccagcgccccccacggcttcgccgaggagctgagcaagtgcgtgcaggtgagagtgagacccaacaacgtgagcgtgaccagccccggcgtgcagctgaccgtgaccctgcacaacgtgcccgacctgagcgccggcgtgagctgcgccttcgaggccgccgccgagaacgaggccgtgctgctgcccagcggcgagctgctgtgccccagccccagcctgcaggagctgagagccctgaccagaggccacggcgccaccagaaccgtgagactgcagctgctgagcaaggagaccggcgtgagattcgccggcgccgacttcgtgttctacaactgcagcgtgctgcagagctgcatgagctgcgtgggcagcccctacccctgccactggtgcaagtacagacacacctgcaccagcagaccccacgagtgcagcttccaggagggcagagtgcacagccccgagggctgccccgagatcctgcccagcggcgacctgctgatccccgtgggcgtgatgcagcccctgaccctgagagccaagaacctgccccagccccagagcggccagaagaactacgagtgcgtggtgagagtgcagggcagacagcagagagtgcccgccgtgagattcaacagcagcagcgtgcagtgccagaacgccagctacagctacgagggcgacgagcacggcgacaccgagctggacttcagcgtggtgtgggacggcgacttccccatcgacaagccccccagcttcagagccctgctgtacaagtgctgggcccagagacccagctgcggcctgtgcctgaaggccgaccccagattcaactgcggctggtgcatcagcgagcacagatgccagctgagaacccactgccccgcccccaagaccaactggatgcacctgagccagaagggcaccagatgcagccaccccagaatcacccagatccaccccctggtgggccccaaggagggcggcaccagagtgaccatcgtgggcgacaacctgggcctgctgagcagagaggtgggcctgagagtggccggcgtgagatgcaacagcatccccgccgagtacatcagcgccgagagaatcgtgtgcgagatggaggagagcctggtgcccagccccccccccggccccgtggagctgtgcgtgggcgactgcagcgccgacttcagaacccagagcgagcaggtgtacagcttcgtgacccccaccttcgaccaggtgagccccagcagaggccccgccagcggcggcaccagactgaccatcagcggcagcagcctggacgccggcagcagagtgaccgtgaccgtgagagacagcgagtgccagttcgtgagaagagacgccaaggccatcgtgtgcatcagccccctgagcaccctgggccccagccaggcccccatcaccctggccatcgacagagccaacatcagcagccccggcctgatctacacctacacccaggaccccaccgtgaccagactggagcccacctggagcatcatcaacggcagcaccgccatcaccgtgagcggcacccacctgctgaccgtgcaggagcccagagtgagagccaagtacagaggcatcgagaccaccaacacctgccaggtgatcaacgacaccgccatgctgtgcaaggcccccggcatcttcctgggcagaccccagcccagagcccagggcgagcaccccgacgagttcggcttcctgctggaccacgtgcagaccgccagaagcctgaacagaagcagcttcacctactaccccgaccccagcttcgagcccctgggccccagcggcgtgctggacgtgaagcccggcagccacgtggtgctgaagggcaagaacctgatccccgccgccgccggcagcagcagactgaactacaccgtgctgatcggcggccagccctgcagcctgaccgtgagcgacacccagctgctgtgcgacagccccagccagaccggcagacagcccgtgatggtgctggtgggcggcctggagttctggctgggcaccctgcacatcagcgccgagagagccctgaccctgcccgccatgatgggcctggccgccggcggcggcctgctgctgctggccatcaccgccgtgctggtggcctacaagagaaagacccaggacgccgacagaaccctgaagagactgcagctgcagatggacaacctggagagcagagtggccctggagtgcaaggaggccttcgccgagctgcagaccgacatcaacgagctgaccaaccacatggacgaggtgcagatccccttcctggactacagaacctacgccgtgagagtgctgttccccggcatcgaggcccaccccgtgctgaaggagctggacaccccccccaacgtggagaaggccctgagactgttcggccagctgctgcacagcagagccttcgtgctgaccttcatccacaccctggaggcccagagcagcttcagcatgagagacagaggcaccgtggccagcctgaccatggtggccctgcagagcagactggactacgccaccggcctgctgaagcagctgctggccgacctgatcgagaagaacctggagagcaagaaccaccccaagctgctgctgagaagaaccgagagcgtggccgagaagatgctgaccaactggttcaccttcctgctgcacaagttcctgaaggagtgcgccggcgagcccctgttcctgctgtactgcgccatcaagcagcagatggagaagggccccatcgacgccatcaccggcgaggccagatacagcctgagcgaggacaagctgatcagacagcagatcgactacaagaccctgaccctgcactgcgtgtgccccgagaacgagggcagcgcccaggtgcccgtgaaggtgctgaactgcgacagcatcacccaggccaaggacaagctgctggacaccgtgtacaagggcatcccctacagccagagacccaaggccgaggacatggacctggagtggagacagggcagaatgaccagaatcatcctgcaggacgaggacgtgaccaccaagatcgagtgcgactggaagagactgaacagcctggcccactaccaggtgaccgacggcagcctggtggccctggtgcccaagcaggtgagcgcctacaacatggccaacagcttcaccttcaccagaagcctgagcagatacgagagcctgctgagaaccgccagcagccccgacagcctgagaagcagagcccccatgatcacccccgaccaggagaccggcaccaagctgtggcacctggtgaagaaccacgaccacgccgaccacagagagggcgacagaggcagcaagatggtgagcgagatctacctgaccagactgctggccaccaagggcaccctgcagaagttcgtggacgacctgttcgagaccgtgttcagcaccgcccacagaggcagcgccctgcccctggccatcaagtacatgttcgacttcctggacgagcaggccgaccagagacagatcagcgaccccgacgtgagacacacctggaagagcaactgcctgcccctgagattctgggtgaacgtgatcaagaacccccagttcgtgttcgacatccacaagaacagcatcaccgacgcctgcctgagcgtggtggcccagaccttcatggacagctgcagcaccagcgagcacagactgggcaaggacagccccagcaacaagctgctgtacgccaaggacatccccaactacaagagctgggtggagagatactacagagacatcgccaagatggccagcatcagcgaccaggacatggacgcctacctggtggagcagagcagactgcacgccagcgacttcagcgtgctgagcgccctgaacgagctgtacttctacgtgaccaagtacagacaggagatcctgaccgccctggacagagacgccagctgcagaaagcacaagctgagacagaagctggagcagatcatcagcctggtgagcagcgacagctag

SEQ ID NO: 20922 - DNA, 4707 bp, Artificial Sequence
  Description of Artificial Sequence: Synthetic coding sequence
atggaggtgagcagaagaaaggccccccccagaccccccagacccgccgcccccctgcccctgctggcctacctgctggccctggccgcccccggcagaggcgccgacgagcccgtgtggagaagcgagcaggccatcggcgccatcgccgccagccaggaggacggcgtgttcgtggccagcggcagctgcctggaccagctggactacagcctggagcacagcctgagcagactgtacagagaccaggccggcaactgcaccgagcccgtgagcctggccccccccgccagacccagacccggcagcagcttcagcaagctgctgctgccctacagagagggcgccgccggcctgggcggcctgctgctgaccggctggaccttcgacagaggcgcctgcgaggtgagacccctgggcaacctgagcagaaacagcctgagaaacggcaccgaggtggtgagctgccacccccagggcagcaccgccggcgtggtgtacagagccggcagaaacaacagatggtacctggccgtggccgccacctacgtgctgcccgagcccgagaccgccagcagatgcaaccccgccgccagcgaccacgacaccgccatcgccctgaaggacaccgagggcagaagcctggccacccaggagctgggcagactgaagctgtgcgagggcgccggcagcctgcacttcgtggacgccttcctgtggaacggcagcatctacttcccctactacccctacaactacaccagcggcgccgccaccggctggcccagcatggccagaatcgcccagagcaccgaggtgctgttccagggccaggccagcctggactgcggccacggccaccccgacggcagaagactgctgctgagcagcagcctggtggaggccctggacgtgtgggccggcgtgttcagcgccgccgccggcgagggccaggagagaagaagccccaccaccaccgccctgtgcctgttcagaatgagcgagatccaggccagagccaagagagtgagctgggacttcaagaccgccgagagccactgcaaggagggcgaccagcccgagagagtgcagcccatcgccagcagcaccctgatccacagcgacctgaccagcgtgtacggcaccgtggtgatgaacagaaccgtgctgttcctgggcaccggcgacggccagctgctgaaggtgatcctgggcgagaacctgaccagcaactgccccgaggtgatctacgagatcaaggaggagacccccgtgttctacaagctggtgcccgaccccgtgaagaacatctacatctacctgaccgccggcaaggaggtgagaagaatcagagtggccaactgcaacaagcacaagagctgcagcgagtgcctgaccgccaccgacccccactgcggctggtgccacagcctgcagagatgcaccttccagggcgactgcgtgcacagcgagaacctggagaactggctggacatcagcagcggcgccaagaagtgccccaagatccagatcatcagaagcagcaaggagaagaccaccgtgaccatggtgggcagcttcagccccagacacagcaagtgcatggtgaagaacgtggacagcagcagagagctgtgccagaacaagagccagcccaacagaacctgcacctgcagcatccccaccagagccacctacaaggacgtgagcgtggtgaacgtgatgttcagcttcggcagctggaacctgagcgacagattcaacttcaccaactgcagcagcctgaaggagtgccccgcctgcgtggagaccggctgcgcctggtgcaagagcgccagaagatgcatccaccccttcaccgcctgcgaccccagcgactacgagagaaaccaggagcagtgccccgtggccgtggagaagaccagcggcggcggcagacccaaggagaacaagggcaacagaaccaaccaggccctgcaggtgttctacatcaagagcatcgagccccagaaggtgagcaccctgggcaagagcaacgtgatcgtgaccggcgccaacttcaccagagccagcaacatcaccatgatcctgaagggcaccagcacctgcgacaaggacgtgatccaggtgagccacgtgctgaacgacacccacatgaagttcagcctgcccagcagcagaaaggagatgaaggacgtgtgcatccagttcgacggcggcaactgcagcagcgtgggcagcctgagctacatcgccctgccccactgcagcctgatcttccccgccaccacctggatcagcggcggccagaacatcaccatgatgggcagaaacttcgacgtgatcgacaacctgatcatcagccacgagctgaagggcaacatcaacgtgagcgagtactgcgtggccacctactgcggcttcctggcccccagcctgaagagcagcaaggtgagaaccaacgtgaccgtgaagctgagagtgcaggacacctacctggactgcggcaccctgcagtacagagaggaccccagattcaccggctacagagtggagagcgaggtggacaccgagctggaggtgaagatccagaaggagaacgacaacttcaacatcagcaagaaggacatcgagatcaccctgttccacggcgagaacggccagctgaactgcagcttcgagaacatcaccagaaaccaggacctgaccaccatcctgtgcaagatcaagggcatcaagaccgccagcaccatcgccaacagcagcaagaaggtgagagtgaagctgggcaacctggagctgtacgtggagcaggagagcgtgcccagcacctggtacttcctgatcgtgctgcccgtgctgctggtgatcgtgatcttcgccgccgtgggcgtgaccagacacaagagcaaggagctgagcagaaagcagagccagcagctggagctgctggagagcgagctgagaaaggagatcagagacggcttcgccgagctgcagatggacaagctggacgtggtggacagcttcggcaccgtgcccttcctggactacaagcacttcgccctgagaaccttcttccccgagagcggcggcttcacccacatcttcaccgaggacatgcacaacagagacgccaacgacaagaacgagagcctgaccgccctggacgccctgatctgcaacaagagcttcctggtgaccgtgatccacaccctggagaagcagaagaacttcagcgtgaaggacagatgcctgttcgccagcttcctgaccatcgccctgcagaccaagctggtgtacctgaccagcatcctggaggtgctgaccagagacctgatggagcagtgcagcaacatgcagcccaagctgatgctgagaagaaccgagagcgtggtggagaagctgctgaccaactggatgagcgtgtgcctgagcggcttcctgagagagaccgtgggcgagcccttctacctgctggtgaccaccctgaaccagaagatcaacaagggccccgtggacgtgatcacctgcaaggccctgtacaccctgaacgaggactggctgctgtggcaggtgcccgagttcagcaccgtggccctgaacgtggtgttcgagaagatccccgagaacgagagcgccgacgtgtgcagaaacatcagcgtgaacgtgctggactgcgacaccatcggccaggccaaggagaagatcttccaggccttcctgagcaagaacggcagcccctacggcctgcagctgaacgagatcggcctggagctgcagatgggcaccagacagaaggagctgctggacatcgacagcagcagcgtgatcctggaggacggcatcaccaagctgaacaccatcggccactacgagatcagcaacggcagcaccatcaaggtgttcaagaagatcgccaacttcaccagcgacgtggagtacagcgacgaccactgccacctgatcctgcccgacagcgaggccttccaggacgtgcagggcaagagacacagaggcaagcacaagttcaaggtgaaggagatgtacctgaccaagctgctgagcaccaaggtggccatccacagcgtgctggagaagctgttcagaagcatctggagcctgcccaacagcagagcccccttcgccatcaagtacttcttcgacttcctggacgcccaggccgagaacaagaagatcaccgaccccgacgtggtgcacatctggaagaccaacagcctgcccctgagattctgggtgaacatcctgaagaacccccagttcgtgttcgacatcaagaagaccccccacatcgacggctgcctgagcgtgatcgcccaggccttcatggacgccttcagcctgaccgagcagcagctgggcaaggaggcccccaccaacaagctgctgtacgccaaggacatccccacctacaaggaggaggtgaagagctactacaaggccatcagagacctgccccccctgagcagcagcgagatggaggagttcctgacccaggagagcaagaagcacgagaacgagttcaacgaggaggtggccctgaccgagatctacaagtacatcgtgaagtacttcgacgagatcctgaacaagctggagagagagagaggcctggaggaggcccagaagcagctgctgcacgtgaaggtgctgttcgacgagaagaagaagtgcaagtggatgtag

SEQ ID NO: 20923 - DNA, 1848 bp, Artificial Sequence
  Description of Artificial Sequence: Synthetic coding sequence
atgcagcacctgtgcctgctggccgccgtgggcgtgaccagacacaagagcaaggagctgagcagaaagcagagccagcagctggagctgctggagagcgagctgagaaaggagatcagagacggcttcgccgagctgcagatggacaagctggacgtggtggacagcttcggcaccgtgcccttcctggactacaagcacttcgccctgagaaccttcttccccgagagcggcggcttcacccacatcttcaccgaggacatgcacaacagagacgccaacgacaagaacgagagcctgaccgccctggacgccctgatctgcaacaagagcttcctggtgaccgtgatccacaccctggagaagcagaagaacttcagcgtgaaggacagatgcctgttcgccagcttcctgaccatcgccctgcagaccaagctggtgtacctgaccagcatcctggaggtgctgaccagagacctgatggagcagtgcagcaacatgcagcccaagctgatgctgagaagaaccgagagcgtggtggagaagctgctgaccaactggatgagcgtgtgcctgagcggcttcctgagagagaccgtgggcgagcccttctacctgctggtgaccaccctgaaccagaagatcaacaagggccccgtggacgtgatcacctgcaaggccctgtacaccctgaacgaggactggctgctgtggcaggtgcccgagttcagcaccgtggccctgaacgtggtgttcgagaagatccccgagaacgagagcgccgacgtgtgcagaaacatcagcgtgaacgtgctggactgcgacaccatcggccaggccaaggagaagatcttccaggccttcctgagcaagaacggcagcccctacggcctgcagctgaacgagatcggcctggagctgcagatgggcaccagacagaaggagctgctggacatcgacagcagcagcgtgatcctggaggacggcatcaccaagctgaacaccatcggccactacgagatcagcaacggcagcaccatcaaggtgttcaagaagatcgccaacttcaccagcgacgtggagtacagcgacgaccactgccacctgatcctgcccgacagcgaggccttccaggacgtgcagggcaagagacacagaggcaagcacaagttcaaggtgaaggagatgtacctgaccaagctgctgagcaccaaggtggccatccacagcgtgctggagaagctgttcagaagcatctggagcctgcccaacagcagagcccccttcgccatcaagtacttcttcgacttcctggacgcccaggccgagaacaagaagatcaccgaccccgacgtggtgcacatctggaagaccaacagcctgcccctgagattctgggtgaacatcctgaagaacccccagttcgtgttcgacatcaagaagaccccccacatcgacggctgcctgagcgtgatcgcccaggccttcatggacgccttcagcctgaccgagcagcagctgggcaaggaggcccccaccaacaagctgctgtacgccaaggacatccccacctacaaggaggaggtgaagagctactacaaggccatcagagacctgccccccctgagcagcagcgagatggaggagttcctgacccaggagagcaagaagcacgagaacgagttcaacgaggaggtggccctgaccgagatctacaagtacatcgtgaagtacttcgacgagatcctgaacaagctggagagagagagaggcctggaggaggcccagaagcagctgctgcacgtgaaggtgctgttcgacgagaagaagaagtgcaagtggatgtag

SEQ ID NO: 20924 - DNA, 1593 bp, Artificial Sequence
  Description of Artificial Sequence: Synthetic coding sequence
atgggcagactgctgagagccgccagactgccccccctgctgagccccctgctgctgctgctggtgggcggcgccttcctgggcgcctgcgtggccggcagcgacgagcccggccccgagggcctgaccagcaccagcctgctggacctgctgctgcccaccggcctggagcccctggacagcgaggagcccagcgagaccatgggcctgggcgccggcctgggcgcccccggcagcggcttccccagcgaggagaacgaggagagcagaatcctgcagcccccccagtacttctgggaggaggaggaggagctgaacgacagcagcctggacctgggccccaccgccgactacgtgttccccgacctgaccgagaaggccggcagcatcgaggacaccagccaggcccaggagctgcccaacctgcccagccccctgcccaagatgaacctggtggagcccccctggcacatgccccccagagaggaggaggaggaggaggaggaggaggaggagagagagaaggaggaggtggagaagcaggaggaggaggaggaggaggagctgctgcccgtgaacggcagccaggaggaggccaagccccaggtgagagacttcagcctgaccagcagcagccagacccccggcgccaccaagagcagacacgaggacagcggcgaccaggccagcagcggcgtggaggtggagagcagcatgggccccagcctgctgctgcccagcgtgacccccaccaccgtgacccccggcgaccaggacagcaccagccaggaggccgaggccaccgtgctgcccgccgccggcctgggcgtggagttcgaggccccccaggaggccagcgaggaggccaccgccggcgccgccggcctgagcggccagcacgaggaggtgcccgccctgcccagcttcccccagaccaccgcccccagcggcgccgagcaccccgacgaggaccccctgggcagcagaaccagcgccagcagccccccccagctgctggccctggtggaggaggtgctgcccagacacggcagcggccaccacggcgcctggcacatcagcctgagcaagcccagcgagaaggagcagcacctgctgatgaccctggtgggcgagcagggcgtggtgcccacccaggacgtgctgagcatgctgggcgacatcagaagaagcctggaggagatcggcatccagaactacagcaccaccagcagctgccaggccagagccagccaggtgagaagcgactacggcaccctgttcgtggtgctggtggtgatcggcgccatctgcatcatcatcatcgccctgggcctgctgtacaactgctggcagagaagactgcccaagctgaagcacgtgagccacggcgaggagctgagattcgtggagaacggctgccacgacaaccccaccctggacgtggccagcgacagccagagcgagatgcaggagaagcaccccagcctgaacggcggcggcgccctgaacggccccggcagctggggcgccctgatgggcggcaagagagaccccgaggacagcgacgtgttcgaggaggacacccacctgtag

SEQ ID NO: 20925 - DNA, 1818 bp, Artificial Sequence
  Description of Artificial Sequence: Synthetic coding sequence
atgggcagactgctgagagccgccagactgccccccctgctgagccccctgctgctgctgctggtgggcggcgccttcctgggcgcctgcgtggccggcagcgacgagcccggccccgagggcctgaccagcaccagcctgctggacctgctgctgcccaccggcctggagcccctggacagcgaggagcccagcgagaccatgggcctgggcgccggcctgggcgcccccggcagcggcttccccagcgaggagaacgaggagagcagaatcctgcagcccccccagtacttctgggaggaggaggaggagctgaacgacagcagcctggacctgggccccaccgccgactacgtgttccccgacctgaccgagaaggccggcagcatcgaggacaccagccaggcccaggagctgcccaacctgcccagccccctgcccaagatgaacctggtggagcccccctggcacatgccccccagagaggaggaggaggaggaggaggaggaggaggagagagagaaggaggaggtggagaagcaggaggaggaggaggaggaggagctgctgcccgtgaacggcagccaggaggaggccaagccccaggtgagagacttcagcctgaccagcagcagccagacccccggcgccaccaagagcagacacgaggacagcggcgaccaggccagcagcggcgtggaggtggagagcagcatgggccccagcctgctgctgcccagcgtgacccccaccaccgtgacccccggcgaccaggacagcaccagccaggaggccgaggccaccgtgctgcccgccgccggcctgggcgtggagttcgaggccccccaggaggccagcgaggaggccaccgccggcgccgccggcctgagcggccagcacgaggaggtgcccgccctgcccagcttcccccagaccaccgcccccagcggcgccgagcaccccgacgaggaccccctgggcagcagaaccagcgccagcagccccctggcccccggcgacatggagctgacccccagcagcgccaccctgggccaggaggacctgaaccagcagctgctggagggccaggccgccgaggcccagagcagaatcccctgggacagcacccaggtgatctgcaaggactggagcaacctggccggcaagaactacatcatcctgaacatgaccgagaacatcgactgcgaggtgttcagacagcacagaggcccccagctgctggccctggtggaggaggtgctgcccagacacggcagcggccaccacggcgcctggcacatcagcctgagcaagcccagcgagaaggagcagcacctgctgatgaccctggtgggcgagcagggcgtggtgcccacccaggacgtgctgagcatgctgggcgacatcagaagaagcctggaggagatcggcatccagaactacagcaccaccagcagctgccaggccagagccagccaggtgagaagcgactacggcaccctgttcgtggtgctggtggtgatcggcgccatctgcatcatcatcatcgccctgggcctgctgtacaactgctggcagagaagactgcccaagctgaagcacgtgagccacggcgaggagctgagattcgtggagaacggctgccacgacaaccccaccctggacgtggccagcgacagccagagcgagatgcaggagaagcaccccagcctgaacggcggcggcgccctgaacggccccggcagctggggcgccctgatgggcggcaagagagaccccgaggacagcgacgtgttcgaggaggacacccacctgtag

SEQ ID NO: 20926 - DNA, 717 bp, Artificial Sequence
  Description of Artificial Sequence: Synthetic coding sequence
atgctgacccccctgggcaagttcagcaccgccaagttcgccgtgagactgcccagagtgtgggaggccagagcccccagcctgagcggcgcccccgcccccaccccccccgcccccccccccagcagaagcagcagactgggcctgtggcccagatgcttcctgatcttcccccagctgagaatcctgctgctgggcccccaggagagcaacaacagcaccggcaccatgtggaaggtgagcgccctgctgttcgtgctgggcagcgccagcctgtgggtgctggccgagggcgccagcaccggccagcccgaggacgacaccgagaccaccggcctggagggcggcgtggccatgcccggcgccgaggacgacgtggtgacccccggcaccagcgaggacagatacaagagcggcctgaccaccctggtggccaccagcgtgaacagcgtgaccggcatcagaatcgaggacctgcccaccagcgagagcaccgtgcacgcccaggagcagagccccagcgccaccgccagcaacgtggccaccagccacagcaccgagaaggtggacggcgacacccagaccaccgtggagaaggacggcctgagcaccgtgaccctggtgggcatcatcgtgggcgtgctgctggccatcggcttcatcggcgccatcatcgtggtggtgatgagaaagatgagcggcagatacagcccctag

SEQ ID NO: 20927 - DNA, 711 bp, Artificial Sequence
  Description of Artificial Sequence: Synthetic coding sequence
atgctgacccccctgggcaagttcagcaccgccaagttcgccgtgagactgcccagagtgtgggaggccagagcccccagcctgagcggcgcccccgcccccaccccccccgcccccccccccagcagaagcagcagactgggcctgtggcccagatgcttcctgatcttcccccagctgagaatcctgctgctgggcccccaggagagcaacaacagcaccggcaccatgtggaaggtgagcgccctgctgttcgtgctgggcagcgccagcctgtgggtgctggccgagggcgccagcaccggccagcccgaggacgacaccgagaccaccggcctggagggcggcgtggccatgcccggcgccgaggacgacgtggtgacccccggcaccagcgaggacagatacaagagcggcctgaccaccctggtggccaccagcgtgaacagcgtgaccggcatcagaatcgaggacctgcccaccagcgagagcaccgtgcacgcccaggagcagagccccagcgccaccgccagcaacgtggccaccagccacagcaccgagaaggtggacggcgacacccagaccaccgtggagaaggacggcctgagcaccgtgaccctggtgggcatcatcgtgggcgtgctgctggccatcggcttcatcggcgccatcatcgtggtggtgatgagaaagatgagcggcagaccctag

SEQ ID NO: 20928 - DNA, 363 bp, Artificial Sequence
  Description of Artificial Sequence: Synthetic coding sequence
atgcccggcgccgaggacgacgtggtgacccccggcaccagcgaggacagatacaagagcggcctgaccaccctggtggccaccagcgtgaacagcgtgaccggcatcagaatcgaggacctgcccaccagcgagagcaccgtgcacgcccaggagcagagccccagcgccaccgccagcaacgtggccaccagccacagcaccgagaaggtggacggcgacacccagaccaccgtggagaaggacggcctgagcaccgtgaccctggtgggcatcatcgtgggcgtgctgctggccatcggcttcatcggcgccatcatcgtggtggtgatgagaaagatgagcggcagatacagcccctag

SEQ ID NO: 20929 - DNA, 357 bp, Artificial Sequence
  Description of Artificial Sequence: Synthetic coding sequence
atgcccggcgccgaggacgacgtggtgacccccggcaccagcgaggacagatacaagagcggcctgaccaccctggtggccaccagcgtgaacagcgtgaccggcatcagaatcgaggacctgcccaccagcgagagcaccgtgcacgcccaggagcagagccccagcgccaccgccagcaacgtggccaccagccacagcaccgagaaggtggacggcgacacccagaccaccgtggagaaggacggcctgagcaccgtgaccctggtgggcatcatcgtgggcgtgctgctggccatcggcttcatcggcgccatcatcgtggtggtgatgagaaagatgagcggcagaccctag

SEQ ID NO: 20930 - DNA, 363 bp, Artificial Sequence; identical to SEQ ID NO: 20928
  Description of Artificial Sequence: Synthetic coding sequence

SEQ ID NO: 20931 - DNA, 363 bp, Artificial Sequence; identical to SEQ ID NO: 20928
  Description of Artificial Sequence: Synthetic coding sequence

SEQ ID NO: 20932 - DNA, 981 bp, Artificial Sequence
  Description of Artificial Sequence: Synthetic coding sequence
atgagaaccgaggcccaggtgcccgccctgcagccccccgagcccggcctggagggcgccatgggccacagaaccctggtgctgccctgggtgctgctgaccctgtgcgtgaccgccggcacccccgaggtgtgggtgcaggtgagaatggaggccaccgagctgagcagcttcaccatcagatgcggcttcctgggcagcggcagcatcagcctggtgaccgtgagctggggcggccccaacggcgccggcggcaccaccctggccgtgctgcaccccgagagaggcatcagacagtgggcccccgccagacaggccagatgggagacccagagcagcatcagcctgatcctggagggcagcggcgccagcagcccctgcgccaacaccaccttctgctgcaagttcgccagcttccccgagggcagctgggaggcctgcggcagcctgccccccagcagcgaccccggcctgagcgccccccccacccccgcccccatcctgagagccgacctggccggcatcctgggcgtgagcggcgtgctgctgttcggctgcgtgtacctgctgcacctgctgagaagacacaagcacagacccgcccccagactgcagcccagcagaaccagcccccaggcccccagagccagagcctgggcccccagccaggccagccaggccgccctgcacgtgccctacgccaccatcaacaccagctgcagacccgccaccctggacaccgcccacccccacggcggccccagctggtgggccagcctgcccacccacgccgcccacagaccccagggccccgccgcctgggccagcacccccatccccgccagaggcagcttcgtgagcgtggagaacggcctgtacgcccaggccggcgagagacccccccacaccggccccggcctgaccctgttccccgaccccagaggccccagagccatggagggccccctgggcgtgagatag

SEQ ID NO: 20933 - DNA, 972 bp, Artificial Sequence
  Description of Artificial Sequence: Synthetic coding sequence
atgcagcccagcggctgggccgccgccagagaggccgccggcagagacatgctggccgccgacctgagatgcagcctgttcgccagcgccctgcagagctacaagagagacagcgtgctgagacccttccccgccagctacgccagaggcgactgcaaggacttcgaggccctgctggccgacgccagcaagctgcccaacctgaaggagctgctgcagagcagcggcgacaaccacaagagagcctgggacctggtgagctggatcctgagcagcaaggtgctgaccatccacagcgccggcaaggccgagttcgagaagatccagaagctgaccggcgccccccacacccccgtgcccgcccccgacttcctgttcgagatcgagtacttcgaccccgccaacgccaagttctacgagaccaagggcgagagagacctgatctacgccttccacggcagcagactggagaacttccacagcatcatccacaacggcctgcactgccacctgaacaagaccagcctgttcggcgagggcacctacctgaccagcgacctgagcctggccctgatctacagcccccacggccacggctggcagcacagcctgctgggccccatcctgagctgcgtggccgtgtgcgaggtgatcgaccaccccgacgtgaagtgccagaccaagaagaaggacagcaaggagatcgacagaagaagagccagaatcaagcacagcgagggcggcgacatcccccccaagtacttcgtggtgaccaacaaccagctgctgagagtgaagtacctgctggtgtacagccagaagccccccaagagcagagccagcagccagctgagctggttcagcagccactggttcaccgtgatgatcagcctgtacctgctgctgctgctgatcgtgagcgtgatcaacagcagcgccttccagcacttctggaacagagccaagagatag

SEQ ID NO: 20934 - DNA, 1563 bp, Artificial Sequence
  Description of Artificial Sequence: Synthetic coding sequence
atgttctgcaccagaggcctgctgttcttcgccttcctggccggcctggacatcgagttcaccggcctgagaagcaacctgagcggcccccagcagatcagcctgttcgacctgcccagcgagtggtacctgaagaccagacagagcgtgcagcagttcaccgtgtgccagatcggcctgagcgtgttcagcgccatcgagggcgaggccaacaagtacatcgcccacagctgcaacttctacctgttccccaccaccttcggcatcctggacagcgagttcagcttccaggccagcagcgtgcagttcctgaaccagtacggcttcaactacaacaagttcctgaagaacggcatcccctacatgaacgaggagcaggagaagaagatcagacacgacatcctgaccggcaactggagagtgagaagcagccccgacaaggaccagatcaaggtggtgatcgacgaggtgaccagatggctggagctggccaaggagggcgactggatgaccctgcccggcatcaccggcttccaggccttcgaggtgcagctggtgctgagacaggccctgcccaacatctggaccgtgctgaaggacgagggcgtggtggtgaagaaggtgagcaagcagcacagatggtacctgcagaacaccagctgcgacagagagagctgctggaaggagaacatcctgctgagcgccagaggcttcagcgtgttcttccagatgctggtgaaggcccagaagcccctggtgggccacaacatgatgatggacctgctgcacctgcacgagaagttcttcagacccctgcccgagagctacgaccagttcaagcagaacatccacagcctgttccccgtgctgatcgacaccaagagcgtgaccaaggacatctggaaggagatgaacttccccagagtgagcaacctgagcgaggtgtacgaggtgctgaacagcgacctgaaccccaccaagaacagcggccccgagatcgtgcacgccagcagatgcgagaagtacgtggagaccaagtgcccccacgaggccgcctacgacgccttcctgtgcggcagcgtgctgctgaaggtggcccacctgctgctgcagaagatctaccacatcgaccccgtgcccgagagcagcttcccccagtacctggacgtgctggccccctacgtgaaccaggtgaacctgatcagagccggcgtgcccaagatcaacttcagcggccccgactaccccagcatcagaccccccatcctgatcctgagcgtgaagagatggcccggcgtgagcgagcagcaggtgtaccacaagttccagaacctgtgcaagttcgacgtgagaagactgaccagaagccagttcctgctgctgaccaacaagttcaaggacgccagaaacatcctgaaggagtacagagaccaccccaccctgtgcatcagcctgtacagatactggagacacagccccaacgtgaactgcctgctgcaggtgtgcggcatcgtgaccgcctgggccctgctggccttcatcctgggcagaagcggcacctag

SEQ ID NO: 20935 - DNA, 792 bp, Artificial Sequence
  Description of Artificial Sequence: Synthetic coding sequence
atggacaacagctggagactgggccccgccatcggcctgagcgccggccagagccagctgctggtgagcctgctgctgctgctgaccagagtgcagcccggcaccgacgtggccgcccccgagcacatcagctacgtgccccagctgagcaacgacaccctggccggcagactgaccctgagcaccttcaccctggagcagcccctgggccagttcagcagccacaacatcagcgacctggacaccatctggctggtggtggccctgagcaacgccacccagagcttcaccgcccccagaaccaaccaggacatccccgcccccgccaacttcagccagagaggctactacctgaccctgagagccaacagagtgctgtaccagaccagaggccagctgcacgtgctgagagtgggcaacgacacccactgccagcccaccaagatcggctgcaaccaccccctgcccggccccggcccctacagagtgaagttcctggtgatgaacgacgagggccccgtggccgagaccaagtggagcagcgacaccagactgcagcaggcccaggccctgagagccgtgcccggcccccagagccccggcaccgtggtgatcatcgccatcctgagcatcctgctggccgtgctgctgaccgtgctgctggccgtgctgatctacacctgcttcaacagctgcagaagcaccagcctgagcggccccgaggaggccggcagcgtgagaagatacaccacccacctggccttcagcacccccgccgagggcgccagctag

SEQ ID NO: 20936 - DNA, 2352 bp, Artificial Sequence
  Description of Artificial Sequence: Synthetic coding sequence
atggccgcctgcagatactgctgcagctgcctgagactgagacccctgagcgacggccccttcctgctgcccagaagagacagagccctgacccagctgcaggtgagagccctgtggagcagcgccggcagcagagccgtggccgtggacctgggcaacagaaagctggagatcagcagcggcaagctggccagattcgccgacggcagcgccgtggtgcagagcggcgacaccgccgtgatggtgaccgccgtgagcaagaccaagcccagccccagccagttcatgcccctggtggtggactacagacagaaggccgccgccgccggcagaatccccaccaactacctgagaagagagatcggcaccagcgacaaggagatcctgaccagcagaatcatcgacagaagcatcagacccctgttccccgccggctacttctacgacacccaggtgctgtgcaacctgctggccgtggacggcgtgaacgagcccgacgtgctggccatcaacggcgccagcgtggccctgagcctgagcgacatcccctggaacggccccgtgggcgccgtgagaatcggcatcatcgacggcgagtacgtggtgaaccccaccagaaaggagatgagcagcagcaccctgaacctggtggtggccggcgcccccaagagccagatcgtgatgctggaggccagcgccgagaacatcctgcagcaggacttctgccacgccatcaaggtgggcgtgaagtacacccagcagatcatccagggcatccagcagctggtgaaggagaccggcgtgaccaagagaaccccccagaagctgttcacccccagccccgagatcgtgaagtacacccacaagctggccatggagagactgtacgccgtgttcaccgactacgagcacgacaaggtgagcagagacgaggccgtgaacaagatcagactggacaccgaggagcagctgaaggagaagttccccgaggccgacccctacgagatcatcgagagcttcaacgtggtggccaaggaggtgttcagaagcatcgtgctgaacgagtacaagagatgcgacggcagagacctgaccagcctgagaaacgtgagctgcgaggtggacatgttcaagaccctgcacggcagcgccctgttccagagaggccagacccaggtgctgtgcaccgtgaccttcgacagcctggagagcggcatcaagagcgaccaggtgatcaccgccatcaacggcatcaaggacaagaacttcatgctgcactacgagttccccccctacgccaccaacgagatcggcaaggtgaccggcctgaacagaagagagctgggccacggcgccctggccgagaaggccctgtaccccgtgatccccagagacttccccttcaccatcagagtgaccagcgaggtgctggagagcaacggcagcagcagcatggccagcgcctgcggcggcagcctggccctgatggacagcggcgtgcccatcagcagcgccgtggccggcgtggccatcggcctggtgaccaagaccgaccccgagaagggcgagatcgaggactacagactgctgaccgacatcctgggcatcgaggactacaacggcgacatggacttcaagatcgccggcaccaacaagggcatcaccgccctgcaggccgacatcaagctgcccggcatccccatcaagatcgtgatggaggccatccagcaggccagcgtggccaagaaggagatcctgcagatcatgaacaagaccatcagcaagcccagagccagcagaaaggagaacggccccgtggtggagaccgtgcaggtgcccctgagcaagagagccaagttcgtgggccccggcggctacaacctgaagaagctgcaggccgagaccggcgtgaccatcagccaggtggacgaggagaccttcagcgtgttcgcccccacccccagcgccatgcacgaggccagagacttcatcaccgagatctgcaaggacgaccaggagcagcagctggagttcggcgccgtgtacaccgccaccatcaccgagatcagagacaccggcgtgatggtgaagctgtaccccaacatgaccgccgtgctgctgcacaacacccagctggaccagagaaagatcaagcaccccaccgccctgggcctggaggtgggccaggagatccaggtgaagtacttcggcagagaccccgccgacggcagaatgagactgagcagaaaggtgctgcagagccccgccaccaccgtggtgagaaccctgaacgacagaagcagcatcgtgatgggcgagcccatcagccagagcagcagcaacagccagtag

SEQ ID NO: 20937 - DNA, 2352 bp, Artificial Sequence; identical to SEQ ID NO: 20936
  Description of Artificial Sequence: Synthetic coding sequence

SEQ ID NO: 20938 - DNA, 2955 bp, Artificial Sequence
  Description of Artificial Sequence: Synthetic coding sequence
atggtgtgcagccccgtgaccgtgagaatcgccccccccgacagaagattcagcagaagcgccatccccgagcagatcatcagcagcaccctgagcagccccagcagcaacgcccccgacccctgcgccaaggagaccgtgctgagcgccctgaaggagaaggagaagaagagaaccgtggaggaggaggaccagatcttcctggacggccaggagaacaagagaagaagacacgacagcagcggcagcggccacagcgccttcgagcccctggtggccaacggcgtgcccgccagcttcgtgcccaagcccggcagcctgaagagaggcctgaacagccagagcagcgacgaccacctgaacaagagaagcagaagcagcagcatgagcagcctgaccggcgcctacgccagcggcatccccagcagcagcagaaacgccatcaccagcagctacagcagcaccagaggcatcagccagctgtggaagagaaacggccccagcagcagccccttcagcagccccgccagcagcagaagccagacccccgagagacccgccaagaagatcagagaggaggagctgtgccaccacagcagcagcagcacccccctggccgccgacagagagagccagggcgagaaggccgccgacaccacccccagaaagaagcagaacagcaacagccagagcacccccggcagcagcggccagagaaagagaaaggtgcagctgctgcccagcagaagaggcgagcagctgaccctgcccccccccccccagctgggctacagcatcaccgccgaggacctggacctggagaagaaggccagcctgcagtggttcaaccaggccctggaggacaagagcgacgccgccagcaacagcgtgaccgagaccccccccatcacccagcccagcttcaccttcaccctgcccgccgccgcccccgccagcccccccaccagcctgctggcccccagcaccaaccccctgctggagagcctgaagaagatgcagaccccccccagcctgcccccctgccccgagagcgccggcgccgccaccaccgaggccctgagcccccccaagacccccagcctgctgccccccctgggcctgagccagagcggcccccccggcctgctgcccagccccagcttcgacagcaagccccccaccaccctgctgggcctgatccccgcccccagcatggtgcccgccaccgacaccaaggccccccccaccctgcaggccgagaccgccaccaagccccaggccaccagcgcccccagccccgcccccaagcagagcttcctgttcggcacccagaacaccagccccagcagccccgccgcccccgccgccagcagcgccccccccatgttcaagcccatcttcaccgccccccccaagagcgagaaggagggccccaccccccccggccccagcgtgaccgccaccgcccccagcagcagcagcctgcccaccaccaccagcaccaccgcccccaccttccagcccgtgttcagcagcatgggcccccccgccagcgtgcccctgcccgcccccttcttcaagcagaccaccacccccgccaccgcccccaccaccaccgcccccctgttcaccggcctggccagcgccaccagcgccgtggcccccatcaccagcgccagccccagcaccgacagcgccagcaagcccgccttcggcttcggcatcaacagcgtgagcagcagcagcgtgagcaccaccaccagcaccgccaccgccgccagccagcccttcctgttcggcgccccccaggccagcgccgccagcttcacccccgccatgggcagcatcttccagttcggcaagccccccgccctgcccaccaccaccaccgtgaccaccttcagccagagcctgcacaccgccgtgcccaccgccaccagcagcagcgccgccgacttcagcggcttcggcagcaccctggccaccagcgcccccgccaccagcagccagcccaccctgaccttcagcaacaccagcacccccaccttcaacatccccttcggcagcagcgccaagagccccctgcccagctaccccggcgccaacccccagcccgccttcggcgccgccgagggccagccccccggcgccgccaagcccgccctggcccccagcttcggcagcagcttcaccttcggcaacagcgccgcccccgccgccgcccccacccccgccccccccagcatgatcaaggtggtgcccgcctacgtgcccacccccatccaccccatcttcggcggcgccacccacagcgccttcggcctgaaggccaccgccagcgccttcggcgcccccgccagcagccagcccgccttcggcggcagcaccgccgtgttcttcggcgccgccaccagcagcggcttcggcgccaccacccagaccgccagcagcggcagcagcagcagcgtgttcggcagcaccacccccagccccttcaccttcggcggcagcgccgcccccgccggcagcggcagcttcggcatcaacgtggccacccccggcagcagcaccaccaccggcgccttcagcttcggcgccggccagagcggcagcaccgccaccagcacccccttcgccggcggcctgggccagaacgccctgggcaccaccggccagagcacccccttcgccttcaacgtgagcagcaccaccgagagcaagcccgtgttcggcggcaccgccacccccaccttcggcctgaacacccccgcccccggcgtgggcaccagcggcagcagcctgagcttcggcgccagcagcgcccccgcccagggcttcgtgggcgtggcccccttcggcagcgccgccctgagcttcagcatcggcgccggcagcaagacccccggcgccagacagagactgcaggccagaagacagcacaccagaaagaagtag

SEQ ID NO: 20939 - DNA, 2955 bp, Artificial Sequence; identical to SEQ ID NO: 20938
  Description of Artificial Sequence: Synthetic coding sequence

SEQ ID NO: 20940 - DNA, 3000 bp, Artificial Sequence
  Description of Artificial Sequence: Synthetic coding sequence
atggtgtgcagccccgtgaccgtgagaatcgccccccccgacagaagattcagcagaagcgccatccccgagcagatcatcagcagcaccctgagcagccccagcagcaacgcccccgacccctgcgccaaggagaccgtgctgagcgccctgaaggagaaggagaagaagagaaccgtggaggaggaggaccagatcttcctggacggccaggagaacaagagaagaagacacgacagcagcggcagcggccacagcgccttcgagcccctggtggccaacggcgtgcccgccagcttcgtgcccaagcccggcagcctgaagagaggcctgaacagccagagcagcgacgaccacctgaacaagagaagcagaagcagcagcatgagcagcctgaccggcgcctacgccagcggcatccccagcagcagcagaaacgccatcaccagcagctacagcagcaccagaggcatcagccagctgtggaagagaaacggccccagcagcagccccttcagcagccccgccagcagcagaagccagacccccgagagacccgccaagaagatcagagaggaggagctgtgccaccacagcagcagcagcacccccctggccgccgacagagagagccagggcgagaaggccgccgacaccacccccagaaagaagcagaacagcaacagccagagcacccccggcagcagcggccagagaaagagaaaggtgcagctgctgcccagcagaagaggcgagcagctgaccctgcccccccccccccagctgggctacagcatcaccgccgaggacctggacctggagaagaaggccagcctgcagtggttcaaccaggccctggaggacaagagcgacgccgccagcaacagcgtgaccgagaccccccccatcacccagcccagcttcaccttcaccctgcccgccgccgcccccgccagcccccccaccagcctgctggcccccagcaccaaccccctgctggagagcctgaagaagatgcagaccccccccagcctgcccccctgccccgagagcgccggcgccgccaccaccgaggccctgagcccccccaagacccccagcctgctgccccccctgggcctgagccagagcggcccccccggcctgctgcccagccccagcttcgacagcaagccccccaccaccctgctgggcctgatccccgcccccagcatggtgcccgccaccgacaccaaggccccccccaccctgcaggccgagaccgccaccaagccccaggccaccagcgcccccagccccgcccccaagcagagcttcctgttcggcacccagaacaccagccccagcagccccgccgcccccgccgccagcagcgccccccccatgttcaagcccatcttcaccgccccccccaagagcgagaaggagggccccaccccccccggccccagcgtgaccgccaccgcccccagcagcagcagcctgcccaccaccaccagcaccaccgcccccaccttccagcccgtgttcagcagcatgggcccccccgccagcgtgcccctgcccgcccccttcttcaagcagaccaccacccccgccaccgcccccaccaccaccgcccccctgttcaccggcctggccagcgccaccagcgccgtggcccccatcaccagcgccagccccagcaccgacagcgccagcaagcccgccttcggcttcggcatcaacagcgtgagcagcagcagcgtgagcaccaccaccagcaccgccaccgccgccagccagcccttcctgttcggcgccccccaggccagcgccgccagcttcacccccgccatgggcagcatcttccagttcggcaagccccccgccctgcccaccaccaccaccgtgaccaccttcagccagagcctgcacaccgccgtgcccaccgccaccagcagcagcgccgccgacttcagcggcttcggcagcaccctggccaccagcgcccccgccaccagcagccagcccaccctgaccttcagcaacaccagcacccccaccttcaacatccccttcggcagcagcgccaagagccccctgcccagctaccccggcgccaacccccagcccgccttcggcgccgccgagggccagccccccggcgccgccaagcccgccctggcccccagcttcggcagcagcttcaccttcggcaacagcgccgcccccgccgccgcccccacccccgccccccccagcatgatcaaggtggtgcccgcctacgtgcccacccccatccaccccatcttcggcggcgccacccacagcgccttcggcctgaaggccaccgccagcgccttcggcgcccccgccagcagccagcccgccttcggcggcagcaccgccgtgttcttcggcgccgccaccagcagcggcttcggcgccaccacccagaccgccagcagcggcagcagcagcagcgtgttcggcagcaccacccccagccccttcaccttcggcggcagcgccgcccccgccggcagcggcagcttcggcatcaacgtggccacccccggcagcagcaccaccaccggcgccttcagcttcggcgccggccagagcggcagcaccgccaccagcacccccttcgccggcggcctgggccagaacgccctgggcaccaccggccagagcacccccttcgccttcaacgtgagcagcaccaccgagagcaagcccgtgttcggcggcaccgccacccccaccttcggcctgaacacccccgcccccggcgtgggcaccagcggcagcagcctgagcttcggcgccagcagcgcccccgcccagggcttcgtgggcgtggcccccttcggcaacaccttcgcccaccagcaggagcacagccccagaaagggccccaacaacctgagcaagagaaagctgctgcccgccgtgagagcccagggcctgcccagaagaggccaggccagcagcttccccaccagaaaggagtag

SEQ ID NO: 20941 - DNA, 3750 bp, Artificial Sequence
  Description of Artificial Sequence: Synthetic coding sequence
atgagccccgccgccgccgccgccggcgccggcgagagaagaagacccatcgccagcgtgagagacggcagaggcagaggctgcggcggccccgccagagccgtgctgctgggcctgagcctggtgggcctgctgctgtacctggtgcccgccgccgccgccctggcctggctgaccgtgggcgccaccgccgcctggtggggcctgagcagagagcccagaggcagcagacccctgagcagcttcgtgagaaaggccagacacagaagacccctgagcagcttcgtgagaaaggccagacacagaagaaccctgttcgccagccccctggccaagagcaccgccaacggcaacctgctggagcccagaaccctgctggagggccccgaccccgccgagctgctgctgatgggcagctacctgggcaagcccggccccccccagcccgccgccgcccccgagggccaggacctgagagacagacccggcagaagaccccccgccagacccgcccccagaagccccccccccagaagccccccccccagaagccccccccccagcccccccacccacagagcccaccacgtgtaccccagcctgcccacccccctgctgagacccagcagaagacccagccccagagactgcggcaccctgcccaacagattcgtgatcacccccagaagaagataccccatccaccaggcccagtacagctgcctgggcgtgctgcccaccgtgtgctggaacggctaccacaagaaggccgtgctgagccccagaaacagcagaatggtgtgcagccccgtgaccgtgagaatcgccccccccgacagaagattcagcagaagcgccatccccgagcagatcatcagcagcaccctgagcagccccagcagcaacgcccccgacccctgcgccaaggagaccgtgctgagcgccctgaaggagaaggagaagaagagaaccgtggaggaggaggaccagatcttcctggacggccaggagaacaagagaagaagacacgacagcagcggcagcggccacagcgccttcgagcccctggtggccaacggcgtgcccgccagcttcgtgcccaagcccggcagcctgaagagaggcctgaacagccagagcagcgacgaccacctgaacaagagaagcagaagcagcagcatgagcagcctgaccggcgcctacgccagcggcatccccagcagcagcagaaacgccatcaccagcagctacagcagcaccagaggcatcagccagctgtggaagagaaacggccccagcagcagccccttcagcagccccgccagcagcagaagccagacccccgagagacccgccaagaagatcagagaggaggagctgtgccaccacagcagcagcagcacccccctggccgccgacagagagagccagggcgagaaggccgccgacaccacccccagaaagaagcagaacagcaacagccagagcacccccggcagcagcggccagagaaagagaaaggtgcagctgctgcccagcagaagaggcgagcagctgaccctgcccccccccccccagctgggctacagcatcaccgccgaggacctggacctggagaagaaggccagcctgcagtggttcaaccaggccctggaggacaagagcgacgccgccagcaacagcgtgaccgagaccccccccatcacccagcccagcttcaccttcaccctgcccgccgccgcccccgccagcccccccaccagcctgctggcccccagcaccaaccccctgctggagagcctgaagaagatgcagaccccccccagcctgcccccctgccccgagagcgccggcgccgccaccaccgaggccctgagcccccccaagacccccagcctgctgccccccctgggcctgagccagagcggcccccccggcctgctgcccagccccagcttcgacagcaagccccccaccaccctgctgggcctgatccccgcccccagcatggtgcccgccaccgacaccaaggccccccccaccctgcaggccgagaccgccaccaagccccaggccaccagcgcccccagccccgcccccaagcagagcttcctgttcggcacccagaacaccagccccagcagccccgccgcccccgccgccagcagcgccccccccatgttcaagcccatcttcaccgccccccccaagagcgagaaggagggccccaccccccccggccccagcgtgaccgccaccgcccccagcagcagcagcctgcccaccaccaccagcaccaccgcccccaccttccagcccgtgttcagcagcatgggcccccccgccagcgtgcccctgcccgcccccttcttcaagcagaccaccacccccgccaccgcccccaccaccaccgcccccctgttcaccggcctggccagcgccaccagcgccgtggcccccatcaccagcgccagccccagcaccgacagcgccagcaagcccgccttcggcttcggcatcaacagcgtgagcagcagcagcgtgagcaccaccaccagcaccgccaccgccgccagccagcccttcctgttcggcgccccccaggccagcgccgccagcttcacccccgccatgggcagcatcttccagttcggcaagccccccgccctgcccaccaccaccaccgtgaccaccttcagccagagcctgcacaccgccgtgcccaccgccaccagcagcagcgccgccgacttcagcggcttcggcagcaccctggccaccagcgcccccgccaccagcagccagcccaccctgaccttcagcaacaccagcacccccaccttcaacatccccttcggcagcagcgccaagagccccctgcccagctaccccggcgccaacccccagcccgccttcggcgccgccgagggccagccccccggcgccgccaagcccgccctggcccccagcttcggcagcagcttcaccttcggcaacagcgccgcccccgccgccgcccccacccccgccccccccagcatgatcaaggtggtgcccgcctacgtgcccacccccatccaccccatcttcggcggcgccacccacagcgccttcggcctgaaggccaccgccagcgccttcggcgcccccgccagcagccagcccgccttcggcggcagcaccgccgtgttcttcggcgccgccaccagcagcggcttcggcgccaccacccagaccgccagcagcggcagcagcagcagcgtgttcggcagcaccacccccagccccttcaccttcggcggcagcgccgcccccgccggcagcggcagcttcggcatcaacgtggccacccccggcagcagcaccaccaccggcgccttcagcttcggcgccggccagagcggcagcaccgccaccagcacccccttcgccggcggcctgggccagaacgccctgggcaccaccggccagagcacccccttcgccttcaacgtgagcagcaccaccgagagcaagcccgtgttcggcggcaccgccacccccaccttcggcctgaacacccccgcccccggcgtgggcaccagcggcagcagcctgagcttcggcgccagcagcgcccccgcccagggcttcgtgggcgtggcccccttcggcagcgccgccctgagcttcagcatcggcgccggcagcaagacccccggcgccagacagagactgcaggccagaagacagcacaccagaaagaagtag

SEQ ID NO: 20942 - DNA, 3000 bp, Artificial Sequence; identical to SEQ ID NO: 20940
  Description of Artificial Sequence: Synthetic coding sequence

SEQ ID NO: 20943 - DNA, 3690 bp, Artificial Sequence
  Description of Artificial Sequence: Synthetic coding sequence
atgagccccgccgccgccgccgccggcgccggcgagagaagaagacccatcgccagcgtgagagacggcagaggcagaggctgcggcggccccgccggcgccgccctgctgggcctgagcctggtgggcctgctgctgtacctggtgcccgccgccgccgccctggcctggctggccgtgggcaccaccgccgcctggtggggcctgagcagagagcccagaggcagcagacccctgagcagcttcgtgcagaaggccagacacagaagaaccctgttcgccagcccccccgccaagagcaccgccaacggcaacctgctggagcccagaaccctgctggagggccccgaccccgccgagctgctgctgatgggcagctacctgggcaagcccggccccccccagcccgcccccgcccccgagggccaggacctgagaaacagacccggcagaagaccccccgccagacccgcccccagaagcaccccccccagcccccccacccacagagtgcaccacttctaccccagcctgcccacccccctgctgagacccagcggcagacccagccccagagacagaggcaccctgcccgacagattcgtgatcacccccagaagaagataccccatccaccagacccagtacagctgccccggcgtgctgcccaccgtgtgctggaacggctaccacaagaaggccgtgctgagccccagaaacagcagaatggtgtgcagccccgtgaccgtgagaatcgccccccccgacagaagattcagcagaagcgccatccccgagcagatcatcagcagcaccctgagcagccccagcagcaacgcccccgacccctgcgccaaggagaccgtgctgagcgccctgaaggagaagaagaagaagagaaccgtggaggaggaggaccagatcttcctggacggccaggagaacaagagaagaagacacgacagcagcggcagcggccacagcgccttcgagcccctggtggccagcggcgtgcccgccagcttcgtgcccaagcccggcagcctgaagagaggcctgaacagccagagcagcgacgaccacctgaacaagagaagcagaagcagcagcatgagcagcctgaccggcgcctacaccagcggcatccccagcagcagcagaaacgccatcaccagcagctacagcagcaccagaggcatcagccagctgtggaagagaaacggccccagcagcagccccttcagcagccccgccagcagcagaagccagacccccgagagacccgccaagaagatcagagaggaggagctgtgccaccacagcagcagcagcacccccctggccgccgacaaggagagccagggcgagaaggccgccgacaccacccccagaaagaagcagaacagcaacagccagagcacccccggcagcagcggccagagaaagagaaaggtgcagctgctgcccagcagaagaggcgagcagctgaccctgcccccccccccccagctgggctacagcatcaccgccgaggacctggacctggagaagaaggccagcctgcagtggttcaaccaggccctggaggacaagagcgacgccgccagcaacagcgtgaccgagaccccccccaccacccagcccagcttcaccttcaccctgcccgccgccgccaccgccagcccccccaccagcctgctggcccccagcaccaaccccctgctggagagcctgaagaagatgcagaccccccccagcctgcccccctgccccgagagcgccggcgccgccaccaccgaggccctgagcccccccaagacccccagcctgctgccccccctgggcctgagccagagcggcccccccggcctgctgcccagccccagcttcgacagcaagccccccaccaccctgctgggcctgatccccgcccccagcatggtgcccgccaccgacaccaaggccccccccaccctgcaggccgagaccgccaccaagccccaggccaccagcgcccccagccccgcccccaagcagagcttcctgttcggcacccagaacaccagccccagcagccccgccgcccccgccgccagcagcgccagccccatgttcaagcccatcttcaccgccccccccaagagcgagaaggagggccccaccccccccggccccagcgtgaccgccaccgcccccagcagcagcagcctgcccaccaccaccagcaccaccgcccccaccttccagcccgtgttcagcagcatgggcccccccgccagcgtgcccctgcccgcccccttcttcaagcagaccaccacccccgccaccgcccccaccaccaccgcccccctgttcaccggcctggccagcgccaccagcgccgtggcccccatcaccagcgccagccccagcaccgacagcgccagcaagcccgccttcggcttcggcatcaacagcgtgagcagcagcagcgtgagcaccaccaccagcaccgccaccgccgccagccagcccttcctgttcggcgccccccaggccagcgccgccagcttcacccccgccatgggcagcatcttccagttcggcaagccccccgccctgcccaccaccaccaccgtgaccaccttcagccagagcctgcccaccgccgtgcccaccgccaccagcagcagcgccgccgacttcagcggcttcggcagcaccctggccaccagcgcccccgccaccagcagccagcccaccctgaccttcagcaacaccagcacccccaccttcaacatccccttcggcagcagcgccaagagccccctgcccagctaccccggcgccaacccccagcccgccttcggcgccgccgagggccagccccccggcgccgccaagcccgccctgacccccagcttcggcagcagcttcaccttcggcaacagcgccgcccccgcccccgccaccgcccccacccccgcccccgccagcaccatcaagatcgtgcccgcccacgtgcccacccccatccagcccaccttcggcggcgccacccacagcgccttcggcctgaaggccaccgccagcgccttcggcgcccccgccagcagccagcccgccttcggcggcagcaccgccgtgttcagcttcggcgccgccaccagcagcggcttcggcgccaccacccagaccgccagcagcggcagcagcagcagcgtgttcggcagcaccacccccagccccttcaccttcggcggcagcgccgcccccgccggcagcggcagcttcggcatcaacgtggccacccccggcagcagcgccaccaccggcgccttcagcttcggcgccggccagagcggcagcaccgccaccagcacccccttcaccggcggcctgggccagaacgccctgggcaccaccggccagagcacccccttcgccttcaacgtgggcagcaccaccgagagcaagcccgtgttcggcggcaccgccacccccaccttcggccagaacacccccgcccccggcgtgggcaccagcggcagcagcctgagcttcggcgccagcagcgcccccgcccagggcttcgtgggcgtgggccccttcggcagcgccgcccccagcttcagcatcggcgccggcagcaagacccccggcgccagacagagactgcaggccagaagacagcacaccagaaagaagtag

SEQ ID NO: 20944 - DNA, 129 bp, Artificial Sequence
  Description of Artificial Sequence: Synthetic coding sequence
atggtgtgcagccccgtgaccgtgagaatcgccccccccgacagaagattcagcagaagcgccatccccgagcagatcatcagcagcaccctgagcagccccagcagcaacgcccccgacccctgctag

SEQ ID NO: 20945 - DNA, 2964 bp, Artificial Sequence
  Description of Artificial Sequence: Synthetic coding sequence
atggtgtgcagccccgtgaccgtgagaatcgccccccccgacagaagattcagcagaagcgccatccccgagcagatcatcagcagcaccctgagcagccccagcagcaacgcccccgacccctgcgccaaggagaccgtgctgagcgccctgaaggagaagaagaagaagagaaccgtggaggaggaggaccagatcttcctggacggccaggagaacaagagaagaagacacgacagcagcggcagcggccacagcgccttcgagcccctggtggccagcggcgtgcccgccagcttcgtgcccaagcccggcagcctgaagagaggcctgaacagccagagcagcgacgaccacctgaacaagagaagcagaagcagcagcatgagcagcctgaccggcgcctacaccagcggcatccccagcagcagcagaaacgccatcaccagcagctacagcagcaccagaggcatcagccagctgtggaagagaaacggccccagcagcagccccttcagcagccccgccagcagcagaagccagacccccgagagacccgccaagaagatcagagaggaggagctgtgccaccacagcagcagcagcacccccctggccgccgacaaggagagccagggcgagaaggccgccgacaccacccccagaaagaagcagaacagcaacagccagagcacccccggcagcagcggccagagaaagagaaaggtgcagctgctgcccagcagaagaggcgagcagctgaccctgcccccccccccccagctgggctacagcatcaccgccgaggacctggacctggagaagaaggccagcctgcagtggttcaaccaggccctggaggacaagagcgacgccgccagcaacagcgtgaccgagaccccccccaccacccagcccagcttcaccttcaccctgcccgccgccgccaccgccagcccccccaccagcctgctggcccccagcaccaaccccctgctggagagcctgaagaagatgcagaccccccccagcctgcccccctgccccgagagcgccggcgccgccaccaccgaggccctgagcccccccaagacccccagcctgctgccccccctgggcctgagccagagcggcccccccggcctgctgcccagccccagcttcgacagcaagccccccaccaccctgctgggcctgatccccgcccccagcatggtgcccgccaccgacaccaaggccccccccaccctgcaggccgagaccgccaccaagccccaggccaccagcgcccccagccccgcccccaagcagagcttcctgttcggcacccagaacaccagccccagcagccccgccgcccccgccgccagcagcgccagccccatgttcaagcccatcttcaccgccccccccaagagcgagaaggagggccccaccccccccggccccagcgtgaccgccaccgcccccagcagcagcagcctgcccaccaccaccagcaccaccgcccccaccttccagcccgtgttcagcagcatgggcccccccgccagcgtgcccctgcccgcccccttcttcaagcagaccaccacccccgccaccgcccccaccaccaccgcccccctgttcaccggcctggccagcgccaccagcgccgtggcccccatcaccagcgccagccccagcaccgacagcgccagcaagcccgccttcggcttcggcatcaacagcgtgagcagcagcagcgtgagcaccaccaccagcaccgccaccgccgccagccagcccttcctgttcggcgccccccaggccagcgccgccagcttcacccccgccatgggcagcatcttccagttcggcaagccccccgccctgcccaccaccaccaccgtgaccaccttcagccagagcctgcccaccgccgtgcccaccgccaccagcagcagcgccgccgacttcagcggcttcggcagcaccctggccaccagcgcccccgccaccagcagccagcccaccctgaccttcagcaacaccagcacccccaccttcaacatccccttcggcagcagcgccaagagccccctgcccagctaccccggcgccaacccccagcccgccttcggcgccgccgagggccagccccccggcgccgccaagcccgccctgacccccagcttcggcagcagcttcaccttcggcaacagcgccgcccccgcccccgccaccgcccccacccccgcccccgccagcaccatcaagatcgtgcccgcccacgtgcccacccccatccagcccaccttcggcggcgccacccacagcgccttcggcctgaaggccaccgccagcgccttcggcgcccccgccagcagccagcccgccttcggcggcagcaccgccgtgttcagcttcggcgccgccaccagcagcggcttcggcgccaccacccagaccgccagcagcggcagcagcagcagcgtgttcggcagcaccacccccagccccttcaccttcggcggcagcgccgcccccgccggcagcggcagcttcggcatcaacgtggccacccccggcagcagcgccaccaccggcgccttcagcttcggcgccggccagagcggcagcaccgccaccagcacccccttcaccggcggcctgggccagaacgccctgggcaccaccggccagagcacccccttcgccttcaacgtgggcagcaccaccgagagcaagcccgtgttcggcggcaccgccacccccaccttcggccagaacacccccgcccccggcgtgggcaccagcggcagcagcctgagcttcggcgccagcagcgcccccgcccagggcttcgtgggcgtgggccccttcggcagcgccgcccccagcttcagcatcggcgccggcagcaagacccccggcgccagacagagactgcaggccagaagacagcacaccagaaagaagtag

SEQ ID NO: 20946 - DNA, 948 bp, Artificial Sequence
  Description of Artificial Sequence: Synthetic coding sequence
atgtaccaggtgcccctgcccctggacagagacggcaccctggtgagactgagattcaccatggtggccctggtgaccgtgtgctgccccctggtggccttcctgttctgcatcctgtggagcctgctgttccacttcaaggagaccaccgccacccactgcggcgccaccccctgcagaatgttcagcgccgccagccagcccctggaccccgacggcaccctgttcagactgagattcaccgccatggtgtggtgggccatcaccttccccgtgttcggcttcttcttctgcatcatctggagcctggtgttccacttcgagtacaccgtggccaccgactgcggcgtgcccaactacctgcccagcgtgagcagcgccatcggcggcgaggtgccccagagatacgtgtggagattctgcatcggcctgcacagcgcccccagattcctggtggccttcgcctactggaaccactacctgagctgcaccagcccctgcagctgctacagacccctgtgcagactgaacttcggcctgaacgtggtggagaacctggccctgctggtgctgacctacgtgagcagcagcgaggacttcaccatccacgagaacgccttcatcgtgttcatcgccagcagcctgggccacatgctgctgacctgcatcctgtggagactgaccaagaagcacaccgtgagccaggaggacagaaagagctacagctggaagcagagactgttcatcatcaacttcatcagcttcttcagcgccctggccgtgtacttcagacacaacatgtactgcgaggccggcgtgtacaccatcttcgccatcctggagtacaccgtggtgctgaccaacatggccttccacatgaccgcctggtgggacttcggcaacaaggagctgctgatcaccagccagcccgaggagaagagattctag

SEQ ID NO: 20947 - DNA, 924 bp, Artificial Sequence
  Description of Artificial Sequence: Synthetic coding sequence
atggccagactgggcagcaccggcggcgtgagcggcagagtggtgacccagcacagagacagcgcccccttcctgggcgcccccagactgggcctgagagagctgggccccatcagaggcaccgcccccgagtggcacggcagatggaacgccgccgagagaagcgacaagatgtaccaggtgcccctgcccctggacagagacggcaccctggtgagactgagattcaccatggtggccctggtgaccgtgtgctgccccctggtggccttcctgttctgcatcctgtggagcctgctgttccacttcaaggagaccaccgccacccactgcggcgtgcccaactacctgcccagcgtgagcagcgccatcggcggcgaggtgccccagagatacgtgtggagattctgcatcggcctgcacagcgcccccagattcctggtggccttcgcctactggaaccactacctgagctgcaccagcccctgcagctgctacagacccctgtgcagactgaacttcggcctgaacgtggtggagaacctggccctgctggtgctgacctacgtgagcagcagcgaggacttcaccatccacgagaacgccttcatcgtgttcatcgccagcagcctgggccacatgctgctgacctgcatcctgtggagactgaccaagaagcacaccgacagaaagagctacagctggaagcagagactgttcatcatcaacttcatcagcttcttcagcgccctggccgtgtacttcagacacaacatgtactgcgaggccggcgtgtacaccatcttcgccatcctggagtacaccgtggtgctgaccaacatggccttccacatgaccgcctggtgggacttcggcaacaaggagctgctgatcaccagccagcccgaggagaagagattctag

SEQ ID NO: 20948 - DNA, 948 bp, Artificial Sequence; identical to SEQ ID NO: 20946
  Description of Artificial Sequence: Synthetic coding sequence

SEQ ID NO: 20949 - DNA, 486 bp, Artificial Sequence
  Description of Artificial Sequence: Synthetic coding sequence
atggtggacggcacccagctgagaggcgcccagctgcccgccctgggcgagctgagccacagaagaggcggcgcccccgccctgagagtggccttcctgcacagacccgccctgggcgccagcctgctgggcggcctgagactgctggagcccctgccccagctgcacctgcccgtgttcctgctgagccccgccctgcccccccagctgagaccccagtgcagaggcgagcccagagtggccagcgcccacctgtgcctgctgctgagaggcctgcaccaccccagaaagtgcttccactgcgtgcactgcctgatccccagagcccacgccccccacctgcacagcctggccgtggaccaggaggcccacagcaagagcggcggcagccaggtgctgcagctggagaccgccgccctgcaccaccagctgcacctgctgctgctgggcgccggctgcctgctgagcgcccagcacgtgctgtag

SEQ ID NO: 20950 - DNA, 765 bp, Artificial Sequence
  Description of Artificial Sequence: Synthetic coding sequence
atgtaccaggtgcccctgcccctggacagagacggcaccctggtgagactgagattcaccatggtggccctggtgaccgtgtgctgccccctggtggccttcctgttctgcatcctgtggagcctgctgttccacttcaaggagaccaccgccacccactgcggcgtgcccaactacctgcccagcgtgagcagcgccatcggcggcgaggtgccccagagatacgtgtggagattctgcatcggcctgcacagcgcccccagattcctggtggccttcgcctactggaaccactacctgagctgcaccagcccctgcagctgctacagacccctgtgcagactgaacttcggcctgaacgtggtggagaacctggccctgctggtgctgacctacgtgagcagcagcgaggacttcaccatccacgagaacgccttcatcgtgttcatcgccagcagcctgggccacatgctgctgacctgcatcctgtggagactgaccaagaagcacaccgtgagccaggaggacagaaagagctacagctggaagcagagactgttcatcatcaacttcatcagcttcttcagcgccctggccgtgtacttcagacacaacatgtactgcgaggccggcgtgtacaccatcttcgccatcctggagtacaccgtggtgctgaccaacatggccttccacatgaccgcctggtgggacttcggcaacaaggagctgctgatcaccagccagcccgaggagaagagattctag

SEQ ID NO: 20951 - DNA, 1038 bp, Artificial Sequence
  Description of Artificial Sequence: Synthetic coding sequence
tgaagactgggcctgagagagctgggccccatcagaggcaccgcccccgagtggcacggcagatggaacgccgccgagagaagcgacaagatgtaccaggtgcccctgcccctggacagagacggcaccctggtgagactgagattcaccatggtggccctggtgaccgtgtgctgccccctggtggccttcctgttctgcatcctgtggagcctgctgttccacttcaaggagaccaccgccacccactgcggcgccaccccctgcagaatgttcagcgccgccagccagcccctggaccccgacggcaccctgttcagactgagattcaccgccatggtgtggtgggccatcaccttccccgtgttcggcttcttcttctgcatcatctggagcctggtgttccacttcgagtacaccgtggccaccgactgcggcgtgcccaactacctgcccagcgtgagcagcgccatcggcggcgaggtgccccagagatacgtgtggagattctgcatcggcctgcacagcgcccccagattcctggtggccttcgcctactggaaccactacctgagctgcaccagcccctgcagctgctacagacccctgtgcagactgaacttcggcctgaacgtggtggagaacctggccctgctggtgctgacctacgtgagcagcagcgaggacttcaccatccacgagaacgccttcatcgtgttcatcgccagcagcctgggccacatgctgctgacctgcatcctgtggagactgaccaagaagcacaccgtgagccaggaggacagaaagagctacagctggaagcagagactgttcatcatcaacttcatcagcttcttcagcgccctggccgtgtacttcagacacaacatgtactgcgaggccggcgtgtacaccatcttcgccatcctggagtacaccgtggtgctgaccaacatggccttccacatgaccgcctggtgggacttcggcaacaaggagctgctgatcaccagccagcccgaggagaagagattctag

SEQ ID NO: 20952 - DNA, 624 bp, Artificial Sequence
  Description of Artificial Sequence: Synthetic coding sequence
atgttcagcgccgccagccagcccctggaccccgacggcaccctgttcagactgagattcaccgccatggtgtggtgggccatcaccttccccgtgttcggcttcttcttctgcatcatctggagcctggtgttccacttcgagtacaccgtggccaccgactgcggcgtgagcgccagcagccccgcccccggcagcggccccggccaggaggtggccgtgagagtggagctggacagcggcgaggaggtggaggaccagagagagggcaagggccagggcgacggcggcagagtgggcaagagcgagagcgagatcatccacggcggcagactgagagagaacagaatcaccgtgctgcccgagctggaggacgacgacagaaacgccagagagatgaccggcgccgtggcccacacctgcaacctgagcaccagcggcggcagaagccagtggatcaccagagtgcagttcgagaccagcctgggcaacatggtgaagcccagactgtacaagaagtgcaagaagatcagctgggtgccctggcacgcccccgtggtgcccgccacctgggaggccaaggccggcgagctgctggaggccggcagatggaccttccagtag

SEQ ID NO: 20953 - DNA, 936 bp, Artificial Sequence
  Description of Artificial Sequence: Synthetic coding sequence
atggccagactgggcagcaccggcggcgtgagcggcagagtggtgacccagcacagagacagcgcccccttcctgggcgcccccagactgggcctgagagagctgggccccatcagaggcaccgcccccgagtggcacggcagatggaacgccgccgagagaagcgacaagatgtaccaggtgcccctgcccctggacagagacggcaccctggtgagactgagattcaccatggtggccctggtgaccgtgtgctgccccctggtggccttcctgttctgcatcctgtggagcctgctgttccacttcaaggagaccaccgccacccactgcggcgtgcccaactacctgcccagcgtgagcagcgccatcggcggcgaggtgccccagagatacgtgtggagattctgcatcggcctgcacagcgcccccagattcctggtggccttcgcctactggaaccactacctgagctgcaccagcccctgcagctgctacagacccctgtgcagactgaacttcggcctgaacgtggtggagaacctggccctgctggtgctgacctacgtgagcagcagcgaggacttcaccatccacgagaacgccttcatcgtgttcatcgccagcagcctgggccacatgctgctgacctgcatcctgtggagactgaccaagaagcacaccgtgagccaggaggacagaaagagctacagctggaagcagagactgttcatcatcaacttcatcagcttcttcagcgccctggccgtgtacttcagacacaacatgtactgcgaggccggcgtgtacaccatcttcgccatcctggagtacaccgtggtgctgaccaacatggccttccacatgaccgcctggtgggacttcggcaacaaggagctgctgatcaccagccagcccgaggagaagagattctag

SEQ ID NO: 20954 - DNA, 699 bp, Artificial Sequence
  Description of Artificial Sequence: Synthetic coding sequence
atgtaccaggtgcccctgcccctggacagagacggcaccctggtgagactgagattcaccatggtggccctggtgaccgtgtgctgccccctggtggccttcctgttctgcatcctgtggagcctgctgttccacttcaaggagaccaccgccacccactgcggcgtgcccaactacctgcccagcgtgagcagcgccatcggcggcgaggtgccccagagatacgtgtggagattctgcatcggcctgcacagcgcccccagattcctggtggccttcgcctactggaaccactacctgagctgcaccagcccctgcagctgctacagacccctgtgcagactgaacttcggcctgaacgtggtggagaacctggccctgctggtgctgacctacgtgagcagcagcgaggacttcaccatccacgagaacgccttcatcgtgttcatcgccagcagcctgggccacatgctgctgacctgcatcctgtggagactgaccaagaagcacaccgtgagccaggaggtgagaagcatccccagcggcggcagcaaggccgcccagaagaagatcaaggacatctgcccccaggacagcggcagccaggtgctgcagctggagaccgccgccctgcaccaccagctgcacctgctgctgctgggcgccggctgcctgctgagcgcccagcacgtgctgtag

SEQ ID NO: 20955 - DNA, 171 bp, Artificial Sequence
  Description of Artificial Sequence: Synthetic coding sequence
atgtaccaggtgcccctgcccctggacagagacggcaccctggtgagactgagattcaccatggtggccctggtgaccgtgtgctgccccctggtggccttcctgttctgcatcctgtggagcctgctgttccacttcaaggagaccaccgccacccactgcggcgactag

SEQ ID NO: 20956 - DNA, 963 bp, Artificial Sequence
  Description of Artificial Sequence: Synthetic coding sequence
atggccggcctggccgccagactggtgctgctggccggcgccgccgccctggccagcggcagccagggcgacagagagcccgtgtacagagactgcgtgctgcagtgcgaggagcagaactgcagcggcggcgccctgaaccacttcagaagcagacagcccatctacatgagcctggccggctggacctgcagagacgactgcaagtacgagtgcatgtgggtgaccgtgggcctgtacctgcaggagggccacaaggtgccccagttccacggcaagtggcccttcagcagattcctgttcttccaggagcccgccagcgccgtggccagcttcctgaacggcctggccagcctggtgatgctgtgcagatacagaaccttcgtgcccgccagcagccccatgtaccacacctgcgtggccttcgcctgggtgagcctgaacgcctggttctggagcaccgtgttccacaccagagacaccgacctgaccgagaagatggactacttctgcgccagcaccgtgatcctgcacagcatctacctgtgctgcgtgagaaccgtgggcctgcagcaccccgccgtggtgagcgccttcagagccctgctgctgctgatgctgaccgtgcacgtgagctacctgagcctgatcagattcgactacggctacaacctggtggccaacgtggccatcggcctggtgaacgtggtgtggtggctggcctggtgcctgtggaaccagagaagactgccccacgtgagaaagtgcgtggtggtggtgctgctgctgcagggcctgagcctgctggagctgctggacttcccccccctgttctgggtgctggacgcccacgccatctggcacatcagcaccatccccgtgcacgtgctgttcttcagcttcctggaggacgacagcctgtacctgctgaaggagagcgaggacaagttcaagctggactag

SEQ ID NO: 20957 - DNA, 795 bp, Artificial Sequence
  Description of Artificial Sequence: Synthetic coding sequence
atgagcctggccggctggacctgcagagacgactgcaagtacgagtgcatgtgggtgaccgtgggcctgtacctgcaggagggccacaaggtgccccagttccacggcaagtggcccttcagcagattcctgttcttccaggagcccgccagcgccgtggccagcttcctgaacggcctggccagcctggtgatgctgtgcagatacagaaccttcgtgcccgccagcagccccatgtaccacacctgcgtggccttcgcctgggtgagcctgaacgcctggttctggagcaccgtgttccacaccagagacaccgacctgaccgagaagatggactacttctgcgccagcaccgtgatcctgcacagcatctacctgtgctgcgtgagaaccgtgggcctgcagcaccccgccgtggtgagcgccttcagagccctgctgctgctgatgctgaccgtgcacgtgagctacctgagcctgatcagattcgactacggctacaacctggtggccaacgtggccatcggcctggtgaacgtggtgtggtggctggcctggtgcctgtggaaccagagaagactgccccacgtgagaaagtgcgtggtggtggtgctgctgctgcagggcctgagcctgctggagctgctggacttcccccccctgttctgggtgctggacgcccacgccatctggcacatcagcaccatccccgtgcacgtgctgttcttcagcttcctggaggacgacagcctgtacctgctgaaggagagcgaggacaagttcaagctggactag

SEQ ID NO: 20958 - DNA, 810 bp, Artificial Sequence
  Description of Artificial Sequence: Synthetic coding sequence
atggccggcctggccgccagactggtgctgctggccggcgccgccgccctggccagcggcagccagggcgacagagagcccgtgtacagagactgcgtgctgcagtgcgaggagcagaactgcagcggcggcgccctgaaccacttcagaagcagacagcccatctacatgagcctggccggctggacctgcagagacgactgcaagtacgagtgcatgtgggtgaccgtgggcctgtacctgcaggagggccacaaggtgccccagttccacggcaaggtgagcctgaacgcctggttctggagcaccgtgttccacaccagagacaccgacctgaccgagaagatggactacttctgcgccagcaccgtgatcctgcacagcatctacctgtgctgcgtgagaaccgtgggcctgcagcaccccgccgtggtgagcgccttcagagccctgctgctgctgatgctgaccgtgcacgtgagctacctgagcctgatcagattcgactacggctacaacctggtggccaacgtggccatcggcctggtgaacgtggtgtggtggctggcctggtgcctgtggaaccagagaagactgccccacgtgagaaagtgcgtggtggtggtgctgctgctgcagggcctgagcctgctggagctgctggacttcccccccctgttctgggtgctggacgcccacgccatctggcacatcagcaccatccccgtgcacgtgctgttcttcagcttcctggaggacgacagcctgtacctgctgaaggagagcgaggacaagttcaagctggactag

SEQ ID NO: 20959 - DNA, 900 bp, Artificial Sequence
  Description of Artificial Sequence: Synthetic coding sequence
atggccggcctggccgccagactggtgctgctggccggcgccgccgccctggccagcggcagccagggcgacagagagcccgtgtacagagactgcgtgctgcagtgcgaggagcagaactgcagcggcggcgccctgaaccacttcagaagcagacagcccatctacatgagcctggccggctggacctgcagagacgactgcaagtacgagtgcatgtgggtgaccgtgggcctgtacctgcaggagggccacaaggtgccccagttccacggcaagtggcccttcagcagattcctgttcttccaggagcccgccagcgccgtggccagcttcctgaacggcctggccagcctggtgatgctgtgcagatacagaaccttcgtgcccgccagcagccccatgtaccacacctgcgtggccttcgcctggaagatggactacttctgcgccagcaccgtgatcctgcacagcatctacctgtgctgcgtgagaaccgtgggcctgcagcaccccgccgtggtgagcgccttcagagccctgctgctgctgatgctgaccgtgcacgtgagctacctgagcctgatcagattcgactacggctacaacctggtggccaacgtggccatcggcctggtgaacgtggtgtggtggctggcctggtgcctgtggaaccagagaagactgccccacgtgagaaagtgcgtggtggtggtgctgctgctgcagggcctgagcctgctggagctgctggacttcccccccctgttctgggtgctggacgcccacgccatctggcacatcagcaccatccccgtgcacgtgctgttcttcagcttcctggaggacgacagcctgtacctgctgaaggagagcgaggacaagttcaagctggactag

SEQ ID NO: 20960 - DNA, 819 bp, Artificial Sequence
  Description of Artificial Sequence: Synthetic coding sequence
atgagcagccaggagctggtgaccctgaacgtgggcggcaagatcttcaccaccagattcagcaccatcaagcagttccccgccagcagactggccagaatgctggacggcagagaccaggagttcaagatggtgggcggccagatcttcgtggacagagacggcgacctgttcagcttcatcctggacttcctgagaacccaccagctgctgctgcccaccgagttcagcgactacctgagactgcagagagaggccctgttctacgagctgagaagcctggtggacctgctgaacccctacctgctgcagcccagacccgccctggtggaggtgcacttcctgagcagaaacacccaggccttcttcagagtgttcggcagctgcagcaagaccatcgagatgctgaccggcagaatcaccgtgttcaccgagcagcccagcgcccccacctggaacggcaacttcttccccccccagatgaccctgctgcccctgcccccccagagacccagctaccacgacctggtgttccagtgcggcagcgacagcaccaccgacaaccagaccggcgtgagatacgtgagcatcaagcccgacaacagaaagctggccaacggcaccaacgtgctgggcctgctgatcgacaccctgctgaaggagggcttccacctggtgagcaccagaaccgtgagcagcgaggacaagaccgagtgctacagcttcgagagaatcaagagccccgaggtgctgatcaccaacgagacccccaagcccgagaccatcatcatccccgagcagagccagatcaagaagtag

SEQ ID NO: 20961 - DNA, 690 bp, Artificial Sequence
  Description of Artificial Sequence: Synthetic coding sequence
atgagcagccaggagctggtgaccctgaacgtgggcggcaagatcttcaccaccagattcagcaccatcaagcagttccccgccagcagactggccagaatgctggacggcagagaccaggagttcaagatggtgggcggccagatcttcgtggacagagacggcgacctgttcagcttcatcctggacttcctgagaacccaccagctgctgctgcccaccgagttcagcgactacctgagactgcagagagaggccctgttctacgagctgagaagcctggtggacctgctgaacccctacctgctgcagcccagacccgccctggtggaggtgcacttcctgagcagaaacacccaggccttcttcagagtgttcggcagctgcagcaagaccatcgagatgctgaccggcagaatcaccgtgttcaccgagcagcccagcgcccccacctggaacggcaacttcttccccccccagatgaccctgctgcccctgcccccccagagacccagctaccacgacctggtgttccagtgcggcagcgacagcaccaccgacaaccagaccggcgtgagactggtgtgcaacggcgtgatcagcgcccaccacaacctgagactgtggggcagcagcgacagccccgccagcgccagcagagtggccggcatcaccggcatgttcctgtag

SEQ ID NO: 20962 - DNA, 978 bp, Artificial Sequence
  Description of Artificial Sequence: Synthetic coding sequence
atggccctggccgacagcaccagaggcctgcccaacggcggcggcggcggcggcggcagcggcagcagcagcagcagcgccgagccccccctgttccccgacatcgtggagctgaacgtgggcggccaggtgtacgtgaccagaagatgcaccgtggtgagcgtgcccgacagcctgctgtggagaatgttcacccagcagcagccccaggagctggccagagacagcaagggcagattcttcctggacagagacggcttcctgttcagatacatcctggactacctgagagacctgcagctggtgctgcccgactacttccccgagagaagcagactgcagagagaggccgagtacttcgagctgcccgagctggtgagaagactgggcgccccccagcagcccggccccggccccccccccagcagaagaggcgtgcacaaggagggcagcctgggcgacgagctgctgcccctgggctacagcgagcccgagcagcaggagggcgccagcgccggcgcccccagccccaccctggagctggccagcagaagccccagcggcggcgccgccggccccctgctgacccccagccagagcctggacggcagcagaagaagcggctacatcaccatcggctacagaggcagctacaccatcggcagagacgcccaggccgacgccaagttcagaagagtggccagaatcaccgtgtgcggcaagaccagcctggccaaggaggtgttcggcgacaccctgaacgagagcagagaccccgacagaccccccgagagatacaccagcagatactacctgaagttcaacttcctggagcaggccttcgacaagctgagcgagagcggcttccacatggtggcctgcagcagcaccggcacctgcgccttcgccagcagcaccgaccagagcgaggacaagatctggaccagctacaccgagtacgtgttctgcagagagtag

SEQ ID NO: 20963 - DNA, 978 bp, Artificial Sequence; identical to SEQ ID NO: 20962
  Description of Artificial Sequence: Synthetic coding sequence

SEQ ID NO: 20964 - DNA, 768 bp, Artificial Sequence
  Description of Artificial Sequence: Synthetic coding sequence
atgtggcagggctgcgccgtggagagacccgtgggcagaatgaccagccagacccccctgccccagagccccagacccagaagacccaccatgagcaccgtggtggagctgaacgtgggcggcgagttccacaccaccaccctgggcaccctgagaaagttccccggcagcaagctggccgagatgttcagcagcctggccaaggccagcaccgacgccgagggcagattcttcatcgacagacccagcacctacttcagacccatcctggactacctgagaaccggccaggtgcccacccagcacatccccgaggtgtacagagaggcccagttctacgagatcaagcccctggtgaagctgctggaggacatgccccagatcttcggcgagcaggtgagcagaaagcagttcctgctgcaggtgcccggctacagcgagaacctggagctgatggtgagactggccagagccgaggccatcaccgccagaaagagcagcgtgctggtgtgcctggtggagaccgaggagcaggacgcctactacagcgaggtgctgtgcttcctgcaggacaagaagatgttcaagagcgtggtgaagttcggcccctggaaggccgtgctggacaacagcgacctgatgcactgcctggagatggacatcaaggcccagggctacaaggtgttcagcaagttctacctgacctaccccaccaagagaaacgagttccacttcaacatctacagcttcaccttcacctggtggtag

SEQ ID NO: 20965 - DNA, 678 bp, Artificial Sequence
  Description of Artificial Sequence: Synthetic coding sequence
atgagcaccgtggtggagctgaacgtgggcggcgagttccacaccaccaccctgggcaccctgagaaagttccccggcagcaagctggccgagatgttcagcagcctggccaaggccagcaccgacgccgagggcagattcttcatcgacagacccagcacctacttcagacccatcctggactacctgagaaccggccaggtgcccacccagcacatccccgaggtgtacagagaggcccagttctacgagatcaagcccctggtgaagctgctggaggacatgccccagatcttcggcgagcaggtgagcagaaagcagttcctgctgcaggtgcccggctacagcgagaacctggagctgatggtgagactggccagagccgaggccatcaccgccagaaagagcagcgtgctggtgtgcctggtggagaccgaggagcaggacgcctactacagcgaggtgctgtgcttcctgcaggacaagaagatgttcaagagcgtggtgaagttcggcccctggaaggccgtgctggacaacagcgacctgatgcactgcctggagatggacatcaaggcccagggctacaaggtgttcagcaagttctacctgacctaccccaccaagagaaacgagttccacttcaacatctacagcttcaccttcacctggtggtag

SEQ ID NO: 20966 - DNA, 861 bp, Artificial Sequence
  Description of Artificial Sequence: Synthetic coding sequence
gacgcccagatgccccacagaaaggagagacccagcggcagcagcctgcacacccacggcagcaccggcaccgccgagggcggcaacatgagcagactgagcctgaccagaagccccgtgagccccctggccgcccagggcatccccctgcccgcccagctgaccaagagcaacgcccccgtgcacatcgacgtgggcggccacatgtacaccagcagcctggccaccctgaccaagtaccccgacagcagaatcagcagactgttcaacggcaccgagcccatcgtgctggacagcctgaagcagcactacttcatcgacagagacggcgagatcttcagatacgtgctgagcttcctgagaaccagcaagctgctgctgcccgacgacttcaaggacttcagcctgctgtacgaggaggccagatactaccagctgcagcccatggtgagagagctggagagatggcagcaggagcaggagcagagaagaagaagcagagcctgcgactgcctggtggtgagagtgacccccgacctgggcgagagaatcgccctgagcggcgagaaggccctgatcgaggaggtgttccccgagaccggcgacgtgatgtgcaacagcgtgaacgccggctggaaccaggaccccacccacgtgatcagattccccctgaacggctactgcagactgaacagcgtgcaggtgctggagagactgttccagagaggcttcagcgtggccgccagctgcggcggcggcgtggacagcagccagttcagcgagtacgtgctgtgcagagaggagagaagaccccagcccacccccaccgccgtgagaatcaagcaggagcccctggactag

SEQ ID NO: 20967 - DNA, 852 bp, Artificial Sequence
  Description of Artificial Sequence: Synthetic coding sequence
atgccccacagaaaggagagacccagcggcagcagcctgcacacccacggcagcaccggcaccgccgagggcggcaacatgagcagactgagcctgaccagaagccccgtgagccccctggccgcccagggcatccccctgcccgcccagctgaccaagagcaacgcccccgtgcacatcgacgtgggcggccacatgtacaccagcagcctggccaccctgaccaagtaccccgacagcagaatcagcagactgttcaacggcaccgagcccatcgtgctggacagcctgaagcagcactacttcatcgacagagacggcgagatcttcagatacgtgctgagcttcctgagaaccagcaagctgctgctgcccgacgacttcaaggacttcagcctgctgtacgaggaggccagatactaccagctgcagcccatggtgagagagctggagagatggcagcaggagcaggagcagagaagaagaagcagagcctgcgactgcctggtggtgagagtgacccccgacctgggcgagagaatcgccctgagcggcgagaaggccctgatcgaggaggtgttccccgagaccggcgacgtgatgtgcaacagcgtgaacgccggctggaaccaggaccccacccacgtgatcagattccccctgaacggctactgcagactgaacagcgtgcaggtgctggagagactgttccagagaggcttcagcgtggccgccagctgcggcggcggcgtggacagcagccagttcagcgagtacgtgctgtgcagagaggagagaagaccccagcccacccccaccgccgtgagaatcaagcaggagcccctggactag

SEQ ID NO: 20968 - DNA, 894 bp, Artificial Sequence
  Description of Artificial Sequence: Synthetic coding sequence
atgcagacccccagacccgccatgagaatggaggccggcgaggccgccccccccgccggcgccggcggcagagccgccggcggctggggcaagtgggtgagactgaacgtgggcggcaccgtgttcctgaccaccagacagaccctgtgcagagagcagaagagcttcctgagcagactgtgccagggcgaggagctgcagagcgacagagacgagaccggcgcctacctgatcgacagagaccccacctacttcggccccatcctgaacttcctgagacacggcaagctggtgctggacaaggacatggccgaggagggcgtgctggaggaggccgagttctacaacatcggccccctgatcagaatcatcaaggacagaatggaggagaaggactacaccgtgacccaggtgccccccaagcacgtgtacagagtgctgcagtgccaggaggaggagctgacccagatggtgagcaccatgagcgacggctggagattcgagcagctggtgaacatcggcagcagctacaactacggcagcgaggaccaggccgagttcctgtgcgtggtgagcaaggagctgcacagcacccccaacggcctgagcagcgagagcagcagaaagaccaagagcaccgaggagcagctggaggagcagcagcagcaggaggaggaggtggaggaggtggaggtggagcaggtgcaggtggaggccgacgcccaggagaagggcagcagaccccaccccctgagacccgaggccgagctggccgtgagagccagccccagacccctggccagaccccagagctgccacccctgctgctacaagcccgaggcccccggctgcgaggcccccgaccacctgcagggcctgggcgtgcccatctag

SEQ ID NO: 20969 - DNA, 966 bp, Artificial Sequence
  Description of Artificial Sequence: Synthetic coding sequence
atgcagacccccagacccgccatgagaatggaggccggcgaggccgccccccccgccggcgccggcggcagagccgccggcggctggggcaagtgggtgagactgaacgtgggcggcaccgtgttcctgaccaccagacagaccctgtgcagagagcagaagagcttcctgagcagactgtgccagggcgaggagctgcagagcgacagagacgagaccggcgcctacctgatcgacagagaccccacctacttcggccccatcctgaacttcctgagacacggcaagctggtgctggacaaggacatggccgaggagggcgtgctggaggaggccgagttctacaacatcggccccctgatcagaatcatcaaggacagaatggaggagaaggactacaccgtgacccaggtgccccccaagcacgtgtacagagtgctgcagtgccaggaggaggagctgacccagatggtgagcaccatgagcgacggctggagattcgagcagctggtgaacatcggcagcagctacaactacggcagcgaggaccaggccgagttcctgtgcgtggtgagcaaggagctgcacagcacccccaacggcctgagcagcgagagcagcagaaagaccaagagcaccgaggagcagctggaggagcagcagcagcaggaggaggaggtggaggaggtggaggtggagcaggtgcaggtggaggccgacgcccaggagaaggcccagagcagccaggaccccgccaacctgttcagcctgccccccctgccccccccccccctgcccgccggcggcagcagaccccaccccctgagacccgaggccgagctggccgtgagagccagccccagacccctggccagaccccagagctgccacccctgctgctacaagcccgaggcccccggctgcgaggcccccgaccacctgcagggcctgggcgtgcccatctag

SEQ ID NO: 20970 - DNA, 192 bp, Artificial Sequence
  Description of Artificial Sequence: Synthetic coding sequence
atgaccagcaaggtgagctgcccccccagcgtgaccctgagatgctgcggcctgtggcaggtggccagccccctgaacgtgagcgacctgagcgacgagaccggcgcctacctgatcgacagagaccccacctacttcggccccatcctgaacttcctgagacacggcaagctggtgctggacaaggactag

SEQ ID NO: 20971 - DNA, 543 bp, Artificial Sequence
  Description of Artificial Sequence: Synthetic coding sequence
tgacagaccctgtgcagagagcagaagagcttcctgagcagactgtgccagggcgaggagctgcagagcgacagagacgagaccggcgcctacctgatcgacagagaccccacctacttcggccccatcctgaacttcctgagacacggcaagctggtgctggacaaggacatggccgaggagggcgtgctggaggaggccgagttctacaacatcggccccctgatcagaatcatcaaggacagaatggaggagaaggactacaccgtgacccaggtgccccccaagcacgtgtacagagtgctgcagtgccaggaggaggagctgacccagatggtgagcaccatgagcgacggctggagattcgagcagctggtgaacatcggcagcagctacaactacggcagcgaggaccaggccgagttcctgtgcgtggtgagcaaggagctgcacagcacccccaacggcctgagcagcgagagcagcagaaagaccaaggtgcccgtgagaaccctgagcgacctgagactgagcctgcagtag

SEQ ID NO: 20972 - DNA, 1281 bp, Artificial Sequence
  Description of Artificial Sequence: Synthetic coding sequence
atggagggccacaaggccgaggaggaggtgctggacgtgctgagactgaacgtgggcggctgcatctacaccgccagaagagagagcctgtgcagattcaaggacagcatgctggccagcatgttcagcggcagattccccctgaagaccgacgagagcggcgcctgcgtgatcgacagagacggcagactgttcaagtacctgctggactacctgcacggcgaggtgcagatccccaccgacgagcagaccagaatcgccctgcaggaggaggccgactacttcggcatcccctacccctacagcctgagcgaccacctggccaacgagatggagacctacagcctgagaagcaacatcgagctgaagaaggccctgaccgacttctgcgacagctacggcctggtgtgcaacaagcccaccgtgtgggtgctgcactacctgaacaccagcggcgccagctgcgagagcagaatcatcggcgtgtacgccaccaagaccgacggcaccgacgccatcgagaagcagctgggcggcagaatccacagcaagggcatcttcaagagagaggccggcaacaacgtgcagtacatctggagctactacagcgtggccgagctgaagaagatgatggacgccttcgacgcctgggagggcaagggcgtgagctactggagagtgccccacgagctgatcgagtgctggaccctggaggagagacccctgctgggcagcctgagacacatggcccccatcagaaagagaagactgatcaccttcaacgaggccgacgagagcgtgaactacaagaccggccccaagcccgtgagattcctgggccccagcaccagcacccagatcaaggtgaagaacagcgccagcgtgaccgtgagccccgccagcgccatccagaccagcgccggcgccaccgccaacagattccagagcggcagcagaagaaaggccgcccagagaagcgcccccagcagagccaccgccctggtgggcaccggcgcccccggccacccccaggccagccccggcgccgccagcgccgagaacggcggcacccacctgccccccgccaaggtgctgctgagcgacaagaagcccaccccccagagagtgatcaagctgaagagaacccccctgtgcgccaccgccccctgcctgcccagccccaccgccaccagacaggccaacagcctgaagcccctgcccggcgaggccgccagagccctgggcgtgagaaccgagaacggcaagaacaagggcaactag

SEQ ID NO: 20973 - DNA, 1281 bp, Artificial Sequence; identical to SEQ ID NO: 20972
  Description of Artificial Sequence: Synthetic coding sequence

SEQ ID NO: 20974 - DNA, 2781 bp, Artificial Sequence
  Description of Artificial Sequence: Synthetic coding sequence
atggaggagagcggcatggcccacgagagcgccgaggacctgttccacttcaacgtgggcggctggcacttcagcgtgcccagaagcaagctgagccagttccccgacagcctgctgtggaaggaggccagcgccctgaccagcagcgagagccagagactgttcatcgacagagacggcagcaccttcagacacgtgcactactacctgtacaccagcaagctgagcttcagcagctgcgccgagctgaacctgctgtacgagcaggccctgggcctgcagctgatgcccctgctgcagaccctggacaacctgaaggagggcaagcaccacctgagagtgagacccgccgacctgcccgtggccgagagagccagcctgaactactggagaacctggaagtgcatcagcaagcccagcgagttccccatcaagagccccgccttcaccggcctgcacgacaaggcccccctgggcctgatggacacccccctgctggacaccgaggaggaggtgcactactgcttcctgcccctggacctggtggccaagtaccccagcctggtgaccgaggacaacctgctgtggctggccgagaccgtggccctgatcgagtgcgagtgcagcgagttcagattcatcgtgaacttcctgagaagccagaagatcctgctgcccgacaacttcagcaacatcgacgtgctggaggccgaggtggagatcctggagatccccgccctgaccgaggccgtgagatggtacagaatgaacatgggcggctgcagccccaccacctgcagccccctgagccccggcaagggcgccagaaccgccagcctggagagcgtgaagcccctgtacaccatggccctgggcctgctggtgaagtaccccgacagcgccctgggccagctgagaatcgagagcaccctggacggcagcagactgtacatcaccggcaacggcgtgctgttccagcacgtgaagaactggctgggcacctgcagactgcccctgaccgagaccatcagcgaggtgtacgagctgtgcgccttcctggacaagagagacatcacctacgagcccatcaaggtggccctgaagacccacctggagcccagaaccctggcccccatggacgtgctgaacgagtggaccgccgagatcaccgtgtacagcccccagcagatcatcaaggtgtacgtgggcagccactggtacgccaccaccctgcagaccctgctgaagtaccccgagctgctgagcaacccccagagagtgtactggatcacctacggccagaccctgctgatccacggcgacggccagatgttcagacacatcctgaacttcctgagactgggcaagctgttcctgcccagcgagttcaaggagtggcccctgttctgccaggaggtggaggagtaccacatccccagcctgagcgaggccctggcccagtgcgaggcctacaagagctggacccaggagaaggagagcgagaacgaggaggccttcagcatcagaagactgcacgtggtgaccgagggccccggcagcctggtggagttcagcagagacaccaaggagaccaccgcctacatgcccgtggacttcgaggactgcagcgacagaaccccctggaacaaggccaagggcaacctggtgagaagcaaccagatggacgaggccgagcagtacaccagacccatccaggtgagcctgtgcagaaacgccaagagagccggcaaccccagcacctacagccactgcagaggcctgtgcaccaaccccggccactggggcagccaccccgagagcccccccaagaagaagtgcaccaccatcaacctgacccagaagagcgagaccaaggacccccccgccacccccatgcagaagctgatcagcctggtgagagagtgggacatggtgaactgcaagcagtgggagttccagcccctgaccgccaccagaagcagccccctggaggaggccaccctgcagctgcccctgggcagcgaggccgccagccagcccagcaccagcgccgcctggaaggcccacagcaccgccagcgagaaggaccccggcccccaggccggcgccggcgccggcgccaaggacaagggccccgagcccaccttcaagccctacctgccccccaagagagccggcaccctgaaggactggagcaagcagagaaccaaggagagagagagccccgcccccgagcagcccctgcccgaggccagcgaggtggacagcctgggcgtgatcctgaaggtgacccacccccccgtggtgggcagcgacggcttctgcatgttcttcgaggacagcatcatctacaccaccgagatggacaacctgagacacaccacccccaccgccagcccccagccccaggaggtgaccttcctgagcttcagcctgagctgggaggagatgttctacgcccagaagtgccactgcttcctggccgacatcatcatggacagcatcagacagaaggaccccaaggccatcaccgccaaggtggtgagcctggccaacagactgtggaccctgcacatcagccccaagcagttcgtggtggacctgctggccatcaccggcttcaaggacgacagacacacccaggagagactgtacagctgggtggagctgaccctgcccttcgccagaaagtacggcagatgcatggacctgctgatccagagaggcctgagcagaagcgtgagctacagcatcctgggcaagtacctgcaggaggactag

SEQ ID NO: 20975 - DNA, 1260 bp, Artificial Sequence
  Description of Artificial Sequence: Synthetic coding sequence
atgaacgtgcacagaggcagcgacagcgacagactgctgagacaggaggccagctgcctggtggacgacaccctggccgtggcccaggagaaggaggccaacagcctggccagcagcggcccccacaacctgacctaccccctgggccccagaaacgaggacctgagcctggactacgccagccagcccgccaacctgcagttcccccacatcatgcccctggccgaggacatcaagggcagctgcttccagagcggcaacaagagaaaccacgagcccttcatcgcccccgagagattcggcaacagcagcgtgggcttcggcagcaacagccacagccaggcccccgagaaggtgaccctgctggtggacggcaccagattcgtggtgaacccccagatcttcaccgcccaccccgacaccatgctgggcagaatgttcggccccggcagagagtacaacttcaccagacccaacgagaagggcgagtacgagatcgccgagggcatcagcgccaccgtgttcagaaccgtgctggactactacaagaccggcatcatcaactgccccgacggcatcagcatccccgacctgagagacacctgcgactacctgtgcatcaacttcgacttcaacaccatcagatgccaggacctgagcgccctgctgcacgagctgagcaacgacggcgcccacaagcagttcgaccactacctggaggagctgatcctgcccatcatggtgggctgcgccaagaagggcgagagagagtgccacatcgtggtgctgaccgacgaggacagcgtggactgggacgaggaccaccccccccccatgggcgaggagtacagccagatcctgtacagcagcaagctgtacagattcttcaagtacatcgagaacagagacgtggccaagaccgtgctgaaggagagaggcctgaagaacatcagaatcggcatcgagggctaccccacctgcaaggagaagatcaagagaagacccggcggcagaagcgaggtgatctacaactacgtgcagagacccttcatccagatgagctgggagaaggaggagggcaagagcagacacgtggacttccagtgcgtgagaagcaagagcctgaccaacctggtggccgccggcgacgacgtgctggaggaccaggagatcctgatgcaccaccccccccaggtggacgagctggacagactgaacgcccccctgagccagatggccagcaacgacttccaggactag

SEQ ID NO: 20976 - DNA, 762 bp, Artificial Sequence
  Description of Artificial Sequence: Synthetic coding sequence
atgaacgtgcacagaggcagcgacagcgacagactgctgagacaggaggccagctgcctggtggacgacaccctggccgtggcccaggagaaggaggccaacagcctggccagcagcggcccccacaacctgacctaccccctgggccccagaaacgagggcgccctgctgcacgagctgagcaacgacggcgcccacaagcagttcgaccactacctggaggagctgatcctgcccatcatggtgggctgcgccaagaagggcgagagagagtgccacatcgtggtgctgaccgacgaggacagcgtggactgggacgaggaccaccccccccccatgggcgaggagtacagccagatcctgtacagcagcaagctgtacagattcttcaagtacatcgagaacagagacgtggccaagaccgtgctgaaggagagaggcctgaagaacatcagaatcggcatcgagggctaccccacctgcaaggagaagatcaagagaagacccggcggcagaagcgaggtgatctacaactacgtgcagagacccttcatccagatgagctgggagaaggaggagggcaagagcagacacgtggacttccagtgcgtgagaagcaagagcctgaccaacctggtggccgccggcgacgacgtgctggaggaccaggagatcctgatgcaccaccccccccaggtggacgagctggacagactgaacgcccccctgagccagatggccagcaacgacttccaggactag

SEQ ID NO: 20977 - DNA, 264 bp, Artificial Sequence
  Description of Artificial Sequence: Synthetic coding sequence
atgaacgtgcacagaggcagcgacagcgacagactgctgagacaggaggccagctgcctggtggacgacaccctggccgtggcccaggagaaggaggccaacagcctggccagcagcggcccccacaacctgacctaccccctgggccccagaaacgaggacctgagcctggactacgccagccagcccgccaacctgcagttcccccacatcatgcccctggccgaggacatcaagggcagctgcttccagagcggcaactag

SEQ ID NO: 20978 - DNA, 330 bp, Artificial Sequence
  Description of Artificial Sequence: Synthetic coding sequence
atgaacgtgcacagaggcagcgacagcgacagactgctgagacaggaggccagctgcctggtggacgacaccctggccgtggcccaggagaaggaggccaacagcctggccagcagcggcccccacaacctgacctaccccctgggccccagaaacgaggacctgagcctggactacgccagccagcccgccaacctgcagttcccccacatcatgcccctggccgaggacatcaagggcagctgcttccagagcggcaacaagagaaaccacgagcccttcatcgcccccgagagattcggcaacagcagcgtgggcttcggcagctag

SEQ ID NO: 20979 - DNA, 294 bp, Artificial Sequence
  Description of Artificial Sequence: Synthetic coding sequence
atgaacgtgcacagaggcagcgacagcgacagactgctgagacaggaggccagctgcctggtggacgacaccctggccgtggcccaggagaaggaggccaacagcctggccagcagcggcccccacaacctgacctaccccctgggccccagaaacgaggacctgagcctggactacgccagccagcccgccaacctgcagttcccccacatcatgcccctggccgaggacatcaagggcagctgcttccagagcggcaacaagagaaaccacgagcccttcatcgccccctag

SEQ ID NO: 20980 - DNA, 825 bp, Artificial Sequence
  Description of Artificial Sequence: Synthetic coding sequence
atgttcggccccggcagagagtacaacttcaccagacccaacgagaagggcgagtacgagatcgccgagggcatcagcgccaccgtgttcagaaccgtgctggactactacaagaccggcatcatcaactgccccgacggcatcagcatccccgacctgagagacacctgcgactacctgtgcatcaacttcgacttcaacaccatcagatgccaggacctgagcgccctgctgcacgagctgagcaacgacggcgcccacaagcagttcgaccactacctggaggagctgatcctgcccatcatggtgggctgcgccaagaagggcgagagagagtgccacatcgtggtgctgaccgacgaggacagcgtggactgggacgaggaccaccccccccccatgggcgaggagtacagccagatcctgtacagcagcaagctgtacagattcttcaagtacatcgagaacagagacgtggccaagaccgtgctgaaggagagaggcctgaagaacatcagaatcggcatcgagggctaccccacctgcaaggagaagatcaagagaagacccggcggcagaagcgaggtgatctacaactacgtgcagagacccttcatccagatgagctgggagaaggaggagggcaagagcagacacgtggacttccagtgcgtgagaagcaagagcctgaccaacctggtggccgccggcgacgacgtgctggaggaccaggagatcctgatgcaccaccccccccaggtggacgagctggacagactgaacgcccccctgagccagatggccagcaacgacttccaggactag

SEQ ID NO: 20981 - DNA, 522 bp, Artificial Sequence
  Description of Artificial Sequence: Synthetic coding sequence
atggtgggctgcgccaagaagggcgagagagagtgccacatcgtggtgctgaccgacgaggacagcgtggactgggacgaggaccaccccccccccatgggcgaggagtacagccagatcctgtacagcagcaagctgtacagattcttcaagtacatcgagaacagagacgtggccaagaccgtgctgaaggagagaggcctgaagaacatcagaatcggcatcgagggctaccccacctgcaaggagaagatcaagagaagacccggcggcagaagcgaggtgatctacaactacgtgcagagacccttcatccagatgagctgggagaaggaggagggcaagagcagacacgtggacttccagtgcgtgagaagcaagagcctgaccaacctggtggccgccggcgacgacgtgctggaggaccaggagatcctgatgcaccaccccccccaggtggacgagctggacagactgaacgcccccctgagccagatggccagcaacgacttccaggactag

SEQ ID NO: 20982 - DNA, 783 bp, Artificial Sequence
  Description of Artificial Sequence: Synthetic coding sequence
atgagcgaccccatcaccctgaacgtgggcggcaagctgtacaccaccagcctggccaccctgaccagcttccccgacagcatgctgggcgccatgttcagcggcaagatgcccaccaagagagacagccagggcaactgcttcatcgacagagacggcaaggtgttcagatacatcctgaacttcctgagaaccagccacctggacctgcccgaggacttccaggagatgggcctgctgagaagagaggccgacttctaccaggtgcagcccctgatcgaggccctgcaggagaaggaggtggagctgagcaaggccgagaagaacgccatgctgaacatcaccctgaaccagagagtgcagaccgtgcacttcaccgtgagagaggccccccagatctacagcctgagcagcagcagcatggaggtgttcaacgccaacatcttcagcaccagctgcctgttcctgaagctgctgggcagcaagctgttctactgcagcaacggcaacctgagcagcatcaccagccacctgcaggaccccaaccacctgaccctggactgggtggccaacgtggagggcctgcccgaggaggagtacaccaagcagaacctgaagagactgtgggtggtgcccgccaacaagcagatcaacagcttccaggtgttcgtggaggaggtgctgaagatcgccctgagcgacggcttctgcatcgacagcagccacccccacgccctggacttcatgaacaacaagatcatcagactgatcagatacagatag

SEQ ID NO: 20983 - DNA, 423 bp, Artificial Sequence
  Description of Artificial Sequence: Synthetic coding sequence
atgagcgaccccatcaccctgaacgtgggcggcaagctgtacaccaccagcctggccaccctgaccagcttccccgacagcatgctgggcgccatgttcagcggcaagatgcccaccaagagagacagccagggcaactgcttcatcgacagagacggcaaggtgttcagatacatcctgaacttcctgagaaccagccacctggacctgcccgaggacttccaggagatgggcctgctgagaagagaggccgacttctaccaggtgcagcccctgatcgaggccctgcaggagaaggaggtggagctgagcaaggccgagaagaacgccatgctgaacatcaccctgaaccagagagtgcagaccgtgcacttcaccgtgagagaggccccccagatctacagcctgagcagcagcagctag

SEQ ID NO: 20984 - DNA, 780 bp, Artificial Sequence
  Description of Artificial Sequence: Synthetic coding sequence
atggagagaaagatcaacagaagagagaaggagaaggagtacgagggcaagcacaacagcctggaggacaccgaccagggcaagaactgcaagagcaccctgatgaccctgaacgtgggcggctacctgtacatcacccagaagcagaccctgaccaagtaccccgacaccttcctggagggcatcgtgaacggcaagatcctgtgccccttcgacgccgacggccactacttcatcgacagagacggcctgctgttcagacacgtgctgaacttcctgagaaacggcgagctgctgctgcccgagggcttcagagagaaccagctgctggcccaggaggccgagttcttccagctgaagggcctggccgaggaggtgaagagcagatgggagaaggagcagctgacccccagagagaccaccttcctggagatcaccgacaaccacgacagaagccagggcctgagaatcttctgcaacgcccccgacttcatcagcaagatcaagagcagaatcgtgctggtgagcaagagcagactggacggcttccccgaggagttcagcatcagcagcaacatcatccagttcaagtacttcatcaagagcgagaacggcaccagactggtgctgaaggaggacaacaccttcgtgtgcaccctggagaccctgaagttcgaggccatcatgatggccctgaagtgcggcttcagactgctgaccagcctggactgcagcaagggcagcatcgtgcacagcgacgccctgcacttcatcaagtag

SEQ ID NO: 20985 - DNA, 780 bp, Artificial Sequence; identical to SEQ ID NO: 20984
  Description of Artificial Sequence: Synthetic coding sequence

SEQ ID NO: 20986 - DNA, 705 bp, Artificial Sequence
  Description of Artificial Sequence: Synthetic coding sequence
atggccgagaaccactgcgagctgctgagccccgccagaggcggcatcggcgccggcctgggcggcggcctgtgcagaagatgcagcgccggcctgggcgccctggcccagagacccggcagcgtgagcaagtgggtgagactgaacgtgggcggcacctacttcctgaccaccagacagaccctgtgcagagaccccaagagcttcctgtacagactgtgccaggccgaccccgacctggacagcgacaaggacgagaccggcgcctacctgatcgacagagaccccacctacttcggccccgtgctgaactacctgagacacggcaagctggtgatcaacaaggacctggccgaggagggcgtgctggaggaggccgagttctacaacatcaccagcctgatcaagctggtgaaggacaagatcagagagagagacagcaagaccagccaggtgcccgtgaagcacgtgtacagagtgctgcagtgccaggaggaggagctgacccagatggtgagcaccatgagcgacggctggaagttcgagcagctggtgagcatcggcagcagctacaactacggcaacgaggaccaggccgagttcctgtgcgtggtgagcaaggagctgcacaacaccccctacggcaccgccagcgagcccagcgagaaggccaagatcctgcaggagagaggcagcagaatgtag

SEQ ID NO: 20987 - DNA, 714 bp, Artificial Sequence
  Description of Artificial Sequence: Synthetic coding sequence
atggacaacggcgactggggctacatgatgaccgaccccgtgaccctgaacgtgggcggccacctgtacaccaccagcctgaccaccctgaccagataccccgacagcatgctgggcgccatgttcggcggcgacttccccaccgccagagacccccagggcaactacttcatcgacagagacggccccctgttcagatacgtgctgaacttcctgagaaccagcgagctgaccctgcccctggacttcaaggagttcgacctgctgagaaaggaggccgacttctaccagatcgagcccctgatccagtgcctgaacgaccccaagcccctgtaccccatggacaccttcgaggaggtggtggagctgagcagcaccagaaagctgagcaagtacagcaaccccgtggccgtgatcatcacccagctgaccatcaccaccaaggtgcacagcctgctggagggcatcagcaactacttcaccaagtggaacaagcacatgatggacaccagagactgccaggtgagcttcaccttcggcccctgcgactaccaccaggaggtgagcctgagagtgcacctgatggagtacatcaccaagcagggcttcaccatcagaaacaccagagtgcaccacatgagcgagagagccaacgagaacaccgtggagcacaactggaccttctgcagactggccagaaagaccgacgactag

SEQ ID NO: 20988 - DNA, 714 bp, Artificial Sequence; identical to SEQ ID NO: 20987
  Description of Artificial Sequence: Synthetic coding sequence

SEQ ID NO: 20989 - DNA, 30 bp, Artificial Sequence
  Description of Artificial Sequence: Synthetic coding sequence
atggacaacggcgactggggctacatgtag

SEQ ID NO: 20990 - DNA, 714 bp, Artificial Sequence; identical to SEQ ID NO: 20987
  Description of Artificial Sequence: Synthetic coding sequence

SEQ ID NO: 20991 - DNA, 1422 bp, Artificial Sequence
  Description of Artificial Sequence: Synthetic coding sequence
atggccctgaaggacaccggcagcggcggcagcaccatcctgcccatcagcgagatggtgagcagcagcagcagccccggcgccagcgccgccgccgcccccggcccctgcgcccccagccccttccccgaggtggtggagctgaacgtgggcggccaggtgtacgtgaccaagcacagcaccctgctgagcgtgcccgacagcaccctggccagcatgttcagccccagcagccccagaggcggcgccagaagaagaggcgagctgcccagagacagcagagccagattcttcatcgacagagacggcttcctgttcagatacgtgctggactacctgagagacaagcagctggccctgcccgagcacttccccgagaaggagagactgctgagagaggccgagtacttccagctgaccgacctggtgaagctgctgagccccaaggtgaccaagcagaacagcctgaacgacgagggctgccagagcgacctggaggacaacgtgagccagggcagcagcgacgccctgctgctgagaggcgccgccgccgccgtgcccagcggccccggcgcccacggcggcggcggcggcggcggcgcccaggacaagagaagcggcttcctgaccctgggctacagaggcagctacaccaccgtgagagacaaccaggccgacgccaagttcagaagagtggccagaatcatggtgtgcggcagaatcgccctggccaaggaggtgttcggcgacaccctgaacgagagcagagaccccgacagacagcccgagaagtacaccagcagattctacctgaagttcacctacctggagcaggccttcgacagactgagcgaggccggcttccacatggtggcctgcaacagcagcggcaccgccgccttcgtgaaccagtacagagacgacaagatctggagcagctacaccgagtacatcttcttcagacccccccagaagatcgtgagccccaagcaggagcacgaggacagaaagcacgacaaggtgaccgacaagggcagcgagagcggcaccagctgcaacgagctgagcaccagcagctgcgacagccacagcgaggccagcaccccccaggacaaccccagcagcgcccagcaggccaccgcccaccagcccaacaccctgaccctggacagacccagcaagaaggcccccgtgcagtggatccccccccccgacaagagaagaaacagcgagctgttccagaccctgatcagcaagagcagagagaccaacctgagcaagaagaaggtgtgcgagaagctgagcgtggaggaggagatgaagaagtgcatccaggacttcaagaagatccacatccccgactacttccccgagagaaagagacagtggcagagcgagctgctgcagaagtacggcctgtag

SEQ ID NO: 20992 - DNA, 2751 bp, Artificial Sequence
  Description of Artificial Sequence: Synthetic coding sequence
atgagctacaccctggacagcctgggcaaccccagcgcctacagaagagtgaccgagaccagaagcagcttcagcagagtgagcggcagccccagcagcggcttcagaagccagagctggagcagaggcagccccagcaccgtgagcagcagctacaagagaagcatgctggcccccagactggcctacagcagcgccatgctgagcagcgccgagagcagcctggacttcagccagagcagcagcctgctgaacggcggcagcggccccggcggcgactacaagctgagcagaagcaacgagaaggagcagctgcagggcctgaacgacagattcgccggctacatcgagaaggtgcactacctggagcagcagaacaaggagatcgaggccgagatccaggccctgagacagaagcaggccagccacgcccagctgggcgacgcctacgaccaggagatcagagagctgagagccaccctggagatggtgaaccacgagaaggcccaggtgcagctggacagcgaccacctggaggaggacatccacagactgaaggagagattcgaggaggaggccagactgagagacgacaccgaggccgccatcagagccctgagaaaggacatcgaggaggccagcctggtgaaggtggagctggacaagaaggtgcagagcctgcaggacgaggtggccttcctgagaagcaaccacgaggaggaggtggccgacctgctggcccagatccaggccagccacatcaccgtggagagaaaggactacctgaagaccgacatcagcaccgccctgaaggagatcagaagccagctggagagccacagcgaccagaacatgcaccaggccgaggagtggttcaagtgcagatacgccaagctgaccgaggccgccgagcagaacaaggaggccatcagaagcgccaaggaggagatcgccgagtacagaagacagctgcagagcaagagcatcgagctggagagcgtgagaggcaccaaggagagcctggagagacagctgagcgacatcgaggagagacacaaccacgacctgagcagctaccaggacaccatccagcagctggagaacgagctgagaggcaccaagtgggagatggccagacacctgagagagtaccaggacctgctgaacgtgaagatggccctggacatcgagatcgccgcctacagaaagctgctggagggcgaggagaccagattcagcaccttcgccggcagcatcaccggccccctgtacacccacagaccccccatcaccatcagcagcaagatccagaagcccaaggtggaggcccccaagctgaaggtgcagcacaagttcgtggaggagatcatcgaggagaccaaggtggaggacgagaagagcgagatggaggaggccctgaccgccatcaccgaggagctggccgtgagcatgaaggaggagaagaaggaggccgccgaggagaaggaggaggagcccgaggccgaggaggaggaggtggccgccaagaagagccccgtgaaggccaccgcccccgaggtgaaggaggaggagggcgagaaggaggaggaggagggccaggaggaggaggaggaggaggacgagggcgccaagagcgaccaggccgaggagggcggcagcgagaaggagggcagcagcgagaaggaggagggcgagcaggaggagggcgagaccgaggccgaggccgagggcgaggaggccgaggccaaggaggagaagaaggtggaggagaagagcgaggaggtggccaccaaggaggagctggtggccgacgccaaggtggagaagcccgagaaggccaagagccccgtgcccaagagccccgtggaggagaagggcaagagccccgtgcccaagagccccgtggaggagaagggcaagagccccgtgcccaagagccccgtggaggagaagggcaagagccccgtgcccaagagccccgtggaggagaagggcaagagccccgtgagcaagagccccgtggaggagaaggccaagagccccgtgcccaagagccccgtggaggaggccaagagcaaggccgaggtgggcaagggcgagcagaaggaggaggaggagaaggaggtgaaggaggcccccaaggaggagaaggtggagaagaaggaggagaagcccaaggacgtgcccgagaagaagaaggccgagagccccgtgaaggaggaggccgtggccgaggtggtgaccatcaccaagagcgtgaaggtgcacctggagaaggagaccaaggaggagggcaagcccctgcagcaggagaaggagaaggagaaggccggcggcgagggcggcagcgaggaggagggcagcgacaagggcgccaagggcagcagaaaggaggacatcgccgtgaacggcgaggtggagggcaaggaggaggtggagcaggagaccaaggagaagggcagcggcagagaggaggagaagggcgtggtgaccaacggcctggacctgagccccgccgacgagaagaagggcggcgacaagagcgaggagaaggtggtggtgaccaagaccgtggagaagatcaccagcgagggcggcgacggcgccaccaagtacatcaccaagagcgtgaccgtgacccagaaggtggaggagcacgaggagaccttcgaggagaagctggtgagcaccaagaaggtggagaaggtgaccagccacgccatcgtgaaggaggtgacccagagcgactag

SEQ ID NO: 20993 - DNA, 1932 bp, Artificial Sequence
  Description of Artificial Sequence: Synthetic coding sequence
atggaggccgtggagaccggcgagagacccaccttcggcgcctgggactacggcgtgttcgccctgatgctgctggtgagcaccggcatcggcctgtgggtgggcctggccagaggcggccagagaagcgccgaggacttcttcaccggcggcagaagactggccgccctgcccgtgggcctgagcctgagcgccagcttcatgagcgccgtgcaggtgctgggcgtgcccagcgaggcctacagatacggcctgaagttcctgtggatgtgcctgggccagctgctgaacagcgtgctgaccgccctgctgttcatgcccgtgttctacagactgggcctgaccagcacctacgagtacctggagatgagattcagcagagccgtgagactgtgcggcaccctgcagtacatcgtggccaccatgctgtacaccggcatcgtgatctacgcccccgccctgatcctgaaccaggtgaccggcctggacatctgggccagcctgctgagcaccggcatcatctgcaccttctacaccgccgtgggcggcatgaaggccgtggtgtggaccgacgtgttccaggtggtggtgatgctgagcggcttctgggtggtgctggccagaggcgtgatgctggtgggcggccccagacaggtgctgaccctggcccagaaccacagcagaatcaacctgatggacttcaaccccgaccccagaagcagatacaccttctggaccttcgtggtgggcggcaccctggtgtggctgagcatgtacggcgtgaaccaggcccaggtgcagagatacgtggcctgcagaaccgagaagcaggccaagctggccctgctgatcaaccaggtgggcctgttcctgatcgtgagcagcgccgcctgctgcggcatcgtgatgttcgtgttctacaccgactgcgaccccctgctgctgggcagaatcagcgcccccgaccagtacatgcccctgctggtgctggacatcttcgaggacctgcccggcgtgcccggcctgttcctggcctgcgcctacagcggcaccctgagcaccgccagcaccagcatcaacgccatggccgccgtgaccgtggaggacctgatcaagcccagactgagaagcctggcccccagaaagctggtgatcatcagcaagggcctgagcctgatctacggcagcgcctgcctgaccgtggccgccctgagcagcctgctgggcggcggcgtgctgcagggcagcttcaccgtgatgggcgtgatcagcggccccctgctgggcgccttcatcctgggcatgttcctgcccgcctgcaacacccccggcgtgctggccggcctgggcgccggcctggccctgagcctgtgggtggccctgggcgccaccctgtacccccccagcgagcagaccatgagagtgctgcccagcagcgccgccagatgcgtggccctgagcgtgaacgccagcggcctgctggaccccgccctgctgcccgccaacgacagcagcagagcccccagcagcggcatggacgccagcagacccgccctggccgacagcttctacgccatcagctacctgtactacggcgccctgggcaccctgaccaccgtgctgtgcggcgccctgatcagctgcctgaccggccccaccaagagaagcaccctggcccccggcctgctgtggtgggacctggccagacagaccgccagcgtggcccccaaggaggaggtggccatcctggacgacaacctggtgaagggccccgaggagctgcccaccggcaacaagaagccccccggcttcctgcccaccaacgaggacagactgttcttcctgggccagaaggagctggagggcgccggcagctggaccccctgcgtgggccacgacggcggcagagaccagcaggagaccaacctgtag

SEQ ID NO: 20994 - DNA, 1230 bp, Artificial Sequence
  Description of Artificial Sequence: Synthetic coding sequence
atgaacagccacagctacaacggcagcgtgggcagacccctgggcagcggccccggcgccctgggcagagacccccccgaccccgaggccggccaccccccccagcccccccacagccccggcctgcaggtggtggtggccaagagcgagcccgccagacccagccccggcagccccagaggccagccccaggaccaggacgacgacgaggacgacgaggaggacgaggccggcagacagagagccagcggcaagcccagcaacgtgggccacagactgggccacagaagagccctgttcgagaagagaaagagactgagcgactacgccctgatcttcggcatgttcggcatcgtggtgatggtgaccgagaccgagctgagctggggcgtgtacaccaaggagagcctgtacagcttcgccctgaagtgcctgatcagcctgagcaccgccatcctgctgggcctggtggtgctgtaccacgccagagagatccagctgttcatggtggacaacggcgccgacgactggagaatcgccatgacctgcgagagagtgttcctgatcagcctggagctggccgtgtgcgccatccaccccgtgcccggccactacagattcacctggaccgccagactggccttcacctacgcccccagcgtggccgaggccgacgtggacgtgctgctgagcatccccatgttcctgagactgtacctgctgggcagagtgatgctgctgcacagcaagatcttcaccgacgccagcagcagaagcatcggcgccctgaacaagatcaccttcaacaccagattcgtgatgaagaccctgatgaccatctgccccggcaccgtgctgctggtgttcagcatcagcagctggatcatcgccgcctggaccgtgagagtgtgcgagagataccacgacaagcaggaggtgaccagcaacttcctgggcgccatgtggctgatcagcatcaccttcctgagcatcggctacggcgacatggtgccccacacctactgcggcaagggcgtgtgcctgctgaccggcatcatgggcgccggctgcaccgccctggtggtggccgtggtggccagaaagctggagctgaccaaggccgagaagcacgtgcacaacttcatgatggacacccagctgaccaagagagtgaagaacgccgccgccaacgtgctgagagagacctggctgatctgcaagatgggctag

SEQ ID NO: 20995 - DNA, 1311 bp, Artificial Sequence
  Description of Artificial Sequence: Synthetic coding sequence
atgggcctggccagagccctgagaagactgagcggcgccctggacagcggcgacagcagagccggcgacgaggaggaggccggccccggcctgtgcagaaacggctgggcccccgcccccgtgcagagccccgtgggcagaagaagaggcagattcgtgaagaaggacggccactgcaacgtgagattcgtgaacctgggcggccagggcgccagatacctgagcgacctgttcaccacctgcgtggacgtgagatggagatggatgtgcctgctgttcagctgcagcttcctggccagctggctgctgttcggcctggccttctggctgatcgccagcctgcacggcgacctggccgccccccccccccccgccccctgcttcagccacgtggccagcttcctggccgccttcctgttcgccctggagacccagaccagcatcggctacggcgtgagaagcgtgaccgaggagtgccccgccgccgtggccgccgtggtgctgcagtgcatcgccggctgcgtgctggacgccttcgtggtgggcgccgtgatggccaagatggccaagcccaagaagagaaacgagaccctggtgttcagcgagaacgccgtggtggccctgagagaccacagactgtgcctgatgtggagagtgggcaacctgagaagaagccacctggtggaggcccacgtgagagcccagctgctgcagcccagagtgacccccgagggcgagtacatccccctggaccaccaggacgtggacgtgggcttcgacggcggcaccgacagaatcttcctggtgagccccatcaccatcgtgcacgagatcgacagcgccagccccctgtacgagctgggcagagccgagctggccagagccgacttcgagctggtggtgatcctggagggcatggtggaggccaccgccatgaccacccagtgcagaagcagctacctgcccggcgagctgctgtggggccacagattcgagcccgtgctgttccagagaggcagccagtacgaggtggactacagacacttccacagaacctacgaggtgcccggcacccccgtgtgcagcgccaaggagctggacgagagagccgagcaggccagccacagcctgaagagcagcttccccggcagcctgaccgccttctgctacgagaacgagctggccctgagctgctgccaggaggaggacgaggacgacgagaccgaggagggcaacggcgtggagaccgaggacggcgccgccagccccagagtgctgacccccaccctggccctgaccctgcccccctag

SEQ ID NO: 20996 - DNA, 1311 bp, Artificial Sequence; identical to SEQ ID NO: 20995
  Description of Artificial Sequence: Synthetic coding sequence

SEQ ID NO: 20997 - DNA, 1182 bp, Artificial Sequence
  Description of Artificial Sequence: Synthetic coding sequence
atggcccaggagaacgccgccttcagccccggccaggaggagccccccagaagaagaggcagacagagatacgtggagaaggacggcagatgcaacgtgcagcagggcaacgtgagagagacctacagatacctgaccgacctgttcaccaccctggtggacctgcagtggagactgagcctgctgttcttcgtgctggcctacgccctgacctggctgttcttcggcgccatctggtggctgatcgcctacggcagaggcgacctggagcacctggaggacaccgcctggaccccctgcgtgaacaacctgaacggcttcgtggccgccttcctgttcagcatcgagaccgagaccaccatcggctacggccacagagtgatcaccgaccagtgccccgagggcatcgtgctgctgctgctgcaggccatcctgggcagcatggtgaacgccttcatggtgggctgcatgttcgtgaagatcagccagcccaacaagagagccgccaccctggtgttcagcagccacgccgtggtgagcctgagagacggcagactgtgcctgatgttcagagtgggcgacctgagaagcagccacatcgtggaggccagcatcagagccaagctgatcagaagcagacagaccctggagggcgagttcatccccctgcaccagaccgacctgagcgtgggcttcgacaccggcgacgacagactgttcctggtgagccccctggtgatcagccacgagatcgacgccgccagccccttctgggaggccagcagaagagccctggagagagacgacttcgagatcgtggtgatcctggagggcatggtggaggccaccggcatgacctgccaggccagaagcagctacctggtggacgaggtgctgtggggccacagattcaccagcgtgctgaccctggaggacggcttctacgaggtggactacgccagcttccacgagaccttcgaggtgcccacccccagctgcagcgccagagagctggccgaggccgccgccagactggacgcccacctgtactggagcatccccagcagactggacgagaaggtggaggaggagggcgccggcgagggcgccggcggcgaggccggcgccgacaaggagcagaacggctgcctgcccccccccgagagcgagagcaaggtgtag

SEQ ID NO: 20998 - DNA, 708 bp, Artificial Sequence
  Description of Artificial Sequence: Synthetic coding sequence
atgttcatctggaccagcggcagaaccagcagcagctacagacacgacgagaagagaaacatctaccagaagatcagagaccacgacctgctggacaagagaaagaccgtgaccgccctgaaggccggcgaggacagagccatcctgctgggcctggccatgatggtgtgcagcatcatgatgtacttcctgctgggcatcaccctgctgagaagctacatgcagagcgtgtggaccgaggagagccagtgcaccctgctgaacgccagcatcaccgagaccttcaactgcagcttcagctgcggccccgactgctggaagctgagccagtacccctgcctgcaggtgtacgtgaacctgaccagcagcggcgagaagctgctgctgtaccacaccgaggagaccatcaagatcaaccagaagtgcagctacatccccaagtgcggcaagaacttcgaggagagcatgagcctggtgaacgtggtgatggagaacttcagaaagtaccagcacttcagctgctacagcgaccccgagggcaaccagaagagcgtgatcctgaccaagctgtacagcagcaacgtgctgttccacagcctgttctggcccacctgcatgatggccggcggcgtggccatcgtggccatggtgaagctgacccagtacctgagcctgctgtgcgagagaatccagagaatcaacagatag

SEQ ID NO: 20999 - DNA, 708 bp, Artificial Sequence; identical to SEQ ID NO: 20998
  Description of Artificial Sequence: Synthetic coding sequence

SEQ ID NO: 21000 - DNA, 708 bp, Artificial Sequence; identical to SEQ ID NO: 20998
  Description of Artificial Sequence: Synthetic coding sequence

SEQ ID NO: 21001 - DNA, 414 bp, Artificial Sequence
  Description of Artificial Sequence: Synthetic coding sequence
atgttcatctggaccagcggcagaaccagcagcagctacagacacgacgagaagagaaacatctaccagaagatcagagaccacgacctgctggacaagagaaagaccgtgaccgccctgaaggccggcgaggacagagccatcctgctgggcctggccatgatggtgtgcagcatcatgatgtacttcctgctgggcatcaccctgctgagaagctacatgcagagcgtgtggaccgaggagagccagtgcaccctgctgaacgccagcatcaccgagaccttcaactgcagcttcagctgcggccccgactgctggaagctgagccagtacccctgcctgcaggtgtacgtgaacctgaccagcagcggcgagaagctgctgctgtaccacaccgaggagaccatcaagtag

SEQ ID NO: 21002 - DNA, 708 bp, Artificial Sequence; identical to SEQ ID NO: 20998
  Description of Artificial Sequence: Synthetic coding sequence

SEQ ID NO: 21003 - DNA, 303 bp, Artificial Sequence
  Description of Artificial Sequence: Synthetic coding sequence
atgttcatctggaccagcggcagaaccagcagcagctacagacacgacgagaagagaaacatctaccagaagatcagagaccacgacctgctggacaagagaaagaccgtgaccgccctgaaggccggcgaggacagagccatcctgctgggcctggccatgatggtgtgcagcatcatgatgtacttcctgctgggcatcaccctgctgagaagctacatgcagagcgtgtggaccgaggagagccagtgcaccctgctgaacgccagcatcaccgagaccttcaactgcagcttcagctag

SEQ ID NO: 21004 - DNA, 651 bp, Artificial Sequence
  Description of Artificial Sequence: Synthetic coding sequence
atgttcatctggaccagcggcagaaccagcagcagctacagacacgacgagaagagaaacatctaccagaagatcagagaccacgacctgctgggcctggccatgatggtgtgcagcatcatgatgtacttcctgctgggcatcaccctgctgagaagctacatgcagagcgtgtggaccgaggagagccagtgcaccctgctgaacgccagcatcaccgagaccttcaactgcagcttcagctgcggccccgactgctggaagctgagccagtacccctgcctgcaggtgtacgtgaacctgaccagcagcggcgagaagctgctgctgtaccacaccgaggagaccatcaagatcaaccagaagtgcagctacatccccaagtgcggcaagaacttcgaggagagcatgagcctggtgaacgtggtgatggagaacttcagaaagtaccagcacttcagctgctacagcgaccccgagggcaaccagaagagcgtgatcctgaccaagctgtacagcagcaacgtgctgttccacagcctgttctggcccacctgcatgatggccggcggcgtggccatcgtggccatggtgaagctgacccagtacctgagcctgctgtgcgagagaatccagagaatcaacagatag

SEQ ID NO: 21005 - DNA, 2718 bp, Artificial Sequence
  Description of Artificial Sequence: Synthetic coding sequence
atgcccgtgagaagaggccacgtggccccccagaacacctacctggacaccatcatcagaaagttcgagggccagagcagaaagttcctgatcgccaacgcccagatggagaactgcgccatcatctactgcaacgacggcttctgcgagctgttcggctacagcagagtggaggtgatgcagcagccctgcacctgcgacttcctgaccggccccaacacccccagcagcgccgtgagcagactggcccaggccctgctgggcgccgaggagtgcaaggtggacatcctgtactacagaaaggacgccagcagcttcagatgcctggtggacgtggtgcccgtgaagaacgaggacggcgccgtgatcatgttcatcctgaacttcgaggacctggcccagctgctggccaagtgcagcagcagaagcctgagccagagactgctgagccagagcttcctgggcagcgagggcagccacggcagacccggcggccccggccccggcaccggcagaggcaagtacagaaccatcagccagatcccccagttcaccctgaacttcgtggagttcaacctggagaagcacagaagcagcagcaccaccgagatcgagatcatcgccccccacaaggtggtggagagaacccagaacgtgaccgagaaggtgacccaggtgctgagcctgggcgccgacgtgctgcccgagtacaagctgcaggcccccagaatccacagatggaccatcctgcactacagccccttcaaggccgtgtgggactggctgatcctgctgctggtgatctacaccgccgtgttcaccccctacagcgccgccttcctgctgagcgaccaggacgagagcagaagaggcgcctgcagctacacctgcagccccctgaccgtggtggacctgatcgtggacatcatgttcgtggtggacatcgtgatcaacttcagaaccacctacgtgaacaccaacgacgaggtggtgagccaccccagaagaatcgccgtgcactacttcaagggctggttcctgatcgacatggtggccgccatccccttcgacctgctgatcttcagaaccggcagcgacgagaccaccaccctgatcggcctgctgaagaccgccagactgctgagactggtgagagtggccagaaagctggacagatacagcgagtacggcgccgccgtgctgttcctgctgatgtgcaccttcgccctgatcgcccactggctggcctgcatctgcagcctgaccagcgtgggcttcggcaacgtgagccccaacaccaacagcgagaaggtgttcagcatctgcgtgatgctgatcggcagcctgatgtacgccagcatcttcggcaacgtgagcgccatcatccagagactgtacagcggcaccgccagataccacacccagatgctgagagtgaaggagttcatcagattccaccagatccccaaccccctgagacagagactggaggagtacttccagcacgcctggagctacaccaacggcatcgacatgaacgccgtgctgaagggcttccccgagtgcctgcaggccgacatctgcctgcacctgcacagagccctgctgcagcactgccccgccttcagcggcgccggcaagggctgcctgagagccctggccgtgaagttcaagaccacccacgccccccccggcgacaccctggtgcacctgggcgacgtgctgagcaccctgtacttcatcagcagaggcagcatcgagatcctgagagacgacgtggtggtggccatcctgggcaagaacgacatcttcggcgagcccgtgagcctgcacgcccagcccggcaagagcagcgccgacgtgagagccctgacctactgcgacctgcacaagatccagagagccgacctgctggaggtgctggacatgtaccccgccttcgccgagagcttctggagcaagctggaggtgaccttcaacctgagagacgccgccggcggcctgcacagcagccccagacaggcccccggcagccaggaccaccagggcttcttcctgagcgacaaccagagcgacgccgccccccccctgagcatcagcgacgccagcggcctgtggcccgagctgctgcaggagatgccccccagacacagcccccagagcccccaggaggaccccgactgctggcccctgaagctgggcagcagactggagcagctgcaggcccagatgaacagactggagagcagagtgagcagcgacctgagcagaatcctgcagctgctgcagaagcccatgccccagggccacgccagctacatcctggaggcccccgccagcaacgacctggccctggtgcccatcgccagcgagaccaccagccccggccccagactgccccagggcttcctgccccccgcccagacccccagctacggcgacctggacgactgcagccccaagcacagaaacagcagccccagaatgccccacctggccgtggccaccgacaagaccctggcccccagcagcgagcaggagcagcccgagggcctgtggccccccctggccagccccctgcaccccctggaggtgcagggcctgatctgcggcccctgcttcagcagcctgcccgagcacctgggcagcgtgcccaagcagctggacttccagagacacggcagcgaccccggcttcgccggcagctggggccactag

SEQ ID NO: 21006 - DNA, 2985 bp, Artificial Sequence
  Description of Artificial Sequence: Synthetic coding sequence
atgcccgtgagaagaggccacgtggccccccagaacacctacctggacaccatcatcagaaagttcgagggccagagcagaaagttcctgatcgccaacgcccagatggagaactgcgccatcatctactgcaacgacggcttctgcgagctgttcggctacagcagagtggaggtgatgcagcagccctgcacctgcgacttcctgaccggccccaacacccccagcagcgccgtgagcagactggcccaggccctgctgggcgccgaggagtgcaaggtggacatcctgtactacagaaaggacgccagcagcttcagatgcctggtggacgtggtgcccgtgaagaacgaggacggcgccgtgatcatgttcatcctgaacttcgaggacctggcccagctgctggccaagtgcagcagcagaagcctgagccagagactgctgagccagagcttcctgggcagcgagggcagccacggcagacccggcggccccggccccggcaccggcagaggcaagtacagaaccatcagccagatcccccagttcaccctgaacttcgtggagttcaacctggagaagcacagaagcagcagcaccaccgagatcgagatcatcgccccccacaaggtggtggagagaacccagaacgtgaccgagaaggtgacccaggtgctgagcctgggcgccgacgtgctgcccgagtacaagctgcaggcccccagaatccacagatggaccatcctgcactacagccccttcaaggccgtgtgggactggctgatcctgctgctggtgatctacaccgccgtgttcaccccctacagcgccgccttcctgctgagcgaccaggacgagagcagaagaggcgcctgcagctacacctgcagccccctgaccgtggtggacctgatcgtggacatcatgttcgtggtggacatcgtgatcaacttcagaaccacctacgtgaacaccaacgacgaggtggtgagccaccccagaagaatcgccgtgcactacttcaagggctggttcctgatcgacatggtggccgccatccccttcgacctgctgatcttcagaaccggcagcgacgagaccaccaccctgatcggcctgctgaagaccgccagactgctgagactggtgagagtggccagaaagctggacagatacagcgagtacggcgccgccgtgctgttcctgctgatgtgcaccttcgccctgatcgcccactggctggcctgcatctggtacgccatcggcaacgtggagagaccctacctggagcacaagatcggctggctggacagcctgggcgtgcagctgggcaagagatacaacggcagcgaccccgccagcggccccagcgtgcaggacaagtacgtgaccgccctgtacttcaccttcagcagcctgaccagcgtgggcttcggcaacgtgagccccaacaccaacagcgagaaggtgttcagcatctgcgtgatgctgatcggcagcctgatgtacgccagcatcttcggcaacgtgagcgccatcatccagagactgtacagcggcaccgccagataccacacccagatgctgagagtgaaggagttcatcagattccaccagatccccaaccccctgagacagagactggaggagtacttccagcacgcctggagctacaccaacggcatcgacatgaacgccgtgctgaagggcttccccgagtgcctgcaggccgacatctgcctgcacctgcacagagccctgctgcagcactgccccgccttcagcggcgccggcaagggctgcctgagagccctggccgtgaagttcaagaccacccacgccccccccggcgacaccctggtgcacctgggcgacgtgctgagcaccctgtacttcatcagcagaggcagcatcgagatcctgagagacgacgtggtggtggccatcctgggcaagaacgacatcttcggcgagcccgtgagcctgcacgcccagcccggcaagagcagcgccgacgtgagagccctgacctactgcgacctgcacaagatccagagagccgacctgctggaggtgctggacatgtaccccgccttcgccgagagcttctggagcaagctggaggtgaccttcaacctgagagacgccgccggcggcctgcacagcagccccagacaggcccccggcagccaggaccaccagggcttcttcctgagcgacaaccagagcggcagcccccacgagctgggcccccagttccccagcaagggctacagcctgctgggccccggcagccagaacagcatgggcgccggcccctgcgcccccggccaccccgacgccgccccccccctgagcatcagcgacgccagcggcctgtggcccgagctgctgcaggagatgccccccagacacagcccccagagcccccaggaggaccccgactgctggcccctgaagctgggcagcagactggagcagctgcaggcccagatgaacagactggagagcagagtgagcagcgacctgagcagaatcctgcagctgctgcagaagcccatgccccagggccacgccagctacatcctggaggcccccgccagcaacgacctggccctggtgcccatcgccagcgagaccaccagccccggccccagactgccccagggcttcctgccccccgcccagacccccagctacggcgacctggacgactgcagccccaagcacagaaacagcagccccagaatgccccacctggccgtggccaccgacaagaccctggcccccagcagcgagcaggagcagcccgagggcctgtggccccccctggccagccccctgcaccccctggaggtgcagggcctgatctgcggcccctgcttcagcagcctgcccgagcacctgggcagcgtgcccaagcagctggacttccagagacacggcagcgaccccggcttcgccggcagctggggccactag

SEQ ID NO: 21007 - DNA, 1581 bp, Artificial Sequence
  Description of Artificial Sequence: Synthetic coding sequence
atgctgatgctgctggtgagaggcacccactacgagaacctgagaagcaaggtggtgctgcccacccccctgggcggcagaagcaccgagaccttcgtgagcgagttccccggccccgacaccggcatcagatggagaagaagcgacgaggccctgagagtgaacgtgggcggcgtgagaagacagctgagcgccagagccctggccagattccccggcaccagactgggcagactgcaggccgccgccagcgaggagcaggccagaagactgtgcgacgactacgacgaggccgccagagagttctacttcgacagacaccccggcttcttcctgagcctgctgcacttctacagaaccggccacctgcacgtgctggacgagctgtgcgtgttcgccttcggccaggaggccgactactggggcctgggcgagaacgccctggccgcctgctgcagagccagatacctggagagaagactgacccagccccacgcctgggacgaggacagcgacacccccagcagcgtggacccctgccccgacgagatcagcgacgtgcagagagagctggccagatacggcgccgccagatgcggcagactgagaagaagactgtggctgaccatggagaaccccggctacagcctgcccagcaagctgttcagctgcgtgagcatcagcgtggtgctggccagcatcgccgccatgtgcatccacagcctgcccgagtaccaggccagagaggccgccgccgccgtggccgccgtggccgccggcagaagccccgagggcgtgagagacgaccccgtgctgagaagactggagtacttctgcatcgcctggttcagcttcgaggtgagcagcagactgctgctggcccccagcaccagaaacttcttctgccaccccctgaacctgatcgacatcgtgagcgtgctgcccttctacctgaccctgctggccggcgtggccctgggcgaccagggcggcaaggagttcggccacctgggcaaggtggtgcaggtgttcagactgatgagaatcttcagagtgctgaagctggccagacacagcaccggcctgagaagcctgggcgccaccctgaagcacagctacagagaggtgggcatcctgctgctgtacctggccgtgggcgtgagcgtgttcagcggcgtggcctacaccgccgagaaggaggaggacgtgggcttcaacaccatccccgcctgctggtggtggggcaccgtgagcatgaccaccgtgggctacggcgacgtggtgcccgtgaccgtggccggcaagctggccgccagcggctgcatcctgggcggcatcctggtggtggccctgcccatcaccatcatcttcaacaagttcagccacttctacagaagacagaaggccctggaggccgccgtgagaaacagcaaccaccaggagttcgaggacctgctgagcagcatcgacggcgtgagcgaggccagcctggagaccagcagagagaccagccaggagggccagagcgccgacctggagagccaggcccccagcgagcccccccacccccagatgtactag

SEQ ID NO: 21008 - DNA, 1581 bp, Artificial Sequence; identical to SEQ ID NO: 21007
  Description of Artificial Sequence: Synthetic coding sequence

SEQ ID NO: 21009 - DNA, 1500 bp, Artificial Sequence
  Description of Artificial Sequence: Synthetic coding sequence
atgaccgtggccaccggcgaccccgccgacgaggccgccgccctgcccggccacccccaggacacctacgaccccgaggccgaccacgagtgctgcgagagagtggtgatcaacatcagcggcctgagattcgagacccagctgaagaccctggcccagttccccgagaccctgctgggcgaccccaagaagagaatgagatacttcgaccccctgagaaacgagtacttcttcgacagaaacagacccagcttcgacgccatcctgtactactaccagagcggcggcagactgagaagacccgtgaacgtgcccctggacatcttcagcgaggagatcagattctacgagctgggcgaggaggccatggagatgttcagagaggacgagggctacatcaaggaggaggagagacccctgcccgagaacgagttccagagacaggtgtggctgctgttcgagtaccccgagagcagcggccccgccagaatcatcgccatcgtgagcgtgatggtgatcctgatcagcatcgtgagcttctgcctggagaccctgcccatcttcagagacgagaacgaggacatgcacggcagcggcgtgaccttccacacctacagcaacagcaccatcggctaccagcagagcaccagcttcaccgaccccttcttcatcgtggagaccctgtgcatcatctggttcagcttcgagttcctggtgagattcttcgcctgccccagcaaggccggcttcttcaccaacatcatgaacatcatcgacatcgtggccatcatcccctacttcatcaccctgggcaccgagctggccgagaagcccgaggacgcccagcagggccagcaggccatgagcctggccatcctgagagtgatcagactggtgagagtgttcagaatcttcaagctgagcagacacagcaagggcctgcagatcctgggccagaccctgaaggccagcatgagagagctgggcctgctgatcttcttcctgttcatcggcgtgatcctgttcagcagcgccgtgtacttcgccgaggccgacgagagagagagccagttccccagcatccccgacgccttctggtgggccgtggtgagcatgaccaccgtgggctacggcgacatggtgcccaccaccatcggcggcaagatcgtgggcagcctgtgcgccatcgccggcgtgctgaccatcgccctgcccgtgcccgtgatcgtgagcaacttcaactacttctaccacagagagaccgagggcgaggagcaggcccagtacctgcaggtgaccagctgccccaagatccccagcagccccgacctgaagaagagcagaagcgccagcaccatcagcaagagcgactacatggagatccaggagggcgtgaacaacagcaacgaggacttcagagaggagaacctgaagaccgccaactgcaccctggccaacaccaactacgtgaacatcaccaagatgctgaccgacgtgtag

SEQ ID NO: 21010 - DNA, 1071 bp, Artificial Sequence
  Description of Artificial Sequence: Synthetic coding sequence
atgaccgtggccaccggcgaccccgccgacgaggccgccgccctgcccggccacccccaggacacctacgaccccgaggccgaccacgagtgctgcgagagagtggtgatcaacatcagcggcctgagattcgagacccagctgaagaccctggcccagttccccgagaccctgctgggcgaccccaagaagagaatgagatacttcgaccccctgagaaacgagtacttcttcgacagaaacagacccagcttcgacgccatcctgtactactaccagagcggcggcagactgagaagacccgtgaacgtgcccctggacatcttcagcgaggagatcagattctacgagctgggcgaggaggccatggagatgttcagagaggacgagggctacatcaaggaggaggagagacccctgcccgagaacgagttccagagacaggtgtggctgctgttcgagtaccccgagagcagcggccccgccagaatcatcgccatcgtgagcgtgatggtgatcctgatcagcatcgtgagcttctgcctggagaccctgcccatcttcagagacgagaacgaggacatgcacggcagcggcgtgaccttccacacctacagcaacagcaccatcggctaccagcagagcaccagcttcaccgaccccttcttcatcgtggagaccctgtgcatcatctggttcagcttcgagttcctggtgagattcttcgcctgccccagcaaggccggcttcttcaccaacatcatgaacatcatcgacatcgtggccatcatcccctacttcatcaccctgggcaccgagctggccgagaagcccgaggacgcccagcagggccagcaggccatgagcctggccatcctgagagtgatcagactggagagaagacccctgcagagccagaagagcaagagaggcagacagcacctgaacaccagccacgactgcaccctgggcatcaacctggtggccggcatgaccgtgcagtggaccagagccagcggccccgacgacagacagacccccgccgtgaccaccctgcacagaatgtactag

SEQ ID NO: 21011 - DNA, 1500 bp, Artificial Sequence; identical to SEQ ID NO: 21009
  Description of Artificial Sequence: Synthetic coding sequence

SEQ ID NO: 21012 - DNA, 1500 bp, Artificial Sequence; identical to SEQ ID NO: 21009
  Description of Artificial Sequence: Synthetic coding sequence

SEQ ID NO: 21013 - DNA, 1590 bp, Artificial Sequence
  Description of Artificial Sequence: Synthetic coding sequence
atgagaagcgagaagagcctgaccctggccgcccccggcgaggtgagaggccccgagggcgagcagcaggacgccggcgacttccccgaggccggcggcggcggcggctgctgcagcagcgagagactggtgatcaacatcagcggcctgagattcgagacccagctgagaaccctgagcctgttccccgacaccctgctgggcgaccccggcagaagagtgagattcttcgaccccctgagaaacgagtacttcttcgacagaaacagacccagcttcgacgccatcctgtactactaccagagcggcggcagactgagaagacccgtgaacgtgcccctggacatcttcctggaggagatcagattctaccagctgggcgacgaggccctggccgccttcagagaggacgagggctgcctgcccgagggcggcgaggacgagaagcccctgcccagccagcccttccagagacaggtgtggctgctgttcgagtaccccgagagcagcggccccgccagaggcatcgccatcgtgagcgtgctggtgatcctgatcagcatcgtgatcttctgcctggagaccctgccccagttcagagtggacggcagaggcggcaacaacggcggcgtgagcagagtgagccccgtgagcagaggcagccaggaggaggaggaggacgaggacgacagctacaccttccaccacggcatcacccccggcgagatgggcaccggcggcagcagcagcctgagcaccctgggcggcagcttcttcaccgaccccttcttcctggtggagaccctgtgcatcgtgtggttcaccttcgagctgctggtgagattcagcgcctgccccagcaagcccgccttcttcagaaacatcatgaacatcatcgacctggtggccatcttcccctacttcatcaccctgggcaccgagctggtgcagcagcaggagcagcagcccgccagcggcggcggcggccagaacggccagcaggccatgagcctggccatcctgagagtgatcagactggtgagagtgttcagaatcttcaagctgagcagacacagcaagggcctgcagatcctgggcaagaccctgcaggccagcatgagagagctgggcctgctgatcttcttcctgttcatcggcgtgatcctgttcagcagcgccgtgtacttcgccgaggccgacgacgacgacagcctgttccccagcatccccgacgccttctggtgggccgtggtgaccatgaccaccgtgggctacggcgacatgtaccccatgaccgtgggcggcaagatcgtgggcagcctgtgcgccatcgccggcgtgctgaccatcgccctgcccgtgcccgtgatcgtgagcaacttcaactacttctaccacagagagaccgagcaggaggagcagggccagtacacccacgtgacctgcggccagcccgcccccgacctgagagccaccgacaacggcctgggcaagcccgacttccccgaggccaacagagagagaagacccagctacctgcccaccccccacagagcctacgccgagaagagaatgctgaccgaggtgtag

SEQ ID NO: 21014 - DNA, 1590 bp, Artificial Sequence; identical to SEQ ID NO: 21013
  Description of Artificial Sequence: Synthetic coding sequence

SEQ ID NO: 21015 - DNA, 2319 bp, Artificial Sequence
  Description of Artificial Sequence: Synthetic coding sequence
atggagaagagcgccagcaaggaggagaagcagcagcccaagcaggacagcaccgagcagggcaacgccgacagcgaggagtggatgagcagcgagagcgaccccgagcagatcagcctgaagagcagcgacaacagcaagagctgccagcccagagacggccagctgaagaagaaggagatgcacagcaagccccacagacagctgtgcagaagcccctgcctggacagacccagcttcagccagaaccacctgctgatgatgtactggcagagcctgagcgacctgggcaccaaggtgatccagaagggcagcagcagagagatcgccagccccgagctgagcctggaggacgagatcgacaacagcgacaacctgagacccgtggtgatcgacggcagcaacgtggccatgagccacggcaacaaggaggagttcagctgcagaggcatccagctggccgtggactggttcctggacaagggccacaaggacatcaccgtgttcgtgcccgcctggagaaaggagcagagcagacccgacgcccccatcaccgaccaggacatcctgagaaagctggagaaggagaagatcctggtgttcacccccagcagaagagtgcagggcagaagagtggtgtgctacgacgacagattcatcgtgaagctggccttcgacagcgacggcatcatcgtgagcaacgacaactacagagacctgcaggtggagaagcccgagtggaagaagttcatcgaggagagactgctgatgtacagcttcgtgaacgacaagttcatgccccccgacgaccccctgggcagacacggccccagcctggagaacttcctgagaaagagacccatcgtgcccgagcacaagaagcagccctgcccctacggcaagaagtgcacctacggccacaagtgcaagtactaccaccccgagagagccaaccagccccagagaagcgtggccgacgagctgagaatcagcgccaagctgagcaccgtgaagaccatgagcgagggcaccctggccaagtgcggcaccggcatgagcagcgccaagggcgagatcaccagcgaggtgaagagagtggcccccaagagacagagcgaccccagcatcagaagcgtggccatggagcccgaggagtggctgagcatcgccagaaagcccgaggccagcagcgtgcccagcctggtgaccgccctgagcgtgcccaccatccccccccccaagagccacgccgtgggcgccctgaacaccagaagcgccagcagccccgtgcccggcagcagccacttcccccaccagaaggccagcctggagcacatggccagcatgcagtacccccccatcctggtgaccaacagccacggcacccccatcagctacgccgagcagtaccccaagttcgagagcatgggcgaccacggctactacagcatgctgggcgacttcagcaagctgaacatcaacagcatgcacaacagagagtactacatggccgaggtggacagaggcgtgtacgccagaaaccccaacctgtgcagcgacagcagagtgagccacaccagaaacgacaactacagcagctacaacaacgtgtacctggccgtggccgacacccaccccgagggcaacctgaagctgcacagaagcgccagccagaacagactgcagcccttcccccacggctaccacgaggccctgaccagagtgcagagctacggccccgaggacagcaagcagggcccccacaagcagagcgtgccccacctggccctgcacgcccagcaccccagcaccggcaccagaagcagctgccccgccgactaccccatgccccccaacatccaccccggcgccaccccccagcccggcagagccctggtgatgaccagaatggacagcatcagcgacagcagactgtacgagagcaaccccgtgagacagagaagaccccccctgtgcagagagcagcacgccagctgggaccccctgccctgcaccaccgacagctacggctaccacagctaccccctgagcaacagcctgatgcagccctgctacgagcccgtgatggtgagaagcgtgcccgagaagatggagcagctgtggagaaacccctgggtgggcatgtgcaacgacagcagagagcacatgatccccgagcaccagtaccagacctacaagaacctgtgcaacatcttccccagcaacatcgtgctggccgtgatggagaagaacccccacaccgccgacgcccagcagctggccgccctgatcgtggccaagctgagagccgccagatag

SEQ ID NO: 21016 - DNA, 813 bp, Artificial Sequence
  Description of Artificial Sequence: Synthetic coding sequence
atggtgcccagcaccatcgccggcaagatcttcggcagcatctgcagcctgagcggcgtgctggtgatcgccctgcccgtgcccgtgatcgtgagcaacttcagcagaatctaccaccagaaccagagagccgacaagagaagagcccagcagaaggtgagactggccagaatcagactggccaagagcggcaccaccaacgccttcctgcagtacaagcagaacggcggcctggaggacagcggcagcggcgaggagcaggccctgtgcgtgagaaacagaagcgccttcgagcagcagcaccaccacctgctgcactgcctggagaagaccacctgccacgagttcaccgacgagctgaccttcagcgaggccctgggcgccgtgagccccggcggcagaaccagcagaagcaccagcgtgagcagccagcccgtgggccccggcagcctgctgagcagctgctgccccagaagagccaagagaagagccatcagactggccaacagcaccgccagcgtgagcagaggcagcatgcaggagctggacatgctggccggcctgagaagaagccacgccccccagagcagaagcagcctgaacgccaagccccacgacagcctggacctgaactgcgacagcagagacttcgtggccgccatcatcagcatccccaccccccccgccaacacccccgacgagagccagcccagcagccccggcggcggcggcagagccggcagcaccctgagaaacagcagcctgggcaccccctgcctgttccccgagaccgtgaagatcagcagcctgtag

SEQ ID NO: 21017 - DNA, 402 bp, Artificial Sequence
  Description of Artificial Sequence: Synthetic coding sequence
tgaggcagaggcctggacagagtgggcgtgagccacaacggcgaggagggcgccgccctgatcgccctgctgcacctgctgcaggacagcggcagcggcgaggagcaggccctgtgcgtgagaaacagaagcgccttcgagcagcagcaccaccacctgctgcactgcctggagaagaccacctgccacgagttcaccgacgagctgaccttcagcgaggccctgggcgccgtgagccccggcggcagaaccagcagaagcaccagcgtgagcagccagcccgtgggccccggcagcctgctgagcagctgctgccccagaagagccaagagaagagccatcagactggccaacagcaccgccagcgtgagcagaggcagcatgcaggagctggacatgtag

SEQ ID NO: 21018 - DNA, 1401 bp, Artificial Sequence
  Description of Artificial Sequence: Synthetic coding sequence
atggagccctggccctgcagccccggcggcggcggcggcaccagagccagacacgtgatcatcaacgtgggcggctgcagagtgagactggcctgggccgccctggccagatgccccctggccagactggagagactgagagcctgcagaggccacgacgacctgctgagagtgtgcgacgactacgacgtgagcagagacgagttcttcttcgacagaagcccctgcgccttcagagccatcgtggccctgctgagagccggcaagctgagactgctgagaggcccctgcgccctggccttcagagacgagctggcctactggggcatcgacgaggccagactggagagatgctgcctgagaagactgagaagaagagaggaggaggccgccgaggccagagccggccccaccgagagaggcgcccagggcagccccgccagagccctgggccccagaggcagactgcagagaggcagaagaagactgagagacgtggtggacaacccccacagcggcctggccggcaagctgttcgcctgcgtgagcgtgagcttcgtggccgtgaccgccgtgggcctgtgcctgagcaccatgcccgacatcagagccgaggaggagagaggcgagtgcagccccaagtgcagaagcctgttcgtgctggagaccgtgtgcgtggcctggttcagcttcgagttcctgctgagaagcctgcaggccgagagcaagtgcgccttcctgagagcccccctgaacatcatcgacatcctggccctgctgcccttctacgtgagcctgctgctgggcctggccgccggccccggcggcaccaagctgctggagagagccggcctggtgctgagactgctgagagccctgagagtgctgtacgtgatgagactggccagacacagcctgggcctgagaagcctgggcctgaccatgagaagatgcgccagagagttcggcctgctgctgctgttcctgtgcgtggccatggccctgttcgcccccctggtgcacctggccgagagagagctgggcgccagaagagacttcagcagcgtgcccgccagctactggtgggccgtgatcagcatgaccaccgtgggctacggcgacatggtgcccagaagcctgcccggccaggtggtggccctgagcagcatcctgagcggcatcctgctgatggccttccccgtgaccagcatcttccacaccttcagcagaagctacagcgagctgaaggagcagcagcagagagccgccagccccgagcccgccctgcaggaggacagcacccacagcgccaccgccaccgaggacagcagccagggccccgacagcgccggcctggccgacgacagcgccgacgccctgtgggtgagagccggcagatag

SEQ ID NO: 21019 - DNA, 3054 bp, Artificial Sequence
  Description of Artificial Sequence: Synthetic coding sequence
atgcccgtgatgaagggcctgctggccccccagaacaccttcctggacaccatcgccaccagattcgacggcacccacagcaacttcctgctggccaacgcccagggcaccagaggcttccccatcgtgtactgcagcgacggcttctgcgagctgaccggctacggcagaaccgaggtgatgcagaagacctgcagctgcagattcctgtacggccccgagaccagcgagcccgccctgcagagactgcacaaggccctggagggccaccaggagcacagagccgagatctgcttctacagaaaggacggcagcgccttctggtgcctgctggacatgatgcccatcaagaacgagatgggcgaggtggtgctgttcctgttcagcttcaaggacatcacccagagcggcagccccggcctgggcccccagggcggcagaggcgacagcaaccacgagaacagcctgggcagaagaggcgccacctggaagttcagaagcgccagaagaagaagcagaaccgtgctgcacagactgaccggccacttcggcagaagaggccagggcggcatgaaggccaacaacaacgtgttcgagcccaagcccagcgtgcccgagtacaaggtggccagcgtgggcggcagcagatgcctgctgctgcactacagcgtgagcaaggccatctgggacggcctgatcctgctggccaccttctacgtggccgtgaccgtgccctacaacgtgtgcttcagcggcgacgacgacacccccatcaccagcagacacaccctggtgagcgacatcgccgtggagatgctgttcatcctggacatcatcctgaacttcagaaccacctacgtgagccagagcggccaggtgatcagcgcccccagaagcatcggcctgcactacctggccacctggttcttcatcgacctgatcgccgccctgcccttcgacctgctgtacatcttcaacatcaccgtgaccagcctggtgcacctgctgaagaccgtgagactgctgagactgctgagactgctgcagaagctggagagatacagccagtgcagcgccgtggtgctgaccctgctgatgagcgtgttcgccctgctggcccactggatggcctgcatctggtacgtgatcggcagaagagagatggaggccaacgaccccctgctgtgggacatcggctggctgcacgagctgggcaagagactggaggtgccctacgtgaacggcagcgtgggcggccccagcagaagaagcgcctacatcgccgccctgtacttcaccctgagcagcctgaccagcgtgggcttcggcaacgtgtgcgccaacaccgacgccgagaagatcttcagcatctgcaccatgctgatcggcgccctgatgcacgccgtggtgttcggcaacgtgaccgccatcatccagagaatgtacagcagaagaagcctgtaccacagcagaatgaaggacctgaaggacttcatcagagtgcacagactgcccagacccctgaagcagagaatgctggagtacttccagaccacctgggccgtgaacagcggcatcgacgccaacgagctgctgagagacttccccgacgagctgagagccgacatcgccatgcacctgaacagagagatcctgcagctgcccctgttcggcgccgccagcagaggctgcctgagagccctgagcctgcacatcaagaccagcttctgcgcccccggcgagtacctgctgagaagaggcgacgccctgcaggcccactactacgtgtgcagcggcagcctggaggtgctgagagacaacatggtgctggccatcctgggcaagggcgacctgatcggcgccgacatccccgagcccggccaggagcccggcctgggcgccgaccccaacttcgtgctgaagaccagcgccgacgtgaaggccctgacctactgcggcctgcagcagctgagcagcagaggcctggccgaggtgctgagactgtaccccgagtacggcgccgccttcagagccggcctgcccagagacctgaccttcaacctgagacagggcagcgacaccagcggcctgagcagattcagcagaagccccagactgagccagcccagaagcgagagcctgggcagcagcagcgacaagaccctgcccagcatcaccgaggccgagagcggcgccgagcccggcggcggccccagacccagaagacccctgctgctgcccaacctgagccccgccagacccagaggcagcctggtgagcctgctgggcgaggagctgccccccttcagcgccctggtgagcagccccagcctgagccccagcctgagccccgccctggccggccagggccacagcgccagcccccacggcccccccagatgcagcgccgcctggaagcccccccagctgctgatcccccccctgggcaccttcggcccccccgacctgagccccagaatcgtggacggcatcgaggacagcggcagcaccgccgaggcccccagcttcagattcagcagaagacccgagctgcccagacccagaagccaggccccccccaccggcaccagacccagccccgagctggccagcgaggccgaggaggtgaaggagaaggtgtgcagactgaaccaggagatcagcagactgaaccaggaggtgagccagctgagcagagagctgagacacatcatgggcctgctgcaggccagactgggcccccccggccaccccgccggcagcgcctggacccccgaccccccctgcccccagctgagacccccctgcctgagcccctgcgccagcagacccccccccagcctgcaggacaccaccctggccgaggtgcactgccccgccagcgtgggcaccatggagaccggcaccgccctgctggacctgagacccagcatcctgcccccctaccccagcgagcccgaccccctgggccccagccccgtgcccgaggccagcccccccacccccagcctgctgagacacagcttccagagcagaagcgacaccttccactag

SEQ ID NO: 21020 - DNA, 2985 bp, Artificial Sequence; identical to SEQ ID NO: 21006
  Description of Artificial Sequence: Synthetic coding sequence

SEQ ID NO: 21021 - DNA, 2718 bp, Artificial Sequence; identical to SEQ ID NO: 21005
  Description of Artificial Sequence: Synthetic coding sequence

SEQ ID NO: 21022 - DNA, 3324 bp, Artificial Sequence
  Description of Artificial Sequence: Synthetic coding sequence
atgcccgtgatgaagggcctgctggccccccagaacaccttcctggacaccatcgccaccagattcgacggcacccacagcaacttcatcctggccaacgcccaggtggccaagggcttccccatcgtgtactgcagcgacggcttctgcgagctggccggcttcgccagaaccgaggtgatgcagaagagctgcagctgcaagttcctgttcggcgtggagaccaacgagcagctgatgctgcagatcgagaagagcctggaggagaagaccgagttcaagggcgagatcatgttctacaagaagaacggcagccccttctggtgcctgctggacatcgtgcccatcaagaacgagaagggcgacgtggtgctgttcctggccagcttcaaggacatcaccgacaccaaggtgaagatcacccccgaggacaagaaggaggacaaggtgaagggcagaagcagagccggcacccacttcgacagcgccagaagaagaagcagagccgtgctgtaccacatcagcggccacctgcagagaagagagaagaacaagctgaagatcaacaacaacgtgttcgtggacaagcccgccttccccgagtacaaggtgagcgacgccaagaagagcaagttcatcctgctgcacttcagcaccttcaaggccggctgggactggctgatcctgctggccaccttctacgtggccgtgaccgtgccctacaacgtgtgcttcatcggcaacgacgacctgagcaccaccagaagcaccaccgtgagcgacatcgccgtggagatcctgttcatcatcgacatcatcctgaacttcagaaccacctacgtgagcaagagcggccaggtgatcttcgaggccagaagcatctgcatccactacgtgaccacctggttcatcatcgacctgatcgccgccctgcccttcgacctgctgtacgccttcaacgtgaccgtggtgagcctggtgcacctgctgaagaccgtgagactgctgagactgctgagactgctgcagaagctggacagatacagccagcacagcaccatcgtgctgaccctgctgatgagcatgttcgccctgctggcccactggatggcctgcatctggtacgtgatcggcaagatggagagagaggacaacagcctgctgaagtgggaggtgggctggctgcacgagctgggcaagagactggagagcccctactacggcaacaacaccctgggcggccccagcatcagaagcgcctacatcgccgccctgtacttcaccctgagcagcctgaccagcgtgggcttcggcaacgtgagcgccaacaccgacgccgagaagatcttcagcatctgcaccatgctgatcggcgccctgatgcacgccctggtgttcggcaacgtgaccgccatcatccagagaatgtacagcagatggagcctgtaccacaccagaaccaaggacctgaaggacttcatcagagtgcaccacctgccccagcagctgaagcagagaatgctggagtacttccagaccacctggagcgtgaacaacggcatcgacagcaacgagctgctgaaggacttccccgacgagctgagaagcgacatcaccatgcacctgaacaaggagatcctgcagctgagcctgttcgagtgcgccagcagaggctgcctgagaagcctgagcctgcacatcaagaccagcttctgcgcccccggcgagtacctgctgagacagggcgacgccctgcaggccatctacttcgtgtgcagcggcagcatggaggtgctgaaggacagcatggtgctggccatcctgggcaagggcgacctgatcggcgccaacctgagcatcaaggaccaggtgatcaagaccaacgccgacgtgaaggccctgacctactgcgacctgcagtgcatcatcctgaagggcctgttcgaggtgctggacctgtaccccgagtacgcccacaagttcgtggaggacatccagcacgacctgacctacaacctgagagagggccacgagagcgacgtgatcagcagactgagcaacaagagcatggtgagccagagcgagcccaagggcaacggcaacatcaacaagagactgcccagcatcgtggaggacgaggaggaggaggaggagggcgaggaggaggaggccgtgagcctgagccccatctgcaccagaggcagcagcagcagaaacaagaaggtgggcagcaacaaggcctacctgggcctgagcctgaagcagctggccagcggcaccgtgcccttccacagccccatcagagtgagcagaagcaacagccccaagaccaagcaggagatcgacccccccaaccacaacaagagaaaggagaagaacctgaagctgcagctgagcaccctgaacaacgccggcccccccgacctgagccccagaatcgtggacggcatcgaggacggcaacagcagcgaggagagccagaccttcgacttcggcagcgagagaatcagaagcgagcccagaatcagcccccccctgggcgaccccgagatcggcgccgccgtgctgttcatcaaggccgaggagaccaagcagcagatcaacaagctgaacagcgaggtgaccaccctgacccaggaggtgagccagctgggcaaggacatgagaaacgtgatccagctgctggagaacgtgctgagcccccagcagcccagcagattctgcagcctgcacagcaccagcgtgtgccccagcagagagagcctgcagaccagaaccagctggagcgcccaccagccctgcctgcacctgcagaccggcggcgccgcctacacccaggcccagctgtgcagcagcaacatcaccagcgacatctggagcgtggaccccagcagcgtgggcagcagcccccagagaaccggcgcccacgagcagaaccccgccgacagcgagctgtaccacagccccagcctggactacagccccagccactaccaggtggtgcaggagggccacctgcagttcctgagatgcatcagcccccacagcgacagcaccctgacccccctgcagagcatcagcgccaccctgagcagcagcgtgtgcagcagcagcgagaccagcctgcacctggtgctgcccagcagaagcgaggagggcagcttcagccagggcaccgtgagcagcttcagcctggagaacctgcccggcagctggaaccaggagggcatggccagcgccagcaccaagcccctggagaacctgcccctggaggtggtgaccagcaccgccgaggtgaaggacaacaaggccatcaacgtgtag

SEQ ID NO: 21023 - DNA, 558 bp, Artificial Sequence
  Description of Artificial Sequence: Synthetic coding sequence
atgagcatgttcgccctgctggcccactggatggcctgcatctggtacgtgatcggcaagatggagagagaggacaacagcctgctgaagtgggaggtgggctggctgcacgagctgggcaagagactggagagcccctactacggcaacaacaccctgggcggccccagcatcagaagcgcctacatcgccgccctgtacttcaccctgagcagcctgaccagcgtgggcttcggcaacgtgagcgccaacaccgacgccgagaagatcttcagcatctgcaccatgctgatcggcgtgagccagttccaggtgtgccccagacccagctggatcatctgctggttcagaaaccacttcggcttcatcctgctgatgaccaccctgatgcacgccctggtgttcggcaacgtgaccgccatcatccagagaatgtacagcagatggagcctgtaccacaccagaaccaaggacctgaaggacttcatcagagtgcaccacctgccccagcagctgaagcagagaatgctggagtacttccagaccacctgcttctag

SEQ ID NO: 21024 - DNA, 399 bp, Artificial Sequence
  Description of Artificial Sequence: Synthetic coding sequence
atggaggccgagggcctggactggctgctggtgcccctgcaccagctggtgagctggggcgccgccgccgccatggtgttcggcggcgtggtgccctacgtgccccagtacagagacatcagaagaacccagaacgccgacggcttcagcacctacgtgtgcctggtgctgctggtggccaacatcctgagaatcctgttctggttcggcagaagattcgagagccccctgctgtggcagagcgccatcatgatcctgaccatgctgctgatgctgaagctgtgcaccgaggtgagagtggccaacgagctgaacgccagaagaagaagcttcaccgccagcagatggtgcagctgcggccccgtggtgacccccagcagaagacccaccagctgctag

SEQ ID NO: 21025 - DNA, 762 bp, Artificial Sequence
  Description of Artificial Sequence: Synthetic coding sequence
atggaggccgagggcctggactggctgctggtgcccctgcaccagctggtgagctggggcgccgccgccgccatggtgttcggcggcgtggtgccctacgtgccccagtacagagacatcagaagaacccagaacgccgacggcttcagcacctacgtgtgcctggtgctgctggtggccaacatcctgagaatcctgttctggttcggcagaagattcgagagccccctgctgtggcagagcgccatcatgatcctgaccatgctgctgatgctgaagctgtgcaccgaggtgagagtggccaacgagctgaacgccagaagaagaagcttcaccgacttcgacccccaccacttctggcagtggagcagcttcagcgactacgtgcagtgcgtgctggccttcaccggcgtggccggctacatcacctacctgagcatcgacagcgccctgttcgtggagaccctgggcttcctggccgtgctgaccgaggccatgctgggcgtgccccagctgtacagaaaccacagacaccagagcaccgagggcatgagcatcaagatggtgctgatgtggaccagcggcgacgccttcaagaccgcctacttcctgctgaagggcgcccccctgcagttcagcgtgtgcggcctgctgcaggtgctggtggacctggccatcctgggccaggcctacgccttcgccagacacccccagaagcccgccccccacgccgtgcaccccaccggcaccaaggccctgtag

SEQ ID NO: 21026 - DNA, 816 bp, Artificial Sequence
  Description of Artificial Sequence: Synthetic coding sequence
atggaggccgagggcctggactggctgctggtgcccctgcaccagctggtgagctggggcgccgccgccgccatggtgttcggcggcgtggtgccctacgtgccccagtacagagacatcagaagaacccagaacgccgacggcttcagcacctacgtgtgcctggtgctgctggtggccaacatcctgagaatcctgttctggttcggcagaagattcgagagccccctgctgtggcagagcgccatcatgatcctgaccatgctgctgatgctgaagctgtgcaccgaggtgagagtggccaacgagctgaacgccagaagaagaagcttcaccgccgccgacagcaaggacgaggaggtgaaggtggcccccagaagaagcttcctggacttcgacccccaccacttctggcagtggagcagcttcagcgactacgtgcagtgcgtgctggccttcaccggcgtggccggctacatcacctacctgagcatcgacagcgccctgttcgtggagaccctgggcttcctggccgtgctgaccgaggccatgctgggcgtgccccagctgtacagaaaccacagacaccagagcaccgagggcatgagcatcaagatggtgctgatgtggaccagcggcgacgccttcaagaccgcctacttcctgctgaagggcgcccccctgcagttcagcgtgtgcggcctgctgcaggtgctggtggacctggccatcctgggccaggcctacgccttcgccagacacccccagaagcccgccccccacgccgtgcaccccaccggcaccaaggccctgtag

SEQ ID NO: 21027 - DNA, 399 bp, Artificial Sequence; identical to SEQ ID NO: 21024
  Description of Artificial Sequence: Synthetic coding sequence

SEQ ID NO: 21028 - DNA, 876 bp, Artificial Sequence
  Description of Artificial Sequence: Synthetic coding sequence
atggtgtggaagaagctgggcagcagaaacttcagcagctgccccagcggcagcatccagtggatctgggacgtgctgggcgagtgcgcccaggacggctgggacgaggccagcgtgggcctgggcctgatcagcatcctgtgcttcgccgccagcaccttcccccagttcatcaaggcctacaagaccggcaacatggaccaggccctgagcctgtggttcctgctgggctggatcggcggcgacagctgcaacctgatcggcagcttcctggccgaccagctgcccctgcagacctacaccgccgtgtactacgtgctggccgacctggtgatgctgaccctgtacttctactacaagttcagaaccagacccagcctgctgagcgcccccatcaacagcgtgctgctgttcctgatgggcatggcctgcgccacccccctgctgagcgccgccggccccgtggccgcccccagagaggccttcagaggcagagccctgctgagcgtggagagcggcagcaagcccttcaccagacaggaggtgatcggcttcgtgatcggcagcatcagcagcgtgctgtacctgctgagcagactgccccagatcagaaccaacttcctgagaaagagcacccagggcatcagctacagcctgttcgccctggtgatgctgggcaacaccctgtacggcctgagcgtgctgctgaagaaccccgaggagggccagagcgagggcagctacctgctgcaccacctgccctggctggtgggcagcctgggcgtgctgctgctggacaccatcatcagcatccagttcctggtgtacagaagaagcaccgccgccagcgagctggagcccctgctgcccagctag

SEQ ID NO: 21029 - DNA, 876 bp, Artificial Sequence; identical to SEQ ID NO: 21028
  Description of Artificial Sequence: Synthetic coding sequence

SEQ ID NO: 21030 - DNA, 681 bp, Artificial Sequence
  Description of Artificial Sequence: Synthetic coding sequence
atggaccaggccctgagcctgtggttcctgctgggctggatcggcggcgacagctgcaacctgatcggcagcttcctggccgaccagctgcccctgcagacctacaccgccgtgtactacgtgctggccgacctggtgatgctgaccctgtacttctactacaagttcagaaccagacccagcctgctgagcgcccccatcaacagcgtgctgctgttcctgatgggcatggcctgcgccacccccctgctgagcgccgccggccccgtggccgcccccagagaggccttcagaggcagagccctgctgagcgtggagagcggcagcaagcccttcaccagacaggaggtgatcggcttcgtgatcggcagcatcagcagcgtgctgtacctgctgagcagactgccccagatcagaaccaacttcctgagaaagagcacccagggcatcagctacagcctgttcgccctggtgatgctgggcaacaccctgtacggcctgagcgtgctgctgaagaaccccgaggagggccagagcgagggcagctacctgctgcaccacctgccctggctggtgggcagcctgggcgtgctgctgctggacaccatcatcagcatccagttcctggtgtacagaagaagcaccgccgccagcgagctggagcccctgctgcccagctag

SEQ ID NO: 21031 - DNA, 609 bp, Artificial Sequence
  Description of Artificial Sequence: Synthetic coding sequence
atggaggccgccctgctgggcctgtgcaactggagcaccctgggcgtgtgcgccgccctgaagctgccccagatcagcgccgtgctggccgccagaagcgccagaggcctgagcctgcccagcctgctgctggagctggccggcttcctggtgttcctgagataccagtgctactacggctacccccccctgacctacctggagtaccccatcctgatcgcccaggacgtgatcctgctgctgtgcatcttccacttcaacggcaacgtgaagcaggccaccccctacatcgccgtgctggtgagcagctggttcatcctggccctgcagaagtggatcatcgacctggccatgaacctgtgcaccttcatcagcgccgccagcaagttcgcccagctgcagtgcctgtggaagaccagagacagcggcaccgtgagcgccctgacctggagcctgagcagctacacctgcgccaccagaatcatcaccaccctgatgaccaccaacgacttcaccatcctgctgagattcgtgatcatgctggccctgaacatctgggtgaccgtgaccgtgctgagatacagaaagaccgccatcaaggccgagtag

SEQ ID NO: 21032 - DNA, 567 bp, Artificial Sequence
  Description of Artificial Sequence: Synthetic coding sequence
atggaggccgccctgctgggcctgtgcaactggagcaccctgggcgtgtgcgccgccctgaagctgccccagatcagcgccgtgctggccgccagaagcgccagaggcctgagcctgcccagcctgctgctggagctggccggcttcctggtgttcctgagataccagtgctactacggctacccccccctgacctacctggagtaccccatcctgatcgcccaggacgtgatcctgctgctgtgcatcttccacttcaacggcaacgtgaagcaggccaccccctacatcgccgtgctggtgagcagctggttcatcctggccctgcagaagtggatcatcgacctggccatgaacctgtgcaccttcatcagcgccgccagcaagttcgcccagctgcagtgcctgtggaagaccagagacagcggcaccgtgagcgccctgacctggagcctgagcagctacacctgcgccatcctgctgagattcgtgatcatgctggccctgaacatctgggtgaccgtgaccgtgctgagatacagaaagaccgccatcaaggccgagtag

SEQ ID NO: 21033 - DNA, 2127 bp, Artificial Sequence
  Description of Artificial Sequence: Synthetic coding sequence
atgagccagtacaccgagaaggagcccgccgccatggaccaggagagcggcaaggccgtgtggcccaagcccgccggcggctaccagaccatcaccggcagaagatacggcagaagacacgcctacgtgagcttcaagccctgcatgaccagacacgagagaagcctgggcagagccggcgacgactacgaggtgctggagctggacgacgtgcccaaggagaacagcagcggcagcagccccctggaccaggtggacagcagcctgcccagcgagcccatcttcgagaagagcgagaccgagatccccacctgcggcagcgccctgaaccagaccaccgagagcagccagagcttcgtggccgtgcaccacagcgaggagggcagagacaccctgggcagcagcaccaacctgcacaaccacagcgagggcgagtacatccccggcgcctgcagcgccagcagcgtgcagaacggcatcgccctggtgcacaccgacagctacgaccccgacggcaagcacggcgaggacaacgaccacctgcagctgagcgccgaggtggtggagggcagcagataccaggagagcctgggcaacaccgtgttcgagctggagaacagagaggccgaggcctacaccggcctgagcccccccgtgcccagcttcaactgcgaggtgagagacgagttcgaggagctggacagcgtgcccctggtgaagagcagcgccggcgacaccgagttcgtgcaccagaacagccaggagatccagagaagcagccaggacgagatggtgagcaccaagcagcagaacaacaccagccaggagagacagaccgagcacagccccgaggacgccgcctgcggccccggccacatctgcagcgagcagaacaccaacgacagagagaagaaccacggcagcagccccgagcaggtggtgagacccaaggtgagaaagctgatcagcagcagccaggtggaccaggagaccggcttcaacagacacgaggccaagcagagaagcgtgcagagatggagagaggccctggaggtggaggagagcggcagcgacgacctgctgatcaagtgcgaggagtacgacggcgagcacgactgcatgttcctggaccccccctacagcagagtgatcacccagagagagaccgagaacaaccagatgaccagcgagagcggcgccaccgccggcagacaggaggtggacaacaccttctggaacggctgcggcgactactaccagctgtacgacaaggacgaggacagcagcgagtgcagcgacggcgagtggagcgccagcctgccccacagattcagcggcaccgagaaggaccagagcagcagcgacgagagctgggagaccctgcccggcaaggacgagaacgagcccgagctgcagagcgacagcagcggccccgaggaggagaaccaggagctgagcctgcaggagggcgagcagaccagcctggaggagggcgagatcccctggctgcagtacaacgaggtgaacgagagcagcagcgacgagggcaacgagcccgccaacgagttcgcccagcccgccttcatgctggacggcaacaacaacctggaggacgacagcagcgtgagcgaggacctggacgtggactggagcctgttcgacggcttcgccgacggcctgggcgtggccgaggccatcagctacgtggacccccagttcctgacctacatggccctggaggagagactggcccaggccatggagaccgccctggcccacctggagagcctggccgtggacgtggaggtggccaacccccccgccagcaaggagagcatcgacggcctgcccgagaccctggtgctggaggaccacaccgccatcggccaggagcagtgctgccccatctgctgcagcgagtacatcaaggacgacatcgccaccgagctgccctgccaccacttcttccacaagccctgcgtgagcatctggctgcagaagagcggcacctgccccgtgtgcagaagacacttcccccccgccgtgatcgaggccagcgccgcccccagcagcgagcccgaccccgacgccccccccagcaacgacagcatcgccgaggccccctag

SEQ ID NO: 21034 - DNA, 2127 bp, Artificial Sequence; identical to SEQ ID NO: 21033
  Description of Artificial Sequence: Synthetic coding sequence

SEQ ID NO: 21035 - DNA, 570 bp, Artificial Sequence
  Description of Artificial Sequence: Synthetic coding sequence
atgggcgtgagcgtggacgtgcaccaggtgtacaagtaccccttcgagcaggtggtggccagcttcctgagaaagtaccccaaccccatggacaagaacgtgatcagcgtgaagatcatggaggagaagagagacgagagcaccggcgtgatctacagaaagagaatcgccatctgccagaacgtggtgcccgagatcctgagaaagagcctgagcaccctggtgatcctgtgctggaagaaggtgagcatcctgaaggtgcccaacatccagctggaggaggagagctggctgaaccccagagagagaaacatggccatcagaagccactgcctgacctggacccagtacgccagcatgaaggaggagagcgtgttcagagagagcatggagaaccccaactggaccgagttcatccagagaggcagaatcagcatcaccggcgtgggcttcctgaactgcgtgctggagaccttcgccagcaccttcctgagacagggcgcccagaagggcatcagaatcatggagatgctgctgaaggagcagtgcggcgcccccctggccgagtag

SEQ ID NO: 21036 - DNA, 534 bp, Artificial Sequence
  Description of Artificial Sequence: Synthetic coding sequence
atgggcgtgagcgtggacgtgcaccaggtgtacaagtaccccttcgagcaggtggtggccagcttcctgagaaagtaccccaaccccatggacaagaacgtgatcagcgtgaagatcatggaggagaagagagacgagagcaccggcgtgatctacagaaagagaatcgccatctgccagaacgtggtgcccgagatcctgagaaaggtgagcatcctgaaggtgcccaacatccagctggaggaggagagctggctgaaccccagagagagaaacatggccatcagaagccactgcctgacctggacccagtacgccagcatgaaggaggagagcgtgttcagagagagcatggagaaccccaactggaccgagttcatccagagaggcagaatcagcatcaccggcgtgggcttcctgaactgcgtgctggagaccttcgccagcaccttcctgagacagggcgcccagaagggcatcagaatcatggagatgctgctgaaggagcagtgcggcgcccccctggccgagtag

SEQ ID NO: 21037 - DNA, 447 bp, Artificial Sequence
  Description of Artificial Sequence: Synthetic coding sequence
atggacaagaacgtgatcagcgtgaagatcatggaggagaagagagacgagagcaccggcgtgatctacagaaagagaatcgccatctgccagaacgtggtgcccgagatcctgagaaaggtgagcatcctgaaggtgcccaacatccagctggaggaggagagctggctgaaccccagagagagaaacatggccatcagaagccactgcctgacctggacccagtacgccagcatgaaggaggagagcgtgttcagagagagcatggagaaccccaactggaccgagttcatccagagaggcagaatcagcatcaccggcgtgggcttcctgaactgcgtgctggagaccttcgccagcaccttcctgagacagggcgcccagaagggcatcagaatcatggagatgctgctgaaggagcagtgcggcgcccccctggccgagtag

SEQ ID NO: 21038 - DNA, 267 bp, Artificial Sequence
  Description of Artificial Sequence: Synthetic coding sequence
atgcaccagaagctgctgaagagcgcccactacatcgagctgggcagctaccagtactggcccgtgctggtgcccagaggcatcagactgtacacctacgagcagatccccggcagcctgaaggacaacccctacatcaccgacggctacagagcctacctgcccagcagactgtgcatcaagagaagcgtgtgcttcgccctgtgggccatcatcttcttccccgccatcggccagaagaagcacgtggaggacggctggcactag

SEQ ID NO: 21039 - DNA, 876 bp, Artificial Sequence
  Description of Artificial Sequence: Synthetic coding sequence
atgcaccagaagctgctgaagagcgcccactacatcgagctgggcagctaccagtactggcccgtgctggtgcccagaggcatcagactgtacacctacgagcagatccccggcagcctgaaggacaacccctacatcaccgacggctacagagcctacctgcccagcagactgtgcatcaagagcctgttcatcctgagcaacgagaccgtgaacatctggagccacctgctgggcttcttcctgttcttcaccctgggcatctacgacatgaccagcgtgctgcccagcgccagcgccagcagagaggacttcgtgatctgcagcatctgcctgttctgcttccaggtgtgcatgctgtgcagcgtgggctaccacctgttcagctgccacagaagcgagaagacctgcagaagatggatggccctggactacgccggcatcagcatcggcatcctgggctgctacgtgagcggcgtgttctacgccttctactgcaacaactactggagacaggtgtacctgatcaccgtgctggccatgatcctggccgtgttcttcgcccagatccaccccaactacctgacccagcagtggcagagactgagaagcatcatcttctgcagcgtgagcggctacggcgtgatccccaccctgcactgggtgtggctgaacggcggcatcggcgcccccatcgtgcaggacttcgcccccagagtgatcgtgatgtacatgatcgccctgctggccttcctgttctacatcagcaaggtgcccgagagatacttccccgagaacatcttcagatggaagatcaccaagagaaccctgggcggcgtgaacaacagcctgcagaacctgtacctgctggtgtag

SEQ ID NO: 21040 - DNA, 936 bp, Artificial Sequence
  Description of Artificial Sequence: Synthetic coding sequence
atgcaccagaagctgctgaagagcgcccactacatcgagctgggcagctaccagtactggcccgtgctggtgcccagaggcatcagactgtacacctacgagcagatccccggcagcctgaaggacaacccctacatcaccgacggctacagagcctacctgcccagcagactgtgcatcaagagcctgttcatcctgagcaacgagaccgtgaacatctggagccacctgctgggcttcttcctgttcttcaccctgggcatctacgacatgaccagcgtgctgcccagcgccagcgccagcagagaggacttcgtgatctgcagcatctgcctgttctgcttccaggtgtgcatgctgtgcagcgtgggctaccacctgttcagctgccacagaagcgagaagacctgcagaagatggatggccctggactacgccggcatcagcatcggcatcctgggctgctacgtgagcggcgtgttctacgccttctactgcaacaactactggagacaggtgtacctgatcaccgtgctggccatgatcctggccgtgttcttcgcccagatccaccccaactacctgacccagcagtggcagagactgagaagcatcatcttctgcagcgtgagcggctacggcgtgatccccaccctgcactgggtgtggctgaacggcggcatcggcgcccccatcgtgcaggacttcgcccccagagtgatcgtgatgtacatgatcgccctgctggccttcctgttctacatcagcaaggtgcccgagagatacttccccggccagctgaactacctgggcagcagccaccagatctggcacatcctggccgtggtgatgctgtactggtggcaccagagcaccgtgtacgtgatgcagtacagacacagcaagccctgccccgactacgtgagccacctgtag

SEQ ID NO: 21041 - DNA, 936 bp, Artificial Sequence; identical to SEQ ID NO: 21040
  Description of Artificial Sequence: Synthetic coding sequence

SEQ ID NO: 21042 - DNA, 600 bp, Artificial Sequence
  Description of Artificial Sequence: Synthetic coding sequence
atggccttcctggccggccccagactgctggactgggccagcagccccccccacctgcagttcaacaagttcgtgctgaccggctacagacccgccagcagcggcagcggctgcctgagaagcctgttctacctgcacaacgagctgggcaacatctacacccacggcgccctgcccatcatccactgcaccctggcctgcagaccctggctgagacccgccgccctggtgggctacaccgtgctgagcggcgtggccggctggagagccctgaccgcccccagcaccagcgccagactgagagccttcggctggcaggccgccgccagactgctggtgttcggcgccagaggcgtgggcctgggcagcggcgcccccggcagcctgccctgctacctgagaatggacgccctggccctgctgggcggcctggtgaacgtggccagactgcccgagagatggggccccggcagattcgactactggggcaacagccaccagatcatgcacctgctgagcgtgggcagcatcctgcagctgcacgccggcgtggtgcccgacctgctgtgggccgcccaccacgcctgccccagagactag

SEQ ID NO: 21043 - DNA, 822 bp, Artificial Sequence
  Description of Artificial Sequence: Synthetic coding sequence
atggccttcctggccggccccagactgctggactgggccagcagccccccccacctgcagttcaacaagttcgtgctgaccggctacagacccgccagcagcggcagcggctgcctgagaagcctgttctacctgcacaacgagctgggcaacatctacacccacggcctggccctgctgggcttcctggtgctggtgcccatgaccatgccctggggccagctgggcaaggacggctggctgggcggcacccactgcgtggcctgcctggccccccccgccggcagcgtgctgtaccacctgttcatgtgccaccagggcggcagcgccgtgtacgccagactgctggccctggacatgtgcggcgtgtgcctggtgaacaccctgggcgccctgcccatcatccactgcaccctggcctgcagaccctggctgagacccgccgccctggtgggctacaccgtgctgagcggcgtggccggctggagagccctgaccgcccccagcaccagcgccagactgagagccttcggctggcaggccgccgccagactgctggtgttcggcgccagaggcgtgggcctgggcagcggcgcccccggcagcctgccctgctacctgagaatggacgccctggccctgctgggcggcctggtgaacgtggccagactgcccgagagatggggccccggcagattcgactactggggcaacagccaccagatcatgcacctgctgagcgtgggcagcatcctgcagctgcacgccggcgtggtgcccgacctgctgtgggccgcccaccacgcctgccccagagactag

SEQ ID NO: 21044 - DNA, 1134 bp, Artificial Sequence
  Description of Artificial Sequence: Synthetic coding sequence
atgcccagaagactgcagcccagaggcgccggcaccaagggcccccccgcccccgcccccgccgccagcggcgccgccagaaacagccacagcgccgccagcagagacccccccgccagcgccaagcccctgctgagatgggacgaggtgcccgacgacttcgtggagtgcttcatcctgagcggctacagaagactgccctgcaccgcccaggagtgcctggccagcgtgctgaagcccaccaacgagaccctgaacttctggacccacttcatccccctgctgctgttcctgagcaagttctgcagactgttcttcctgagcggcggcgacgtgcccttccaccacccctggctgctgcccctgtggtgctacgccagcggcgtgctgctgaccttcgccatgagctgcaccgcccacgtgttcagctgcctgagcctgagactgagagccgccttcttctacctggactacgccagcatcagctactacggcttcggcagcaccgtggcctactactactacctgctgcccggcctgagcctgctggacgccagagtgatgaccccctacctgcagcagagactgggctggcacgtggactgcaccagactgatcgccgcctacagagccctggtgctgcccgtggccttcgtgctggccgtggcctgcaccgtggcctgctgcaagagcagaaccgactggtgcacctaccccttcgccctgagaaccttcgtgttcgtgatgcccctgagcatggcctgccccatcatgctggagagctggctgttcgacctgagaggcgagaaccccaccctgttcgtgcacttctacagaagatacttctggctggtggtggccgccttcttcaacgtgagcaagatccccgagagaatccagcccggcctgttcgacatcatcggccacagccaccagctgttccacatcttcaccttcctgagcatctacgaccaggtgtactacgtggaggagggcctgagacagttcctgcaggccccccccgccgcccccaccttcagcggcaccgtgggctacatgctgctgctggtggtgtgcctgggcctggtgatcagaaagttcctgaacagcagcgagttctgcagcaagaagtag

SEQ ID NO: 21045 - DNA, 993 bp, Artificial Sequence
  Description of Artificial Sequence: Synthetic coding sequence
atgctgagcctgaagctgcccagactgttcagcatcgaccagatcccccaggtgttccacgagcagggcatcctgttcggctacagacacccccagagcagcgccaccgcctgcatcctgagcctgttccagatgaccaacgagaccctgaacatctggacccacctgctgcccttctggttcttcgcctggagattcgtgaccgccctgtacatgaccgacatcaagaacgacagctacagctggcccatgctggtgtacatgtgcaccagctgcgtgtaccccctggtgagcagctgcgcccacaccttcagcagcatgagcaagaacgccagacacatctgctacttcctggactacggcgccgtgaacctgttcagcctgggcagcgccatcgcctacagcgcctacaccttccccgacgccctgatgtgcaccaccttccacgactactacgtggccctggccgtgctgaacaccatcctgagcaccggcctgagctgctacagcagattcctggagatccagaagcccagactgtgcaaggtgatcagagtgctggccttcgcctacccctacacctgggacagcctgcccatcttctacagactgttcctgttccccggcgagagcgcccagaacgaggccaccagctaccaccagaagcacatgatcatgaccctgctggccagcttcctgtacagcgcccacctgcccgagagactggcccccggcagattcgactacatcggccacagccaccagctgttccacgtgtgcgtgatcctggccacccacatgcagatggaggccatcctgctggacaagaccctgagaaaggagtggctgctggccaccagcaagcccttcagcttcagccagatcgccggcgccatcctgctgtgcatcatcttcagcctgagcaacatcatctacttcagcgccgccctgtacagaatccccaagcccgagctgcacaagaaggagacctag

SEQ ID NO: 21046 - DNA, 993 bp, Artificial Sequence; identical to SEQ ID NO: 21045
  Description of Artificial Sequence: Synthetic coding sequence

SEQ ID NO: 21047 - DNA, 993 bp, Artificial Sequence; identical to SEQ ID NO: 21045
  Description of Artificial Sequence: Synthetic coding sequence

SEQ ID NO: 21048 - DNA, 1035 bp, Artificial Sequence
  Description of Artificial Sequence: Synthetic coding sequence
atgctgagcctgaagctgccccagctgctgcaggtgcaccaggtgcccagagtgttctgggaggacggcatcatgagcggctacagaagacccaccagcagcgccctggactgcgtgctgagcagcttccagatgaccaacgagaccgtgaacatctggacccacttcctgcccacctggtacttcctgtggagactgctggccctggccggcggccccggcttcagagccgagccctaccactggcccctgctggtgttcctgctgcccgcctgcctgtaccccttcgccagctgctgcgcccacaccttcagcagcatgagccccagaatgagacacatctgctacttcctggactacggcgccctgagcctgtacagcctgggctgcgccttcccctacgccgcctacagcatgcccgccagctggctgcacggccacctgcaccagttcttcgtgcccgccgccgccctgaacagcttcctgtgcaccggcctgagctgctacagcagattcctggagctggagagccccggcctgagcaaggtgctgagaaccggcgccttcgcctaccccttcctgttcgacaacctgcccctgttctacagactgggcctgtgctggggcagaggccacggctgcggccaggaggccctgagcaccagccacggctaccacctgttctgcgccctgctgaccggcttcctgttcgccagccacctgcccgagagactggcccccggcagattcgactacatcggccacagccaccagctgttccacatctgcgccgtgctgggcacccacttccagctggaggccgtgctggccgacatgggcagcagaagagcctggctggccacccaggagcccgccctgggcctggccggcaccgtggccaccctggtgctggccgccgccggcaacctgctgatcatcgccgccttcaccgccaccctgctgagagcccccagcacctgccccctgctgcagggcggccccctggagggcggcacccaggccaagcagcagtag

SEQ ID NO: 21049 - DNA, 1056 bp, Artificial Sequence
  Description of Artificial Sequence: Synthetic coding sequence
atgagccccagaatgagacacatctgctacttcctggactacggcgccctgagcctgtacagcctgggctgcgccttcccctacgccgcctacagcatgcccgccagctggctgcacggccacctgcaccagttcttcgtgcccgccgccgccctgaacagcttcctgtgcaccggcctgagctgctacagcagattcctggagctggagagccccggcctgagcaaggtgctgagaaccggcgccttcgcctaccccttcctgttcgacaacctgcccctgttctacagactgggcctgtgctggggcagaggccacggctgcggccaggaggccctgagcaccagccacggctaccacctgttctgcgccctgctgaccggcttcctgttcgccagccacctgcccgagagactggcccccggcagattcgactacatcggcgagggcacccccggccccgccagagaggaggccggcgccgacgccttccccgagcacagaatgaactgggccaccgccaccagctacagcaccagcgtgcagtgctgggcccccaccagcagctggagacagtgctggctgatctgggaccacgccgagcccggctggccccacagaaacctgccctgggcctggcaggcccagtggccccactggagctggctgcagctgggcacctacagcctgctgctgctgagccagcccccctgcttcggcccccccgtgcacgccctgtgctgcagagtggcccactggagaggcgtgcccagacccaacaacagcgaggcccccagcctgaccctgagctggagaggccagagacccggccccagcgccgacgaggagcccagattcggccccaaccaggtgggcacccacctgagcctggagcccaccggcgccgaggagagaggccacagaagagagggcagagaggaggagggctgcctgggcggcctggccgagtgcgagagagacagagagggcgccctggacggcagcggcagaagcgccgagggcctgagaggcgagatgcacgcctgccccggctag

SEQ ID NO: 21050 - DNA, 1092 bp, Artificial Sequence
  Description of Artificial Sequence: Synthetic coding sequence
accctgccccccagcgcctggctggccgccgccctggacagcgccagaggcgccctgggcctgctgacccaccagctgagaagcacccaccaggccctgggcgtgctgggcagatggcaccacgtgtggctgccccccccccaccagctgggcttcggcctgtgcccccagctgctgcccgacgaccagagagacggccagcacctggacagcctgcccgcccacctggtgagaggcggcagcgcccccggcagaggcctggagctgagaggcggcacccaggccggcagagacagacccggccccagagccgccgccgccgtggccggcgtgagaggcggcctgagcaccagacccccccaggtgctgcccgtggccgcccccggcgccggcggcagacccagactgccctgcggcgccgtgcccctggccgccgccggcctgcccgccgccagactgcccctgcccctgagagtggtgctgagagcccacctgcagctgcacgtggccccccacgccccccacctgctgctgcccagactgagaagagcccagcccctgcagagcggcttcctggagctggagagccccggcctgagcaaggtgctgagaaccggcgccttcgcctaccccttcctgttcgacaacctgcccctgttctacagactgggcctgtgctggggcagaggccacggctgcggccaggaggccctgagcaccagccacggctaccacctgttctgcgccctgctgaccggcttcctgttcgccagccacctgcccgagagactggcccccggcagattcgactacatcggccacagccaccagctgttccacatctgcgccgtgctgggcacccacttccagctggaggccgtgctggccgacatgggcagcagaagagcctggctggccacccaggagcccgccctgggcctggccggcaccgtggccaccctggtgctggccgccgccggcaacctgctgatcatcgccgccttcaccgccaccctgctgagagcccccagcacctgccccctgctgcagggcggccccctggagggcggcacccaggccaagcagcagtag

SEQ ID NO: 21051 - DNA, 1056 bp, Artificial Sequence; identical to SEQ ID NO: 21049
  Description of Artificial Sequence: Synthetic coding sequence

SEQ ID NO: 21052 - DNA, 1056 bp, Artificial Sequence; identical to SEQ ID NO: 21049
  Description of Artificial Sequence: Synthetic coding sequence

SEQ ID NO: 21053 - DNA, 963 bp, Artificial Sequence
  Description of Artificial Sequence: Synthetic coding sequence
atgagcggctacagaagacccaccagcagcgccctggactgcgtgctgagcagcttccagatgaccaacgagaccgtgaacatctggacccacttcctgcccacctggtacttcctgtggagactgctggccctggccggcggccccggcttcagagccgagccctaccactggcccctgctggtgttcctgctgcccgcctgcctgtaccccttcgccagctgctgcgcccacaccttcagcagcatgagccccagaatgagacacatctgctacttcctggactacggcgccctgagcctgtacagcctgggctgcgccttcccctacgccgcctacagcatgcccgccagctggctgcacggccacctgcaccagttcttcgtgcccgccgccgccctgaacagcttcctgtgcaccggcctgagctgctacagcagattcctggagctggagagccccggcctgagcaaggtgctgagaaccggcgccttcgcctaccccttcctgttcgacaacctgcccctgttctacagactgggcctgtgctggggcagaggccacggctgcggccaggaggccctgagcaccagccacggctaccacctgttctgcgccctgctgaccggcttcctgttcgccagccacctgcccgagagactggcccccggcagattcgactacatcggccacagccaccagctgttccacatctgcgccgtgctgggcacccacttccagctggaggccgtgctggccgacatgggcagcagaagagcctggctggccacccaggagcccgccctgggcctggccggcaccgtggccaccctggtgctggccgccgccggcaacctgctgatcatcgccgccttcaccgccaccctgctgagagcccccagcacctgccccctgctgcagggcggccccctggagggcggcacccaggccaagcagcagtag

SEQ ID NO: 21054 - DNA, 381 bp, Artificial Sequence
  Description of Artificial Sequence: Synthetic coding sequence
ctgcccctgcccctgagagtggtgctgagagcccacctgcagctgcacgtggccccccacgccccccacctgctgctgcccagactgagaagattcgactacatcggccacagccaccagctgttccacatctgcgccgtgctgggcacccacttccagctggaggccgtgctggccgacatgggcagcagaagagcctggctggccacccaggagcccgccctgggcctggccggcaccgtggccaccctggtgctggccgccgccggcaacctgctgatcatcgccgccttcaccgccaccctgctgagagcccccagcacctgccccctgctgcagggcggccccctggagggcggcacccaggccaagcagcagtag

SEQ ID NO: 21055 - DNA, 1026 bp, Artificial Sequence
  Description of Artificial Sequence: Synthetic coding sequence
atgctgagcctgaagctgccccagctgctgcaggtgcaccaggtgttctgggaggacggcatcatgagcggctacagaagacccaccagcagcgccctggactgcgtgctgagcagcttccagatgaccaacgagaccgtgaacatctggacccacttcctgcccacctggtacttcctgtggagactgctggccctggccggcggccccggcttcagagccgagccctaccactggcccctgctggtgttcctgctgcccgcctgcctgtaccccttcgccagctgctgcgcccacaccttcagcagcatgagccccagaatgagacacatctgctacttcctggactacggcgccctgagcctgtacagcctgggctgcgccttcccctacgccgcctacagcatgcccgccagctggctgcacggccacctgcaccagttcttcgtgcccgccgccgccctgaacagcttcctgtgcaccggcctgagctgctacagcagattcctggagctggagagccccggcctgagcaaggtgctgagaaccggcgccttcgcctaccccttcctgttcgacaacctgcccctgttctacagactgggcctgtgctggggcagaggccacggctgcggccaggaggccctgagcaccagccacggctaccacctgttctgcgccctgctgaccggcttcctgttcgccagccacctgcccgagagactggcccccggcagattcgactacatcggccacagccaccagctgttccacatctgcgccgtgctgggcacccacttccagctggaggccgtgctggccgacatgggcagcagaagagcctggctggccacccaggagcccgccctgggcctggccggcaccgtggccaccctggtgctggccgccgccggcaacctgctgatcatcgccgccttcaccgccaccctgctgagagcccccagcacctgccccctgctgcagggcggccccctggagggcggcacccaggccaagcagcagtag

SEQ ID NO: 21056 - DNA, 1065 bp, Artificial Sequence
  Description of Artificial Sequence: Synthetic coding sequence
atgaccaccgccatcctggagagactgagcaccctgagcgtgagcggccagcagctgagaagactgcccaagatcctggaggacggcctgcccaagatgccctgcaccgtgcccgagaccgacgtgccccagctgttcagagagccctacatcagaaccggctacagacccaccggccacgagtggagatactacttcttcagcctgttccagaagcacaacgaggtggtgaacgtgtggacccacctgctggccgccctggccgtgctgctgagattctgggccttcgccgaggccgaggccctgccctgggccagcacccacagcctgcccctgctgctgttcatcctgagcagcatcacctacctgacctgcagcctgctggcccacctgctgcagagcaagagcgagctgagccactacaccttctacttcgtggactacgtgggcgtgagcgtgtaccagtacggcagcgccctggcccacttcttctacagcagcgaccaggcctggtacgacagattctggctgttcttcctgcccgccgccgccttctgcggctggctgagctgcgccggctgctgctacgccaagtacagatacagaagaccctaccccgtgatgagaaagatctgccaggtggtgcccgccggcctggccttcatcctggacatcagccccgtggcccacagagtggccctgtgccacctggccggctgccaggagcaggccgcctggtaccacaccctgcagatcctgttcttcctggtgagcgcctacttcttcagctgccccgtgcccgagaagtacttccccggcagctgcgacatcgtgggccacggccaccagatcttccacgccttcctgagcatctgcaccctgagccagctggaggccatcctgctggactaccagggcagacaggagatcttcctgcagagacacggccccctgagcgtgcacatggcctgcctgagcttcttcttcctggccgcctgcagcgccgccaccgccgccctgctgagacacaaggtgaaggccagactgaccaagaaggacagctag

SEQ ID NO: 21057 - DNA, 1065 bp, Artificial Sequence; identical to SEQ ID NO: 21056
  Description of Artificial Sequence: Synthetic coding sequence

SEQ ID NO: 21058 - DNA, 339 bp, Artificial Sequence
  Description of Artificial Sequence: Synthetic coding sequence
atgaccaccgccatcctggagagactgagcaccctgagcgtgagcggccagcagctgagaagactgcccaagatcctggaggacggcctgcccaagatgccctgcaccgtgcccgagaccgacgtgccccagctgttcagagagccctacatcagaaccggctacagacccaccggccacgagtggagatactacttcttcagcctgttccagaagcacaacgaggtggtgaacgtgtggacccacctgctggccgccctggccgtgctgctgagattctgggccttcgccgaggccgaggccctgccctgggccagcacccacagcctgcccctgtag

SEQ ID NO: 21059 - DNA, 576 bp, Artificial Sequence
  Description of Artificial Sequence: Synthetic coding sequence
atggccgcctacagctacagacccggccccggcgccggccccggccccgccgccggcgccgccctgcccgaccagagcttcctgtggaacgtgttccagagagtggacaaggacagaagcggcgtgatcagcgacaccgagctgcagcaggccctgagcaacggcacctggacccccttcaaccccgtgaccgtgagaagcatcatcagcatgttcgacagagagaacaaggccggcgtgaacttcagcgagttcaccggcgtgtggaagtacatcaccgactggcagaacgtgttcagaacctacgacagagacaacagcggcatgatcgacaagaacgagctgaagcaggccctgagcggcttcggctacagactgagcgaccagttccacgacatcctgatcagaaagttcgacagacagggcagaggccagatcgccttcgacgacttcatccagggctgcatcgtgctgcagagactgaccgacatcttcagaagatacgacaccgaccaggacggctggatccaggtgagctacgagcagtacctgagcatggtgttcagcatcgtgtag

SEQ ID NO: 21060 - DNA, 210 bp, Artificial Sequence
  Description of Artificial Sequence: Synthetic coding sequence
atggccgcctacagctacagacccggccccggcgccggccccggccccgccgccggcgccgccctgcccgaccagagcttcctgtggaacgtgttccagagagtggacaaggacagaagcggcgtgatcagcgacaccgagctgcagcaggccctgagcaacggcacctggacccccttcaaccccgtgaccgtgagaagcatcatctag

SEQ ID NO: 21061 - DNA, 222 bp, Artificial Sequence
  Description of Artificial Sequence: Synthetic coding sequence
atggccgcctacagctacagacccggccccggcgccggccccggccccgccgccggcgccgccctgcccgaccagagcttcctgtggaacgtgttccagagagtggacaaggacagaagcggcgtgatcagcgacaccgagctgcagcaggccctgagcaacggcacctggacccccttcaaccccgtgaccgtgagaagcatcatctgcagaggcagatag

SEQ ID NO: 21062 - DNA, 570 bp, Artificial Sequence
  Description of Artificial Sequence: Synthetic coding sequence
atggccgcctacagctacagacccggccccggcgccggccccggccccgccgccggcgccgccctgcccgaccagagcttcctgtggaacgtgttccagagagtggacaaggacagaagcggcgtgatcagcgacaccgagctgcagcaggccctgagcaacggcacctggacccccttcaaccccgtgaccgtgagaagcatcatcagcatgttcgacagagagaacaaggccggcgtgaacttcagcgagttcaccggcgtgtggaagtacatcaccgactggcagaacgtgttcagaacctacgacagagacaacagcggcatgatcgacaagaacgagctgaagcaggccctgagcggctacagactgagcgaccagttccacgacatcctgatcagaaagttcgacagacagggcagaggccagatcgccttcgacgacttcatccagggctgcatcgtgctgcagagactgaccgacatcttcagaagatacgacaccgaccaggacggctggatccaggtgagctacgagcagtacctgagcatggtgttcagcatcgtgtag

SEQ ID NO: 21063 - DNA, 168 bp, Artificial Sequence
  Description of Artificial Sequence: Synthetic coding sequence
atggccgcctacagctacagacccggccccggcgccggccccggccccgccgccggcgccgccctgcccgaccagagcttcctgtggaacgtgttccagagagtggacaaggacagaagcggcgtgatcagcgacaccgagctgcagcaggccctgagcaacggctag

SEQ ID NO: 21064 - DNA, 1182 bp, Artificial Sequence
  Description of Artificial Sequence: Synthetic coding sequence
atggagaccaccatgggcttcatggacgacaacgccaccaacaccagcaccagcttcctgagcgtgctgaacccccacggcgcccacgccaccagcttccccttcaacttcagctacagcgactacgacatgcccctggacgaggacgaggacgtgaccaacagcagaaccttcttcgccgccaagatcgtgatcggcatggccctggtgggcatcatgctggtgtgcggcatcggcaacttcatcttcatcgccgccctggtgagatacaagaagctgagaaacctgaccaacctgctgatcgccaacctggccatcagcgacttcctggtggccatcgtgtgctgccccttcgagatggactactacgtggtgagacagctgagctgggagcacggccacgtgctgtgcaccagcgtgaactacctgagaaccgtgagcctgtacgtgagcaccaacgccctgctggccatcgccatcgacagatacctggccatcgtgcaccccctgagacccagaatgaagtgccagaccgccaccggcctgatcgccctggtgtggaccgtgagcatcctgatcgccatccccagcgcctacttcaccaccgagaccgtgctggtgatcgtgaagagccaggagaagatcttctgcggccagatctggcccgtggaccagcagctgtactacaagagctacttcctgttcatcttcggcatcgagttcgtgggccccgtggtgaccatgaccctgtgctacgccagaatcagcagagagctgtggttcaaggccgtgcccggcttccagaccgagcagatcagaaagagactgagatgcagaagaaagaccgtgctggtgctgatgtgcatcctgaccgcctacgtgctgtgctgggcccccttctacggcttcaccatcgtgagagacttcttccccaccgtgttcgtgaaggagaagcactacctgaccgccttctacatcgtggagtgcatcgccatgagcaacagcatgatcaacaccctgtgcttcgtgaccgtgaagaacgacaccgtgaagtacttcaagaagatcatgctgctgcactggaaggccagctacaacggcggcaagagcagcgccgacctggacctgaagaccatcggcatgcccgccaccgaggaggtggactgcatcagactgaagtag

SEQ ID NO: 21065 - DNA, 1182 bp, Artificial Sequence; identical to SEQ ID NO: 21064
  Description of Artificial Sequence: Synthetic coding sequence

SEQ ID NO: 21066 - DNA, 1113 bp, Artificial Sequence
  Description of Artificial Sequence: Synthetic coding sequence
atggccagcagcaccaccagaggccccagagtgagcgacctgttcagcggcctgccccccgccgtgaccacccccgccaaccagagcgccgaggccagcgccggcaacggcagcgtggccggcgccgacgcccccgccgtgacccccttccagagcctgcagctggtgcaccagctgaagggcctgatcgtgctgctgtacagcgtggtggtggtggtgggcctggtgggcaactgcctgctggtgctggtgatcgccagagtgagaagactgcacaacgtgaccaacttcctgatcggcaacctggccctgagcgacgtgctgatgtgcaccgcctgcgtgcccctgaccctggcctacgccttcgagcccagaggctgggtgttcggcggcggcctgtgccacctggtgttcttcctgcagcccgtgaccgtgtacgtgagcgtgttcaccctgaccaccatcgccgtggacagatacgtggtgctggtgcaccccctgagaagaagaatcagcctgagactgagcgcctacgccgtgctggccatctgggccctgagcgccgtgctggccctgcccgccgccgtgcacacctaccacgtggagctgaagccccacgacgtgagactgtgcgaggagttctggggcagccaggagagacagagacagctgtacgcctggggcctgctgctggtgacctacctgctgcccctgctggtgatcctgctgagctacgtgagagtgagcgtgaagctgagaaacagagtggtgcccggctgcgtgacccagagccaggccgactgggacagagccagaagaagaagaaccttctgcctgctggtggtgatcgtggtggtgttcgccgtgtgctggctgcccctgcacgtgttcaacctgctgagagacctggacccccacgccatcgacccctacgccttcggcctggtgcagctgctgtgccactggctggccatgagcagcgcctgctacaaccccttcatctacgcctggctgcacgacagcttcagagaggagctgagaaagctgctggtggcctggcccagaaagatcgccccccacggccagaacatgaccgtgagcgtggtgatctag

SEQ ID NO: 21067 - DNA, 1113 bp, Artificial Sequence; identical to SEQ ID NO: 21066
  Description of Artificial Sequence: Synthetic coding sequence

SEQ ID NO: 21068 - DNA, 888 bp, Artificial Sequence
  Description of Artificial Sequence: Synthetic coding sequence
atgcccttcccccccatgccccccccccccgcccccgcccccggcgcccaggccgccagacagctgcccagaagaccctgcgccgccggcgacaagaagaagagacccccccagagacccgagggcctgctgagcagcagctggcccagcgccaccctgaagagaccccccgccagaagaggccccggcctggacagaacccagccccccgccccccccggcgtgagcccccaggccctgcccagcagagccagagcccccgccacctgcgccccccccagacccgccggcagcggccacagccccgccagaaccacctacgccgccaccagcgccggcaccggcaccaccgccgccggcaccagcagcggcgccggcccctgccccgacagcgccgccagattctgcctgaacctgacccccgaggccgtgctggtgatccagaagagacacctggagaagcagctgctggccagacccagaagacccttccccagccccagcgccgagcccagaagactgctggccccctgcctgcccgccagagccgccggccccagaagaggcggccccgccagcgaccccgacgccccccccaccgccggccagggcagaagagcccccccccccggcgcccagctgctgcacggcggcctgcaggtgccccagctgagccccagacccggcgccctgagacccatgctgaaggtgagcctgctgaacgagagacacagatacgacgacgtggagtacgaggaggagcccgaggccgtggacgagggcctggtgagaaagtgcaccgagtggctgagaggcgtggagagcgccgccgccgccagaggcagagccggcgccctggacagcagaagacacctgagcaccctgtag

SEQ ID NO: 21069 - DNA, 354 bp, Artificial Sequence
  Description of Artificial Sequence: Synthetic coding sequence
atgcccttcccccccatgccccccccccccgcccccgcccccggcgcccaggccgccagacagctgcccagaagaccctgcgccgccggcgacaagaagaagagacccccccagagacccgagggcctgctgagcagcagctggcccagcgccaccctgaagagaccccccgccagaagaggccccggcctggacagaacccagccccccgccccccccggcgtgagcccccaggccctgcccagcagagccagagcccccgccacctgcgccccccccagacccgccggcagcggccacagccccgccagaaccacctacgccgccaccagcgccggcaccggcaccacctag

SEQ ID NO: 21070 - DNA, 888 bp, Artificial Sequence
  Description of Artificial Sequence: Synthetic coding sequence
atgagcagccccgtgctgagcgacctgcccagattccaggccgccagacaggccctgcagctgagcagcagcagcgcctggaacagcgtgcagaccgccgtgatcaacgtgttcaagggcggcggcctgcagagcaacgagctgtacgccctgaacgagaacatcagaagactgctgaagagcgagctgggcagcttcatcaccgactacttccagaaccagctgctggccaagggcctgttcttcgtggaggagaagatcaagctgtgcgagggcgagaacagaatcgaggtgctggccgaggtgtgggaccacttcttcaccgagaccctgcccaccctgcaggccatcttctaccccgtgcagagcgtgcacgagcccaccggccccagcgagagctacctgcagctggaggagctggtgaagcaggtggtgagccccttcctgggcatcagcggcgacagaagcttcagcggccccacctacaccctggccagaagacacagcagagtgagacccaaggtgaccgtgctgaactacgccagccccatcaccgccgtgagcagacccctgaacgagatggtgctgacccccctgaccgagcaggagggcgaggcctacctggagaagtgcggcagcgtgagaagacacaccgtggccaacgcccacagcgacatccagctgctggccatggccaccatgatgcacagcggcctgggcgaggaggccagcagcgagaacaagtgcctgctgctgccccccagcttcccccccccccacagacagtgcagcagcgagcccaacatcaccgacaaccccgacggcctggaggagggcgccagaggcagccaggagggcagcgagctgaactgcgccagcctgagctag

SEQ ID NO: 21071 - DNA, 1107 bp, Artificial Sequence
  Description of Artificial Sequence: Synthetic coding sequence
atgaccagaggcttcgcccccatcctgcccgtggagttccacaagatgggcagcttcagaagacccagacccagattcatgagcagccccgtgctgagcgacctgcccagattccaggccgccagacaggccctgcagctgagcagcagcagcgcctggaacagcgtgcagaccgccgtgatcaacgtgttcaagggcggcggcctgcagagcaacgagctgtacgccctgaacgagaacatcagaagactgctgaagagcgagctgggcagcttcatcaccgactacttccagaaccagctgctggccaagggcctgttcttcgtggaggagaagatcaagctgtgcgagggcgagaacagaatcgaggtgctggccgaggtgtgggaccacttcttcaccgagaccctgcccaccctgcaggccatcttctaccccgtgcagggccaggagctgaccatcagacagatcagcctgctgggcttcagagacctggtgctgctgaaggtgaagctgggcgacctgctgctgctggcccagagcaagctgcccagcagcatcgtgcagatgctgctgatcctgcagagcgtgcacgagcccaccggccccagcgagagctacctgcagctggaggagctggtgaagcaggtggtgagccccttcctgggcatcagcggcgacagaagcttcagcggccccacctacaccctggccagaagacacagcagagtgagacccaaggtgaccgtgctgaactacgccagccccatcaccgccgtgagcagacccctgaacgagatggtgctgacccccctgaccgagcaggagggcgaggcctacctggagaagtgcggcagcgtgagaagacacaccgtggccaacgcccacagcgacatccagctgctggccatggccaccatgatgcacagcggcctgggcgaggaggccagcagcgagaacaagtgcctgctgctgccccccagcttcccccccccccacagacagtgcagcagcgagcccaacatcaccgacaaccccgacggcctggaggagggcgccagaggcagccaggagggcagcgagctgaactgcgccagcctgagctag

SEQ ID NO: 21072 - DNA, 147 bp, Artificial Sequence
  Description of Artificial Sequence: Synthetic coding sequence
atgaccagaggcttcgcccccatcctgcccgtggagttccacaagatgggcagcttcagaagacccagacccagattcatgagcagccccgtgctgagcgacctgcccagattccaggccgccagacaggccctgcagctgagctag

SEQ ID NO: 21073 - DNA, 243 bp, Artificial Sequence
  Description of Artificial Sequence: Synthetic coding sequence
atgaccagaggcttcgcccccatcctgcccgtggagttccacaagatgggcagcttcagaagacccagacccagattcatgagcagccccgtgctgagcgacctgcccagattccaggccgccagacaggccctgcagctgagcagcagcagcgcctggaacagcgtgcagaccgccgtgatcaacgtgttcaagggcggcggcctgcagagcaacgagctgtacgccctgaacgagaactag

SEQ ID NO: 21074 - DNA, 192 bp, Artificial Sequence
  Description of Artificial Sequence: Synthetic coding sequence
atgaccagaggcttcgcccccatcctgcccgtggagttccacaagatgggcagcttcagaagacccagacccagattcatgagcagccccgtgctgagcgacctgcccagattccaggccgccagacaggccctgcagctgagcagcagcagcgcctggaacagcgtgcagaccgccgtgatcaacgtgtag

SEQ ID NO: 21075 - DNA, 231 bp, Artificial Sequence
  Description of Artificial Sequence: Synthetic coding sequence
atgaccagaggcttcgcccccatcctgcccgtggagttccacaagatgggcagcttcagaagacccagacccagattcatgagcagccccgtgctgagcgacctgcccagattccaggccgccagacaggccctgcagctgagcagcagcagcgcctggaacagcgtgcagaccgccgtgatcaacgtgttcaagggcggcggcctgcagagcaacgagctgtacgcctag

SEQ ID NO: 21076 - DNA, 144 bp, Artificial Sequence
  Description of Artificial Sequence: Synthetic coding sequence
atgaccagaggcttcgcccccatcctgcccgtggagttccacaagatgggcagcttcagaagacccagacccagattcatgagcagccccgtgctgagcgacctgcccagattccaggccgccagacaggccctgcagctgtag

SEQ ID NO: 21077 - DNA, 228 bp, Artificial Sequence
  Description of Artificial Sequence: Synthetic coding sequence
atgaccagaggcttcgcccccatcctgcccgtggagttccacaagatgggcagcttcagaagacccagacccagattcatgagcagccccgtgctgagcgacctgcccagattccaggccgccagacaggccctgcagctgagcagcagcagcgcctggaacagcgtgcagaccgccgtgatcaacgtgttcaagggcggcggcctgcagagcaacgagctgtactag

SEQ ID NO: 21078 - DNA, 150 bp, Artificial Sequence
  Description of Artificial Sequence: Synthetic coding sequence
atgaccagaggcttcgcccccatcctgcccgtggagttccacaagatgggcagcttcagaagacccagacccagattcatgagcagccccgtgctgagcgacctgcccagattccaggccgccagacaggccctgcagctgagcagctag

SEQ ID NO: 21079 - DNA, 1107 bp, Artificial Sequence; identical to SEQ ID NO: 21071
  Description of Artificial Sequence: Synthetic coding sequence

SEQ ID NO: 21080 - DNA, 252 bp, Artificial Sequence
  Description of Artificial Sequence: Synthetic coding sequence
atgaccagaggcttcgcccccatcctgcccgtggagttccacaagatgggcagcttcagaagacccagacccagattcatgagcagccccgtgctgagcgacctgcccagattccaggccgccagacaggccctgcagctgagcagcagcagcgcctggaacagcgtgcagaccgccgtgatcaacgtgttcaagggcggcggcctgcagagcaacgagctgtacgccctgaacgagaacatcagaagatag

SEQ ID NO: 21081 - DNA, 618 bp, Artificial Sequence
  Description of Artificial Sequence: Synthetic coding sequence
atgaccagaggcttcgcccccatcctgcccgtggagttccacaagatgggcagcttcagaagacccagacccagattcatgagcagccccgtgctgagcgacctgcccagattccaggccgccagacaggccctgcagctgagcagcagcagcgcctggaacagcgtgcagaccgccgtgatcaacgtgttcaagggcggcggcctgcagagcaacgagctgtacgccctgaacgagaacatcagaagactgctgaagagcgagctgggcagcttcatcaccgactacttccagaaccagctgctggccaagggcctgttcttcgtggaggagaagatcaagctgtgcgagggcgagaacagaatcgaggtgctggccgaggtgtgggaccacttcttcaccgagaccctgcccaccctgcaggccatcttctaccccgtgcagggccaggagctgaccatcagacagatcagcctgctgggcttcagagacctggtgctgctgaaggtgaagctgggcgacctgctgctgctggcccagagcaagctgcccagcagcatcgtgcagatgctgctgatcctgcagcccggcggcacccccggcagcggccccagatag

SEQ ID NO: 21082 - DNA, 825 bp, Artificial Sequence
  Description of Artificial Sequence: Synthetic coding sequence
atggtgatgagccagggcacctacaccttcctgacctgcttcgccggcttctggctgatctggggcctgatcgtgctgctgtgctgcttctgcagcttcctgagaagaagactgaagagaagacaggaggagagactgagagagcagaacctgagagccctggagctggagcccctggagctggagggcagcctggccggcagcccccccggcctggcccccccccagccccccccccacagaagcagactggaggcccccgcccacgcccacagccacccccacgtgcacgtgcaccccctgctgcaccacggccccgcccagccccacgcccacgcccacccccacccccaccaccacgccctgccccaccccccccccacccacctgagcgtgccccccagaccctggagctaccccagacaggccgagagcgacatgagcaagcccccctgctacgaggaggccgtgctgatggccgagcccccccccccctacagcgaggtgctgaccgacaccagaggcctgtacagaaagatcgtgacccccttcctgagcagaagagacagcgccgagaagcaggagcagcccccccccagctacaagcccctgttcctggacagaggctacaccagcgccctgcacctgcccagcgcccccagacccgcccccccctgccccgccctgtgcctgcaggccgacagaggcagaagagtgttccccagctggaccgacagcgagctgagcagcagagagcccctggagcacggcgcctggagactgcccgtgagcatccccctgttcggcagaaccaccgccgtgtag

SEQ ID NO: 21083 - DNA, 765 bp, Artificial Sequence
  Description of Artificial Sequence: Synthetic coding sequence
atggtgatgagccagggcacctacaccttcctgacctgcttcgccggcttctggctgatctggggcctgatcgtgctgctgtgctgcttctgcagcttcctgagaagaagactgaagagaagacaggaggagagactgagagagcagaacctgagagccctggagctggagcccctggagctggagggcagcctggccggcagcccccccggcctggcccccccccagccccccccccacagaagcagactggaggcccccgcccaccacgcccacgcccacccccacccccaccaccacgccctgccccaccccccccccacccacctgagcgtgccccccagaccctggagctaccccagacaggccgagagcgacatgagcaagcccccctgctacgaggaggccgtgctgatggccgagcccccccccccctacagcgaggtgctgaccgacaccagaggcctgtacagaaagatcgtgacccccttcctgagcagaagagacagcgccgagaagcaggagcagcccccccccagctacaagcccctgttcctggacagaggctacaccagcgccctgcacctgcccagcgcccccagacccgcccccccctgccccgccctgtgcctgcaggccgacagaggcagaagagtgttccccagctggaccgacagcgagctgagcagcagagagcccctggagcacggcgcctggagactgcccgtgagcatccccctgttcggcagaaccaccgccgtgtag

SEQ ID NO: 21084 - DNA, 825 bp, Artificial Sequence; identical to SEQ ID NO: 21082
  Description of Artificial Sequence: Synthetic coding sequence

SEQ ID NO: 21085 - DNA, 537 bp, Artificial Sequence
  Description of Artificial Sequence: Synthetic coding sequence
atggtgatgagccagggcacctacaccttcctgacctgcttcgccggcttctggctgatctggggcctgatcgtgctgctgtgctgcttctgcagcttcctgagaagaagactgaagagaagacaggaggagagactgagagagcagaacctgagagccctggagctggagcccctggagctggagggcagcctggccggcagcccccccggcctggcccccccccagccccccccccacagaagcagactggaggcccccgcccacgcccacagccacccccacgtgcacgtgcaccccctgctgcaccacggccccgcccagccccacgcccacgcccacccccacccccaccaccacgccctgccccaccccccccccacccacctgagcgtgccccccagaccctggagctaccccagacaggccgagagcgacatgagcaagcccccctgctacgaggaggccgtgctgatggccgagcccccccccccctacagcgaggtgctgaccgacaccagaggcctgtacagatag

SEQ ID NO: 21086 - DNA, 825 bp, Artificial Sequence; identical to SEQ ID NO: 21082
  Description of Artificial Sequence: Synthetic coding sequence

SEQ ID NO: 21087 - DNA, 1338 bp, Artificial Sequence
  Description of Artificial Sequence: Synthetic coding sequence
atgatggaggagagcggcatcgagaccaccccccccggcacccccccccccaaccccgccggcctggccgccaccgccatgagcagcacccccgtgcccctggccgccaccagcagcttcagcagccccaacgtgagcagcatggagagcttcccccccctggcctacagcaccccccagccccccctgccccccgtgagacccagcgcccccctgcccttcgtgcccccccccgccgtgcccagcgtgccccccctggtgaccagcatgcccccccccgtgagccccagcaccgccgccgccttcggcaacccccccgtgagccacttcccccccagcaccagcgcccccaacaccctgctgcccgccccccccagcggcccccccatcagcggcttcagcgtgggcagcacctacgacatcaccagaggccacgccggcagagccccccagacccccctgatgcccagcttcagcgcccccagcggcaccggcctgctgcccacccccatcacccagcaggccagcctgaccagcctggcccagggcaccggcaccaccagcgccatcaccttccccgaggagcaggaggaccccagaatcaccagaggccaggacgaggccagcgccggcggcatctggggcttcatcaagggcgtggccggcaaccccatggtgaagagcgtgctggacaagaccaagcacagcgtggagagcatgatcaccaccctggaccccggcatggccccctacatcaagagcggcggcgagctggacatcgtggtgaccagcaacaaggaggtgaaggtggccgccgtgagagacgccttccaggaggtgttcggcctggccgtggtggtgggcgaggccggccagagcaacatcgccccccagcccgtgggctacgccgccggcctgaagggcgcccaggagagaatcgacagcctgagaagaaccggcgtgatccacgagaagcagaccgccgtgagcgtggagaacttcatcgccgagctgctgcccgacaagtggttcgacatcggctgcctggtggtggaggaccccgtgcacggcatccacctggagaccttcacccaggccacccccgtgcccctggagttcgtgcagcaggcccagagcctgaccccccaggactacaacctgagatggagcggcctgctggtgaccgtgggcgaggtgctggagaagagcctgctgaacgtgagcagaaccgactggcacatggccttcaccggcatgagcagaagacagatgatctacagcgccgccagagccatcgccggcatgtacaagcagagactgccccccagaaccgtgtag

SEQ ID NO: 21088 - DNA, 1395 bp, Artificial Sequence
  Description of Artificial Sequence: Synthetic coding sequence
atgatggaggagagcggcatcgagaccaccccccccggcacccccccccccaaccccgccggcctggccgccaccgccatgagcagcacccccgtgcccctggccgccaccagcagcttcagcagccccaacgtgagcagcatggagagcttcccccccctggcctacagcaccccccagccccccctgccccccgtgagacccagcgcccccctgcccttcgtgcccccccccgccgtgcccagcgtgccccccctggtgaccagcatgcccccccccgtgagccccagcaccgccgccgccttcggcaacccccccgtgagccacttcccccccagcaccagcgcccccaacaccctgctgcccgccccccccagcggcccccccatcagcggcttcagcgtgggcagcacctacgacatcaccagaggccacgccggcagagccccccagacccccctgatgcccagcttcagcgcccccagcggcaccggcctgctgcccacccccatcacccagcaggccagcctgaccagcctggcccagggcaccggcaccaccagcgccatcaccttccccgaggagcaggaggaccccagaatcaccagaggccaggacgaggccagcgccggcggcatctggggcttcatcaagggcgtggccggcaaccccatggtgaagagcgtgctggacaagaccaagcacagcgtggagagcatgatcaccaccctggaccccggcatggccccctacatcaagagcggcggcgagctggacatcgtggtgaccagcaacaaggaggtgaaggtggccgccgtgagagacgccttccaggaggtgttcggcctggccgtggtggtgggcgaggccggccagagcaacatcgccccccagcccgtgggctacgccgccggcctgaagggcgcccaggagagaatcgacagcctgagaagaaccggcgtgatccacgagaagcagaccgccgtgagcgtggagaacttcatcgccgagctgctgcccgacaagtggttcgacatcggctgcctggtggtggaggaccccgtgcacggcatccacctggagaccttcacccaggccacccccgtgcccctggagttcgtgcagcaggcccagagcctgaccccccaggactacaacctgagatggagcggcctgctggtgaccgtgggcgaggtgctggagaagagcctgctgaacgtgagcagaaccgactggcacatggccttcaccggcatgagcagaagacagatgatctacagcgccgccagagccatcgccaacccccagagagccgtggccgtgcacggcctggtggaggccagaaacttccccgcccccggcgacctggtgagcctgctgctgggcaccgtgtag

SEQ ID NO: 21089 - DNA, 936 bp, Artificial Sequence
  Description of Artificial Sequence: Synthetic coding sequence
atgatggaggagagcggcatcgagaccaccccccccggcacccccccccccaaccccgccggcctggccgccaccgccatgagcagcacccccgtgcccctggccgccaccagcagcttcagcagccccaacgtgagcagcatggagagcttcccccccctggcctacagcaccccccagccccccctgccccccgtgagacccagcgcccccctgcccttcgtgcccccccccgccgtgcccagcgtgccccccctggtgaccagcatgcccccccccgtgagccccagcaccgccgccgccttcggcaacccccccgtgagccacttcccccccagcaccagcgcccccaacaccctgctgcccgccccccccagcggcccccccatcagcggcttcagcgtgggcagcacctacgacatcaccagaggccacgccggcagagccccccagacccccctgatgcccagcttcagcgcccccagcggcaccggcctgctgcccacccccatcacccagcaggccagcctgaccagcctggcccagggcaccggcaccaccagcgccatcaccttccccgaggagcaggaggaccccagaatcaccagaggccaggacgaggccagcgccggcggcatctggggcttcatcaagggcgtggccggcaaccccatggtgaagagcgtgctggacaagaccaagcacagcgtggagagcatgatcaccaccctggaccccggcatggccccctacatcaagagcggcggcgagctggacatcgtggtgaccagcaacaaggaggtgaaggtggccgccgtgagagacgccttccaggaggtgttcggcctggccgtggtggtgggcgaggccggccagagcaacatcgccccccagcccgtgggctacgccgccggcctgaagggcgccaacagatag

SEQ ID NO: 21090 - DNA, 1257 bp, Artificial Sequence
  Description of Artificial Sequence: Synthetic coding sequence
atgatggaggagagcggcatcgagaccaccccccccggcacccccccccccaaccccgccggcctggccgccaccgccatgagcagcacccccgtgcccctggccgccaccagcagcttcagcagccccaacgtgagcagcatggagagcttcccccccctggcctacagcaccccccagccccccctgccccccgtgagacccagcgcccccctgcccttcgtgcccccccccgccgtgcccagcgtgccccccctggtgaccagcatgcccccccccgtgagccccagcaccgccgccgccttcggcaacccccccgtgagccacttcccccccagcaccagcgcccccaacaccctgctgcccgccccccccagcggcccccccatcagcggcttcagcgtgggcagcacctacgacatcaccagaggccacgccggcagagccccccagacccccctgatgcccagcttcagcgcccccagcggcaccggcctgctgcccacccccatcacccagcaggccagcctgaccagcctggcccagggcaccggcaccaccagcgccatcaccttccccgaggagcaggaggaccccagaatcaccagaggccaggacgaggccagcgccggcggcatctggggcttcatcaagggcgtggccggcaaccccatggtgaagagcgtgctggacaagaccaagcacagcgtggagagcatgatcaccaccctggaccccggcatggccccctacatcaagagcggcggcgagctggacatcgtggtgaccagcaacaaggaggtgaaggtggccgccgtgagagacgccttccaggaggtgttcggcctggccgtggtggtgggcgaggccggccagagcaacatcgccccccagcccgtgggctacgccgccggcctgaagggcgcccaggagagaatcgacagcctgagaagaaccggcgtgatccacgagaagcagaccgccgtgagcgtggagaacttcatcgccgagctgctgcccgacaagtggttcgacatcggctgcctggtggtggaggaccccgtgcacggcatccacctggagaccttcacccaggccacccccgtgcccctggagttcgtgcagcaggtgggcttcctgctgtgcttcttcatcatgctgcagagaaacctgcactactgcttccagaacaagaacctgttcggcttcttcgtgagaaacatgttcctgatcctgttccagagcttcttcttctag

SEQ ID NO: 21091 - DNA, 1338 bp, Artificial Sequence
  Description of Artificial Sequence: Synthetic coding sequence
atgatggaggagagcggcatcgagaccaccccccccggcacccccccccccaaccccgccggcctggccgccaccgccatgagcagcacccccgtgcccctggccgccaccagcagcttcagcagccccaacgtgagcagcatggagagcttcccccccctggcctacagcaccccccagccccccctgccccccgtgagacccagcgcccccctgcccttcgtgcccccccccgccgtgcccagcgtgccccccctggtgaccagcatgcccccccccgtgagccccagcaccgccgccgccttcggcaacccccccgtgagccacttcccccccagcaccagcgcccccaacaccctgctgcccgccccccccagcggcccccccatcagcggcttcagcgtgggcagcacctacgacatcaccagaggccacgccggcagagccccccagacccccctgatgcccagcttcagcgcccccagcggcaccggcctgctgcccacccccatcacccagcaggccagcctgaccagcctggcccagggcaccggcaccaccagcgccatcaccttccccgaggagcaggaggaccccagaatcaccagaggccaggacgaggccagcgccggcggcatctggggcttcatcaagggcgtggccggcaaccccatggtgaagagcgtgctggacaagaccaagcacagcgtggagagcatgatcaccaccctggaccccggcatggccccctacatcaagagcggcggcgagctggacatcgtggtgaccagcaacaaggaggtgaaggtggccgccgtgagagacgccttccaggaggtgttcggcctggccgtggtggtgggcgaggccggccagagcaacatcgccccccagcccgtgggctacgccgccggcctgaagggcgcccaggagagaatcgacagcctgagaagaaccggcgtgatccacgagaagcagaccgccgtgagcgtggagaacttcatcgccgagctgctgcccgacaagtggttcgacatcggctgcctggtggtggaggaccccgtgcacggcatccacctggagaccttcacccaggccacccccgtgcccctggagttcgtgcagcaggcccagagcctgaccccccaggactacaacctgagatggagcggcctgctggtgaccgtgggcgaggtgctggagaagagcctgctgaacgtgagcagaaccgactggcacatggccttcaccggcatgagcagaagacagatgatctacagcgccgccagagccatcgccgagagccccaagagcagcggcagcccctggctgggctag

SEQ ID NO: 21092 - DNA, 1389 bp, Artificial Sequence
  Description of Artificial Sequence: Synthetic coding sequence
atgatggaggagagcggcatcgagaccaccccccccggcacccccccccccaaccccgccggcctggccgccaccgccatgagcagcacccccgtgcccctggccgccaccagcagcttcagcagccccaacgtgagcagcatggagagcttcccccccctggcctacagcaccccccagccccccctgccccccgtgagacccagcgcccccctgcccttcgtgcccccccccgccgtgcccagcgtgccccccctggtgaccagcatgcccccccccgtgagccccagcaccgccgccgccttcggcaacccccccgtgagccacttcccccccagcaccagcgcccccaacaccctgctgcccgccccccccagcggcccccccatcagcggcttcagcgtgggcagcacctacgacatcaccagaggccacgccggcagagccccccagacccccctgatgcccagcttcagcgcccccagcggcaccggcctgctgcccacccccatcacccagcaggccagcctgaccagcctggcccagggcaccggcaccaccagcgccatcaccttccccgaggagcaggaggaccccagaatcaccagaggccaggacgaggccagcgccggcggcatctggggcttcatcaagggcgtggccggcaaccccatggtgaagagcgtgctggacaagaccaagcacagcgtggagagcatgatcaccaccctggaccccggcatggccccctacatcaagagcggcggcgagctggacatcgtggtgaccagcaacaaggaggtgaaggtggccgccgtgagagacgccttccaggaggtgttcggcctggccgtggtggtgggcgaggccggccagagcaacatcgccccccagcccgtgggctacgccgccggcctgaagggcgcccaggagagaatcgacagcctgagaagaaccggcgtgatccacgagaagcagaccgccgtgagcgtggagaacttcatcgccgagctgctgcccgacaagtggttcgacatcggctgcctggtggtggaggaccccgtgcacggcatccacctggagaccttcacccaggccacccccgtgcccctggagttcgtgcagcaggcccagagcctgaccccccaggactacaacctgagatggagcggcctgctggtgaccgtgggcgaggtgctggagaagagcctgctgaacgtgagcagaaccgactggcacatggccttcaccggcatgagcagaagacagatgatctacagcgccgccagagccatcgccgacgactacttccccagaatccccaaggagcagtggcagagcatggcctggctgaagctggagatcttcctgcccctggtgacctggtag

SEQ ID NO: 21093 - DNA, 3795 bp, Artificial Sequence
  Description of Artificial Sequence: Synthetic coding sequence
atgagcaccctgtacgtgagcccccaccccgacgccttccccagcctgagagccctgatcgccgccagatacggcgaggccggcgagggccccggctggggcggcgcccaccccagaatctgcctgcagcccccccccaccagcagaacccccttccccccccccagactgcccgccctggagcagggccccggcggcctgtgggtgtggggcgccaccgccgtggcccagctgctgtggcccgccggcctgggcggccccggcggcagcagagccgccgtgctggtgcagcagtgggtgagctacgccgacaccgagctgatccccgccgcctgcggcgccaccctgcccgccctgggcctgagaagcagcgcccaggacccccaggccgtgctgggcgccctgggcagagccctgagccccctggaggagtggctgagactgcacacctacctggccggcgaggcccccaccctggccgacctggccgccgtgaccgccctgctgctgcccttcagatacgtgctggacccccccgccagaagaatctggaacaacgtgaccagatggttcgtgacctgcgtgagacagcccgagttcagagccgtgctgggcgaggtggtgctgtacagcggcgccagacccctgagccaccagcccggccccgaggcccccgccctgcccaagaccgccgcccagctgaagaaggaggccaagaagagagagaagctggagaagttccagcagaagcagaagatccagcagcagcagcccccccccggcgagaagaagcccaagcccgagaagagagagaagagagaccccggcgtgatcacctacgacctgcccaccccccccggcgagaagaaggacgtgagcggccccatgcccgacagctacagccccagatacgtggaggccgcctggtacccctggtgggagcagcagggcttcttcaagcccgagtacggcagacccaacgtgagcgccgccaaccccagaggcgtgttcatgatgtgcatccccccccccaacgtgaccggcagcctgcacctgggccacgccctgaccaacgccatccaggacagcctgaccagatggcacagaatgagaggcgagaccaccctgtggaaccccggctgcgaccacgccggcatcgccacccaggtggtggtggagaagaagctgtggagagagcagggcctgagcagacaccagctgggcagagaggccttcctgcaggaggtgtggaagtggaaggaggagaagggcgacagaatctaccaccagctgaagaagctgggcagcagcctggactgggacagagcctgcttcaccatggaccccaagctgagcgccgccgtgaccgaggccttcgtgagactgcacgaggagggcatcatctacagaagcaccagactggtgaactggagctgcaccctgaacagcgccatcagcgacatcgaggtggacaagaaggagctgaccggcagaaccctgctgagcgtgcccggctacaaggagaaggtggagttcggcgtgctggtgagcttcgcctacaaggtgcagggcagcgacagcgacgaggaggtggtggtggccaccaccagaatcgagaccatgctgggcgacgtggccgtggccgtgcaccccaaggacaccagataccagcacctgaagggcaagaacgtgatccaccccttcctgagcagaagcctgcccatcgtgttcgacgagttcgtggacatggacttcggcaccggcgccgtgaagatcacccccgcccacgaccagaacgactacgaggtgggccagagacacggcctggaggccatcagcatcatggacagcagaggcgccctgatcaacgtgcccccccccttcctgggcctgcccagattcgaggccagaaaggccgtgctggtggccctgaaggagagaggcctgttcagaggcatcgaggacaaccccatggtggtgcccctgtgcaacagaagcaaggacgtggtggagcccctgctgagaccccagtggtacgtgagatgcggcgagatggcccaggccgccagcgccgccgtgaccagaggcgacctgagaatcctgcccgaggcccaccagagaacctggcacgcctggatggacaacatcagagagtggtgcatcagcagacagctgtggtggggccacagaatccccgcctacttcgtgaccgtgagcgaccccgccgtgccccccggcgaggaccccgacggcagatactgggtgagcggcagaaacgaggccgaggccagagagaaggccgccaaggagttcggcgtgagccccgacaagatcagcctgcagcaggacgaggacgtgctggacacctggttcagcagcggcctgttccccctgagcatcctgggctggcccaaccagagcgaggacctgagcgtgttctaccccggcaccctgctggagaccggccacgacatcctgttcttctgggtggccagaatggtgatgctgggcctgaagctgaccggcagactgcccttcagagaggtgtacctgcacgccatcgtgagagacgcccacggcagaaagatgagcaagagcctgggcaacgtgatcgaccccctggacgtgatctacggcatcagcctgcagggcctgcacaaccagctgctgaacagcaacctggaccccagcgaggtggagaaggccaaggagggccagaaggccgacttccccgccggcatccccgagtgcggcaccgacgccctgagattcggcctgtgcgcctacatgagccagggcagagacatcaacctggacgtgaacagaatcctgggctacagacacttctgcaacaagctgtggaacgccaccaagttcgccctgagaggcctgggcaagggcttcgtgcccagccccaccagccagcccggcggccacgagagcctggtggacagatggatcagaagcagactgaccgaggccgtgagactgagcaaccagggcttccaggcctacgacttccccgccgtgaccaccgcccagtacagcttctggctgtacgagctgtgcgacgtgtacctggagtgcctgaagcccgtgctgaacggcgtggaccaggtggccgccgagtgcgccagacagaccctgtacacctgcctggacgtgggcctgagactgctgagccccttcatgcccttcgtgaccgaggagctgttccagagactgcccagaagaatgccccaggccccccccagcctgtgcgtgaccccctaccccgagcccagcgagtgcagctggaaggaccccgaggccgaggccgccctggagctggccctgagcatcaccagagccgtgagaagcctgagagccgactacaacctgaccagaatcagacccgactgcttcctggaggtggccgacgaggccaccggcgccctggccagcgccgtgagcggctacgtgcaggccctggccagcgccggcgtggtggccgtgctggccctgggcgcccccgccccccagggctgcgccgtggccctggccagcgacagatgcagcatccacctgcagctgcagggcctggtggaccccgccagagagctgggcaagctgcaggccaagagagtggaggcccagagacaggcccagagactgagagagagaagagccgccagcggctaccccgtgaaggtgcccctggaggtgcaggaggccgacgaggccaagctgcagcagaccgaggccgagctgagaaaggtggacgaggccatcgccctgttccagaagatgctgtag

SEQ ID NO: 21094 - DNA, 678 bp, Artificial Sequence
  Description of Artificial Sequence: Synthetic coding sequence
atgcccggcacccagacccccgcccccgccgaggacccccacagcggctgcagagaccccgtgcccgccagaccccaggcctgccaccccaagagccaggagaccagattcgagggccccctgcccccccccccccccgccgccgccgccccccccccccccgcccccgcccagaccgcccaggcccccggcttcgtggtgcccacccacgccggcaccgtgggcaccctgcccctgggcggctacgtggcccccggctaccccctgcagctgcagccctgcaccgcctacgtgcccgtgtaccccgtgggcaccccctacgccggcggcacccccggcggcaccggcgtgaccagcaccctgcccccccccccccagggccccggcctggccctgctggagcccagaagacccccccacgactacatgcccatcgccgtgctgaccaccatctgctgcttctggcccaccggcatcatcgccatcttcaaggccgtgcaggtgagaaccgccctggccagaggcgacatggtgagcgccgagatcgccagcagagaggccagaaacttcagcttcatcagcctggccgtgggcatcgccgccatggtgctgtgcaccatcctgaccgtggtgatcatcatcgccgcccagcaccacgagaactactgggacccctag

SEQ ID NO: 21095 - DNA, 678 bp, Artificial Sequence; identical to SEQ ID NO: 21094
  Description of Artificial Sequence: Synthetic coding sequence

SEQ ID NO: 21096 - DNA, 678 bp, Artificial Sequence; identical to SEQ ID NO: 21094
  Description of Artificial Sequence: Synthetic coding sequence

SEQ ID NO: 21097 - DNA, 921 bp, Artificial Sequence
  Description of Artificial Sequence: Synthetic coding sequence
atgagcagcgagaagagcggcctgcccgacagcgtgccccacaccagcccccccccctacaacgccccccagccccccgccgagccccccgccccccccccccaggccgcccccagcagccaccaccaccaccaccaccactaccaccagagcggcaccgccaccctgcccagactgggcgccggcggcctggccagcagcgccgccaccgcccagagaggccccagcagcagcgccaccctgcccagacccccccaccacgccccccccggccccgccgccggcgcccccccccccggctgcgccaccctgcccagaatgccccccgacccctacctgcaggagaccagattcgagggccccctgcccccccccccccccgccgccgccgccccccccccccccgcccccgcccagaccgcccaggcccccggcttcgtggtgcccacccacgccggcaccgtgggcaccctgcccctgggcggctacgtggcccccggctaccccctgcagctgcagccctgcaccgcctacgtgcccgtgtaccccgtgggcaccccctacgccggcggcacccccggcggcaccggcgtgaccagcaccctgcccccccccccccagggccccggcctggccctgctggagcccagaagacccccccacgactacatgcccatcgccgtgctgaccaccatctgctgcttctggcccaccggcatcatcgccatcttcaaggccgtgcaggtgagaaccgccctggccagaggcgacatggtgagcgccgagatcgccagcagagaggccagaaacttcagcttcatcagcctggccgtgggcatcgccgccatggtgctgtgcaccatcctgaccgtggtgatcatcatcgccgcccagcaccacgagaactactgggacccctag

SEQ ID NO: 21098 - DNA, 678 bp, Artificial Sequence; identical to SEQ ID NO: 21094
  Description of Artificial Sequence: Synthetic coding sequence

SEQ ID NO: 21099 - DNA, 921 bp, Artificial Sequence; identical to SEQ ID NO: 21097
  Description of Artificial Sequence: Synthetic coding sequence

SEQ ID NO: 21100 - DNA, 192 bp, Artificial Sequence
  Description of Artificial Sequence: Synthetic coding sequence
atgcccggcacccagacccccgcccccgccgaggacccccacagcggctgcagagaccccgtgcccgccagaccccaggcctgccaccccaagagccaggagaccagattcgagggccccctgcccccccccccccccgccgccgccgccccccccccccccgcccccgcccagaccgcccaggccccctag

SEQ ID NO: 21101 - DNA, 192 bp, Artificial Sequence; identical to SEQ ID NO: 21100
  Description of Artificial Sequence: Synthetic coding sequence

SEQ ID NO: 21102 - DNA, 678 bp, Artificial Sequence; identical to SEQ ID NO: 21094
  Description of Artificial Sequence: Synthetic coding sequence

SEQ ID NO: 21103 - DNA, 192 bp, Artificial Sequence; identical to SEQ ID NO: 21100
  Description of Artificial Sequence: Synthetic coding sequence

SEQ ID NO: 21104 - DNA, 678 bp, Artificial Sequence; identical to SEQ ID NO: 21094
  Description of Artificial Sequence: Synthetic coding sequence

SEQ ID NO: 21105 - DNA, 192 bp, Artificial Sequence; identical to SEQ ID NO: 21100
  Description of Artificial Sequence: Synthetic coding sequence

SEQ ID NO: 21106 - DNA, 192 bp, Artificial Sequence; identical to SEQ ID NO: 21100
  Description of Artificial Sequence: Synthetic coding sequence

SEQ ID NO: 21107 - DNA, 192 bp, Artificial Sequence; identical to SEQ ID NO: 21100
  Description of Artificial Sequence: Synthetic coding sequence

SEQ ID NO: 21108 - DNA, 678 bp, Artificial Sequence; identical to SEQ ID NO: 21094
  Description of Artificial Sequence: Synthetic coding sequence

SEQ ID NO: 21109 - DNA, 192 bp, Artificial Sequence; identical to SEQ ID NO: 21100
  Description of Artificial Sequence: Synthetic coding sequence

SEQ ID NO: 21110 - DNA, 921 bp, Artificial Sequence; identical to SEQ ID NO: 21097
  Description of Artificial Sequence: Synthetic coding sequence

SEQ ID NO: 21111 - DNA, 678 bp, Artificial Sequence; identical to SEQ ID NO: 21094
  Description of Artificial Sequence: Synthetic coding sequence

SEQ ID NO: 21112 - DNA, 921 bp, Artificial Sequence; identical to SEQ ID NO: 21097
  Description of Artificial Sequence: Synthetic coding sequence

SEQ ID NO: 21113 - DNA, 678 bp, Artificial Sequence; identical to SEQ ID NO: 21094
  Description of Artificial Sequence: Synthetic coding sequence

SEQ ID NO: 21114 - DNA, 921 bp, Artificial Sequence; identical to SEQ ID NO: 21097
  Description of Artificial Sequence: Synthetic coding sequence

SEQ ID NO: 21115 - DNA, 921 bp, Artificial Sequence; identical to SEQ ID NO: 21097
  Description of Artificial Sequence: Synthetic coding sequence

SEQ ID NO: 21116 - DNA, 192 bp, Artificial Sequence; identical to SEQ ID NO: 21100
  Description of Artificial Sequence: Synthetic coding sequence

SEQ ID NO: 21117 - DNA, 921 bp, Artificial Sequence; identical to SEQ ID NO: 21097
  Description of Artificial Sequence: Synthetic coding sequence

SEQ ID NO: 21118 - DNA, 678 bp, Artificial Sequence; identical to SEQ ID NO: 21094
  Description of Artificial Sequence: Synthetic coding sequence

SEQ ID NO: 21119 - DNA, 678 bp, Artificial Sequence; identical to SEQ ID NO: 21094
  Description of Artificial Sequence: Synthetic coding sequence

SEQ ID NO: 21120 - DNA, 678 bp, Artificial Sequence; identical to SEQ ID NO: 21094
  Description of Artificial Sequence: Synthetic coding sequence

SEQ ID NO: 21121 - DNA, 678 bp, Artificial Sequence; identical to SEQ ID NO: 21094
  Description of Artificial Sequence: Synthetic coding sequence

SEQ ID NO: 21122 - DNA, 678 bp, Artificial Sequence; identical to SEQ ID NO: 21094
  Description of Artificial Sequence: Synthetic coding sequence

SEQ ID NO: 21123 - DNA, 678 bp, Artificial Sequence; identical to SEQ ID NO: 21094
  Description of Artificial Sequence: Synthetic coding sequence

SEQ ID NO: 21124 - DNA, 678 bp, Artificial Sequence; identical to SEQ ID NO: 21094
  Description of Artificial Sequence: Synthetic coding sequence

SEQ ID NO: 21125 - DNA, 2946 bp, Artificial Sequence
  Description of Artificial Sequence: Synthetic coding sequence
atggccagcagcccctggggctgcgtgtgcggcctgctgctgctgctgctgcccctgctgggcaccggccccgccctgggcagaggcttccccagacccctggagaacagcgagatccccatgatccccggcgcccaccccaagggcagcgtgggcagcgagccccaggccttcgacgtgttccccgagaaccccagagccgacagccacagaaacagcgacgtgagacacgcccccgccgaggagatgcccgagaagcccgtggccagccccctgggccccgccctgtacggccccaaggccgcccagggcgcccagagagagagactgcccgtgaccgacgacctgcagatggcccagggccccagcagccacggctggaccggccccctggacagccaggagctgctgcagcaggaggccgtggccccccaccccgtgggccacccccacctgaccttcatccccaccacccccagaagacagctgagagtggccaccgtgccccccagcctgcagcacgagggccaggagggccagtggccccccagagacgagggcctgaaggccaagaccaagagcagagtgccccccaccagccccagcgaccaccagggccccccccacaccctggtgagccacagcggcaccgtgaagagacccgtgctggagggccagggcggcttcgaggagcacctgcaggaggccgcccagggcccccacttcacccagcaggaccccgccgcccccgacgtgggcagcgtgccccccgtggaggtggtgtacagccaggagcccggcgcccagcccgacctggccctggccagaagcctgccccccgccgaggagctgcccgtggagacccccaagagagccggcgccgaggtgagctgggaggtgagcagccccggccccccccccaagcaggccgacctgcccgacgccaaggacagccccggcccccagcccaccgacccccccgccagcgaggcccccgacagacccagcaagcccgagagagccgccatgaacggcgccgaccccatcagcccccagagagtgagaggcgccgtggaggcccccggcacccccaagagcctgatccccggccccagcgaccccggccccgccgtgaacagaaccgagagccccatgggcgccctgcagcccgacgaggccgaggagtggcccggcagaccccagagccacccccccgccccccccgtgcaggcccccagcaccagcagaagaggcctgatcagagtgaccacccagagagccctgggccagccccccccccccgagcccaccgccagcagcatggccagcgcccccgccagcagcccccccgccaacgccaccgccccccccctgagatggggccccctgagaagagtgctgagcttcagctgggagctgcacgtgtacggcgtgggcgtgctgttcctgctgcccgccctgctggccctggccgccctggccgccgcccccgccggccccagactggccctggtggccgccgtgctggtgctggtggccagcgccctgagaagcgcctacatgctgaccgacccctacggcagccaggccagactgggcgtgagaggcggcctggtgctgtacaacctgcccttccccctgctgctgaccgccctggccgccctgaccctgctgggcctgggcgccggcctgcccccccccctgcagaaccccctgctgctgggcgccgtggccctggtgcacggcgtgggcctgctggccaccgacctgctgagcacctggagcgtgctgaacctgctgacccagggcctgagctgcgcctggggcgccgccgtggccctgggcaccctgtgcctgtgcagaagaagactgctggacggccccagaggctgggacgccagccccggccccagactgctggccgtggccggcgccctgggcctgctggccagcggcctgcagctggccgccgccctgtggctgtaccccggccccggcagagtgggcagattcagctgggcctggtggggcgtgcacttctggctgagactgctggagctgacctgggccctggccctggccctggccgccgtggccgccgccagacccagaccccccaccgagcacgcctgctgggccaagctgatgagactggcctgccccgcccccagcggcaagagcgaggtgcccgagagacccaacaactgctacgccggccccagcaacgtgggcgccggcagcctggacatcagcaagagcctgatcagaaaccccgccgagagcggccagctggccacccccagcagcggcgcctggggcagcgccgccagcctgggcagaggcccccagggcggccccggcctgagcagaaacggcgtgggccccgcccccagcctgagcgagctggacctgagaccccccagccccatcaacctgagcagaagcatcgacgccgccctgttcagagagcacctggtgagagacagcgtgttccagagatgcggcctgagaggcctggccagccccccccccggcggcgccctgagacccagaagaggcagccaccccaaggccgagctggacgacgccggcagcagcctgctgagaggcagatgcagaagcctgagcgacgtgagagtgagaggccccgtgccccagcacgtggtggaggcccccgacggcgccgccgccgccgccagcggcagcagcctggacagcttcagcagaggcagcctgaagatcagctggaacccctggagacacggcctgagcagcgtggacagcctgcccctggacgagctgcccagcaccgtgcagctgctgcccgcccccacccccgcccccgacagcaccgccgccagacagggcgacggccagggcgaggtgcagcccagaggcaagcccggcgagagcagaagcgccagcagcgacaccatcgagctgtag

SEQ ID NO: 21126 - DNA, 2946 bp, Artificial Sequence; identical to SEQ ID NO: 21125
  Description of Artificial Sequence: Synthetic coding sequence

SEQ ID NO: 21127 - DNA, 2082 bp, Artificial Sequence
  Description of Artificial Sequence: Synthetic coding sequence
atggccagacacggctgcctgggcctgggcctgttctgctgcgtgctgttcgccgccaccgtgggcccccagcccacccccagcatccccggcgcccccgccaccaccctgacccccgtgccccagagcgaggccagcatgctgagcctgaacctgggcctgaacttcaagttccacctgagaggccccgccgccgtgtggggcagccccgtgaccgagacccagcccctgagcctgggccccggccaggagcccggcgaggaggtggccagcggcctgagaaccgaccccctgtgggagctgctggtgggcagcagcggcaacagcctgaccgagtggggcagcaccgagggcggcagcaagcccagagccagcagcctgctgcccgagagcaccagcagaagaagcggccccagcgacggccccaccgccccctaccagcccagaagaagcaccgtgacctgggacaccgccctgatggtgaccgccctgcccagcagcgcccccagaccccaccagagcgagctggagctgaagttcgacatggccctgagagccggcgccgcccccaccctgggccacagaaccctgcccctgctgcccagcctgagagccagcctggccgagatcgccggcagactgggccccttcggcttcttcggcaccaccctgagccccctgagaaacttcagcggcctgagcccccccggcgagaccaccagcaccagcagcgccagcggcgtgagcggcagcctgggcttcctgggcaccaccctgagcctgcccccctacagcctggagagaaagctgagcagccccagccccctggaccccgccgccagcctgagcttcgccagcatcgccaccaccagcctggaccccaccgtgcccatcagcggccccgacgacctgagcccccccgccagcctgggcaaccccagcggccagcccgagtgcggccccggcagctgcagcgtgggcgagctgcccgagagagagggccagccccccgaggcccccagacccctgttcttcctgaccctggaggccgactgggccgaggccagagccagatggggcctggcctgggaggcccacgtgtacggcggctacgaggtgctgcacgccctgggctacggcggccagagcggcctggagggcccctggccctggtgggccttccagctgggcctgagactgggcgaggtgggcgtggccctgcccctggccctgctgggcctgtaccccgccctgtgcagccccagagtgccccccagatgctgggccaagctgttcagactgagccccggccacgccgcccccctgctgcccggcggctgggtgaccggcccccccgacaaggagcccctgggcagcgccatcgccagaggcgacgccgagctgctgcagctgtgcgccctggccggccccggccccgacctgctgctgcagggcggcggctgcagaggcttcgagggcgccgccgccaaccccgcccccagccccgccagcagcccctgcagcgactacaccgtggacttcagaccccccagccccatcaacctgagaagaagcatcgaggaggccctgtgcagcgaggccctgctggcccccggcctgttccagggccccgccttcgaggacgccctgcccggcctgggcctgtacagaaccgccagcctgggcaccggcggcagagccagcgagagaagcggcgaggccagcggccccgccgccccccccgagctgcccagccccggcgcctggcccgccggcagcagcgtgagcagcggcagcttctgcggcctgagcagagacagcagcagcatgctgctgtgcagcagccccgacagaccccccagatgccccctggtgtgcgtgctgagcccccccagacccagcggcagcagccccagcctgcccgccagcggcagctaccaggccctgagcccccccagcagagacagccccgagcccgccagcgagctgcaggccgaggaggccctgctgcaggagcagttcctggacgcctgcagacagatcgacgagctgagcgtgggcagcgacaccatcgacctgtag

SEQ ID NO: 21128 - DNA, 2700 bp, Artificial Sequence
  Description of Artificial Sequence: Synthetic coding sequence
atggccagacacggctgcctgggcctgggcctgttctgctgcgtgctgttcgccgccaccgtgggcccccagcccacccccagcatccccggcgcccccgccaccaccctgacccccgtgccccagagcgaggccagcatgctgagcctgaacctgggcctgaacttcaagttccacctgagaggccccgccgccgtgtggggcagccccgtgaccgagacccagcccctgagcctgggccccggccaggagcccggcgaggaggtggccagcggcctgagaaccgaccccctgtgggagctgctggtgggcagcagcggcaacagcctgaccgagtggggcagcaccgagggcggcagcaagcccagagccagcagcctgctgcccgagagcaccagcagaagaagcggccccagcgacggccccaccgccccctaccagcccagaagaagcaccgtgacctgggacaccgccctgatggtgaccgccctgcccagcagcgcccccagaccccaccagagcgagctggagctgaagttcgacatggccctgagagccggcgccgcccccaccctgggccacagaaccctgcccctgctgcccagcctgagagccagcctggccgagatcgccggcagactgggccccttcggcttcttcggcaccaccctgagccccctgagaaacttcagcggcctgagcccccccggcgagaccaccagcaccagcagcgccagcggcgtgagcggcagcctgggcttcctgggcaccaccctgagcctgcccccctacagcctggagagaaagctgagcagccccagccccctggaccccgccgccagcctgagcttcgccagcatcgccaccaccagcctggaccccaccgtgcccatcagcggccccgacgacctgagcccccccgccagcctgggcaaccccagcggccagcccgagtgcggccccggcagctgcagcgtgggcgagctgcccgagagagagggccagccccccgaggcccccagacccctgttcttcctgaccctggaggccgactgggccgaggccagagccagatggggcctggcctgggaggcccacgtgtacggcgtgggcgccctgttcggcctggtggccctgctggccctgctggccctggccctgctgccctggagatgcccccccggcgccccctgcctggccctgctggacctgctgctgctgagcgccggcaccaccagagccttccccctgttctacgacgcctacggccacagagacagactgcccgccctggcctggctgctgctgcaggacctgcccctgccctgcctggccgccggcctgggcctggcctgcctgctgctggccagacccagaccccccagatgccccaccggcctggccgccctgctgctgctgggcctgggcctggccgccgccgccgccctgggcagcgccgcccacagacccctgagacccctgagactggccagcagaggcctgcacgccttcctggccgccttcctgagcggcctgctgctggccctgagctgctggggcggcagaagaagaagagccggcgcccccctgggcggcagcggcttcaagggcgccacccccctgccccagggcagaagccccttcgcccccagagagagctggagaagagccgccagaaccgcccccgtggccggcaccttcggcctgctgagcggcgccctgcagggctacgaggtgctgcacgccctgggctacggcggccagagcggcctggagggcccctggccctggtgggccttccagctgggcctgagactgggcgaggtgggcgtggccctgcccctggccctgctgggcctgtaccccgccctgtgcagccccagagtgccccccagatgctgggccaagctgttcagactgagccccggccacgccgcccccctgctgcccggcggctgggtgaccggcccccccgacaaggagcccctgggcagcgccatcgccagaggcgacgccgagctgctgcagctgtgcgccctggccggccccggccccgacctgctgctgcagggcggcggctgcagaggcttcgagggcgccgccgccaaccccgcccccagccccgccagcagcccctgcagcgactacaccgtggacttcagaccccccagccccatcaacctgagaagaagcatcgaggaggccctgtgcagcgaggccctgctggcccccggcctgttccagggccccgccttcgaggacgccctgcccggcctgggcctgtacagaaccgccagcctgggcaccggcggcagagccagcgagagaagcggcgaggccagcggccccgccgccccccccgagctgcccagccccggcgcctggcccgccggcagcagcgtgagcagcggcagcttctgcggcctgagcagagacagcagcagcatgctgctgtgcagcagccccgacagaccccccagatgccccctggtgtgcgtgctgagcccccccagacccagcggcagcagccccagcctgcccgccagcggcagctaccaggccctgagcccccccagcagagacagccccgagcccgccagcgagctgcaggccgaggaggccctgctgcaggagcagttcctggacgcctgcagacagatcgacgagctgagcgtgggcagcgacaccatcgacctgtag

SEQ ID NO: 21129 - DNA, 2700 bp, Artificial Sequence; identical to SEQ ID NO: 21128
  Description of Artificial Sequence: Synthetic coding sequence

SEQ ID NO: 21130 - DNA, 1290 bp, Artificial Sequence
  Description of Artificial Sequence: Synthetic coding sequence
atggccagacacggctgcctgggcctgggcctgttctgctgcgtgctgttcgccgccaccgtgggcccccagcccacccccagcatccccggcgcccccgccaccaccctgacccccgtgccccagagcgaggccagcatgctgagcctgaacctgggcctgaacttcaagttccacctgagaggccccgccgccgtgtggggcagccccgtgaccgagacccagcccctgagcctgggccccggccaggagcccggcgaggaggtggccagcggcctgagaaccgaccccctgtgggagctgctggtgggcagcagcggcaacagcctgaccgagtggggcagcaccgagggcggcagcaagcccagagccagcagcctgctgcccgagagcaccagcagaagaagcggccccagcgacggccccaccgccccctaccagcccagaagaagcaccgtgacctgggacaccgccctgatggtgaccgccctgcccagcagcgcccccagaccccaccagagcgagctggagctgaagttcgacatggccctgagagccggcgccgcccccaccctgggccacagaaccctgcccctgctgcccagcctgagagccagcctggccgagatcgccggcagactgggccccttcggcttcttcggcaccaccctgagccccctgagaaacttcagcggcctgagcccccccggcgagaccaccagcaccagcagcgccagcggcgtgagcggcagcctgggcttcctgggcaccaccctgagcctgcccccctacagcctggagagaaagctgagcagccccagccccctggaccccgccgccagcctgagcttcgccagcatcgccaccaccagcctggaccccaccgtgcccatcagcggccccgacgacctgagcccccccgccagcctgggcaaccccagcggccagcccgagtgcggccccggcagctgcagcgtgggcgagctgcccgagagagagggccagccccccgaggcccccagacccctgttcttcctgaccctggaggccgactgggccgaggccagagccagatggggcctggcctgggaggcccacgtgtacggcagactgcacagaggcctgccccccgccctgcccaaccagcccgccacccagcacagaggcggccccctgcagagaggccccgcctgcgcctggcccctgcccggcccctgcctgagaggcagaagcgcctgggccagaaccctgccccacagactggccggcgacagaggccagggccagtag

SEQ ID NO: 21131 - DNA, 1692 bp, Artificial Sequence
  Description of Artificial Sequence: Synthetic coding sequence
atggccgccgccgccgtgaccggccagagacccgagaccgccgccgccgaggaggccagcagaccccagtgggccccccccgaccactgccaggcccaggccgccgccggcctgggcgacggcgaggacgcccccgtgagacccctgtgcaagcccagaggcatctgcagcagagcctacttcctggtgctgatggtgttcgtgcacctgtacctgggcaacgtgctggccctgctgctgttcgtgcactacagcaacggcgacgagagcagcgaccccggcccccagcacagagcccagggccccggccccgagcccaccctgggccccctgaccagactggagggcatcaaggtgggccacgagagaaaggtgcagctggtgaccgacagagaccacttcatcagaaccctgagcctgaagcccctgctgttcgagatccccggcttcctgaccgacgaggagtgcagactgatcatccacctggcccagatgaagggcctgcagagaagccagatcctgcccaccgaggagtacgaggaggccatgagcaccatgcaggtgagccagctggacctgttcagactgctggaccagaacagagacggccacctgcagctgagagaggtgctggcccagaccagactgggcaacggctggtggatgacccccgagagcatccaggagatgtacgccgccatcaaggccgaccccgacggcgacggcgtgctgagcctgcaggagttcagcaacatggacctgagagacttccacaagtacatgagaagccacaaggccgagagcagcgagctggtgagaaacagccaccacacctggctgtaccagggcgagggcgcccaccacatcatgagagccatcagacagagagtgctgagactgaccagactgagccccgagatcgtggagctgagcgagcccctgcaggtggtgagatacggcgagggcggccactaccacgcccacgtggacagcggccccgtgtaccccgagaccatctgcagccacaccaagctggtggccaacgagagcgtgcccttcgagaccagctgcagacaggtgagccccaactggggcctgcccagcatcctgagacccggcacccccatgacccaggcccagccctgcaccgtgggcgtgcccctgggcatgggccccggcgaccactgggtgatccccgtgagcccctgggagcacccccagctgggcacctgcagcgtgccccccctgccctacagctacatgaccgtgctgttctacctgaacaacgtgaccggcggcggcgagaccgtgttccccgtggccgacaacagaacctacgacgagatgagcctgatccaggacgacgtggacctgagagacaccagaagacactgcgacaagggcaacctgagagtgaagccccagcagggcaccgccgtgttctggtacaactacctgcccgacggccagggctgggtgggcgacgtggacgactacagcctgcacggcggctgcctggtgaccagaggcaccaagtggatcgccaacaactggatcaacgtggaccccagcagagccagacaggccctgttccagcaggagatggccagactggccagagagggcggcaccgacagccagcccgagtgggccctggacagagcctacagagacgccagagtggagctgtag

SEQ ID NO: 21132 - DNA, 1509 bp, Artificial Sequence
  Description of Artificial Sequence: Synthetic coding sequence
atggccgccgccgccgtgaccggccagagacccgagaccgccgccgccgaggaggccagcagaccccagtgggccccccccgaccactgccaggcccaggccgccgccggcctgggcgacggcgaggacgcccccgtgagacccctgtgcaagcccagaggcatctgcagcagagcctacttcctggtgctgatggtgttcgtgcacctgtacctgggcaacgtgctggccctgctgctgttcgtgcactacagcaacggcgacgagagcagcgaccccggcccccagcacagagcccagggccccggccccgagcccaccctgggccccctgaccagactggagggcatcaaggtgggccacgagagaaaggtgcagctggtgaccgacagagaccacttcatcagaaccctgagcctgaagcccctgctgttcgagatccccggcttcctgaccgacgaggagtgcagactgatcatccacctggcccagatgaagggcctgcagagaagccagatcctgcccaccgaggagtacgaggaggccatgagcaccatgcaggtgagccagctggacctgttcagactgctggaccagaacagagacggccacctgcagctgagagaggtgctggcccagaccagactgggcaacggctggtggatgacccccgagagcatccaggagatgtacgccgccatcaaggccgaccccgacggcgacggcgtgctgagcctgcaggagttcagcaacatggacctgagagacttccacaagtacatgagaagccacaaggccgagagcagcgagctggtgagaaacagccaccacacctggctgtaccagggcgagggcgcccaccacatcatgagagccatcagacagagagtgctgagactgaccagactgagccccgagatcgtggagctgagcgagcccctgcaggtggtgagatacggcgagggcggccactaccacgcccacgtggacagcggccccgtgtaccccgagaccatctgcagccacaccaagctggtggccaacgagagcgtgcccttcgagaccagctgcagatacatgaccgtgctgttctacctgaacaacgtgaccggcggcggcgagaccgtgttccccgtggccgacaacagaacctacgacgagatgagcctgatccaggacgacgtggacctgagagacaccagaagacactgcgacaagggcaacctgagagtgaagccccagcagggcaccgccgtgttctggtacaactacctgcccgacggccagggctgggtgggcgacgtggacgactacagcctgcacggcggctgcctggtgaccagaggcaccaagtggatcgccaacaactggatcaacgtggaccccagcagagccagacaggccctgttccagcaggagatggccagactggccagagagggcggcaccgacagccagcccgagtgggccctggacagagcctacagagacgccagagtggagctgtag

SEQ ID NO: 21133 - DNA, 2358 bp, Artificial Sequence
  Description of Artificial Sequence: Synthetic coding sequence
atgcccaagggcagacagaaggtgccccacctggacgcccccctgggcctgcccacctgcctgtggctggagctggccggcctgttcctgctggtgccctgggtgatgggcctggccggcaccggcggccccgacggccagggcaccggcggccccagctgggccgtgcacctggagagcctggagggcgacggcgaggaggagaccctggagcagcaggccgacgccctggcccaggccgccggcctggtgaacgccggcagaatcggcgagctgcagggccactacctgttcgtgcagcccgccggccacagacccgccctggaggtggaggccatcagacagcaggtggaggccgtgctggccggccacgaggccgtgagatggcacagcgagcagagactgctgagaagagccaagagaagcgtgcacttcaacgaccccaagtacccccagcagtggcacctgaacaacagaagaagccccggcagagacatcaacgtgaccggcgtgtgggagagaaacgtgaccggcagaggcgtgaccgtggtggtggtggacgacggcgtggagcacaccatccaggacatcgcccccaactacagccccgagggcagctacgacctgaacagcaacgaccccgaccccatgccccaccccgacgtggagaacggcaaccaccacggcaccagatgcgccggcgagatcgccgccgtgcccaacaacagcttctgcgccgtgggcgtggcctacggcagcagaatcgccggcatcagagtgctggacggccccctgaccgacagcatggaggccgtggccttcaacaagcactaccagatcaacgacatctacagctgcagctggggccccgacgacgacggcaagaccgtggacggcccccaccagctgggcaaggccgccctgcagcacggcgtgatcgccggcagacagggcttcggcagcatcttcgtggtggccagcggcaacggcggccagcacaacgacaactgcaactacgacggctacgccaacagcatctacaccgtgaccatcggcgccgtggacgaggagggcagaatgcccttctacgccgaggagtgcgccagcatgctggccgtgaccttcagcggcggcgacaagatgctgagaagcatcgtgaccaccgactgggacctgcagaagggcaccggctgcaccgagggccacaccggcaccagcgccgccgcccccctggccgccggcatgatcgccctgatgctgcaggtgagaccctgcctgacctggagagacgtgcagcacatcatcgtgttcaccgccaccagatacgaggacagaagagccgagtgggtgaccaacgaggccggcttcagccacagccaccagcacggcttcggcctgctgaacgcctggagactggtgaacgccgccaagatctggaccagcgtgccctacctggccagctacgtgagccccgtgctgaaggagaacaaggccatcccccagagccccagaagcctggaggtgctgtggaacgtgagcagaatggacctggagatgagcggcctgaagaccctggagcacgtggccgtgaccgtgagcatcacccaccccagaagaggcagcctggagctgaagctgttctgccccagcggcatgatgagcctgatcggcgcccccagaagcatggacagcgaccccaacggcttcaacgactggaccttcagcaccgtgagatgctggggcgagagagccagaggcacctacagactggtgatcagagacgtgggcgacgagagcttccaggtgggcatcctgagacagtggcagctgaccctgtacggcagcgtgtggagcgccgtggacatcagagacagacagagactgctggagagcgccatgagcggcaagtacctgcacgacgacttcgccctgccctgcccccccggcctgaagatccccgaggaggacggctacaccatcacccccaacaccctgaagaccctggtgctggtgggctgcttcaccgtgttctggaccgtgtactacatgctggaggtgtacctgagccagagaaacgtggccagcaaccaggtgtgcagaagcggcccctgccactggccccacagaagcagaaaggccaaggaggagggcaccgagctggagagcgtgcccctgtgcagcagcaaggaccccgacgaggtggagaccgagagcagaggcccccccaccaccagcgacctgctggcccccgacctgctggagcagggcgactggagcctgagccagaacaagagcgccctggactgcccccaccagcacctggacgtgccccacggcaaggaggagcagatctgctag

SEQ ID NO: 21134 - DNA, 342 bp, Artificial Sequence
  Description of Artificial Sequence: Synthetic coding sequence
atgcccaagggcagacagaaggtgccccacctggacgcccccctgggcctgcccacctgcctgtggctggagctggccggcctgttcctgctggtgccctgggtgatgggcctggccggcaccggcggccccgacggccagggcaccggcggccccagctgggccgtgcacctggagagcctggagggcgacggcgaggaggagaccctggagcagcaggccgacgccctggcccaggccgccggcctggtgaacgccggcagaatcggcgagctgcagggccactacctgttcgtgcagcccgccggccacagacccgccctggaggtggaggccatctag

SEQ ID NO: 21135 - DNA, 279 bp, Artificial Sequence
  Description of Artificial Sequence: Synthetic coding sequence
atgcccaagggcagacagaaggtgccccacctggacgcccccctgggcctgcccacctgcctgtggctggagctggccggcctgttcctgctggtgccctgggtgatgggcctggccggcaccggcggccccgacggccagggcaccggcggccccagctgggccgtgcacctggagagcctggagggcgacggcgaggaggagaccctggagcagcaggccgacgccctggcccaggccgccggcctggtgaacgccggcagaatcggcgagctgtag

SEQ ID NO: 21136 - DNA, 279 bp, Artificial Sequence; identical to SEQ ID NO: 21135
  Description of Artificial Sequence: Synthetic coding sequence

SEQ ID NO: 21137 - DNA, 714 bp, Artificial Sequence
  Description of Artificial Sequence: Synthetic coding sequence
atgcccttctacgccgaggagtgcgccagcatgctggccgtgaccttcagcggcggcgacaagatgctgagaagcatcgtgaccaccgactgggacctgcagaagggcaccggctgcaccgagggccacaccggcaccagcgccgccgcccccctggccgccggcatgatcgccctgatgctgcaggtgagaccctgcctgacctggagagacgtgcagcacatcatcgtgttcaccgccaccagatacgaggacagaagagccgagtgggtgaccaacgaggccggcttcagccacagccaccagcacggcttcggcctgctgaacgcctggagactggtgaacgccgccaagatctggaccagcgtgccctacctggccagctacgtgagccccgtgctgaaggagaacaaggccatcccccagagccccagaagcctggaggtgctgtggaacgtgagcagaatggacctggagatgagcggcctgaagaccctggagcacgtggccgtgaccgtgagcatcacccaccccagaagaggcagcctggagctgaagctgttctgccccagcggcatgatgagcctgatcggcgcccccagaagcatggacagcgaccccaacggcttcaacgactggaccttcagcaccgtgagatgctggggcgagagagccagaggcacctacagactggtgatcagagacgtgggctag

SEQ ID NO: 21138 - DNA, 1776 bp, Artificial Sequence
  Description of Artificial Sequence: Synthetic coding sequence
atgcccaagggcagacagaaggtgccccacctggacgcccccctgggcctgcccacctgcctgtggctggagctggccggcctgttcctgctggtgccctgggtgatgggcctggccggcaccggcggccccgacggccagggcaccggcggccccagctgggccgtgcacctggagagcctggagggcgacggcgaggaggagaccctggagcagcaggccgacgccctggcccaggccgccggcctggtgaacgccggcagaatcggcgagctgcagggccactacctgttcgtgcagcccgccggccacagacccgccctggaggtggaggccatcagacagcaggtggaggccgtgctggccggccacgaggccgtgagatggcacagcgagcagagactgctgagaagagccaagagaagcgtgcacttcaacgaccccaagtacccccagcagtggcacctgaacaacagaagaagccccggcagagacatcaacgtgaccggcgtgtgggagagaaacgtgaccggcagaggcgtgaccgtggtggtggtggacgacggcgtggagcacaccatccaggacatcgcccccaactacagccccgagggcagctacgacctgaacagcaacgaccccgaccccatgccccaccccgacgtggagaacggcaaccaccacggcaccagatgcgccggcgagatcgccgccgtgcccaacaacagcttctgcgccgtgggcgtggcctacggcagcagaatcgccggcatcagagtgctggacggccccctgaccgacagcatggaggccgtggccttcaacaagcactaccagatcaacgacatctacagctgcagctggggccccgacgacgacggcaagaccgtggacggcccccaccagctgggcaaggccgccctgcagcacggcgtgatcgccggcagacagggcttcggcagcatcttcgtggtggccagcggcaacggcggccagcacaacgacaactgcaactacgacggctacgccaacagcatctacaccgtgaccatcggcgccgtggacgaggagggcagaatgcccttctacgccgaggagtgcgccagcatgctggccgtgaccttcagcggcggcgacaagatgctgagaagcatcgtgaccaccgactgggacctgcagaagggcaccggctgcaccgagggccacaccggcaccagcgccgccgcccccctggccgccggcatgatcgccctgatgctgcaggtgagaccctgcctgacctggagagacgtgcagcacatcatcgtgttcaccgccaccagatacgaggacagaagagccgagtgggtgaccaacgaggccggcttcagccacagccaccagcacggcttcggcctgctgaacgcctggagactggtgaacgccgccaagatctggaccagcgtgccctacctggccagctacgtgagccccgtgctgaaggagaacaaggccatcccccagagccccagaagcctggaggtgctgtggaacgtgagcagaatggacctggagatgagcggcctgaagaccctggagcacgtggccgtgaccgtgagcatcacccaccccagaagaggcagcctggagctgaagctgttctgccccagcggcatgatgagcctgatcggcgcccccagaagcatggacagctggctgtgcgtggagtgcagcagacaccagggccagaccaaggccgtgagagagtgccacgagtggaagatccccgccagatag

SEQ ID NO: 21139 - DNA, 2022 bp, Artificial Sequence
  Description of Artificial Sequence: Synthetic coding sequence
atggccaagctggagaccctgcccgtgagagccgaccccggcagagaccccctgctggccttcgcccccagacccagcgagctgggcccccccgaccccagactggccatgggcagcgtgggcagcggcgtggcccacgcccaggagttcgccatgaagagcgtgggcaccagaaccggcggcggcggcagccagggcagcttccccggccccagaggcagcggcagcggcgccagcagagagagacccggcagataccccagcgaggacaagggcctggccaacagcctgtacctgaacggcgagctgagaggcagcgaccacaccgacgtgtgcggcaacgtggtgggcagcagcggcggcagcagcagcagcggcggcagcgacaaggcccccccccagtacagagagcccagccacccccccaagctgctggccaccagcggcaagctggaccagtgcagcgagcccctggtgagacccagcgccttcaagcccgtggtgcccaagaacttccacagcatgcagaacctgtgccccccccagaccaacggcacccccgagggcagacagggccccggcggcctgaagggcggcctggacaagagcagaaccatgacccccgccggcggcagcggcagcggcctgagcgacagcggcagaaacagcctgaccagcctgcccacctacagcagcagctacagccagcacctggcccccctgagcgccagcaccagccacatcaacagaatcggcaccgccagctacggcagcggcagcggcggcagcagcggcggcggcagcggctaccaggacctgggcaccagcgacagcggcagagccagcagcaagagcggcagcagcagcagcatgggcagacccggccacctgggcagcggcgagggcggcggcggcggcctgcccttcgccgcctgcagcccccccagccccagcgccctgatccaggagctggaggagagactgtgggagaaggagcaggaggtggccgccctgagaagaagcctggagcagagcgaggccgccgtggcccaggtgctggaggagagacagaaggcctgggagagagagctggccgagctgagacagggctgcagcggcaagctgcagcaggtggccagaagagcccagagagcccagcagggcctgcagctgcaggtgctgagactgcagcaggacaagaagcagctgcaggaggaggccgccagactgatgagacagagagaggagctggaggacaaggtggccgcctgccagaaggagcaggccgacttcctgcccagaatcgaggagaccaagtgggaggtgtgccagaaggccggcgagatcagcctgctgaagcagcagctgaaggacagccaggccgacgtgagccagaagctgagcgagatcgtgggcctgagaagccagctgagagagggcagagccagcctgagagagaaggaggagcagctgctgagcctgagagacagcttcagcagcaagcaggccagcctggagctgggcgagggcgagctgcccgccgcctgcctgaagcccgccctgacccccgtggaccccgccgagccccaggacgccctggccacctgcgagagcgacgaggccaagatgagaagacaggccggcgtggccgccgccgccagcctggtgagcgtggacggcgaggccgaggccggcggcgagagcggcaccagagccctgagaagagaggtgggcagactgcaggccgagctggccgccgagagaagagccagagagagacagggcgccagcttcgccgaggagagaagagtgtggctggaggagaaggagaaggtgatcgagtaccagaagcagctgcagctgagctacgtggagatgtaccagagaaaccagcagctggagagaagactgagagagagaggcgccgccggcggcgccagcacccccaccccccagcacggcgaggagaagaaggcctggacccccagcagactggagagaatcgagagcaccgagatctag

SEQ ID NO: 21140 - DNA, 1884 bp, Artificial Sequence
  Description of Artificial Sequence: Synthetic coding sequence
atggccaagctggagaccctgcccgtgagagccgaccccggcagagaccccctgctggccttcgcccccagacccagcgagctgggcccccccgaccccagactggccatgggcagcgtgggcagcggcgtggcccacgcccaggagttcgccatgaagagcgtgggcaccagaaccggcggcggcggcagccagggcagcttccccggccccagaggcagcggcagcggcgccagcagagagagacccggcagataccccagcgaggacaagggcctggccaacagcctgtacctgaacggcgagctgagaggcagcgaccacaccgacgtgtgcggcaacgtggtgggcagcagcggcggcagcagcagcagcggcggcagcgacaaggcccccccccagtacagagagcccagccacccccccaagctgctggccaccagcggcaagctggaccagtgcagcgagcccctggtgagacccagcgccttcaagcccgtggtgcccaagaacttccacagcatgcagaacctgtgccccccccagaccaacggcacccccgagggcagacagggccccggcggcctgaagggcggcctggacaagagcagaaccatgacccccgccggcggcagcggcagcggcctgagcgacagcggcagaaacagcctgaccagcctgcccacctacagcagcagctacagccagcacctggcccccctgagcgccagcaccagccacatcaacagaatcggcaccgccagctacggcagcggcagcggcggcagcagcggcggcggcagcggctaccaggacctgggcaccagcgacagcggcagagccagcagcaagagcggcagcagcagcagcatgggcagacccggccacctgggcagcggcgagggcggcggcggcggcctgcccttcgccgcctgcagcccccccagccccagcgccctgatccaggagctggaggagagactgtgggagaaggagcaggaggtggccgccctgagaagaagcctggagcagagcgaggccgccgtggcccagcaggacaagaagcagctgcaggaggaggccgccagactgatgagacagagagaggagctggaggacaaggtggccgcctgccagaaggagcaggccgacttcctgcccagaatcgaggagaccaagtgggaggtgtgccagaaggccggcgagatcagcctgctgaagcagcagctgaaggacagccaggccgacgtgagccagaagctgagcgagatcgtgggcctgagaagccagctgagagagggcagagccagcctgagagagaaggaggagcagctgctgagcctgagagacagcttcagcagcaagcaggccagcctggagctgggcgagggcgagctgcccgccgcctgcctgaagcccgccctgacccccgtggaccccgccgagccccaggacgccctggccacctgcgagagcgacgaggccaagatgagaagacaggccggcgtggccgccgccgccagcctggtgagcgtggacggcgaggccgaggccggcggcgagagcggcaccagagccctgagaagagaggtgggcagactgcaggccgagctggccgccgagagaagagccagagagagacagggcgccagcttcgccgaggagagaagagtgtggctggaggagaaggagaaggtgatcgagtaccagaagcagctgcagctgagctacgtggagatgtaccagagaaaccagcagctggagagaagactgagagagagaggcgccgccggcggcgccagcacccccaccccccagcacggcgaggagaagaaggcctggacccccagcagactggagagaatcgagagcaccgagatctag

SEQ ID NO: 21141 - DNA, 1884 bp, Artificial Sequence; identical to SEQ ID NO: 21140
  Description of Artificial Sequence: Synthetic coding sequence

SEQ ID NO: 21142 - DNA, 1188 bp, Artificial Sequence
  Description of Artificial Sequence: Synthetic coding sequence
atgagcgccaacgccaccctgaagcccctgtgccccatcctggagcagatgagcagactgcagagccacagcaacaccagcatcagatacatcgaccacgccgccgtgctgctgcacggcctggccagcctgctgggcctggtggagaacggcgtgatcctgttcgtggtgggctgcagaatgagacagaccgtggtgaccacctgggtgctgcacctggccctgagcgacctgctggccagcgccagcctgcccttcttcacctacttcctggccgtgggccacagctgggagctgggcaccaccttctgcaagctgcacagcagcatcttcttcctgaacatgttcgccagcggcttcctgctgagcgccatcagcctggacagatgcctgcaggtggtgagacccgtgtgggcccagaaccacagaaccgtggccgccgcccacaaggtgtgcctggtgctgtgggccctggccgtgctgaacaccgtgccctacttcgtgttcagagacaccatcagcagactggacggcagaatcatgtgctactacaacgtgctgctgctgaaccccggccccgacagagacgccacctgcaacagcagacaggtggccctggccgtgagcaagttcctgctggccttcctggtgcccctggccatcatcgccagcagccacgccgccgtgagcctgagactgcagcacagaggcagaagaagacccggcagattcgtgagactggtggccgccgtggtggccgccttcgccctgtgctggggcccctaccacgtgttcagcctgctggaggccagagcccacgccaaccccggcctgagacccctggtgtggagaggcctgcccttcgtgaccagcctggccttcttcaacagcgtggccaaccccgtgctgtacgtgctgacctgccccgacatgctgagaaagctgagaagaagcctgagaaccgtgctggagagcgtgctggtggacgacagcgagctgggcggcgccggcagcagcagaagaagaagaaccagcagcaccgccagaagcgccagccccctggccctgtgcagcagacccgaggagcccagaggccccgccagactgctgggctggctgctgggcagctgcgccgccagcccccagaccggccccctgaacagagccctgagcagcaccagcagctag

SEQ ID NO: 21143 - DNA, 933 bp, Artificial Sequence
  Description of Artificial Sequence: Synthetic coding sequence
atggtgtacaagaccctgttcgccctgtgcatcctgaccgccggctggagagtgcagagcctgcccaccagcgcccccctgagcgtgagcctgcccaccaacatcgtgccccccaccaccatctggaccagcagcccccagaacaccgacgccgacaccgccagccccagcaacggcacccacaacaacagcgtgctgcccgtgaccgccagcgcccccaccagcctgctgcccaagaacatcagcatcgagagcagagaggaggagatcaccagccccggcagcaactgggagggcaccaacaccgaccccagccccagcggcttcagcagcaccagcggcggcgtgcacctgaccaccaccctggaggagcacagcagcggcacccccgaggccggcgtggccgccaccctgagccagagcgccgccgagccccccaccctgatcagcccccaggcccccgccagcagccccagcagcctgagcaccagcccccccgaggtgttcagcgccagcgtgaccaccaaccacagcagcaccgtgaccagcacccagcccaccggcgcccccaccgcccccgagagccccaccgaggagagcagcagcgaccacacccccaccagccacgccaccgccgagcccgtgccccaggagaagaccccccccaccaccgtgagcggcaaggtgatgtgcgagctgatcgacatggagaccaccaccaccttccccagagtgatcatgcaggaggtggagcacgccctgagcagcggcagcatcgccgccatcaccgtgaccgtgatcgccgtggtgctgctggtgttcggcgtggccgcctacctgaagatcagacacagcagctacggcagactgctggacgaccacgactacggcagctggggcaactacaacaaccccctgtacgacgacagctag

SEQ ID NO: 21144 - DNA, 1191 bp, Artificial Sequence
  Description of Artificial Sequence: Synthetic coding sequence
atgggcgagagaaagggcgtgaacaagtactacccccccgacttcaaccccgagaagcacggcagcctgaacagataccacaacagccaccccctgagagagagagccagaaagctgagccagggcatcctgatcatcagattcgagatgccctacaacatctggtgcgacggctgcaagaaccacatcggcatgggcgtgagatacaacgccgagaagaagaaggtgggcaactactacaccacccccatctacagattcagaatgaagtgccacctgtgcgtgaactacatcgagatgcagaccgaccccgccaactgcgactacgtgatcgtgagcggcgcccagagaaaggaggagagatgggacatggccgacaacgagcaggtgctgaccaccgagcacgagaagaagcagaagctggagaccgacgccatgttcagactggagcacggcgaggccgacagaagcaccctgaagaaggccctgcccaccctgagccacatccaggaggcccagagcgcctggaaggacgacttcgccctgaacagcatgctgagaagaagattcagagagaagaagaaggccatccaggaggaggaggagagagaccaggccctgcaggccaaggccagcctgaccatccccctggtgcccgagaccgaggacgacagaaagctggccgccctgctgaagttccacaccctggacagctacgaggacaagcagaagctgaagagaaccgagatcatcagcagaagctggttccccagcgcccccggcagcgccagcagcagcaaggtgagcggcgtgctgaagaagctggcccagagcagaagaaccgccctggccaccagccccatcaccgtgggcgacctgggcatcgtgagaagaagaagcagagacgtgcccgagagcccccagcacgccgccgacacccccaagagcggcgagcccagagtgcccgaggaggccgcccaggacagacccatgagccccggcgactgcccccccgagaccaccgagacccccaagtgcagcagccccagaggccaggagggcagcagacaggacaagcccctgagccccgccggcagcagccaggaggccgccgacacccccgacaccagacacccctgcagcctgggcagcagcctggtggccgactacagcgacagcgagagcgagtag

SEQ ID NO: 21145 - DNA, 1251 bp, Artificial Sequence
  Description of Artificial Sequence: Synthetic coding sequence
atggtgagacccagaagagccccctacagaagcggcgccggcggccccctgggcggcagaggcagaccccccagacccctggtggtgagagccgtgagaagcagaagctggcccgccagccccagaggcccccagccccccagaatcagagccagaagcgccccccccatggagggcgccagagtgttcggcgccctgggccccatcggccccagcagccccggcctgaccctgggcggcctggccgtgagcgagcacagactgagcaacaagctgctggcctggagcggcgtgctggagtggcaggagaagagaagaccctacagcgacagcaccgccaagctgaagagaaccctgccctgccaggcctacgtgaaccagggcgagaacctggagaccgaccagtggccccagaagctgatcatgcagctgatcccccagcagctgctgaccaccctgggccccctgttcagaaacagccagctggcccagttccacttcaccaacagagactgcgacagcctgaagggcctgtgcagaatcatgggcaacggcttcgccggctgcatgctgttcccccacatcagcccctgcgaggtgagagtgctgatgctgctgtacagcagcaagaagaagatcttcatgggcctgatcccctacgaccagagcggcttcgtgagcgccatcagacaggtgatcaccaccagaaagcaggccgtgggccccggcggcgtgaacagcggccccgtgcagatcgtgaacaacaagttcctggcctggagcggcgtgatggagtggcaggagcccagacccgagcccaacagcagaagcaagagatggctgcccagccacgtgtacgtgaaccagggcgagatcctgagaaccgagcagtggcccagaaagctgtacatgcagctgatcccccagcagctgctgaccaccctggtgcccctgttcagaaacagcagactggtgcagttccacttcaccaaggacctggagaccctgaagagcctgtgcagaatcatggacaacggcttcgccggctgcgtgcacttcagctacaaggccagctgcgagatcagagtgctgatgctgctgtacagcagcgagaagaagatcttcatcggcctgatcccccacgaccagggcaacttcgtgaacggcatcagaagagtgatcgccaaccagcagcaggtgctgcagagaaacctggagcaggagcagcagcagagaggcatgggcggctag

SEQ ID NO: 21146 - DNA, 831 bp, Artificial Sequence
  Description of Artificial Sequence: Synthetic coding sequence
atgctgctgttcagcgtgctgctgctgctgagcctggtgaccggcacccagctgggccccagaacccccctgcccgaggccggcgtggccatcctgggcagagccagaggcgcccacagaccccagcccccccacccccccagccccgtgagcgagtgcggcgacagaagcatcttcgagggcagaaccagatacagcagaatcaccggcggcatggaggccgaggtgggcgagttcccctggcaggtgagcatccaggccagaagcgagcccttctgcggcggcagcatcctgaacaagtggtggatcctgaccgccgcccactgcctgtacagcgaggagctgttccccgaggagctgagcgtggtgctgggcaccaacgacctgaccagccccagcatggagatcaaggaggtggccagcatcatcctgcacaaggacttcaagagagccaacatggacaacgacatcgccctgctgctgctggccagccccatcaagctggacgacctgaaggtgcccatctgcctgcccacccagcccggccccgccacctggagagagtgctgggtggccggctggggccagaccaacgccgccgacaagaacagcgtgaagaccgacctgatgaaggcccccatggtgatcatggactgggaggagtgcagcaagatgttccccaagctgaccaagaacatgctgtgcgccggctacaagaacgagagctacgacgcctgcaagcagagctacttccccaccctgcagagaatgaacaccggcagcagccagaccaagccccccggcagccacaccttccacctgcagaactag

SEQ ID NO: 21147 - DNA, 1059 bp, Artificial Sequence
  Description of Artificial Sequence: Synthetic coding sequence
atgctgctgttcagcgtgctgctgctgctgagcctggtgaccggcacccagctgggccccagaacccccctgcccgaggccggcgtggccatcctgggcagagccagaggcgcccacagaccccagcccccccacccccccagccccgtgagcgagtgcggcgacagaagcatcttcgagggcagaaccagatacagcagaatcaccggcggcatggaggccgaggtgggcgagttcccctggcaggtgagcatccaggccagaagcgagcccttctgcggcggcagcatcctgaacaagtggtggatcctgaccgccgcccactgcctgtacagcgaggagctgttccccgaggagctgagcgtggtgctgggcaccaacgacctgaccagccccagcatggagatcaaggaggtggccagcatcatcctgcacaaggacttcaagagagccaacatggacaacgacatcgccctgctgctgctggccagccccatcaagctggacgacctgaaggtgcccatctgcctgcccacccagcccggccccgccacctggagagagtgctgggtggccggctggggccagaccaacgccgccgacaagaacagcgtgaagaccgacctgatgaaggcccccatggtgatcatggactgggaggagtgcagcaagatgttccccaagctgaccaagaacatgctgtgcgccggctacaagaacgagagctacgacgcctgcaagggcgacagcggcggccccctggtgtgcacccccgagcccggcgagaagtggtaccaggtgggcatcatcagctggggcaagagctgcggcgagaagaacacccccggcatctacaccagcctggtgaactacaacctgtggatcgagaaggtgacccagctggagggcagacccttcaacgccgagaagagaagaaccagcgtgaagcagaagcccatgggcagccccgtgagcggcgtgcccgagcccggcagccccagaagctggctgctgctgtgccccctgagccacgtgctgttcagagccatcctgtactag

SEQ ID NO: 21148 - DNA, 1185 bp, Artificial Sequence
  Description of Artificial Sequence: Synthetic coding sequence
atgggcatgaagcacagcagcagatgcctgctgctgagaagaaagatggccgagaacgccgccgagagcaccgaggtgaacagcccccccagccagcccccccagcccgtggtgcccgccaagcccgtgcagtgcgtgcaccacgtgagcacccagcccagctgccccggcagaggcaagatgagcaagctgctgaaccccgaggagatgaccagcagagactactacttcgacagctacgcccacttcggcatccacgaggagatgctgaaggacgaggtgagaaccctgacctacagaaacagcatgtaccacaacaagcacgtgttcaaggacaaggtggtgctggacgtgggcagcggcaccggcatcctgagcatgttcgccgccaaggccggcgccaagaaggtgttcggcatcgagtgcagcagcatcagcgactacagcgagaagatcatcaaggccaaccacctggacaacatcatcaccatcttcaagggcaaggtggaggaggtggagctgcccgtggagaaggtggacatcatcatcagcgagtggatgggctactgcctgttctacgagagcatgctgaacaccgtgatcttcgccagagacaagtggctgaagcccggcggcctgatgttccccgacagagccgccctgtacgtggtggccatcgaggacagacagtacaaggacttcaagatccactggtgggagaacgtgtacggcttcgacatgacctgcatcagagacgtggccatgaaggagcccctggtggacatcgtggaccccaagcaggtggtgaccaacgcctgcctgatcaaggaggtggacatctacaccgtgaagaccgaggagctgagcttcaccagcgccttctgcctgcagatccagagaaacgactacgtgcacgccctggtgacctacttcaacatcgagttcaccaagtgccacaagaagatgggcttcagcaccgcccccgacgccccctacacccactggaagcagaccgtgttctacctggaggactacctgaccgtgagaagaggcgaggagatctacggcaccatcagcatgaagcccaacgccaagaacgtgagagacctggacttcaccgtggacctggacttcaagggccagctgtgcgagaccagcgtgagcaacgactacaagatgagatag

SEQ ID NO: 21149 - DNA, 1158 bp, Artificial Sequence
  Description of Artificial Sequence: Synthetic coding sequence
atggagagcctggccagcgacggcttcaagctgaaggaggtgagcagcgtgaacagcccccccagccagcccccccagcccgtggtgcccgccaagcccgtgcagtgcgtgcaccacgtgagcacccagcccagctgccccggcagaggcaagatgagcaagctgctgaaccccgaggagatgaccagcagagactactacttcgacagctacgcccacttcggcatccacgaggagatgctgaaggacgaggtgagaaccctgacctacagaaacagcatgtaccacaacaagcacgtgttcaaggacaaggtggtgctggacgtgggcagcggcaccggcatcctgagcatgttcgccgccaaggccggcgccaagaaggtgttcggcatcgagtgcagcagcatcagcgactacagcgagaagatcatcaaggccaaccacctggacaacatcatcaccatcttcaagggcaaggtggaggaggtggagctgcccgtggagaaggtggacatcatcatcagcgagtggatgggctactgcctgttctacgagagcatgctgaacaccgtgatcttcgccagagacaagtggctgaagcccggcggcctgatgttccccgacagagccgccctgtacgtggtggccatcgaggacagacagtacaaggacttcaagatccactggtgggagaacgtgtacggcttcgacatgacctgcatcagagacgtggccatgaaggagcccctggtggacatcgtggaccccaagcaggtggtgaccaacgcctgcctgatcaaggaggtggacatctacaccgtgaagaccgaggagctgagcttcaccagcgccttctgcctgcagatccagagaaacgactacgtgcacgccctggtgacctacttcaacatcgagttcaccaagtgccacaagaagatgggcttcagcaccgcccccgacgccccctacacccactggaagcagaccgtgttctacctggaggactacctgaccgtgagaagaggcgaggagatctacggcaccatcagcatgaagcccaacgccaagaacgtgagagacctggacttcaccgtggacctggacttcaagggccagctgtgcgagaccagcgtgagcaacgactacaagatgagatag

SEQ ID NO: 21150 - DNA, 3498 bp, Artificial Sequence
  Description of Artificial Sequence: Synthetic coding sequence
atgtacttcctgagcggctggcccaagagactgctgtgccccctgggcagccccgccgaggcccccttccacgtgcagagcgacccccagagagccttcttcgccgtgctggccgccgccagactgagcatctggtacagcagacccagcgtgctgatcgtgacctacaaggagcccgccaagagcagcacccagttcggcagctacaagcaggccgagtggagacccgacagcaccatgatcgccgtgagcaccgccaacggctacatcctgttcttccacatcaccagcaccagaggcgacaagtacctgtacgagcccgtgtaccccaagggcagcccccagatgaagggcaccccccacttcaaggaggagcagtgcgcccccgccctgaacctggagatgagaaagatcctggacctgcaggcccccatcatgagcctgcagagcgtgctggaggacctgctggtggccaccagcgacggcctgctgcacctgatccactgggagggcatgaccaacggcagaaaggccatcaacctgtgcaccgtgcccttcagcgtggacctgcagagcagcagagtgggcagcttcctgggcttcaccgacgtgcacatcagagacatggagtactgcgccaccctggacggcttcgccgtggtgttcaacgacggcaaggtgggcttcatcacccccgtgagcagcagattcaccgccgagcagctgcacggcgtgtggccccaggacgtggtggacggcacctgcgtggccgtgaacaacaagtacagactgatggccttcggctgcgtgagcggcagcgtgcaggtgtacaccatcgacaacagcaccggcgccatgctgctgagccacaagctggagctgaccgccaagcagtaccccgacatctggaacaagaccggcgccgtgaagctgatgagatggagccccgacaacagcgtggtgatcgtgacctgggagtacggcggcctgagcctgtggagcgtgttcggcgcccagctgatctgcaccctgggcggcgacttcgcctacagaagcgacggcaccaagaaggaccccctgaagatcaacagcatgagctggggcgccgagggctaccacctgtgggtgatcagcggcttcggcagccagaacaccgagatcgagagcgacctgagaagcgtggtgaagcagcccagcatcctgctgttccagttcatcaagagcgtgctgaccgtgaacccctgcatgagcaaccaggagcaggtgctgctgcagggcgaggacagactgtacctgaactgcggcgaggccagccagacccagaaccccagaagcagcagcacccacagcgagcacaagcccagcagagagaagagccccttcgccgacggcggcctggagagccagggcctgagcaccctgctgggccacagacactggcacgtggtgcagatcagcagcacctacctggagagcaactggcccatcagattcagcgccatcgacaagctgggccagaacatcgccgtggtgggcaagttcggcttcgcccactacagcctgctgaccaagaagtggaagctgttcggcaacatcacccaggagcagaacatgatcgtgaccggcggcctggcctggtggaacgacttcatggtgctggcctgctacaacatcaacgacagacaggaggagctgagagtgtacctgagaaccagcaacctggacaacgccttcgcccacgtgaccaaggcccaggccgagaccctgctgctgagcgtgttccaggacatggtgatcgtgttcagagccgactgcagcatctgcctgtacagcatcgagagaaagagcgacggccccaacaccaccgccggcatccaggtgctgcaggaggtgagcatgagcagatacatcccccaccccttcctggtggtgagcgtgaccctgaccagcgtgagcaccgagaacggcatcaccctgaagatgccccagcaggccagaggcgccgagagcatcatgctgaacctggccggccagctgatcatgatgcagagagacagaagcggcccccagatcagagagaaggacagcaaccccaacaaccagagaaagctgctgcccttctgcccccccgtggtgctggcccagagcgtggagaacgtgtggaccacctgcagagccaacaagcagaagagacacctgctggaggccctgtggctgagctgcggcggcgccggcatgaaggtgtggctgcccctgttccccagagaccacagaaagccccacagcttcctgagccagagaatcatgctgcccttccacatcaacatctaccccctggccgtgctgttcgaggacgccctggtgctgggcgccgtgaacgacaccctgctgtacgacagcctgtacaccagaaacaacgccagagagcagctggaggtgctgttccccttctgcgtggtggagagaaccagccagatctacctgcaccacatcctgagacagctgctggtgagaaacctgggcgagcaggccctgctgctggcccagagctgcgccaccctgccctacttcccccacgtgctggagctgatgctgcacgaggtgctggaggaggaggccaccagcagagagcccatccccgaccccctgctgcccaccgtggccaagttcatcaccgagttccccctgttcctgcagaccgtggtgcactgcgccagaaagaccgagtacgccctgtggaactacctgttcgccgccgtgggcaaccccaaggacctgttcgaggagtgcctgatggcccaggacctggacaccgccgccagctacctgatcatcctgcagaacatggaggtgcccgccgtgagcagacagcacgccaccctgctgttcaacaccgccctggagcagggcaagtgggacctgtgcagacacatgatcagattcctgaaggccatcggcagcggcgagagcgagaccccccccagcacccccaccgcccaggagcccagcagcagcggcggcttcgagttcttcagaaacagaagcatcagcctgagccagagcgccgagaacgtgcccgccagcaagttcagcctgcagaagaccctgagcatgcccagcggccccagcggcaagagatggagcaaggacagcgactgcgccgagaacatgtacatcgacatgatgctgtggagacacgccagaagactgctggaggacgtgagactgaaggacctgggctgcttcgccgcccagctgggcttcgagctgatcagctggctgtgcaaggagagaaccagagccgccagagtggacaacttcgtgatcgccctgaagagactgcacaaggacttcctgtggcccctgcccatcatccccgccagcagcatcagcagccccttcaagaacggcaagtacagaaccggcaacgtggacttcatgagcctggtgcagggcgagctgtacttcaccccctgcatctacaccttctgctactag

SEQ ID NO: 21151 - DNA, 2043 bp, Artificial Sequence
  Description of Artificial Sequence: Synthetic coding sequence
atgtacaccttcctgcccgacaacttcagccccgccaagcccaagcccagcaaggacctgaagcccctgctgggcagcgccgtgctgggcctgctgctggtgctggccgccgtggtggcctggtgctactacagcgtgagcctgagaaaggccgagagactgagagccgagctgctggacctgaaggccggcggcttcagcatcagaaaccagaagggcgagcaggtgttcagactggccttcagaagcggcgccctggacctggacagctgcagcagagacggcgccctgctgggctgcagcctgaccgccgacggcctgcccctgcacttcttcatccagaccgtgagacccaaggacaccgtgatgtgctacagagtgagatgggaggaggccgcccccggcagagccgtggagcacgccatgttcctgggcgacgccgccgcccactggtacggcggcgccgagatgagaacccagcactggcccatcagactggacggccagcaggagccccagcccttcgtgaccagcgacgtgtacagcagcgacgccgccttcggcggcatcctggagagatactggctgagcagcagagccgccgccatcaaggtgaacgacagcgtgcccttccacctgggctggaacagcaccgagagaagcctgagactgcaggccagataccacgacaccccctacaagccccccgccggcagagccgccgcccccgagctgagctacagagtgtgcgtgggcagcgacgtgaccagcatccacaagtacatggtgagaagatacttcaacaagcccagcagagtgcccgcccccgaggccttcagagaccccatctggagcacctgggccctgtacggcagagccgtggaccaggacaaggtgctgagattcgcccagcagatcagactgcaccacttcaacagcagccacctggagatcgacgacatgtacacccccgcctacggcgacttcgacttcgacgaggtgaagttccccaacgccagcgacatgttcagaagactgagagacgccggcttcagagtgaccctgtgggtgcaccccttcgtgaactacaacagcagcagattcggcgagggcgtggagagagagctgttcgtgagagagcccaccggcagactgcccgccctggtgagatggtggaacggcatcggcgccgtgctggacttcacccaccccaaggccagagactggttccagggccacctgagaagactgagaagcagatacagcgtggccagcttcaagttcgacgccggcgaggtgagctacctgcccagagacttcagcacctacagacccctgcccgaccccagcgtgtggagcagaagatacaccgagatggccctgcccttcttcagcctggccgaggtgagagtgggctaccagagccagaacatcagctgcttcttcagactggtggacagagacagcgtgtggggctacgacctgggcctgagaagcctgatccccgccgtgctgaccgtgagcatgctgggctaccccttcatcctgcccgacatggtgggcggcaacgccgtgccccagagaaccgccggcggcgacgtgcccgagagagagctgtacatcagatggctggaggtggccgccttcatgcccgccatgcagttcagcatccccccctggagatacgacgccgaggtggtggccatcgcccagaagttcgccgccctgagagccagcctggtggcccccctgctgctggagctggccggcgaggtgaccgacaccggcgaccccatcgtgagacccctgtggtggatcgcccccggcgacgagaccgcccacagaatcgacagccagttcctgatcggcgacaccctgctggtggcccccgtgctggagcccggcaagcaggagagagacgtgtacctgcccgccggcaagtggagaagctacaagggcgagctgttcgacaagacccccgtgctgctgaccgactaccccgtggacctggacgagatcgcctacttcacctgggccagctag

SEQ ID NO: 21152 - DNA, 228 bp, Artificial Sequence
  Description of Artificial Sequence: Synthetic coding sequence
atggccgccgagtgggccagcagattctggctgtgggccaccctgctgatccccgccgccgccgtgtacgaggaccaggtgggcaagttcgactggagacagcagtacgtgggcaaggtgaagttcgccagcctggagttcagccccggcagcaagaagctggtggtggccaccgagaagaacgtgatcgccgccctgaacagcagaaccggcgagatctgcgagtag

SEQ ID NO: 21153 - DNA, 1665 bp, Artificial Sequence
  Description of Artificial Sequence: Synthetic coding sequence
gcccccaccggcagagccgacctgagcggcaaccagggcaacgccgccggcagactggccaccgtgcacgagcccgtggtgacccagtgggccgtgcacccccccgcccccgcccaccccagcctgctggacaagatggagaaggcccccccccagccccagcacgagggcctgaagagcaaggagcacctgccccagcagcccgccgagggcaagaccgccagcagaagagtgcccagactgagagccgtggtggagagccaggccttcaagaacatcctggtggacgagatggacatgatgcacgccagagccgccaccctgatccaggccaactggagaggctactggctgagacagaagctgatcagccagatgatggccgccaaggccatccaggaggcctggagaagattcaacaagagacacatcctgcacagcagcaagagcctggtgaagaagaccagagccgaggagggcgacatcccctaccacgccccccagcaggtgagattccagcaccccgaggagaacagactgctgagcccccccatcatggtgaacaaggagacccagttccccagctgcgacaacctggtgctgtgcagaccccagagcagccccctgctgcagccccccgccgcccagggcacccccgagccctgcgtgcagggcccccacgccgccagagtgagaggcctggccttcctgccccaccagaccgtgaccatcagattcccctgccccgtgagcctggacgccaagtgccagccctgcctgctgaccagaaccatcagaagcacctgcctggtgcacatcgagggcgacagcgtgaagaccaagagagtgagcgccagaaccaacaaggccagagcccccgagacccccctgagcagaagatacgaccaggccgtgaccagacccagcagagcccagacccagggccccgtgaaggccgagacccccaaggcccccttccagatctgccccggccccatgatcaccaagaccctgctgcagacctaccccgtggtgagcgtgaccctgccccagacctaccccgccagcaccatgaccaccaccccccccaagaccagccccgtgcccaaggtgaccatcatcaagacccccgcccagatgtaccccggccccaccgtgaccaagaccgccccccacacctgccccatgcccaccatgaccaagatccaggtgcaccccaccgccagcagaaccggcacccccagacagacctgccccgccaccatcaccgccaagaacagaccccaggtgagcctgctggccagcatcatgaagagcccccccagcgtggtgatgctggtgggcagcagccccagaacctgccacacctgcggcagaacccagcccaccagagtggtgcagggcatgggccagggcaccgagggccccggcgccgtgagctgggccagcgcctaccagctggccgccctgagccccagacagccccacagacaggacaaggccgccaccgccatccagagcgcctggagaggcttcaagatcagacagcagatgagacagcagcagatggccgccaagatcgtgcaggccacctggtggcacctgggcccctggctgcccgccgtgggcaccagctgggaggccctgatggccctgtgggtgtag

SEQ ID NO: 21154 - DNA, 657 bp, Artificial Sequence
  Description of Artificial Sequence: Synthetic coding sequence
caggtgaagaaggtgctgttcgaggacgacgagagaagcaccgacagcagccagcagtgcagcagcgaggacgaggacatcttcgaggagaccgcccaggtgagcccccccagaggcaaggagaagagacagtggagagccagaatgcccctgctgagcgtgcagcccgtgagcaacgccgactgggtgtggctggtgaagagactgcacaagctgtgcatggagctgtgcaacaactacatccagatgcacctggacctggagaactgcatggaggagccccccatcttcaagggcgaccccttcttcatcctgcccagcttccagagcgagagcagcacccccagcaccggcggcttcagcggcaaggagacccccagcgaggacgacagaagccagcccagaagcggcagcaccggcagcagcctgagcgtgagcgtgagagacgccgaggcccagatccaggcctggaccaacatggtgctgaccgtgctgaaccagatccagatcctgcccgaccagaccttcaccgccctgcagcccgccgtgttcccctgcatcagccagctgacctgccacgtgaccgacatcagagtgagacaggccgtgagagagtggctgggcagagtgggcagagtgtacgacatcatcgtgtag

SEQ ID NO: 21155 - DNA, 1035 bp, Artificial Sequence
  Description of Artificial Sequence: Synthetic coding sequence
atggagaagagactgggcgtgaagcccaaccccgccagctggatcctgagcggctactactggcagaccagcgccaagtggctgagaagcctgtacctgttctacacctgcttctgcttcagcgtgctgtggctgagcaccgacgccagcgagagcagatgccagcagggcaagacccagttcggcgtgggcctgagaagcggcggcgagaaccacctgtggctgctggagggcacccccagcctgcagagctgctgggccgcctgctgccaggacagcgcctgccacgtgttctggtggctggagggcatgtgcatccaggccgactgcagcagaccccagagctgcagagccttcagaacccacagcagcaacagcatgctggtgttcctgaagaagttccagaccgccgacgacctgggcttcctgcccgaggacgacgtgccccacctgctgggcctgggctggaactgggccagctggagacagagcccccccagagccgccctgagacccgccgtgagcagcagcgaccagcagagcctgatcagaaagctgcagaagagaggcagccccagcgacgtggtgacccccatcgtgacccagcacagcaaggtgaacgacagcaacgagctgggcggcctgaccaccagcggcagcgccgaggtgcacaaggccatcaccatcagcagccccctgaccaccgacctgaccgccgagctgagcggcggccccaagaacgtgagcgtgcagcccgagatcagcgagggcctggccaccacccccagcacccagcaggtgaagagcagcgagaagacccagatcgccgtgccccagcccgtggcccccagctacagctacgccacccccaccccccaggccagcttccagagcaccagcgccccctaccccgtgatcaaggagctggtggtgagcgccggcgagagcgtgcagatcaccctgcccaagaacgaggtgcagctgaacgcctacgtgctgcaggagccccccaaggcccacagcagacccgtgtag

SEQ ID NO: 21156 - DNA, 2979 bp, Artificial Sequence
  Description of Artificial Sequence: Synthetic coding sequence
atggccgccgagtgggccagcagattctggctgtgggccaccctgctgatccccgccgccgccgtgtacgaggaccaggtgggcaagttcgactggagacagcagtacgtgggcaaggtgaagttcgccagcctggagttcagccccggcagcaagaagctggtggtggccaccgagaagaacgtgatcgccgccctgaacagcagaaccggcgagatcctgtggagacacgtggacaagggcaccgccgagggcgccgtggacgccatgctgctgcacggccaggacgtgatcaccgtgagcaacggcggcagaatcatgagaagctgggagaccaacatcggcggcctgaactgggagatcaccctggacagcggcagcttccaggccctgggcctggtgggcctgcaggagagcgtgagatacatcgccgtgctgaagaagaccaccctggccctgcaccacctgagcagcggccacctgaagtgggtggagcacctgcccgagagcgacagcatccactaccagatggtgtacagctacggcagcggcgtggtgtgggccctgggcgtggtgcccttcagccacgtgaacatcgtgaagttcaacgtggaggacggcgagatcgtgcagcaggtgagagtgagcaccccctggctgcagcacctgagcggcgcctgcggcgtggtggacgaggccgtgctggtgtgccccgaccccagcagcagaagcctgcagaccctggccctggagaccgagtgggagctgagacagatccccctgcagagcctggacctggagttcggcagcggcttccagcccagagtgctgcccacccagcccaaccccgtggacgccagcagagcccagttcttcctgcacctgagccccagccactacgccctgctgcagtaccactacggcaccctgagcctgctgaagaacttcccccagaccgccctggtgagcttcgccaccaccggcgagaagaccgtggccgccgtgatggcctgcagaaacgaggtgaagagcagcagcagcgaggacggcagcatgggcagcttcagcgagaagagcagcagcaaggacagcctggcctgcttcaaccagacctacaccatcaacctgtacctggtggagaccggcagaagactgctggacaccaccatcaccttcagcctggagcagagcggcaccagacccgagagactgtacatccaggtgttcctgaagaaggacgacagcgtgggctacagagccctggtgcagaccgaggaccacctgctgctgttcctgcagcagctggccggcaaggtggtgctgtggagcagagaggagagcctggccgaggtggtgtgcctggagatggtggacctgcccctgaccggcgcccaggccgagctggagggcgagttcggcaagaaggccgacggcctgctgggcatgttcctgaagagactgagcagccagctgatcctgctgcaggcctggaccagccacctgtggaagatgttctacgacgccagaaagcccagaagccagatcaagaacgagatcaacatcgacaccctggccagagacgagttcaacctgcagaagatgatggtgatggtgaccgccagcggcaagctgttcggcatcgagagcagcagcggcaccatcctgtggaagcagtacctgcccaacgtgaagcccgacagcagcttcaagctgatggtgcagagaaccaccgcccacttcccccaccccccccagtgcaccctgctggtgaaggacaaggagagcggcatgagcagcctgtacgtgttcaaccccatcttcggcaagtggagccaggtggccccccccgtgctgaagagacccatcctgcagagcctgctgctgcccgtgatggaccaggactacgccaaggtgctgctgctgatcgacgacgagtacaaggtgaccgccttccccgccaccagaaacgtgctgagacagctgcacgagctggcccccagcatcttcttctacctggtggacgccgagcagggcagactgtgcggctacagactgagaaaggacctgaccaccgagctgagctgggagctgaccatcccccccgaggtgcagagaatcgtgaaggtgaagggcaagagaagcagcgagcacgtgcacagccagggcagagtgatgggcgacagaagcgtgctgtacaagagcctgaaccccaacctgctggccgtggtgaccgagagcaccgacgcccaccacgagagaaccttcatcggcatcttcctgatcgacggcgtgaccggcagaatcatccacagcagcgtgcagaagaaggccaagggccccgtgcacatcgtgcacagcgagaactgggtggtgtaccagtactggaacaccaaggccagaagaaacgagttcaccgtgctggagctgtacgagggcaccgagcagtacaacgccaccgccttcagcagcctggacagaccccagctgccccaggtgctgcagcagagctacatcttccccagcagcatcagcgccatggaggccaccatcaccgagagaggcatcaccagcagacacctgctgatcggcctgcccagcggcgccatcctgagcctgcccaaggccctgctggaccccagaagacccgagatccccaccgagcagagcagagaggagaacctgatcccctacagccccgacgtgcagatccacgccgagagattcatcaactacaaccagaccgtgagcagaatgagaggcatctacaccgcccccagcggcctggagagcacctgcctggtggtggcctacggcctggacatctaccagaccagagtgtaccccagcaagcagttcgacgtgctgaaggacgactacgactacgtgctgatcagcagcgtgctgttcggcctggtgttcgccaccatgatcaccaagagactggcccaggtgaagctgctgaacagagcctggagatag

SEQ ID NO: 21157 - DNA, 2916 bp, Artificial Sequence
  Description of Artificial Sequence: Synthetic coding sequence
atggccgccgagtgggccagcagattctggctgtgggccaccctgctgatccccgccgccgccgtgtacgaggaccaggtgggcaagttcgactggagacagcagtacgtgggcaaggtgaagttcgccagcctggagttcagccccggcagcaagaagctggtggtggccaccgagaagaacgtgatcgccgccctgaacagcagaaccggcgagatctacgtgatcaccgtgagcaacggcggcagaatcatgagaagctgggagaccaacatcggcggcctgaactgggagatcaccctggacagcggcagcttccaggccctgggcctggtgggcctgcaggagagcgtgagatacatcgccgtgctgaagaagaccaccctggccctgcaccacctgagcagcggccacctgaagtgggtggagcacctgcccgagagcgacagcatccactaccagatggtgtacagctacggcagcggcgtggtgtgggccctgggcgtggtgcccttcagccacgtgaacatcgtgaagttcaacgtggaggacggcgagatcgtgcagcaggtgagagtgagcaccccctggctgcagcacctgagcggcgcctgcggcgtggtggacgaggccgtgctggtgtgccccgaccccagcagcagaagcctgcagaccctggccctggagaccgagtgggagctgagacagatccccctgcagagcctggacctggagttcggcagcggcttccagcccagagtgctgcccacccagcccaaccccgtggacgccagcagagcccagttcttcctgcacctgagccccagccactacgccctgctgcagtaccactacggcaccctgagcctgctgaagaacttcccccagaccgccctggtgagcttcgccaccaccggcgagaagaccgtggccgccgtgatggcctgcagaaacgaggtgcagaagagcagcagcagcgaggacggcagcatgggcagcttcagcgagaagagcagcagcaaggacagcctggcctgcttcaaccagacctacaccatcaacctgtacctggtggagaccggcagaagactgctggacaccaccatcaccttcagcctggagcagagcggcaccagacccgagagactgtacatccaggtgttcctgaagaaggacgacagcgtgggctacagagccctggtgcagaccgaggaccacctgctgctgttcctgcagcagctggccggcaaggtggtgctgtggagcagagaggagagcctggccgaggtggtgtgcctggagatggtggacctgcccctgaccggcgcccaggccgagctggagggcgagttcggcaagaaggccgacggcctgctgggcatgttcctgaagagactgagcagccagctgatcctgctgcaggcctggaccagccacctgtggaagatgttctacgacgccagaaagcccagaagccagatcaagaacgagatcaacatcgacaccctggccagagacgagttcaacctgcagaagatgatggtgatggtgaccgccagcggcaagctgttcggcatcgagagcagcagcggcaccatcctgtggaagcagtacctgcccaacgtgaagcccgacagcagcttcaagctgatggtgcagagaaccaccgcccacttcccccaccccccccagtgcaccctgctggtgaaggacaaggagagcggcatgagcagcctgtacgtgttcaaccccatcttcggcaagtggagccaggtggccccccccgtgctgaagagacccatcctgcagagcctgctgctgcccgtgatggaccaggactacgccaaggtgctgctgctgatcgacgacgagtacaaggtgaccgccttccccgccaccagaaacgtgctgagacagctgcacgagctggcccccagcatcttcttctacctggtggacgccgagcagggcagactgtgcggctacagactgagaaaggacctgaccaccgagctgagctgggagctgaccatcccccccgaggtgcagagaatcgtgaaggtgaagggcaagagaagcagcgagcacgtgcacagccagggcagagtgatgggcgacagaagcgtgctgtacaagagcctgaaccccaacctgctggccgtggtgaccgagagcaccgacgcccaccacgagagaaccttcatcggcatcttcctgatcgacggcgtgaccggcagaatcatccacagcagcgtgcagaagaaggccaagggccccgtgcacatcgtgcacagcgagaactgggtggtgtaccagtactggaacaccaaggccagaagaaacgagttcaccgtgctggagctgtacgagggcaccgagcagtacaacgccaccgccttcagcagcctggacagaccccagctgccccaggtgctgcagcagagctacatcttccccagcagcatcagcgccatggaggccaccatcaccgagagaggcatcaccagcagacacctgctgatcggcctgcccagcggcgccatcctgagcctgcccaaggccctgctggaccccagaagacccgagatccccaccgagcagagcagagaggagaacctgatcccctacagccccgacgtgcagatccacgccgagagattcatcaactacaaccagaccgtgagcagaatgagaggcatctacaccgcccccagcggcctggagagcacctgcctggtggtggcctacggcctggacatctaccagaccagagtgtaccccagcaagcagttcgacgtgctgaaggacgactacgactacgtgctgatcagcagcgtgctgttcggcctggtgttcgccaccatgatcaccaagagactggcccaggtgaagctgctgaacagagcctggagatag

SEQ ID NO: 21158 - DNA, 4101 bp, Artificial Sequence
  Description of Artificial Sequence: Synthetic coding sequence
atgctgttcaagcaggccgagctgtggatgccccaccagggcaagggcaacaagggcgagccccccagcgccctgggcctgagcaccagaaaggccctgagcgtgctgaaggagcagctggaggccgtgctggagggccacctgagagagagaaagaagtgcctgacctggaaggaggtgtggagaagcagcttcctgcaccacagcaacagatgcagctgcttccactggcccggcgccagcctgatgctgctggccgtgctgctgctgctgggctgctgcggcggccagcccgccggcagcagaggcgtgggcctggtgaacgccagcgccctgttcctgctgctgctgctgaacctggtgctgatcggcagacaggacagactgaagagaagagaggtggagagaagactgagaggcatcatcgaccagatccaggacgccctgagagacggcagagagatccagtggcccagcgccatgtaccccgacctgcacatgcccttcgcccccagctggagcctgcactgggcctacagagacggccacctggtgaacctgcccgtgagcctgctggtggagggcgacatcatcgccctgagacccggccaggagagcttcgccagcctgagaggcatcaaggacgacgagcacatcgtgctggagcccggcgacctgttcccccccttcagccccccccccagccccagaggcgaggtggagagaggcccccagagcccccagcagcacagactgttcagagtgctggagacccccgtgatcgacaacatcagatggtgcctggacatggccctgagcagacccgtgaccgccctggacaacgagagattcaccgtgcagagcgtgatgctgcactacgccgtgcccgtggtgctggccggcttcctgatcaccaacgccctgagattcatcttcagcgcccccggcgtgaccagctggcagtacaccctgctgcagctgcaggtgaacggcgtgctgcccatcctgcccctgctgttccccgtgctgtgggtgctggccaccgcctgcggcgaggccagagtgctggcccagatgagcaaggccagccccagcagcctgctggccaagttcagcgaggacaccctgagcagctacaccgaggccgtgagcagccaggagatgctgagatgcatctggggccacttcctgagagtgctgggcggcaccagccccaccctgagccacagcagcagcctgctgcacagcctgggcagcgtgaccgtgctgtgctgcgtggacaagcagggcatcctgagctggcccaaccccagccccgagaccgtgctgttcttcagcggcaaggtggagcccccccacagcagccacgaggacctgaccgacggcctgagcaccagaagcttctgccaccccgagccccacgagagagacgccctgctggccggcagcctgaacaacaccctgcacctgagcaacgagcaggagagaggcgactggcccggcgaggcccccaagccccccgagccctacagccaccacaaggcccacggcagaagcaagcaccccagcggcagcaacgtgagcttcagcagagacaccgagggcggcgaggaggagcccagcaagacccagcccggcatggagagcgacccctacgaggccgaggacttcgtgtgcgactaccacctggagatgctgagcctgagccaggaccagcagaaccccagctgcatccagttcgacgacagcaactggcagctgcacctgaccagcctgaagcccctgggcctgaacgtgctgctgaacctgtgcgacgccagcgtgaccgagagactgtgcagattcagcgaccacctgtgcaacatcgccctgcaggagagccacagcgccgtgctgcccgtgcacgtgccctggggcctgtgcgagctggccagactgatcggcttcacccccggcgccaaggagctgttcaagcaggagaaccacctggccctgtacagactgcccagcgccgagaccatgaaggagaccagcctgggcagactgagctgcgtgaccaagagaagaccccccctgagccacatgatcagcctgttcatcaaggacaccaccaccagcaccgagcagatgctgagccacggcaccgccgacgtggtgctggaggcctgcaccgacttctgggacggcgccgacatctaccccctgagcggcagcgacagaaagaaggtgctggacttctaccagagagcctgcctgagcggctactgcagcgccttcgcctacaagcccatgaactgcgccctgagcagccagctgaacggcaagtgcatcgagctggtgcaggtgcccggccagagcagcatcttcaccatgtgcgagctgcccagcaccatccccatcaagcagaacgccagaagaagcagctggagcagcgacgagggcatcggcgaggtgctggagaaggaggactgcatgcaggccctgagcggccagatcttcatgggcatggtgagcagccagtaccaggccagactggacatcgtgagactgatcgacggcctggtgaacgcctgcatcagattcgtgtacttcagcctggaggacgagctgaagagcaaggtgttcgccgagaagatgggcctggagaccggctggaactgccacatcagcctgacccccaacggcgacatgcccggcagcgagatcccccccagcagccccagccacgccggcagcctgcacgacgacctgaaccaggtgagcagagacgacgccgagggcctgctgctgatggaggaggagggccacagcgacctgatcagcttccagcccaccgacagcgacatccccagcttcctggaggacagcaacagagccaagctgcccagaggcatccaccaggtgagaccccacctgcagaacatcgacaacgtgcccctgctggtgcccctgttcaccgactgcacccccgagaccatgtgcgagatgatcaagatcatgcaggagtacggcgaggtgacctgctgcctgggcagcagcgccaacctgagaaacagctgcctgttcctgcagagcgacatcagcatcgccctggaccccctgtaccccagcagatgcagctgggagaccttcggctacgccaccagcatcagcatggcccaggccagcgacggcctgagccccctgcagctgagcggccagctgaacagcctgccctgcagcctgaccttcagacaggaggagaccatcagcatcatcagactgatcgagcaggccagacacgccacctacggcatcagaaagtgcttcctgttcctgctgcagtgccagctgaccctggtggtgatccagttcctgagctgcctggtgcagctgccccccctgctgagcaccaccgacatcctgtggctgagctgcttctgctaccccctgctgagcatcagcctgctgggcaagcccccccacagcagcatcatgagcatggccaccggcaagaacctgcagagcatccccaagaagacccagcactacttcctgctgtgcttcctgctgaagttcagcctgaccatcagcagctgcctgatctgcttcggcttcaccctgcagagcttctgcgacagcagcagagacagaaacctgaccaactgcagcagcgtgatgctgcccagcaacgacgacagagcccccgcctggttcgaggacttcgccaacggcctgctgagcgcccagaagctgaccgccgccctgatcgtgctgcacaccgtgttcatcagcatcacccacgtgcacagaaccaagcccctgtggagaaagagccccctgaccaacctgtggtgggccgtgaccgtgcccgtggtgctgctgggccaggtggtgcagaccgccgtggacctgcagctgtggacccacagagacagccacgtgcacttcggcctggaggacgtgcccctgctgacctggctgctgggctgcctgagcctggtgctggtggtggtgaccaacgagatcgtgaagctgcacgagatcagagtgagagtgagataccagaagagacagaagctgcagttcgagaccaagctgggcatgaacagccccttctag

SEQ ID NO: 21159 - DNA, 2004 bp, Artificial Sequence
  Description of Artificial Sequence: Synthetic coding sequence
atgtggctgcagcagagactgaagggcctgcccggcctgctgagcagcagctgggccagaagactgctgtgcctgctgggcctgctgctgctgctgctgtggttcggcggcagcggcgccagaagagccgccggcggcctgcacctgctgccctggagcagaggcgagcccggcgccgccgagcccagcgcctgcctggaggccgccaccagagcctggagaggcctgagagagagaggcgaggtggtgcccctgggccccggcgtgcccgccctggtggccaacggcttcctggccctggacgtggccgccaacagactgtgggtgacccccggcgagagagagcccgccgtggcccccgacttcgtgcccttcgtgcagctgagacccctgagcgccctggccgaggccggcgaggccgtgctgctgctgagagagggcctgctgagaagagtgagatgcctgcagctgggcagccccggccccggccccgtggccgccggccccggccccgccagcgtgagcggcctggccgccggcagcggcagagactgcgtgctgctgcaggaggacttcctggcccacagaggcagaccccacgtgtacctgcagagaatccagctgaacaaccccaccgagagagtggccgccctgcagaccgtgggccccaccgccggccccgcccccaaggccttcaccagcaccctggagaaggtgggcgaccaccagttcctgctgtacagcggcagaagcccccccacccccaccggcctggtgcacctggtggtggtggccgccaagaagctggtgaacagactgcaggtggcccccaagacccagctggacgagaccgtgctgtgggtggtgcacgtgagcggccccatcaacccccaggtgctgaagagcaaggccgccaaggagctgaaggccctgcaggacctggccagaaaggagatgctggagctgctggacatgcccgccgccgagctgctgcaggaccaccagctgctgtgggcccagctgttcagccccggcgtggagatgaagaagatcaccgacacccacacccccagcggcctgaccgtgaacctgaccctgtactacatgctgagctgcagccccgcccccctgctgagccccagcctgagccacagagagagagaccagatggagagcaccctgaactacgaggaccactgcttcagcggccacgccaccatgcacgccgagaacctgtggcccggcagactgagcagcgtgcagcagatcctgcagctgagcgacctgtggagactgaccctgcagaagagaggctgcaagggcctggtgaaggtgggcgcccccggcatcctgcagggcatggtgctgagcttcggcggcctgcagttcaccgagaaccacctgcagttccaggccgaccccgacgtgctgcacaacagctacgccctgcacggcatcagatacaagaacgaccacatcaacctggccgtgctggccgacgccgagggcaagccctacctgcacgtgagcgtggagagcagaggccagcccgtgaagatctacgcctgcaaggccggctgcctggacgagcccgtggagctgaccagcgcccccaccggccacaccttcagcgtgatggtgacccagcccatcacccccctgctgtacatcagcaccgacctgacccacctgcaggacctgagacacaccctgcacctgaaggccatcctggcccacgacgagcacatggcccagcaggaccccggcctgcccttcctgttctggttcagcgtggccagcctgatcaccctgttccacctgttcctgttcaagctgatctacaacgagtactgcggccccggcgccaagcccctgttcagaagcaaggtgggcagcagacacctggtggagaccagaggcctgggcctggccctgagccccgtgagcagaaagggcctggcctggagaggcggcgtgagacccggccaggagtgggtgagctag

SEQ ID NO: 21160 - DNA, 483 bp, Artificial Sequence
  Description of Artificial Sequence: Synthetic coding sequence
ttcctgcccgacaacttcagccccgccaagcccaagcccagcaaggacctgaagcccctgctgggcagcgccgtgctgggcctgctgctggtgctggccgccgtggtggcctggtgctactacagcgtgagcctgagaaaggccgagagactgagagccgagctgctggacctgaaggccggcggcttcagcatcagaaaccagaagggcgagcaggagccccagcccttcgtgaccagcgacgtgtacagcagcgacgccgccttcggcggcatcctggagagatactggctgagcagcagagccgccgccatcaaggtgaacgacagcgtgcccttccacctgggctggaacagcaccgagagaagcctgagactgcaggccagataccacgacaccccctacaagccccccgccggcagagccgccgcccccgagctgagctacagagtgtgcgtgggcagcgacgtgaccagcatctag

SEQ ID NO: 21161 - DNA, 3261 bp, Artificial Sequence
  Description of Artificial Sequence: Synthetic coding sequence
atgatcgccgtgagcaccgccaacggctacatcctgttcttccacatcaccagcaccagaggcgacaagtacctgtacgagcccgtgtaccccaagggcagcccccagatgaagggcaccccccacttcaaggaggagcagtgcgcccccgccctgaacctggagatgagaaagatcctggacctgcaggcccccatcatgagcctgcagagcgtgctggaggacctgctggtggccaccagcgacggcctgctgcacctgatccactgggagggcatgaccaacggcagaaaggccatcaacctgtgcaccgtgcccttcagcgtggacctgcagagcagcagagtgggcagcttcctgggcttcaccgacgtgcacatcagagacatggagtactgcgccaccctggacggcttcgccgtggtgttcaacgacggcaaggtgggcttcatcacccccgtgagcagcagattcaccgccgagcagctgcacggcgtgtggccccaggacgtggtggacggcacctgcgtggccgtgaacaacaagtacagactgatggccttcggctgcgtgagcggcagcgtgcaggtgtacaccatcgacaacagcaccggcgccatgctgctgagccacaagctggagctgaccgccaagcagtaccccgacatctggaacaagaccggcgccgtgaagctgatgagatggagccccgacaacagcgtggtgatcgtgacctgggagtacggcggcctgagcctgtggagcgtgttcggcgcccagctgatctgcaccctgggcggcgacttcgcctacagaagcgacggcaccaagaaggaccccctgaagatcaacagcatgagctggggcgccgagggctaccacctgtgggtgatcagcggcttcggcagccagaacaccgagatcgagagcgacctgagaagcgtggtgaagcagcccagcatcctgctgttccagttcatcaagagcgtgctgaccgtgaacccctgcatgagcaaccaggagcaggtgctgctgcagggcgaggacagactgtacctgaactgcggcgaggccagccagacccagaaccccagaagcagcagcacccacagcgagcacaagcccagcagagagaagagccccttcgccgacggcggcctggagagccagggcctgagcaccctgctgggccacagacactggcacgtggtgcagatcagcagcacctacctggagagcaactggcccatcagattcagcgccatcgacaagctgggccagaacatcgccgtggtgggcaagttcggcttcgcccactacagcctgctgaccaagaagtggaagctgttcggcaacatcacccaggagcagaacatgatcgtgaccggcggcctggcctggtggaacgacttcatggtgctggcctgctacaacatcaacgacagacaggaggagctgagagtgtacctgagaaccagcaacctggacaacgccttcgcccacgtgaccaaggcccaggccgagaccctgctgctgagcgtgttccaggacatggtgatcgtgttcagagccgactgcagcatctgcctgtacagcatcgagagaaagagcgacggccccaacaccaccgccggcatccaggtgctgcaggaggtgagcatgagcagatacatcccccaccccttcctggtggtgagcgtgaccctgaccagcgtgagcaccgagaacggcatcaccctgaagatgccccagcaggccagaggcgccgagagcatcatgctgaacctggccggccagctgatcatgatgcagagagacagaagcggcccccagatcagagagaaggacagcaaccccaacaaccagagaaagctgctgcccttctgcccccccgtggtgctggcccagagcgtggagaacgtgtggaccacctgcagagccaacaagcagaagagacacctgctggaggccctgtggctgagctgcggcggcgccggcatgaaggtgtggctgcccctgttccccagagaccacagaaagccccacagcttcctgagccagagaatcatgctgcccttccacatcaacatctaccccctggccgtgctgttcgaggacgccctggtgctgggcgccgtgaacgacaccctgctgtacgacagcctgtacaccagaaacaacgccagagagcagctggaggtgctgttccccttctgcgtggtggagagaaccagccagatctacctgcaccacatcctgagacagctgctggtgagaaacctgggcgagcaggccctgctgctggcccagagctgcgccaccctgccctacttcccccacgtgctggagctgatgctgcacgaggtgctggaggaggaggccaccagcagagagcccatccccgaccccctgctgcccaccgtggccaagttcatcaccgagttccccctgttcctgcagaccgtggtgcactgcgccagaaagaccgagtacgccctgtggaactacctgttcgccgccgtgggcaaccccaaggacctgttcgaggagtgcctgatggcccaggacctggacaccgccgccagctacctgatcatcctgcagaacatggaggtgcccgccgtgagcagacagcacgccaccctgctgttcaacaccgccctggagcagggcaagtgggacctgtgcagacacatgatcagattcctgaaggccatcggcagcggcgagagcgagaccccccccagcacccccaccgcccaggagcccagcagcagcggcggcttcgagttcttcagaaacagaagcatcagcctgagccagagcgccgagaacgtgcccgccagcaagttcagcctgcagaagaccctgagcatgcccagcggccccagcggcaagagatggagcaaggacagcgactgcgccgagaacatgtacatcgacatgatgctgtggagacacgccagaagactgctggaggacgtgagactgaaggacctgggctgcttcgccgcccagctgggcttcgagctgatcagctggctgtgcaaggagagaaccagagccgccagagtggacaacttcgtgatcgccctgaagagactgcacaaggacttcctgtggcccctgcccatcatccccgccagcagcatcagcagccccttcaagaacggcaagtacagaaccggcaacgtggacttcatgagcctggtgcagggcgagctgtacttcaccccctgcatctacaccttctgctactag

SEQ ID NO: 21162 - DNA, 1335 bp, Artificial Sequence
  Description of Artificial Sequence: Synthetic coding sequence
atggcccccagcagcagatgggacgccatgggccccaagaacagctacagaagcgtgcacggcagaatcgtgcccgagctgctggagagcagcgtggccagagtgagacccctgcagtacgtgcagagacagcccagccaggccagcgccagaagcggcgccaaccccacccacagacccagcgccgaggtgagacccgtgatcagaaccggcgagatgacccacagcagcgtgatcccccccctggcccccggcgtgagaagagtgagcctgggctacgagagcagccccagcggcagcctgccccccctgttcaaccaggagagcccctggagaagacaggacagctacagcccccagaaccccgccgtgagccacaaggccagcctgaacagcaccatcctgcagggccccgccgacgccggcgtggtgggcggccagagctggaacagagcctgggagcccgccagaggcgccgccagctgggacacctggagaaacaaggccgtggtgccccccagaagaagcggcgagcccatggtgagcatgcaggccgccgaggagatcagaatcctggccgtgatcaccatccaggccggcgtgagaggctacctggccagaagaagaatcagactgtggcacagaggcgccatggtgatccaggccacctggagaggctacagagtgagaagaaacctggcccacctgtgcagagccaccaccaccatccagagcgcctggagaggctacagcaccagaagagaccaggccagacactggcagatgctgcaccccgtgacctgggtggagctgggcagcagagccggcgtgatgagcgacagaagctggttccaggacggcagagccagaaccgtgagcgaccacagatgcttccagagctgccaggcccacgcctgcagcgtgtgccacagcctgagcagcagaatcggcagcccccccagcgtggtgatgctggtgggcagcagccccagaacctgccacacctgcggcagaacccagcccaccagagtggtgcagggcatgggccagggcaccgagggccccggcgccgtgagctgggccagcgcctaccagctggccgccctgagccccagacagccccacagacaggacaaggccgccaccgccatccagagcgcctggagaggcttcaagatcagacagcagatgagacagcagcagatggccgccaagatcgtgcaggccacctggagaggccaccacaccagaagctgcctgaagaacaccgaggccctgctgggccccgccgaccccagcgccagcagcagacacatgcactggcccggcatctag

SEQ ID NO: 21163 - DNA, 4104 bp, Artificial Sequence
  Description of Artificial Sequence: Synthetic coding sequence
atgaccctgcagggcagagccgacctgagcggcaaccagggcaacgccgccggcagactggccaccgtgcacgagcccgtggtgacccagtgggccgtgcacccccccgcccccgcccaccccagcctgctggacaagatggagaaggcccccccccagccccagcacgagggcctgaagagcaaggagcacctgccccagcagcccgccgagggcaagaccgccagcagaagagtgcccagactgagagccgtggtggagagccaggccttcaagaacatcctggtggacgagatggacatgatgcacgccagagccgccaccctgatccaggccaactggagaggctactggctgagacagaagctgatcagccagatgatggccgccaaggccatccaggaggcctggagaagattcaacaagagacacatcctgcacagcagcaagagcctggtgaagaagaccagagccgaggagggcgacatcccctaccacgccccccagcaggtgagattccagcaccccgaggagaacagactgctgagcccccccatcatggtgaacaaggagacccagttccccagctgcgacaacctggtgctgtgcagaccccagagcagccccctgctgcagccccccgccgcccagggcacccccgagccctgcgtgcagggcccccacgccgccagagtgagaggcctggccttcctgccccaccagaccgtgaccatcagattcccctgccccgtgagcctggacgccaagtgccagccctgcctgctgaccagaaccatcagaagcacctgcctggtgcacatcgagggcgacagcgtgaagaccaagagagtgagcgccagaaccaacaaggccagagcccccgagacccccctgagcagaagatacgaccaggccgtgaccagacccagcagagcccagacccagggccccgtgaaggccgagacccccaaggcccccttccagatctgccccggccccatgatcaccaagaccctgctgcagacctaccccgtggtgagcgtgaccctgccccagacctaccccgccagcaccatgaccaccaccccccccaagaccagccccgtgcccaaggtgaccatcatcaagacccccgcccagatgtaccccggccccaccgtgaccaagaccgccccccacacctgccccatgcccaccatgaccaagatccaggtgcaccccaccgccagcagaaccggcacccccagacagacctgccccgccaccatcaccgccaagaacagaccccaggtgagcctgctggccagcatcatgaagagcctgccccaggtgtgccccggccccgccatggccaagacccccccccagatgcaccccgtgaccacccccgccaagaaccccctgcagacctgcctgagcgccaccatgagcaagaccagcagccagagaagccccgtgggcgtgaccaagcccagcccccagaccagactgcccgccatgatcaccaagacccccgcccagctgagaagcgtggccaccatcctgaagaccctgtgcctggccagccccaccgtggccaacgtgaaggcccccccccaggtggccgtggccgccggcacccccaacaccagcggcagcatccacgagaacccccccaaggccaaggccaccgtgaacgtgaagcaggccgccaaggtggtgaaggccagcagccccagctacctggccgagggcaagatcagatgcctggcccagccccaccccggcaccggcgtgcccagagccgccgccgagctgcccctggaggccgagaagatcaagaccggcacccagaagcaggccaagaccgacatggccttcaagaccagcgtggccgtggagatggccggcgcccccagctggaccaaggtggccgaggagggcgacaagcccccccacgtgtacgtgcccgtggacatggccgtgaccctgcccagaggccagctggccgcccccctgaccaacgccagcagccagagacaccccccctgcctgagccagagacccctggccgcccccctgaccaaggccagcagccagggccacctgcccaccgagctgaccaagacccccagcctggcccacctggacacctgcctgagcaagatgcacagccagacccacctggccaccggcgccgtgaaggtgcagagccaggcccccctggccacctgcctgaccaagacccagagcagaggccagcccatcaccgacatcaccacctgcctgatccccgcccaccaggccgccgacctgagcagcaacacccacagccaggtgctgctgaccggcagcaaggtgagcaaccacgcctgccagagactgggcggcctgagcgcccccccctgggccaagcccgaggacagacagacccagccccagccccacggccacgtgcccggcaagaccacccagggcggcccctgccccgccgcctgcgaggtgcagggcatgctggtgccccccatggcccccaccggccacagcacctgcaacgtggagagctggggcgacaacggcgccaccagagcccagcccagcatgcccggccaggccgtgccctgccaggaggacaccgtgggcagcctgctggccagcctgtgcgccgaggtggccggcgtgctggccagccaggaggacctgagaaccctgctggccaaggccctgagccagggcgaggtgtgggccgccctgaaccaggccctgagcaaggaggtgctgggcgccaccgtgaccaaggccctgccccagagcatgctgagcatggccctggtgaaggccctgagctggagcgagctgagactgaccctgagcagagccctgagcagaggcgagctgagagccgagctgaccaaggtgatgcagggcaagctggccgaggtgctgagcaaggccctgaccgaggaggagtgggtggccctgagccaggccctgtgccagggcgagctgggcgccctgctgagccagagctggtgcagagtggccctgagaaccggcaccatcctgcccaaggccgccagcaagagcaccggcagcggcgtgaccaagacccccgccctggtgaaggtggcctgcagaagaagccccagcgccgcctggggccccagcctgggccccgtgagaccccagaccagcaagggccccgccgacgccggcgtggtgggcggccagagctggaacagagcctgggagcccgccagaggcgccgccagctgggacacctggagaaacaaggccgtggtgccccccagaagaagcggcgagcccatggtgagcatgcaggccgccgaggagatcagaatcctggccgtgatcaccatccaggccggcgtgagaggctacctggccagaagaagaatcagactgtggcacagaggcgccatggtgatccaggccacctggagaggctacagagtgagaagaaacctggcccacctgtgcagagccaccaccaccatccagagcgcctggagaggctacagcaccagaagagaccaggccagacactggcagatgctgcaccccgtgacctgggtggagctgggcagcagagccggcgtgatgagcgacagaagctggttccaggacggcagagccagaaccgtgagcgaccacagatgcttccagagctgccaggcccacgcctgcagcgtgtgccacagcctgagcagcagaatcggcagcccccccagcgtggtgatgctggtgggcagcagccccagaacctgccacacctgcggcagaacccagcccaccagagtggtgcagggcatgggccagggcaccgagggccccggcgccgtgagctgggccagcgcctaccagctggccgccctgagccccagacagccccacagacaggacaaggccgccaccgccatccagagcgcctggagaggcttcaagatcagacagcagatgagacagcagcagatggccgccaagatcgtgcaggccacctggagaggccaccacaccagaagctgcctgaagaacaccgaggccctgctgggccccgccgaccccagcgccagcagcagacacatgcactggcccggcatctag

SEQ ID NO: 21164 - DNA, 4833 bp, Artificial Sequence
  Description of Artificial Sequence: Synthetic coding sequence
atggccggcctgagaagaccccagcccggctgctactgcagaaccgccgccgccgtgaacctgctgctgggcgtgttccaggtgctgctgccctgctgcagacccggcggcgcccagggccaggccatcgagcccctgcccaacgtggtggagctgtggcaggccgaggagggcgagctgctgctgcccacccagggcgacagcgaggagggcctggaggagcccagccaggagcagagcttcagcgacaagctgttcagcggcaagggcctgcacttccagcccagcgtgctggacttcggcatccagttcctgggccaccccgtggccaagatcctgcacgcctacaaccccagcagagacagcgaggtggtggtgaacagcgtgttcgccgccgccggccacttccacgtgccccccgtgccctgcagagtgatccccgccatgggcaagaccagcttcagaatcatcttcctgcccaccgaggagggcagcatcgagagcagcctgttcatcaacaccagcagctacggcgtgctgagctaccacgtgagcggcatcggcaccagaagaatcagcaccgagggcagcgccaagcagctgcccaacgcctacttcctgctgcccaaggtgcagagcatccagctgagccagatgcaggccgagaccaccaacaccagcctgctgcaggtgcagctggagtgcagcctgcacaacaaggtgtgccagcagctgaagggctgctacctggagagcgacgacgtgctgagactgcagatgagcatcatggtgaccatggagaacttcagcaaggagttcgaggagaacacccagcacctgctggaccacctgagcatcgtgtacgtggccaccgacgagagcgagaccagcgacgacagcgccgtgaacatgtacatcctgcacagcggcaacagcctgatctggatccaggacatcagacacttcagccagagagacgccctgagcctgcagttcgagcccgtgctgctgcccaccagcaccaccaacttcaccaagatcgccagcttcacctgcaaggccgccaccagctgcgacagcggcatcatcgaggacgtgaagaagaccacccacacccccaccctgaaggcctgcctgttcagcagcgtggcccagggctacttcagaatggacagcagcgccacccagttccacatcgagacccacgagaacaccagcggcctgtggagcatctggtacagaaaccacttcgacagaagcgtggtgctgaacgacgtgttcctgagcaaggagaccaagcacatgctgaagatcctgaacttcaccggccccctgttcctgccccccggctgctggaacatcttcagcctgaagctggccgtgaaggacatcgccatcaacctgttcaccaacgtgttcctgaccaccaacatcggcgccatcttcgccatccccctgcagatctacagcgcccccaccaaggagggcagcctgggcttcgaggtgatcgcccactgcggcatgcactacttcatgggcaagagcaaggccggcaaccccaactggaacggcagcctgagcctggaccagagcacctggaacgtggacagcgagctggccaacaagctgtacgagagatggaagaagtacaagaacggcgacgtgtgcaagagaaacgtgctgggcaccaccagattcgcccacctgaagaagagcaaggagagcgagagcttcgtgttcttcctgcccagactgatcgccgagcccggcctgatgctgaacttcagcgccaccgccctgagaagcagaatgatcaagtacttcgtggtgcagaaccccagcagctggcccgtgagcctgcagctgctgcccctgagcctgtaccccaagcccgaggccctggtgcacctgctgcacagatggttcggcaccgacatgcagatgatcaacttcaccaccggcgagttccagctgaccgaggcctgcccctacctgggcacccacagcgaggagagcagattcggcatcctgcacctgcacctgcagcccctggagatgaagagagtgggcgtggtgttcacccccgccgactacggcaaggtgaccagcctgatcctgatcagaaacaacctgaccgtgatcgacatgatcggcgtggagggcttcggcgccagagagctgctgaaggtgggcggcagactgcccggcgccggcggcagcctgagattcaaggtgcccgagagcaccctgatggactgcagaagacagctgaaggacagcaagcagatcctgagcatcaccaagaacttcaaggtggagaacatcggccccctgcccatcaccgtgagcagcctgaagatcaacggctacaactgccagggctacggcttcgaggtgctggactgccaccagttcagcctggaccccaacaccagcagagacatcagcatcgtgttcacccccgacttcaccagcagctgggtgatcagagacctgagcctggtgaccgccgccgacctggagttcagattcaccctgaacgtgaccctgccccaccacctgctgcccctgtgcgccgacgtggtgcccggccccagctgggaggagagcttctggagactgaccgtgttcttcgtgagcctgagcctgctgggcgtgatcctgatcgccttccagcaggcccagtacatcctgatggagttcatgaagaccagacagagacagaacgccagcagcagcagccagcagaacaacggccccatggacgtgatcagcccccacagctacaagagcaactgcaagaacttcctggacacctacggccccagcgacaagggcagaggcaagaactgcctgcccgtgaacaccccccagagcagaatccagaacgccgccaagagaagccccgccacctacggccacagccagaagaagcacaagtgcagcgtgtactacagcaagcacaagaccagcaccgccgccgccagcagcaccagcaccaccaccgaggagaagcagaccagccccctgggcagcagcctgcccgccgccaaggaggacatctgcaccgacgccatgagagagaactggatcagcctgagatacgccagcggcatcaacgtgaacctgcagaagaacctgaccctgcccaagaacctgctgaacaaggaggagaacaccctgaagaacaccatcgtgttcagcaaccccagcagcgagtgcagcatgaaggagggcatccagacctgcatgttccccaaggagaccgacatcaagaccagcgagaacaccgccgagttcaaggagagagagctgtgccccctgaagaccagcaagaagctgcccgagaaccacctgcccagaaacagcccccagtaccaccagcccgacctgcccgagatcagcagaaagaacaacggcaacaaccagcaggtgcccgtgaagaacgaggtggaccactgcgagaacctgaagaaggtggacaccaagcccagcagcgagaagaagatccacaagaccagcagagaggacatgttcagcgagaagcaggacatccccttcgtggagcaggaggacccctacagaaagaagaagctgcaggagaagagagagggcaacctgcagaacctgaactggagcaagagcagaacctgcagaaagaacaagaagagaggcgtggcccccgtgagcagaccccccgagcagagcgacctgaagctggtgtgcagcgacttcgagagaagcgagctgagcagcgacatcaacgtgagaagctggtgcatccaggagagcaccagagaggtgtgcaaggccgacgccgagatcgccagcagcctgcccgccgcccagagagaggccgagggctactaccagaagcccgagaagaagtgcgtggacaagttctgcagcgacagcagcagcgactgcggcagcagcagcggcagcgtgagagccagcagaggcagctggggcagctggagcagcaccagcagcagcgacggcgacaagaagcccatggtggacgcccagcacttcctgcccgccggcgacagcgtgagccagaacgacttccccagcgaggcccccatcagcctgaacctgagccacaacatctgcaaccccatgaccgtgaacagcctgccccagtacgccgagcccagctgccccagcctgcccgccggccccaccggcgtggaggaggacaagggcctgtacagccccggcgacctgtggcccaccccccccgtgtgcgtgaccagcagcctgaactgcaccctggagaacggcgtgccctgcgtgatccaggagagcgcccccgtgcacaacagcttcatcgactggagcgccacctgcgagggccagttcagcagcgcctactgccccctggagctgaacgactacaacgccttccccgaggagaacatgaactacgccaacggcttcccctgccccgccgacgtgcagaccgacttcatcgaccacaacagccagagcacctggaacaccccccccaacatgcccgccgcctggggccacgccagcttcatcagcagccccccctacctgaccagcaccagaagcctgagccccatgagcggcctgttcggcagcatctgggccccccagagcgacgtgtacgagaactgctgccccatcaaccccaccaccgagcacagcacccacatggagaaccaggccgtggtgtgcaaggagtactaccccggcttcaaccccttcagagcctacatgaacctggacatctggaccaccaccgccaacagaaacgccaacttccccctgagcagagacagcagctactgcggcaacgtgtag

SEQ ID NO: 21165 - DNA, 2385 bp, Artificial Sequence
  Description of Artificial Sequence: Synthetic coding sequence
atgaccctgcagggcagagccgacctgagcggcaaccagggcaacgccgccggcagactggccaccgtgcacgagcccgtggtgacccagtgggccgtgcacccccccgcccccgcccaccccagcctgctggacaagatggagaaggcccccccccagccccagcacgagggcctgaagagcaaggagcacctgccccagcagcccgccgagggcaagaccgccagcagaagagtgcccagactgagagccgtggtggagagccaggccttcaagaacatcctggtggacgagatggacatgatgcacgccagagccgccaccctgatccaggccaactggagaggctactggctgagacagaagctgatcagccagatgatggccgccaaggccatccaggaggcctggagaagattcaacaagagacacatcctgcacagcagcaagagcctggtgaagaagaccagagccgaggagggcgacatcccctaccacgccccccagcaggtgagattccagcaccccgaggagaacagactgctgagcccccccatcatggtgaacaaggagacccagttccccagctgcgacaacctggtgctgtgcagaccccagagcagccccctgctgcagccccccgccgcccagggcacccccgagccctgcgtgcagggcccccacgccgccagagtgagaggcctggccttcctgccccaccagaccgtgaccatcagattcccctgccccgtgagcctggacgccaagtgccagccctgcctgctgaccagaaccatcagaagcacctgcctggtgcacatcgagggcgacagcgtgaagaccaacgccagcagccagagacaccccccctgcctgagccagagacccctggccgcccccctgaccaaggccagcagccagggccacctgcccaccgagctgaccaagacccccagcctggcccacctggacacctgcctgagcaagatgcacagccagacccacctggccaccggcgccgtgaaggtgcagagccaggcccccctggccacctgcctgaccaagacccagagcagaggccagcccatcaccgacatcaccacctgcctgatccccgcccaccaggccgccgacctgagcagcaacacccacagccaggtgctgctgaccggcagcaaggtgagcaaccacgcctgccagagactgggcggcctgagcgcccccccctgggccaagcccgaggacagacagacccagccccagccccacggccacgtgcccggcaagaccacccagggcggcccctgccccgccgcctgcgaggtgcagggcatgctggtgccccccatggcccccaccggccacagcacctgcaacgtggagagctggggcgacaacggcgccaccagagcccagcccagcatgcccggccaggccgtgccctgccaggaggacaccggccccgccgacgccggcgtggtgggcggccagagctggaacagagcctgggagcccgccagaggcgccgccagctgggacacctggagaaacaaggccgtggtgccccccagaagaagcggcgagcccatggtgagcatgcaggccgccgaggagatcagaatcctggccgtgatcaccatccaggccggcgtgagaggctacctggccagaagaagaatcagactgtggcacagaggcgccatggtgatccaggccacctggagaggctacagagtgagaagaaacctggcccacctgtgcagagccaccaccaccatccagagcgcctggagaggctacagcaccagaagagaccaggccagacactggcagatgctgcaccccgtgacctgggtggagctgggcagcagagccggcgtgatgagcgacagaagctggttccaggacggcagagccagaaccgtgagcgaccacagatgcttccagagctgccaggcccacgcctgcagcgtgtgccacagcctgagcagcagaatcggcagcccccccagcgtggtgatgctggtgggcagcagccccagaacctgccacacctgcggcagaacccagcccaccagagtggtgcagggcatgggccagggcaccgagggccccggcgccgtgagctgggccagcgcctaccagctggccgccctgagccccagacagccccacagacaggacaaggccgccaccgccatccagagcgcctggagaggcttcaagatcagacagcagatgagacagcagcagatggccgccaagatcgtgcaggccacctggagaggccaccacaccagaagctgcctgaagaacaccgaggccctgctgggccccgccgaccccagcgccagcagcagacacatgcactggcccggcatctag

SEQ ID NO: 21166 - DNA, 4272 bp, Artificial Sequence
  Description of Artificial Sequence: Synthetic coding sequence
atgtacttcctgagcggctggcccaagagactgctgtgccccctgggcagccccgccgaggcccccttccacgtgcagagcgacccccagagagccttcttcgccgtgctggccgccgccagactgagcatctggtacagcagacccagcgtgctgatcgtgacctacaaggagcccgccaagagcagcacccagttcggcagctacaagcaggccgagtggagacccgacagcaccatgatcgccgtgagcaccgccaacggctacatcctgttcttccacatcaccagcaccagaggcgacaagtacctgtacgagcccgtgtaccccaagggcagcccccagatgaagggcaccccccacttcaaggaggagcagtgcgcccccgccctgaacctggagatgagaaagatcctggacctgcaggcccccatcatgagcctgcagagcgtgctggaggacctgctggtggccaccagcgacggcctgctgcacctgatccactgggagggcatgaccaacggcagaaaggccatcaacctgtgcaccgtgcccttcagcgtggacctgcagagcagcagagtgggcagcttcctgggcttcaccgacgtgcacatcagagacatggagtactgcgccaccctggacggcttcgccgtggtgttcaacgacggcaaggtgggcttcatcacccccgtgagcagcagattcaccgccgagcagctgcacggcgtgtggccccaggacgtggtggacggcacctgcgtggccgtgaacaacaagtacagactgatggccttcggctgcgtgagcggcagcgtgcaggtgtacaccatcgacaacagcaccggcgccatgctgctgagccacaagctggagctgaccgccaagcagtaccccgacatctggaacaagaccggcgccgtgaagctgatgagatggagccccgacaacagcgtggtgatcgtgacctgggagtacggcggcctgagcctgtggagcgtgttcggcgcccagctgatctgcaccctgggcggcgacttcgcctacagaagcgacggcaccaagaaggaccccctgaagatcaacagcatgagctggggcgccgagggctaccacctgtgggtgatcagcggcttcggcagccagaacaccgagatcgagagcgacctgagaagcgtggtgaagcagcccagcatcctgctgttccagttcatcaagagcgtgctgaccgtgaacccctgcatgagcaaccaggagcaggtgctgctgcagggcgaggacagactgtacctgaactgcggcgaggccagccagacccagaaccccagaagcagcagcacccacagcgagcacaagcccagcagagagaagagccccttcgccgacggcggcctggagagccagggcctgagcaccctgctgggccacagacactggcacgtggtgcagatcagcagcacctacctggagagcaactggcccatcagattcagcgccatcgacaagctgggccagaacatcgccgtggtgggcaagttcggcttcgcccactacagcctgctgaccaagaagtggaagctgttcggcaacatcacccaggagcagaacatgatcgtgaccggcggcctggcctggtggaacgacttcatggtgctggcctgctacaacatcaacgacagacaggaggagctgagagtgtacctgagaaccagcaacctggacaacgccttcgcccacgtgaccaaggcccaggccgagaccctgctgctgagcgtgttccaggacatggtgatcgtgttcagagccgactgcagcatctgcctgtacagcatcgagagaaagagcgacggccccaacaccaccgccggcatccaggtgctgcaggaggtgagcatgagcagatacatcccccaccccttcctggtggtgagcgtgaccctgaccagcgtgagcaccgagaacggcatcaccctgaagatgccccagcaggccagaggcgccgagagcatcatgctgaacctggccggccagctgatcatgatgcagagagacagaagcggcccccagatcagagagaaggacagcaaccccaacaaccagagaaagctgctgcccttctgcccccccgtggtgctggcccagagcgtggagaacgtgtggaccacctgcagagccaacaagcagaagagacacctgctggaggccctgtggctgagctgcggcggcgccggcatgaaggtgtggctgcccctgttccccagagaccacagaaagccccacagcttcctgagccagagaatcatgctgcccttccacatcaacatctaccccctggccgtgctgttcgaggacgccctggtgctgggcgccgtgaacgacaccctgctgtacgacagcctgtacaccagaaacaacgccagagagcagctggaggtgctgttccccttctgcgtggtggagagaaccagccagatctacctgcaccacatcctgagacagctgctggtgagaaacctgggcgagcaggccctgctgctggcccagagctgcgccaccctgccctacttcccccacgtgctggagctgatgctgcacgaggtgctggaggaggaggccaccagcagagagcccatccccgaccccctgctgcccaccgtggccaagttcatcaccgagttccccctgttcctgcagaccgtggtgcactgcgccagaaagaccgagtacgccctgtggaactacctgttcgccgccgtgggcaaccccaaggacctgttcgaggagtgcctgatggcccaggacctggacaccgccgccagctacctgatcatcctgcagaacatggaggtgcccgccgtgagcagacagcacgccaccctgctgttcaacaccgccctggagcagggcaagtgggacctgtgcagacacatgatcagattcctgaaggccatcggcagcggcgagagcgagaccccccccagcacccccaccgcccaggagcccagcagcagcggcggcttcgagttcttcagaaacagaagcatcagcctgagccagagcgccgagaacgtgcccgccagcaagttcagcctgcagaagaccctgagcatgcccagcggccccagcggcaagagatggagcaaggacagcgactgcgccgagaacatgtacatcgacatgatgctgtggagacacgccagaagactgctggaggacgtgagactgaaggacctgggctgcttcgccgcccagctgggcttcgagctgatcagctggctgtgcaaggagagaaccagagccgccagagtggacaacttcgtgatcgccctgaagagactgcacaaggacttcctgtggcccctgcccatcatccccgccagcagcatcagcagccccttcaagaacggcaagtacagaaccgtgggcgagcagctgctgaagagccagagcgccgaccccttcctgaacctggagatggacgccggcatcagcaacatccagagaagccagagctggctgagcaacatcggccccacccaccacgagatcgacaccgccagcagccacggcccccagatgcaggacgccttcctgagccccctgagcaacaagggcgacgagtgcagcatcggcagcgccaccgacctgaccgagagcagcagcatggtggacggcgactggaccatggtggacgagaacttcagcaccctgagcctgacccagagcgagctggagcacatcagcatggagctggccagcaagggcccccacaagagccaggtgcagctgagatacctgctgcacatcttcatggaggccggctgcctggactggtgcatcgtgatcggcctgatcctgagagagagcagcatcatcaaccagatcctggtgatcacccagagcagcgaggtggacggcgagatgctgcagaacatcaagaccggcctgcacgccgtggacagatgggccagcaccgactgccccggctacaagcccttcctgaacatcatcaagccccagctgcagaagctgagcgagatcaccgaggagcaggtgcagcccgacgccttccagcccatcaccatgggcaagacccccgagcagaccagccccagagccgaggagagcagaggcagcagcagccacggcagcatcccccagggcgaggtgggcagcagcaacatggtgagcagaaaggaggaggacaccgcccaggccgaggaggaggagcccttccaggacggcacctacgactgcagcgtgagctag

SEQ ID NO: 21167 - DNA, 4035 bp, Artificial Sequence
  Description of Artificial Sequence: Synthetic coding sequence
atgatcgccgtgagcaccgccaacggctacatcctgttcttccacatcaccagcaccagaggcgacaagtacctgtacgagcccgtgtaccccaagggcagcccccagatgaagggcaccccccacttcaaggaggagcagtgcgcccccgccctgaacctggagatgagaaagatcctggacctgcaggcccccatcatgagcctgcagagcgtgctggaggacctgctggtggccaccagcgacggcctgctgcacctgatccactgggagggcatgaccaacggcagaaaggccatcaacctgtgcaccgtgcccttcagcgtggacctgcagagcagcagagtgggcagcttcctgggcttcaccgacgtgcacatcagagacatggagtactgcgccaccctggacggcttcgccgtggtgttcaacgacggcaaggtgggcttcatcacccccgtgagcagcagattcaccgccgagcagctgcacggcgtgtggccccaggacgtggtggacggcacctgcgtggccgtgaacaacaagtacagactgatggccttcggctgcgtgagcggcagcgtgcaggtgtacaccatcgacaacagcaccggcgccatgctgctgagccacaagctggagctgaccgccaagcagtaccccgacatctggaacaagaccggcgccgtgaagctgatgagatggagccccgacaacagcgtggtgatcgtgacctgggagtacggcggcctgagcctgtggagcgtgttcggcgcccagctgatctgcaccctgggcggcgacttcgcctacagaagcgacggcaccaagaaggaccccctgaagatcaacagcatgagctggggcgccgagggctaccacctgtgggtgatcagcggcttcggcagccagaacaccgagatcgagagcgacctgagaagcgtggtgaagcagcccagcatcctgctgttccagttcatcaagagcgtgctgaccgtgaacccctgcatgagcaaccaggagcaggtgctgctgcagggcgaggacagactgtacctgaactgcggcgaggccagccagacccagaaccccagaagcagcagcacccacagcgagcacaagcccagcagagagaagagccccttcgccgacggcggcctggagagccagggcctgagcaccctgctgggccacagacactggcacgtggtgcagatcagcagcacctacctggagagcaactggcccatcagattcagcgccatcgacaagctgggccagaacatcgccgtggtgggcaagttcggcttcgcccactacagcctgctgaccaagaagtggaagctgttcggcaacatcacccaggagcagaacatgatcgtgaccggcggcctggcctggtggaacgacttcatggtgctggcctgctacaacatcaacgacagacaggaggagctgagagtgtacctgagaaccagcaacctggacaacgccttcgcccacgtgaccaaggcccaggccgagaccctgctgctgagcgtgttccaggacatggtgatcgtgttcagagccgactgcagcatctgcctgtacagcatcgagagaaagagcgacggccccaacaccaccgccggcatccaggtgctgcaggaggtgagcatgagcagatacatcccccaccccttcctggtggtgagcgtgaccctgaccagcgtgagcaccgagaacggcatcaccctgaagatgccccagcaggccagaggcgccgagagcatcatgctgaacctggccggccagctgatcatgatgcagagagacagaagcggcccccagatcagagagaaggacagcaaccccaacaaccagagaaagctgctgcccttctgcccccccgtggtgctggcccagagcgtggagaacgtgtggaccacctgcagagccaacaagcagaagagacacctgctggaggccctgtggctgagctgcggcggcgccggcatgaaggtgtggctgcccctgttccccagagaccacagaaagccccacagcttcctgagccagagaatcatgctgcccttccacatcaacatctaccccctggccgtgctgttcgaggacgccctggtgctgggcgccgtgaacgacaccctgctgtacgacagcctgtacaccagaaacaacgccagagagcagctggaggtgctgttccccttctgcgtggtggagagaaccagccagatctacctgcaccacatcctgagacagctgctggtgagaaacctgggcgagcaggccctgctgctggcccagagctgcgccaccctgccctacttcccccacgtgctggagctgatgctgcacgaggtgctggaggaggaggccaccagcagagagcccatccccgaccccctgctgcccaccgtggccaagttcatcaccgagttccccctgttcctgcagaccgtggtgcactgcgccagaaagaccgagtacgccctgtggaactacctgttcgccgccgtgggcaaccccaaggacctgttcgaggagtgcctgatggcccaggacctggacaccgccgccagctacctgatcatcctgcagaacatggaggtgcccgccgtgagcagacagcacgccaccctgctgttcaacaccgccctggagcagggcaagtgggacctgtgcagacacatgatcagattcctgaaggccatcggcagcggcgagagcgagaccccccccagcacccccaccgcccaggagcccagcagcagcggcggcttcgagttcttcagaaacagaagcatcagcctgagccagagcgccgagaacgtgcccgccagcaagttcagcctgcagaagaccctgagcatgcccagcggccccagcggcaagagatggagcaaggacagcgactgcgccgagaacatgtacatcgacatgatgctgtggagacacgccagaagactgctggaggacgtgagactgaaggacctgggctgcttcgccgcccagctgggcttcgagctgatcagctggctgtgcaaggagagaaccagagccgccagagtggacaacttcgtgatcgccctgaagagactgcacaaggacttcctgtggcccctgcccatcatccccgccagcagcatcagcagccccttcaagaacggcaagtacagaaccgtgggcgagcagctgctgaagagccagagcgccgaccccttcctgaacctggagatggacgccggcatcagcaacatccagagaagccagagctggctgagcaacatcggccccacccaccacgagatcgacaccgccagcagccacggcccccagatgcaggacgccttcctgagccccctgagcaacaagggcgacgagtgcagcatcggcagcgccaccgacctgaccgagagcagcagcatggtggacggcgactggaccatggtggacgagaacttcagcaccctgagcctgacccagagcgagctggagcacatcagcatggagctggccagcaagggcccccacaagagccaggtgcagctgagatacctgctgcacatcttcatggaggccggctgcctggactggtgcatcgtgatcggcctgatcctgagagagagcagcatcatcaaccagatcctggtgatcacccagagcagcgaggtggacggcgagatgctgcagaacatcaagaccggcctgcacgccgtggacagatgggccagcaccgactgccccggctacaagcccttcctgaacatcatcaagccccagctgcagaagctgagcgagatcaccgaggagcaggtgcagcccgacgccttccagcccatcaccatgggcaagacccccgagcagaccagccccagagccgaggagagcagaggcagcagcagccacggcagcatcccccagggcgaggtgggcagcagcaacatggtgagcagaaaggaggaggacaccgcccaggccgaggaggaggagcccttccaggacggcacctacgactgcagcgtgagctag

SEQ ID NO: 21168 - DNA, 3081 bp, Artificial Sequence
  Description of Artificial Sequence: Synthetic coding sequence
atggagaagagactgggcgtgaagcccaaccccgccagctggatcctgagcggctactactggcagaccagcgccaagtggctgagaagcctgtacctgttctacacctgcttctgcttcagcgtgctgtggctgagcaccgacgccagcgagagcagatgccagcagggcaagacccagttcggcgtgggcctgagaagcggcggcgagaaccacctgtggctgctggagggcacccccagcctgcagagctgctgggccgcctgctgccaggacagcgcctgccacgtgttctggtggctggagggcatgtgcatccaggccgactgcagcagaccccagagctgcagagccttcagaacccacagcagcaacagcatgctggtgttcctgaagaagttccagaccgccgacgacctgggcttcctgcccgaggacgacgtgccccacctgctgggcctgggctggaactgggccagctggagacagagcccccccagagccgccctgagacccgccgtgagcagcagcgaccagcagagcctgatcagaaagctgcagaagagaggcagccccagcgacgtggtgacccccatcgtgacccagcacagcaaggtgaacgacagcaacgagctgggcggcctgaccaccagcggcagcgccgaggtgcacaaggccatcaccatcagcagccccctgaccaccgacctgaccgccgagctgagcggcggccccaagaacgtgagcgtgcagcccgagatcagcgagggcctggccaccacccccagcacccagcaggtgaagagcagcgagaagacccagatcgccgtgccccagcccgtggcccccagctacagctacgccacccccaccccccaggccagcttccagagcaccagcgccccctaccccgtgatcaaggagctggtggtgagcgccggcgagagcgtgcagatcaccctgcccaagaacgaggtgcagctgaacgcctacgtgctgcaggagccccccaagggcgagacctacacctacgactggcagctgatcacccaccccagagactacagcggcgagatggagggcaagcacagccagatcctgaagctgagcaagctgacccccggcctgtacgagttcaaggtgatcgtggagggccagaacgcccacggcgagggctacgtgaacgtgaccgtgaagcccgagcccagaaagaacagaccccccatcgccatcgtgagcccccagttccaggagatcagcctgcccaccaccagcaccgtgatcgacggcagccagagcaccgacgacgacaagatcgtgcagtaccactgggaggagctgaagggccccctgagagaggagaagatcagcgaggacaccgccatcctgaagctgagcaagctggtgcccggcaactacaccttcagcctgaccgtggtggacagcgacggcgccaccaacagcaccaccgccaacctgaccgtgaacaaggccgtggactacccccccgtggccaacgccggccccaaccaggtgatcaccctgccccagaacagcatcaccctgttcggcaaccagagcaccgacgaccacggcatcaccagctacgagtggagcctgagccccagcagcaagggcaaggtggtggagatgcagggcgtgagaacccccaccctgcagctgagcgccatgcaggagggcgactacacctaccagctgaccgtgaccgacaccatcggccagcaggccaccgcccaggtgaccgtgatcgtgcagcccgagaacaacaagcccccccaggccgacgccggccccgacaaggagctgaccctgcccgtggacagcaccaccctggacggcagcaagagcagcgacgaccagaagatcatcagctacctgtgggagaagacccagggccccgacggcgtgcagctggagaacgccaacagcagcgtggccaccgtgaccggcctgcaggtgggcacctacgtgttcaccctgaccgtgaaggacgagagaaacctgcagagccagagcagcgtgaacgtgatcgtgaaggaggagatcaacaagccccccatcgccaagatcaccggcaacgtggtgatcaccctgcccaccagcaccgccgagctggacggcagcaagagcagcgacgacaagggcatcgtgagctacctgtggaccagagacgagggcagccccgccgccggcgaggtgctgaaccacagcgaccaccaccccatcctgttcctgagcaacctggtggagggcacctacaccttccacctgaaggtgaccgacgccaagggcgagagcgacaccgacagaaccaccgtggaggtgaagcccgaccccagaaagaacaacctggtggagatcatcctggacatcaacgtgagccagctgaccgagagactgaagggcatgttcatcagacagatcggcgtgctgctgggcgtgctggacagcgacatcatcgtgcagaagatccagccctacaccgagcagagcaccaagatggtgttcttcgtgcagaacgagcccccccaccagatcttcaagggccacgaggtggccgccatgctgaagagcgagctgagaaagcagaaggccgacttcctgatcttcagagccctggaggtgaacaccgtgacctgccagctgaactgcagcgaccacggccactgcgacagcttcaccaagagatgcatctgcgaccccttctggatggagaacttcatcaaggtgcagctgagagacggcgacagcaactgcgagtggagcgtgctgtacgtgatcatcgccaccttcgtgatcgtggtggccctgggcatcctgagctggaccgtgatctgctgctgcaagagacagaagggcaagcccaagagaaagagcaagtacaagatcctggacgccaccgaccaggagagcctggagctgaagcccaccagcagagccggcatcaagcagaagggcctgctgctgagcagcagcctgatgcacagcgagagcgagctggacagcgacgacgccatcttcacctggcccgacagagagaagggcaagctgctgcactag

SEQ ID NO: 21169 - DNA, 3405 bp, Artificial Sequence
  Description of Artificial Sequence: Synthetic coding sequence
atggagaaggcccccccccagccccagcacgagggcctgaagagcaaggagcacctgccccagcagcccgccgagggcaagaccgccagcagaagagtgcccagactgagagccgtggtggagagccaggccttcaagaacatcctggtggacgagatggacatgatgcacgccagagccgccaccctgatccaggccaactggagaggctactggctgagacagaagctgatcagccagatgatggccgccaaggccatccaggaggcctggagaagattcaacaagagacacatcctgcacagcagcaagagcctggtgaagaagaccagagccgaggagggcgacatcccctaccacgccccccagcaggtgagattccagcaccccgaggagaacagactgctgagcccccccatcatggtgaacaaggagacccagttccccagctgcgacaacctggtgctgtgcagaccccagagcagccccctgctgcagccccccgccgcccagggcacccccgagccctgcgtgcagggcccccacgccgccagagtgagaggcctggccttcctgccccaccagaccgtgaccatcagattcccctgccccgtgagcctggacgccaagtgccagccctgcctgctgaccagaaccatcagaagcacctgcctggtgcacatcgagggcgacagcgtgaagaccaagagagtgagcgccagaaccaacaaggccagagcccccgagacccccctgagcagaagatacgaccaggccgtgaccagacccagcagagcccagacccagggccccgtgaaggccgagacccccaaggcccccttccagatctgccccggccccatgatcaccaagaccctgctgcagacctaccccgtggtgagcgtgaccctgccccagacctaccccgccagcaccatgaccaccaccccccccaagaccagccccgtgcccaaggtgaccatcatcaagacccccgcccagatgtaccccggccccaccgtgaccaagaccgccccccacacctgccccatgcccaccatgaccaagatccaggtgcaccccaccgccagcagaaccggcacccccagacagacctgccccgccaccatcaccgccaagaacagaccccaggtgagcctgctggccagcatcatgaagagcctgccccaggtgtgccccggccccgccatggccaagacccccccccagatgcaccccgtgaccacccccgccaagaaccccctgcagacctgcctgagcgccaccatgagcaagaccagcagccagagaagccccgtgggcgtgaccaagcccagcccccagaccagactgcccgccatgatcaccaagacccccgcccagctgagaagcgtggccaccatcctgaagaccctgtgcctggccagccccaccgtggccaacgtgaaggcccccccccaggtggccgtggccgccggcacccccaacaccagcggcagcatccacgagaacccccccaaggccaaggccaccgtgaacgtgaagcaggccgccaaggtggtgaaggccagcagccccagctacctggccgagggcaagatcagatgcctggcccagccccaccccggcaccggcgtgcccagagccgccgccgagctgcccctggaggccgagaagatcaagaccggcacccagaagcaggccaagaccgacatggccttcaagaccagcgtggccgtggagatggccggcgcccccagctggaccaaggtggccgaggagggcgacaagcccccccacgtgtacgtgcccgtggacatggccgtgaccctgcccagaggccagctggccgcccccctgaccaacgccagcagccagagacaccccccctgcctgagccagagacccctggccgcccccctgaccaaggccagcagccagggccacctgcccaccgagctgaccaagacccccagcctggcccacctggacacctgcctgagcaagatgcacagccagacccacctggccaccggcgccgtgaaggtgcagagccaggcccccctggccacctgcctgaccaagacccagagcagaggccagcccatcaccgacatcaccacctgcctgatccccgcccaccaggccgccgacctgagcagcaacacccacagccaggtgctgctgaccggcagcaaggtgagcaaccacgcctgccagagactgggcggcctgagcgcccccccctgggccaagcccgaggacagacagacccagccccagccccacggccacgtgcccggcaagaccacccagggcggcccctgccccgccgcctgcgaggtgcagggcatgctggtgccccccatggcccccaccggccacagcacctgcaacgtggagagctggggcgacaacggcgccaccagagcccagcccagcatgcccggccaggccgtgccctgccaggaggacaccggccccgccgacgccggcgtggtgggcggccagagctggaacagagcctgggagcccgccagaggcgccgccagctgggacacctggagaaacaaggccgtggtgccccccagaagaagcggcgagcccatggtgagcatgcaggccgccgaggagatcagaatcctggccgtgatcaccatccaggccggcgtgagaggctacctggccagaagaagaatcagactgtggcacagaggcgccatggtgatccaggccacctggagaggctacagagtgagaagaaacctggcccacctgtgcagagccaccaccaccatccagagcgcctggagaggctacagcaccagaagagaccaggccagacactggcagatgctgcaccccgtgacctgggtggagctgggcagcagagccggcgtgatgagcgacagaagctggttccaggacggcagagccagaaccgtgagcgaccacagatgcttccagagctgccaggcccacgcctgcagcgtgtgccacagcctgagcagcagaatcggcagcccccccagcgtggtgatgctggtgggcagcagccccagaacctgccacacctgcggcagaacccagcccaccagagtggtgcagggcatgggccagggcaccgagggccccggcgccgtgagctgggccagcgcctaccagctggccgccctgagccccagacagccccacagacaggacaaggccgccaccgccatccagagcgcctggagaggcttcaagatcagacagcagatgagacagcagcagatggccgccaagatcgtgcaggccacctggagaggccaccacaccagaagctgcctgaagaacaccgaggccctgctgggccccgccgaccccagcgccagcagcagacacatgcactggcccggcatctag

SEQ ID NO: 21170 - DNA, 2058 bp, Artificial Sequence
  Description of Artificial Sequence: Synthetic coding sequence
atggagaagagactgggcgtgaagcccaaccccgccagctggatcctgagcggctactactggcagaccagcgccaagtggctgagaagcctgtacctgttctacacctgcttctgcttcagcgtgctgtggctgagcaccgacgccagcgagagcagatgccagcagggcaagacccagttcggcgtgggcctgagaagcggcggcgagaaccacctgtggctgctggagggcacccccagcctgcagagctgctgggccgcctgctgccaggacagcgcctgccacgtgttctggtggctggagggcatgtgcatccaggccgactgcagcagaccccagagctgcagagccttcagaacccacagcagcaacagcatgctggtgttcctgaagaagttccagaccgccgacgacctgggcttcctgcccgaggacgacgtgccccacctgctgggcctgggctggaactgggccagctggagacagagcccccccagagccgccctgagacccgccgtgagcagcagcgaccagcagagcctgatcagaaagctgcagaagagaggcagccccagcgacgtggtgacccccatcgtgacccagcacagcaaggtgaacgacagcaacgagctgggcggcctgaccaccagcggcagcgccgaggtgcacaaggccatcaccatcagcagccccctgaccaccgacctgaccgccgagctgagcggcggccccaagaacgtgagcgtgcagcccgagatcagcgagggcctggccaccacccccagcacccagcaggtgaagagcagcgagaagacccagatcgccgtgccccagcccgtggcccccagctacagctacgccacccccaccccccaggccagcttccagagcaccagcgccccctaccccgtgatcaaggagctggtggtgagcgccggcgagagcgtgcagatcaccctgcccaagaacgaggtgcagctgaacgcctacgtgctgcaggagccccccaagggcgagacctacacctacgactggcagctgatcacccaccccagagactacagcggcgagatggagggcaagcacagccagatcctgaagctgagcaagctgacccccggcctgtacgagttcaaggtgatcgtggagggccagaacgcccacggcgagggctacgtgaacgtgaccgtgaagcccgagcccagaaagaacagaccccccatcgccatcgtgagcccccagttccaggagatcagcctgcccaccaccagcaccgtgatcgacggcagccagagcaccgacgacgacaagatcgtgcagtaccactgggaggagctgaagggccccctgagagaggagaagatcagcgaggacaccgccatcctgaagctgagcaagctggtgcccggcaactacaccttcagcctgaccgtggtggacagcgacggcgccaccaacagcaccaccgccaacctgaccgtgaacaaggccgtggactacccccccgtggccaacgccggccccaaccaggtgatcaccctgccccagaacagcatcaccctgttcggcaaccagagcaccgacgaccacggcatcaccagctacgagtggagcctgagccccagcagcaagggcaaggtggtggagatgcagggcgtgagaacccccaccctgcagctgagcgccatgcaggagggcgactacacctaccagctgaccgtgaccgacaccatcggccagcaggccaccgcccaggtgaccgtgatcgtgcagcccgagaacaacaagcccccccaggccgacgccggccccgacaaggagctgaccctgcccgtggacagcaccaccctggacggcagcaagagcagcgacgaccagaagatcatcagctacctgtgggagaagacccagggccccgacggcgtgcagctggagaacgccaacagcagcgtggccaccgtgaccggcctgcaggtgggcacctacgtgttcaccctgaccgtgaaggacgagagaaacctgcagagccagagcagcgtgaacgtgatcgtgtag

SEQ ID NO: 21171 - DNA, 4581 bp, Artificial Sequence
  Description of Artificial Sequence: Synthetic coding sequence
atggccggcctgagaagaccccagcccggctgctactgcagaaccgccgccgccgtgaacctgctgctgggcgtgttccaggtgctgctgccctgctgcagacccggcggcgcccagggccaggccatcgagcccctgcccaacgtggtggagctgtggcaggccgaggagggcgagctgctgctgcccacccagggcgacagcgaggagggcctggaggagcccagccaggagcagagcttcagcgacaagctgttcagcggcaagggcctgcacttccagcccagcgtgctggacttcggcatccagttcctgggccaccccgtggccaagatcctgcacgcctacaaccccagcagagacagcgaggtggtggtgaacagcgtgttcgccgccgccggccacttccacgtgccccccgtgccctgcagagtgatccccgccatgggcaagaccagcttcagaatcatcttcctgcccaccgaggagggcagcatcgagagcagcctgttcatcaacaccagcagctacggcgtgctgagctaccacgtgagcggcatcggcaccagaagaatcagcaccgagggcagcgccaagcagctgcccaacgcctacttcctgctgcccaaggtgcagagcatccagctgagccagatgcaggccgagaccaccaacaccagcctgctgcaggtgcagctggagtgcagcctgcacaacaaggtgtgccagcagctgaagggctgctacctggagagcgacgacgtgctgagactgcagatgagcatcatggtgaccatggagaacttcagcaaggagttcgaggagaacacccagcacctgctggaccacctgagcatcgtgtacgtggccaccgacgagagcgagaccagcgacgacagcgccgtgaacatgtacatcctgcacagcggcaacagcctgatctggatccaggacatcagacacttcagccagagagacgccctgagcctgcagttcgagcccgtgctgctgcccaccagcaccaccaacttcaccaagatcgccagcttcacctgcaaggccgccaccagctgcgacagcggcatcatcgaggacgtgaagaagaccacccacacccccaccctgaaggcctgcctgttcagcagcgtggcccagggctacttcagaatggacagcagcgccacccagttccacatcgagacccacgagaacaccagcggcctgtggagcatctggtacagaaaccacttcgacagaagcgtggtgctgaacgacgtgttcctgagcaaggagaccaagcacatgctgaagatcctgaacttcaccggccccctgttcctgccccccggctgctggaacatcttcagcctgaagctggccgtgaaggacatcgccatcaacctgttcaccaacgtgttcctgaccaccaacatcggcgccatcttcgccatccccctgcagatctacagcgcccccaccaaggagggcagcctgggcttcgaggtgatcgcccactgcggcatgcactacttcatgggcaagagcaaggccggcaaccccaactggaacggcagcctgagcctggaccagagcacctggaacgtggacagcgagctggccaacaagctgtacgagagatggaagaagtacaagaacggcgacgtgtgcaagttcggcaccgacatgcagatgatcaacttcaccaccggcgagttccagctgaccgaggcctgcccctacctgggcacccacagcgaggagagcagattcggcatcctgcacctgcacctgcagcccctggagatgaagagagtgggcgtggtgttcacccccgccgactacggcaaggtgaccagcctgatcctgatcagaaacaacctgaccgtgatcgacatgatcggcgtggagggcttcggcgccagagagctgctgaaggtgggcggcagactgcccggcgccggcggcagcctgagattcaaggtgcccgagagcaccctgatggactgcagaagacagctgaaggacagcaagcagatcctgagcatcaccaagaacttcaaggtggagaacatcggccccctgcccatcaccgtgagcagcctgaagatcaacggctacaactgccagggctacggcttcgaggtgctggactgccaccagttcagcctggaccccaacaccagcagagacatcagcatcgtgttcacccccgacttcaccagcagctgggtgatcagagacctgagcctggtgaccgccgccgacctggagttcagattcaccctgaacgtgaccctgccccaccacctgctgcccctgtgcgccgacgtggtgcccggccccagctgggaggagagcttctggagactgaccgtgttcttcgtgagcctgagcctgctgggcgtgatcctgatcgccttccagcaggcccagtacatcctgatggagttcatgaagaccagacagagacagaacgccagcagcagcagccagcagaacaacggccccatggacgtgatcagcccccacagctacaagagcaactgcaagaacttcctggacacctacggccccagcgacaagggcagaggcaagaactgcctgcccgtgaacaccccccagagcagaatccagaacgccgccaagagaagccccgccacctacggccacagccagaagaagcacaagtgcagcgtgtactacagcaagcacaagaccagcaccgccgccgccagcagcaccagcaccaccaccgaggagaagcagaccagccccctgggcagcagcctgcccgccgccaaggaggacatctgcaccgacgccatgagagagaactggatcagcctgagatacgccagcggcatcaacgtgaacctgcagaagaacctgaccctgcccaagaacctgctgaacaaggaggagaacaccctgaagaacaccatcgtgttcagcaaccccagcagcgagtgcagcatgaaggagggcatccagacctgcatgttccccaaggagaccgacatcaagaccagcgagaacaccgccgagttcaaggagagagagctgtgccccctgaagaccagcaagaagctgcccgagaaccacctgcccagaaacagcccccagtaccaccagcccgacctgcccgagatcagcagaaagaacaacggcaacaaccagcaggtgcccgtgaagaacgaggtggaccactgcgagaacctgaagaaggtggacaccaagcccagcagcgagaagaagatccacaagaccagcagagaggacatgttcagcgagaagcaggacatccccttcgtggagcaggaggacccctacagaaagaagaagctgcaggagaagagagagggcaacctgcagaacctgaactggagcaagagcagaacctgcagaaagaacaagaagagaggcgtggcccccgtgagcagaccccccgagcagagcgacctgaagctggtgtgcagcgacttcgagagaagcgagctgagcagcgacatcaacgtgagaagctggtgcatccaggagagcaccagagaggtgtgcaaggccgacgccgagatcgccagcagcctgcccgccgcccagagagaggccgagggctactaccagaagcccgagaagaagtgcgtggacaagttctgcagcgacagcagcagcgactgcggcagcagcagcggcagcgtgagagccagcagaggcagctggggcagctggagcagcaccagcagcagcgacggcgacaagaagcccatggtggacgcccagcacttcctgcccgccggcgacagcgtgagccagaacgacttccccagcgaggcccccatcagcctgaacctgagccacaacatctgcaaccccatgaccgtgaacagcctgccccagtacgccgagcccagctgccccagcctgcccgccggccccaccggcgtggaggaggacaagggcctgtacagccccggcgacctgtggcccaccccccccgtgtgcgtgaccagcagcctgaactgcaccctggagaacggcgtgccctgcgtgatccaggagagcgcccccgtgcacaacagcttcatcgactggagcgccacctgcgagggccagttcagcagcgcctactgccccctggagctgaacgactacaacgccttccccgaggagaacatgaactacgccaacggcttcccctgccccgccgacgtgcagaccgacttcatcgaccacaacagccagagcacctggaacaccccccccaacatgcccgccgcctggggccacgccagcttcatcagcagccccccctacctgaccagcaccagaagcctgagccccatgagcggcctgttcggcagcatctgggccccccagagcgacgtgtacgagaactgctgccccatcaaccccaccaccgagcacagcacccacatggagaaccaggccgtggtgtgcaaggagtactaccccggcttcaaccccttcagagcctacatgaacctggacatctggaccaccaccgccaacagaaacgccaacttccccctgagcagagacagcagctactgcggcaacgtgtag

SEQ ID NO: 21172 - DNA, 3924 bp, Artificial Sequence
  Description of Artificial Sequence: Synthetic coding sequence
atgatcgccgtgagcaccgccaacggctacatcctgttcttccacatcaccagcaccagaggcgacaagtacctgtacgagcccgtgtaccccaagggcagcccccagatgaagggcaccccccacttcaaggaggagcagtgcgcccccgccctgaacctggagatgagaaagatcctggacctgcaggcccccatcatgagcctgcagagcgtgctggaggacctgctggtggccaccagcgacggcctgctgcacctgatccactgggagggcatgaccaacggcagaaaggccatcaacctgtgcaccgtgcccttcagcgtggacctgcagagcagcagagtgggcagcttcctgggcttcaccgacgtgcacatcagagacatggagtactgcgccaccctggacggcttcgccgtggtgttcaacgacggcaaggtgggcttcatcacccccgtgagcagcagattcaccgccgagcagctgcacggcgtgtggccccaggacgtggtggacggcacctgcgtggccgtgaacaacaagtacagactgatggccttcggctgcgtgagcggcagcgtgcaggtgtacaccatcgacaacagcaccggcgccatgctgctgagccacaagctggagctgaccgccaagcagtaccccgacatctggaacaagaccggcgccgtgaagctgatgagatggagccccgacaacagcgtggtgatcgtgacctgggagtacggcggcctgagcctgtggagcgtgttcggcgcccagctgatctgcaccctgggcggcgacttcgcctacagaagcgacggcaccaagaaggaccccctgaagatcaacagcatgagctggggcgccgagggctaccacctgtgggtgatcagcggcttcggcagccagaacaccgagatcgagagcgacctgagaagcgtggtgaagcagcccagcatcctgctgttccagttcatcaagagcgtgctgaccgtgaacccctgcatgagcaaccaggagcaggtgctgctgcagggcgaggacagactgtacctgaactgcggcgaggccagccagacccagaaccccagaagcagcagcacccacagcgagcacaagcccagcagagagaagagccccttcgccgacggcggcctggagagccagggcctgagcaccctgctgggccacagacactggcacgtggtgcagatcagcagcacctacctggagagcaactggcccatcagagagcagaacatgatcgtgaccggcggcctggcctggtggaacgacttcatggtgctggcctgctacaacatcaacgacagacaggaggagctgagagtgtacctgagaaccagcaacctggacaacgccttcgcccacgtgaccaaggcccaggccgagaccctgctgctgagcgtgttccaggacatggtgatcgtgttcagagccgactgcagcatctgcctgtacagcatcgagagaaagagcgacggccccaacaccaccgccggcatccaggtgctgcaggaggtgagcatgagcagatacatcccccaccccttcctggtggtgagcgtgaccctgaccagcgtgagcaccgagaacggcatcaccctgaagatgccccagcaggccagaggcgccgagagcatcatgctgaacctggccggccagctgatcatgatgcagagagacagaagcggcccccagatcagagagaaggacagcaaccccaacaaccagagaaagctgctgcccttctgcccccccgtggtgctggcccagagcgtggagaacgtgtggaccacctgcagagccaacaagcagaagagacacctgctggaggccctgtggctgagctgcggcggcgccggcatgaaggtgtggctgcccctgttccccagagaccacagaaagccccacagcttcctgagccagagaatcatgctgcccttccacatcaacatctaccccctggccgtgctgttcgaggacgccctggtgctgggcgccgtgaacgacaccctgctgtacgacagcctgtacaccagaaacaacgccagagagcagctggaggtgctgttccccttctgcgtggtggagagaaccagccagatctacctgcaccacatcctgagacagctgctggtgagaaacctgggcgagcaggccctgctgctggcccagagctgcgccaccctgccctacttcccccacgtgctggagctgatgctgcacgaggtgctggaggaggaggccaccagcagagagcccatccccgaccccctgctgcccaccgtggccaagttcatcaccgagttccccctgttcctgcagaccgtggtgcactgcgccagaaagaccgagtacgccctgtggaactacctgttcgccgccgtgggcaaccccaaggacctgttcgaggagtgcctgatggcccaggacctggacaccgccgccagctacctgatcatcctgcagaacatggaggtgcccgccgtgagcagacagcacgccaccctgctgttcaacaccgccctggagcagggcaagtgggacctgtgcagacacatgatcagattcctgaaggccatcggcagcggcgagagcgagaccccccccagcacccccaccgcccaggagcccagcagcagcggcggcttcgagttcttcagaaacagaagcatcagcctgagccagagcgccgagaacgtgcccgccagcaagttcagcctgcagaagaccctgagcatgcccagcggccccagcggcaagagatggagcaaggacagcgactgcgccgagaacatgtacatcgacatgatgctgtggagacacgccagaagactgctggaggacgtgagactgaaggacctgggctgcttcgccgcccagctgggcttcgagctgatcagctggctgtgcaaggagagaaccagagccgccagagtggacaacttcgtgatcgccctgaagagactgcacaaggacttcctgtggcccctgcccatcatccccgccagcagcatcagcagccccttcaagaacggcaagtacagaaccgtgggcgagcagctgctgaagagccagagcgccgaccccttcctgaacctggagatggacgccggcatcagcaacatccagagaagccagagctggctgagcaacatcggccccacccaccacgagatcgacaccgccagcagccacggcccccagatgcaggacgccttcctgagccccctgagcaacaagggcgacgagtgcagcatcggcagcgccaccgacctgaccgagagcagcagcatggtggacggcgactggaccatggtggacgagaacttcagcaccctgagcctgacccagagcgagctggagcacatcagcatggagctggccagcaagggcccccacaagagccaggtgcagctgagatacctgctgcacatcttcatggaggccggctgcctggactggtgcatcgtgatcggcctgatcctgagagagagcagcatcatcaaccagatcctggtgatcacccagagcagcgaggtggacggcgagatgctgcagaacatcaagaccggcctgcacgccgtggacagatgggccagcaccgactgccccggctacaagcccttcctgaacatcatcaagccccagctgcagaagctgagcgagatcaccgaggagcaggtgcagcccgacgccttccagcccatcaccatgggcaagacccccgagcagaccagccccagagccgaggagagcagaggcagcagcagccacggcagcatcccccagggcgaggtgggcagcagcaacatggtgagcagaaaggaggaggacaccgcccaggccgaggaggaggagcccttccaggacggcacctacgactgcagcgtgagctag

SEQ ID NO: 21173 - DNA, 822 bp, Artificial Sequence
  Description of Artificial Sequence: Synthetic coding sequence
atggagaagagactgggcgtgaagcccaaccccgccagctggatcctgagcggctactactggcagaccagcgccaagtggctgagaagcctgtacctgttctacacctgcttctgcttcagcgtgctgtggctgagcaccgacgccagcgagagcagatgccagcagggcaagacccagttcggcgtgggcctgagaagcggcggcgagaaccacctgtggctgctggagggcacccccagcctgcagagctgctgggccgcctgctgccaggacagcgcctgccacgtgttctggtggctggagggcatgtgcatccaggccgactgcagcagaccccagagctgcagagccttcagaacccacagcagcaacagcatgctggtgttcctgaagaagttccagaccgccgacgacctgggcttcctgcccgaggacgacgtgccccacctgctgggcctgggctggaactgggccagctggagacagagcccccccagagccgccctgagacccgccgtgagcagcagcgaccagcagagcctgatcagaaagctgcagaagagaggcagccccagcgacgtggtgacccccatcgtgacccagcacagcaaggtgaacgacagcaacgagctgggcggcctgaccaccagcggcagcgccgaggtgcacaaggccatcaccatcagcagccccctgaccaccgacctgaccgccgagctgagcggcggccccaagaacgtgagcgtgcagcccgagatcagcgagggcctggccaccacccccagcacccagcaggtgaagagcagcgagaagacctag

SEQ ID NO: 21174 - DNA, 540 bp, Artificial Sequence
  Description of Artificial Sequence: Synthetic coding sequence
atggagaagagactgggcgtgaagcccaaccccgccagctggatcctgagcggctactactggcagaccagcgccaagtggctgagaagcctgtacctgttctacacctgcttctgcttcagcgtgctgtggctgagcaccgacgccagcgagagcagatgccagcagggcaagacccagttcggcgtgggcctgagaagcggcggcgagaaccacctgtggctgctggagggcacccccagcctgcagagctgctgggccgcctgctgccaggacagcgcctgccacgtgttctggtggctggagggcatgtgcatccaggccgactgcagcagaccccagagctgcagagccttcagaacccacagcagcaacagcatgctggtgttcctgaagaagttccagaccgccgacgacctgggcttcctgcccgaggacgacgtgccccacctgctgggcctgggctggaactgggccagctggagacagagcccccccagagccgccctgagacccgccgtgagcagcagcgaccagtag

SEQ ID NO: 21175 - DNA, 471 bp, Artificial Sequence
  Description of Artificial Sequence: Synthetic coding sequence
atggccgagcccggccacagccaccacctgagcgccagagtgagaggcagaaccgagagaagaatccccagactgtggagactgctgctgtgggccggcaccgccttccaggtgacccagggcaccggccccgagctgcacgcctgcaaggagagcgagtaccactacgagtacaccgcctgcgacagcaccggcagcagatggagagtggccgtgccccacacccccggcctgtgcaccagcctgcccgaccccatcaagggcaccgagtgcagcttcagctgcaacgccggcgagttcctggacatgaaggaccagagctgcaagccctgcgccgagggcagatacagcctgggcaccggcatcagattcgacgagtgggacgagctgccccacggcttcgccagcctgagcgccaacatggagctggacgacagcgccgccgagagcaccggcaactgcaccagctag

SEQ ID NO: 21176 - DNA, 2781 bp, Artificial Sequence
  Description of Artificial Sequence: Synthetic coding sequence
atggccgagcccggccacagccaccacctgagcgccagagtgagaggcagaaccgagagaagaatccccagactgtggagactgctgctgtgggccggcaccgccttccaggtgacccagggcaccggccccgagctgcacgcctgcaaggagagcgagtaccactacgagtacaccgcctgcgacagcaccggcagcagatggagagtggccgtgccccacacccccggcctgtgcaccagcctgcccgaccccatcaagggcaccgagtgcagcttcagctgcaacgccggcgagttcctggacatgaaggaccagagctgcaagccctgcgccgagggcagatacagcctgggcaccggcatcagattcgacgagtgggacgagctgccccacggcttcgccagcctgagcgccaacatggagctggacgacagcgccgccgagagcaccggcaactgcaccagcagcaagtgggtgcccagaggcgactacatcgccagcaacaccgacgagtgcaccgccaccctgatgtacgccgtgaacctgaagcagagcggcaccgtgaacttcgagtactactaccccgacagcagcatcatcttcgagttcttcgtgcagaacgaccagtgccagcccaacgccgacgacagcagatggatgaagaccaccgagaagggctgggagttccacagcgtggagctgaacagaggcaacaacgtgctgtactggagaaccaccgccttcagcgtgtggaccaaggtgcccaagcccgtgctgacccagctgatgtacaagtgggccaagcccaagatctgcagcgaggacctggagggcgccgtgaagctgcccgccagcggcgtgaagacccactgccccccctgcaaccccggcttcttcaagaccaacaacagcacctgccagccctgcccctacggcagctacagcaacggcagcgactgcaccagatgccccgccggcaccgagcccgccgtgggcttcgagtacaagtggtggaacaccctgcccaccaacatggagaccaccgtgctgagcggcatcaacttcgagtacaagggcatgaccggctgggaggtggccggcgaccacatctacaccgccgccggcgccagcgacaacgacttcatgatcctgaccctggtggtgcccggcttcagacccccccagagcgtgatggccgacaccgagaacaaggaggtggccagaatcaccttcgtgttcgagaccctgtgcagcgtgaactgcgagctgtacttcatggtgggcgtgaacagcagaaccaacacccccgtggagacctggaagggcagcaagggcaagcagagctacacctacatcatcgaggagaacaccaccaccagcttcacctgggccttccagagaaccaccttccacgaggccagcagaaagtacaccaacgacgtggccaagatctacagcatcaacgtgaccaacgtgatgaacggcgtggccagctactgcagaccctgcgccctggaggccagcgacgtgggcagcagctgcaccagctgccccgccggctactacatcgacagagacagcggcacctgccacagctgccccaccaacaccatcctgaaggcccaccagccctacggcgtgcaggcctgcgtgccctgcggccccggcaccaagaacaacaagatccacagcctgtgctacaacgactgcaccttcagcagaaacacccccaccagaaccttcaactacaacttcagcgccctggccaacaccgtgaccctggccggcggccccagcttcaccagcaagggcctgaagtacttccaccacttcaccctgagcctgtgcggcaaccagggcagaaagatgagcgtgtgcaccgacaacgtgaccgacctgagaatccccgagggcgagagcggcttcagcaagagcatcaccgcctacgtgtgccaggccgtgatcatcccccccgaggtgaccggctacaaggccggcgtgagcagccagcccgtgagcctggccgacagactgatcggcgtgaccaccgacatgaccctggacggcatcaccagccccgccgagctgttccacctggagagcctgggcatccccgacgtgatcttcttctacagaagcaacgacgtgacccagagctgcagcagcggcagaagcaccaccatcagagtgagatgcagcccccagaagaccgtgcccggcagcctgctgctgcccggcacctgcagcgacggcacctgcgacggctgcaacttccacttcctgtgggagagcgccgccgcctgccccctgtgcagcgtggccgactaccacgccatcgtgagcagctgcgtggccggcatccagaagaccacctacgtgtggagagagcccaagctgtgcagcggcggcatcagcctgcccgagcagagagtgaccatctgcaagaccatcgacttctggctgaaggtgggcatcagcgccggcacctgcaccgccatcctgctgaccgtgctgacctgctacttctggaagaagaaccagaagctggagtacaagtacagcaagctggtgatgaacgccaccctgaaggactgcgacctgcccgccgccgacagctgcgccatcatggagggcgaggacgtggaggacgacctgatcttcaccagcaagaagagcctgttcggcaagatcaagagcttcaccagcaagagaacccccgacggcttcgacagcgtgcccctgaagaccagcagcggcggcctggacatggacctgtag

SEQ ID NO: 21177 - DNA, 618 bp, Artificial Sequence
  Description of Artificial Sequence: Synthetic coding sequence
atggccgagcccggccacagccaccacctgagcgccagagtgagaggcagaaccgagagaagaatccccagactgtggagactgctgctgtgggccggcaccgccttccaggtgacccagggcaccggccccgagctgcacgcctgcaaggagagcgagtaccactacgagtacaccgcctgcgacagcaccggcagcagatggagagtggccgtgccccacacccccggcctgtgcaccagcctgcccgaccccatcaagggcaccgagtgcagcttcagctgcaacgccggcgagttcctggacatgaaggaccagagctgcaagccctgcgccgagggcagatacagcctgggcaccggcatcagattcgacgagtgggacgagctgccccacggcttcgccagcctgagcgccaacatggagctggacgacagcgccgccgagagcaccggcaactgcaccagcagcaagtgggtgcccagaggcgactacatcgccagcaacaccgacgagtgcaccgccaccctgatgtacgccgtgaacctgaagcagagcggcaccgtgaacttcgagtactactaccccgacagcagcatcatcttcgagttcttctag

SEQ ID NO: 21178 - DNA, 276 bp, Artificial Sequence
  Description of Artificial Sequence: Synthetic coding sequence
atggccgagcccggccacagccaccacctgagcgccagagtgagaggcagaaccgagagaagaatccccagactgtggagactgctgctgtgggccggcaccgccttccaggtgacccagggcaccggccccgagctgcacgcctgcaaggagagcgagtaccactacgagtacaccgcctgcgacagcaccggcagcagatggagagtggccgtgccccacacccccggcctgtgcaccagcctgcccgaccccatcaagggcaccgagtgctag

SEQ ID NO: 21179 - DNA, 459 bp, Artificial Sequence
  Description of Artificial Sequence: Synthetic coding sequence
atggccgagcccggccacagccaccacctgagcgccagagtgagaggcagaaccgagagaagaatccccagactgtggagactgctgctgtgggccggcaccgccttccaggtgacccagggcaccggccccgagctgcacgcctgcaaggagagcgagtaccactacgagtacaccgcctgcgacagcaccggcagcagatggagagtggccgtgccccacacccccggcctgtgcaccagcctgcccgaccccatcaagggcaccgagtgcagcttcagctgcaacgccggcgagttcctggacatgaaggaccagagctgcaagccctgcgccgagggcagatacagcctgggcaccggcatcagattcgacgagtgggacgagctgccccacggcttcgccagcctgagcgccaacatggagctggacgacagcgccgccgagagcaccggctag

SEQ ID NO: 21180 - DNA, 1923 bp, Artificial Sequence
  Description of Artificial Sequence: Synthetic coding sequence
atggtggtgcccagcaagaccaagatcgtgtgccacttcagcaccctggtgctgacctgcggccagccccacaccctgcagatcgtgcccagagacgagtacgacaaccccaccaacaacagcatgagcctgagagacgagcacaactacaccctgagcatccacgagctgggcccccaggaggaggagagcaccggcgtgagcttcgagaagagcgtgaccagcaacagacagaccttccaggtgttcctgagactgaccctgcacagcagaggctgcttccacgcctgcatcagctaccagaaccagcccatcaacaacggcgagttcgacatcatcgtgctgagcgaggacgagaagaacatcgtggagagaaacgtgagcaccagcggcgtgagcatctacttcgaggcctacctgtacaacgccaccaactgcagcagcaccccctggcacctgccccccatgcacatgaccagcagccagagaagacccagcaccgccgtggacgaggaggacgaggacagccccagcgagtgccacacccccgagaaggtgaagaagcccaagaaggtgtactgctacgtgagccccaagcagttcagcgtgaaggagttctacctgaagatcatcccctggagactgtacaccttcagagtgtgccccggcaccaagttcagctacctgggccccgaccccgtgcacaagctgctgaccctggtggtggacgacggcatccagccccccgtggagctgagctgcaaggagagaaacatcctggccgccaccttcatcagaagcctgcacaagaacatcggcggcagcgagaccttccaggacaaggtgaacttcttccagagagagctgagacaggtgcacatgaagagaccccacagcaaggtgaccctgaaggtgagcagacacgccctgctggagagcagcctgaaggccaccagaaacttcagcatcagcgactggagcaagaacttcgaggtggtgttccaggacgaggaggccctggactggggcggccccagaagagagtggttcgagctgatctgcaaggccctgttcgacaccaccaaccagctgttcaccagattcagcgacaacaaccaggccctggtgcaccccaaccccaacagacccgcccacctgagactgaagatgtacgagttcgccggcagactggtgggcaagtgcctgtacgagagcagcctgggcggcgcctacaagcagctggtgagagccagattcaccagaagcttcctggcccagatcatcggcctgagaatgcactacaagtacttcgagaccgacgaccccgagttctacaagagcaaggtgtgcttcatcctgaacaacgacatgagcgagatggagctggtgttcgccgaggagaagtacaacaagagcggccagctggacaaggtggtggagctgatgaccggcggcgcccagacccccgtgaccaacgccaacaagatcttctacctgaacctgctggcccagtacagactggccagccaggtgaaggaggaggtggagcacttcctgaagggcctgaacgagctggtgcccgagaacctgctggccatcttcgacgagaacgagctggagctgctgatgtgcggcaccggcgacatcagcgtgagcgacttcaaggcccacgccgtggtggtgggcggcagctggcacttcagagagaaggtgatgagatggttctggaccgtggtgagcagcctgacccaggaggagctggccagactgctgcagttcaccaccggcagcagccagctgccccccggcggcttcgccgccctgtgccccagcttccagatcatcgccgcccccacccacagcaccctgcccaccgcccacacctgcttcaaccaggtgaagggccccggcagctgcagctag

SEQ ID NO: 21181 - DNA, 390 bp, Artificial Sequence
  Description of Artificial Sequence: Synthetic coding sequence
atgttctacgtgatcggcggcatcaccgtgagcgtggtggccttcttcttcaccatcaagttcctgttcgagctggccgccagagtggtgagcttcctgcagaacgaggacagagagagaagaggcgacagaaccatctacgactacgtgagaggcaactacctggaccccagaagctgcaaggtgagctgggactggaaggacccctacgaggtgggccacagcatggccttcagagtgcacctgttctacaagaacggccagcccttccccgcccacagacccgtgggcctgagagtgcacatcagccacgtggagctggccgtggagatccccgtgacccaggaggtgctgcaggagcccaacagcaacgtggtgaaggtggcctag

SEQ ID NO: 21182 - DNA, 1548 bp, Artificial Sequence
  Description of Artificial Sequence: Synthetic coding sequence
atgtggagactgcccggcctgctgggcagagccctgcccagaaccctgggccccagcctgtggagagtgacccccaagagcaccagccccgacggcccccagaccaccagcagcaccctgctggtgcccgtgcccaacctggacagaagcggcccccacggccccggcaccagcggcggccccagaagccacggctggaaggacgccttccagtggatgagcagcagagtgagccccaacaccctgtgggacgccatcagctggggcaccctggccgtgctggccctgcagctggccagacagatccacttccaggccagcctgcccgccggcccccagagagtggagcactgcagctggcacagccccctggacagattcttcagcagccccctgtggcacccctgcagcagcctgagacagcacatcctgcccagccccgacggccccgcccccagacacaccggcctgagagagcccagactgggccaggaggaggccagcgcccagcccagaaacttcagccacaacagcctgagaggcgccagaccccaggaccccagcgaggagggccccggcgacttcggcttcctgcacgccagcagcagcatcgagagcgaggccaagcccgcccagccccagcccaccggcgagaaggagcaggacaagagcaagaccctgagcctggaggaggccgtgaccagcatccagcagctgttccagctgagcgtgagcatcgccttcaacttcctgggcaccgagaacatgaagagcggcgaccacaccgccgccttcagctacttccagaaggccgccgccagaggctacagcaaggcccagtacaacgccggcctgtgccacgagcacggcagaggcacccccagagacatcagcaaggccgtgctgtactaccagctggccgccagccagggccacagcctggcccagtacagatacgccagatgcctgctgagagaccccgccagcagctggaaccccgagagacagagagccgtgagcctgctgaagcaggccgccgacagcggcctgagagaggcccaggccttcctgggcgtgctgttcaccaaggagccctacctggacgagcagagagccgtgaagtacctgtggctggccgccaacaacggcgacagccagagcagataccacctgggcatctgctacgagaagggcctgggcgtgcagagaaacctgggcgaggccctgagatgctaccagcagagcgccgccctgggcaacgaggccgcccaggagagactgagagccctgttcagcatgggcgccgccgcccccggccccagcgacctgaccgtgaccggcctgaagagcttcagcagccccagcctgtgcagcctgaacaccctgctggccggcaccagcagactgccccacgccagcagcaccggcaacctgggcctgctgtgcagaagcggccacctgggcgccagcctggaggccagcagcagagccatccccccccacccctaccccctggagagaagcgtggtgagactgggcttcggctag

SEQ ID NO: 21183 - DNA, 1548 bp, Artificial Sequence; identical to SEQ ID NO: 21182
  Description of Artificial Sequence: Synthetic coding sequence

SEQ ID NO: 21184 - DNA, 654 bp, Artificial Sequence
  Description of Artificial Sequence: Synthetic coding sequence
tgagccgtgctgtactaccagctggccgccagccagggccacagcctggcccagtacagatacgccagatgcctgctgagagaccccgccagcagctggaaccccgagagacagagagccgtgagcctgctgaagcaggccgccgacagcggcctgagagaggcccaggccttcctgggcgtgctgttcaccaaggagccctacctggacgagcagagagccgtgaagtacctgtggctggccgccaacaacggcgacagccagagcagataccacctgggcatctgctacgagaagggcctgggcgtgcagagaaacctgggcgaggccctgagatgctaccagcagagcgccgccctgggcaacgaggccgcccaggagagactgagagccctgttcagcatgggcgccgccgcccccggccccagcgacctgaccgtgaccggcctgaagagcttcagcagccccagcctgtgcagcctgaacaccctgctggccggcaccagcagactgccccacgccagcagcaccggcaacctgggcctgctgtgcagaagcggccacctgggcgccagcctggaggccagcagcagagccatccccccccacccctaccccctggagagaagcgtggtgagactgggcttcggctag

SEQ ID NO: 21185 - DNA, 1560 bp, Artificial Sequence
  Description of Artificial Sequence: Synthetic coding sequence
atggccagagccggccccgcctggctgctgctggccatctgggtggtgctgcccagctggctgagcagcgccaaggtgagcagcctgatcgagagaatcagcgaccccaaggacctgaagaagctgctgagaaccagaaacaacgtgctggtgctgtacagcaagagcgaggtggccgccgagaaccacctgagactgctgagcaccgtggcccaggccgtgaagggccagggcaccatctgctgggtggactgcggcgacgccgagagcagaaagctgtgcaagaagatgaaggtggacctgagccccaaggacaagaaggtggagctgttccactaccaggacggcgccttccacaccgagtacaacagagccgtgaccttcaagagcatcgtggccttcctgaaggaccccaagggcccccccctgtgggaggaggaccccggcgccaaggacgtggtgcacctggacagcgagaaggacttcagaagactgctgaagaaggaggagaagcccctgctgatcatgttctacgccccctggtgcagcatgtgcaagagaatgatgccccacttccagaaggccgccacccagctgagaggccacgccgtgctggccggcatgaacgtgtacagcagcgagttcgagaacatcaaggaggagtacagcgtgagaggcttccccaccatctgctacttcgagaagggcagattcctgttccagtacgacaactacggcagcaccgccgaggacatcgtggagtggctgaagaacccccagcccccccagccccaggtgcccgagaccccctgggccgacgagggcggcagcgtgtaccacctgaccgacgaggacttcgaccagttcgtgaaggagcacagcagcgtgctggtgatgttccacgccccctggtgcggccactgcaagaagatgaagcccgagttcgagaaggccgccgaggccctgcacggcgaggccgacagcagcggcgtgctggccgccgtggacgccaccgtgaacaaggccctggccgagagattccacatcagcgagttccccaccctgaagtacttcaagaacggcgagaagtacgccgtgcccgtgctgagaaccaagaagaagttcctggagtggatgcagaaccccgaggccccccccccccccgagcccacctgggaggagcagcagaccagcgtgctgcacctggtgggcgacaacttcagagagaccctgaagaagaagaagcacaccctggtgatgttctacgccccctggtgcccccactgcaagaaggtgatcccccacttcaccgccaccgccgacgccttcaaggacgacagaaagatcgcctgcgccgccgtggactgcgtgaaggacaagaaccaggacctgtgccagcaggaggccgtgaagggctaccccaccttccactactaccactacggcaagttcgccgagaagtacgacagcgacagaaccgagctgggcttcaccaactacatcagagccctgagagagggcgaccacgagagactgggcaagaagaaggaggagctgtag

SEQ ID NO: 21186 - DNA, 1755 bp, Artificial Sequence
  Description of Artificial Sequence: Synthetic coding sequence
atggacctgctgtggatgcccctgctgctggtggccgcctgcgtgagcgccgtgcacagcagccccgaggtgaacgccggcgtgagcagcatccacatcaccaagcccgtgcacatcctggaggagagaagcctgctggtgctgacccccgccggcctgacccagatgctgaaccagaccagattcctgatggtgctgttccacaaccccagcagcaagcagagcagaaacctggccgaggagctgggcaaggccgtggagatcatgggcaagggcaagaacggcatcggcttcggcaaggtggacatcaccatcgagaaggagctgcagcaggagttcggcatcaccaaggcccccgagctgaagctgttcttcgagggcaacagaagcgagcccatcagctgcaagggcgtggtggagagcgccgccctggtggtgtggctgagaagacagatcagccagaaggccttcctgttcaacagcagcgagcaggtggccgagttcgtgatcagcagacccctggtgatcgtgggcttcttccaggacctggaggaggaggtggccgagctgttctacgacgtgatcaaggacttccccgagctgaccttcggcgtgatcaccatcggcaacgtgatcggcagattccacgtgaccctggacagcgtgctggtgttcaagaagggcaagatcgtgaacagacagaagctgatcaacgacagcaccaacaagcaggagctgaacagagtgatcaagcagcacctgaccgacttcgtgatcgagtacaacaccgagaacaaggacctgatcagcgagctgcacatcatgagccacatgctgctgttcgtgagcaagagcagcgagagctacggcatcatcatccagcactacaagctggccagcaaggagttccagaacaagatcctgttcatcctggtggacgccgacgagcccagaaacggcagagtgttcaagtacttcagagtgaccgaggtggacatccccagcgtgcagatcctgaacctgagcagcgacgccagatacaagatgcccagcgacgacatcacctacgagagcctgaagaagttcggcagaagcttcctgagcaagaacgccaccaagcaccagagcagcgaggagatccccaagtactgggaccagggcctggtgaagcagctggtgggcaagaacttcaacgtggtggtgttcgacaaggagaaggacgtgttcgtgatgttctacgccccctggagcaagaagtgcaagatgctgttccccctgctggaggagctgggcagaaagtaccagaaccacagcaccatcatcatcgccaagatcgacgtgaccgccaacgacatccagctgatgtacctggacagataccccttcttcagactgttccccagcggcagccagcaggccgtgctgtacaagggcgagcacaccctgaagggcttcagcgacttcctggagagccacatcaagaccaagatcgaggacgaggacgagctgctgagcgtggagcagaacgaggtgatcgaggaggaggtgctggccgaggagaaggaggtgcccatgatgagaaagggcctgcccgagcagcagagccccgagctggagaacatgaccaagtacgtgagcaagctggaggagcccgccggcaagaagaagaccagcgaggaggtggtggtggtggtggccaagcccaagggcccccccgtgcagaagaagaagcccaaggtgaaggaggagctgtag

SEQ ID NO: 21187 - DNA, 819 bp, Artificial Sequence
  Description of Artificial Sequence: Synthetic coding sequence
atgggcaacaccaccagcgacagagtgagcggcgagagacacggcgccaaggccgccagaagcgagggcgccggcggccacgcccccggcaaggagcacaagatcatggtgggcagcaccgacgaccccagcgtgttcagcctgcccgacagcaagctgcccggcgacaaggagttcgtgagctggcagcaggacctggaggacagcgtgaagcccacccagcaggccagacccaccgtgatcagatggagcgagggcggcaaggaggtgttcatcagcggcagcttcaacaactggagcaccaagatccccctgatcaagagccacaacgacttcgtggccatcctggacctgcccgagggcgagcaccagtacaagttcttcgtggacggccagtgggtgcacgaccccagcgagcccgtggtgaccagccagctgggcaccatcaacaacctgatccacgtgaagaagagcgacttcgaggtgttcgacgccctgaagctggacagcatggagagcagcgagaccagctgcagagacctgagcagcagcccccccggcccctacggccaggagatgtacgccttcagaagcgaggagagattcaagagcccccccatcctgcccccccacctgctgcaggtgatcctgaacaaggacaccaacatcagctgcgaccccgccctgctgcccgagcccaaccacgtgatgctgaaccacctgtacgccctgagcatcaaggacagcgtgatggtgctgagcgccacccacagatacaagaagaagtacgtgaccaccctgctgtacaagcccatctag

SEQ ID NO: 21188 - DNA, 573 bp, Artificial Sequence
  Description of Artificial Sequence: Synthetic coding sequence
atgcccagaggcagaagcaccagaagctggtggggcgtgagaaccacccccgcctgcagcgccagcctgacccccagccacaacgacttcgtggccatcctggacctgcccgagggcgagcaccagtacaagttcttcgtggacggccagtgggtgcacgaccccagcgagcccgtggtgaccagccagctgggcaccatcaacaacctgatccacgtgaagaagagcgacttcgaggtgttcgacgccctgaagctggacagcatggagagcagcgagaccagctgcagagacctgagcagcagcccccccggcccctacggccaggagatgtacgccttcagaagcgaggagagattcaagagcccccccatcctgcccccccacctgctgcaggtgatcctgaacaaggacaccaacatcagctgcgaccccgccctgctgcccgagcccaaccacgtgatgctgaaccacctgtacgccctgagcatcaaggacagcgtgatggtgctgagcgccacccacagatacaagaagaagtacgtgaccaccctgctgtacaagcccatctag

SEQ ID NO: 21189 - DNA, 1053 bp, Artificial Sequence
  Description of Artificial Sequence: Synthetic coding sequence
atggagaagcagccccagaacagcagaagaggcctggcccccagagaggtgccccccgccgtgggcctgctgctgatcatggccctgatgaacaccctgctgtacctgtgcctggaccacttcttcatcgcccccagacagagcaccgtggaccccacccactgcccctacggccacttcagaatcggccagatgaagaactgcagcccctggctgagctgcgaggagctgagaaccgaggtgagacagctgaagagagtgggcgagggcgccgtgaagagagtgttcctgagcgagtggaaggagcacaaggtggccctgagccagctgaccagcctggagatgaaggacgacttcctgcacggcctgcagatgctgaagagcctgcagggcacccacgtggtgaccctgctgggctactgcgaggacgacaacaccatgctgaccgagtaccaccccctgggcagcctgagcaacctggaggagaccctgaacctgagcaagtaccagaacgtgaacacctggcagcacagactggagctggccatggactacgtgagcatcatcaactacctgcaccacagccccgtgggcaccagagtgatgtgcgacagcaacgacctgcccaagaccctgagccagtacctgctgaccagcaacttcagcatcctggccaacgacctggacgccctgcccctggtgaaccacagcagcggcatgctggtgaagtgcggccacagagagctgcacggcgacttcgtggcccccgagcagctgtggccctacggcgaggacgtgcccttccacgacgacctgatgcccagctacgacgagaagatcgacatctggaagatccccgacatcagcagcttcctgctgggccacatcgagggcagcgacatggtgagattccacctgttcgacatccacaaggcctgcaagagccagacccccagcgagagacccaccgcccaggacgtgctggagacctaccagaaggtgctggacaccctgagagacgccatgatgagccaggccagagagatgctgtag

SEQ ID NO: 21190 - DNA, 585 bp, Artificial Sequence
  Description of Artificial Sequence: Synthetic coding sequence
atgggcgccgccgcctgggccagacccctgagcgtgagcttcctgctgctgctgctgcccctgcccggcatgcccgccggcagctgggaccccgccggctacctgctgtactgcccctgcatgggcagattcggcaaccaggccgaccacttcctgggcagcctggccttcgccaagctgctgaacagaaccctggccgtgcccccctggatcgagtaccagcaccacaagccccccttcaccaacctgcacgtgagctaccagaagtacttcaagctggagcccctgcaggcctaccacagagtgatcagcctggaggacttcatggagaagctggcccccacccactggccccccgagaagagagtggcctactgcttcgaggtggccgcccagagaagccccgacaagaagacctgccccatgaaggagggcaaccccttcggccccttctgggaccagttccacgtgagcttcaacaagagcgagctgttcaccggcatcagcttcagcgccagctacagagagcagtggagccagagaagagagaaccacagctgcgtgaccctgctgttccccagatag

SEQ ID NO: 21191 - DNA, 1167 bp, Artificial Sequence
  Description of Artificial Sequence: Synthetic coding sequence
atgggcgccgccgcctgggccagacccctgagcgtgagcttcctgctgctgctgctgcccctgcccggcatgcccgccggcagctgggaccccgccggctacctgctgtactgcccctgcatgggcagattcggcaaccaggccgaccacttcctgggcagcctggccttcgccaagctgctgaacagaaccctggccgtgcccccctggatcgagtaccagcaccacaagccccccttcaccaacctgcacgtgagctaccagaagtacttcaagctggagcccctgcaggcctaccacagagtgatcagcctggaggacttcatggagaagctggcccccacccactggccccccgagaagagagtggcctactgcttcgaggtggccgcccagagaagccccgacaagaagacctgccccatgaaggagggcaaccccttcggccccttctgggaccagttccacgtgagcttcaacaagagcgagctgttcaccggcatcagcttcagcgccagctacagagagcagtggagccagagattcagccccaaggagcaccccgtgctggccctgcccggcgcccccgcccagttccccgtgctggaggagcacagacccctgcagaagtacatggtgtggagcgacgagatggtgaagaccggcgaggcccagatccacgcccacctggtgagaccctacgtgggcatccacctgagaatcggcagcgactggaagaacgcctgcgccatgctgaaggacggcaccgccggcagccacttcatggccagcccccagtgcgtgggctacagcagaagcaccgccgcccccctgaccatgaccatgtgcctgcccgacctgaaggagatccagagagccgtgaagctgtgggtgagaagcctggacgcccagagcgtgtacgtggccaccgacagcgagagctacgtgcccgagctgcagcagctgttcaagggcaaggtgaaggtggtgagcctgaagcccgaggtggcccaggtggacctgtacatcctgggccaggccgaccacttcatcggcaactgcgtgagcagcttcaccgccttcgtgaagagagagagagacctgcagggcagacccagcagcttcttcggcatggacagaccccccaagctgagagacgagttctag

SEQ ID NO: 21192 - DNA, 534 bp, Artificial Sequence
  Description of Artificial Sequence: Synthetic coding sequence
atggtgtggagcgacgagatggtgaagaccggcgaggcccagatccacgcccacctggtgagaccctacgtgggcatccacctgagaatcggcagcgactggaagaacgcctgcgccatgctgaaggacggcaccgccggcagccacttcatggccagcccccagtgcgtgggctacagcagaagcaccgccgcccccctgaccatgaccatgtgcctgcccgacctgaaggagatccagagagccgtgaagctgtgggtgagaagcctggacgcccagagcgtgtacgtggccaccgacagcgagagctacgtgcccgagctgcagcagctgttcaagggcaaggtgaaggtggtgagcctgaagcccgaggtggcccaggtggacctgtacatcctgggccaggccgaccacttcatcggcaactgcgtgagcagcttcaccgccttcgtgaagagagagagagacctgcagggcagacccagcagcttcttcggcatggacagaccccccaagctgagagacgagttctag

SEQ ID NO: 21193 - DNA, 1275 bp, Artificial Sequence
  Description of Artificial Sequence: Synthetic coding sequence
atggccaccctgagcttcgtgttcctgctgctgggcgccgtgagctggccccccgccagcgccagcggccaggagttctggcccggccagagcgccgccgacatcctgagcggcgccgccagcagaagaagatacctgctgtacgacgtgaacccccccgagggcttcaacctgagaagagacgtgtacatcagaatcgccagcctgctgaagaccctgctgaagaccgaggagtgggtgctggtgctgcccccctggggcagactgtaccactggcagagccccgacatccaccaggtgagaatcccctggagcgagttcttcgacctgcccagcctgaacaagaacatccccgtgatcgagtacgagcagttcatcgccgagagcggcggccccttcatcgaccaggtgtacgtgctgcagagctacgccgagggctggaaggagggcacctgggaggagaaggtggacgagagaccctgcatcgaccagctgctgtacagccaggacaagcacgagtactacagaggctggttctggggctacgaggagaccagaggcctgaacgtgagctgcctgagcgtgcagggcagcgccagcatcgtggcccccctgctgctgagaaacaccagcgccagaagcgtgatgctggacagagccgagaacctgctgcacgaccactacggcggcaaggagtactgggacaccagaagaagcatggtgttcgccagacacctgagagaggtgggcgacgagttcagaagcagacacctgaacagcaccgacgacgccgacagaatccccttccaggaggactggatgaagatgaaggtgaagctgggcagcgccctgggcggcccctacctgggcgtgcacctgagaagaaaggacttcatctggggccacagacaggacgtgcccagcctggagggcgccgtgagaaagatcagaagcctgatgaagacccacagactggacaaggtgttcgtggccaccgacgccgtgagaaaggagtacgaggagctgaagaagctgctgcccgagatggtgagattcgagcccacctgggaggagctggagctgtacaaggacggcggcgtggccatcatcgaccagtggatctgcgcccacgccagatgcctgcccaccagcctgagcgccgagagcggcagcggcggcttccagagattcttctgccccaagtacagcgtgagcgagcagatggtggcctgcgtgcacagcggccacttccacaccgtgtgcctgctggtgtag

SEQ ID NO: 21194 - DNA, 1290 bp, Artificial Sequence
  Description of Artificial Sequence: Synthetic coding sequence
atggccaccctgagcttcgtgttcctgctgctgggcgccgtgagctggccccccgccagcgccagcggccaggagttctggcccggccagagcgccgccgacatcctgagcggcgccgccagcagaagaagatacctgctgtacgacgtgaacccccccgagggcttcaacctgagaagagacgtgtacatcagaatcgccagcctgctgaagaccctgctgaagaccgaggagtgggtgctggtgctgcccccctggggcagactgtaccactggcagagccccgacatccaccaggtgagaatcccctggagcgagttcttcgacctgcccagcctgaacaagaacatccccgtgatcgagtacgagcagttcatcgccgagagcggcggccccttcatcgaccaggtgtacgtgctgcagagctacgccgagggctggaaggagggcacctgggaggagaaggtggacgagagaccctgcatcgaccagctgctgtacagccaggacaagcacgagtactacagaggctggttctggggctacgaggagaccagaggcctgaacgtgagctgcctgagcgtgcagggcagcgccagcatcgtggcccccctgctgctgagaaacaccagcgccagaagcgtgatgctggacagagccgagaacctgctgcacgaccactacggcggcaaggagtactgggacaccagaagaagcatggtgttcgccagacacctgagagaggtgggcgacgagttcagaagcagacacctgaacagcaccgacgacgccgacagaatccccttccaggaggactggatgaagatgaaggtgaagctgggcagcgccctgggcggcccctacctgggcgtgcacctgagaagaaaggacttcatctggggccacagacaggacgtgcccagcctggagggcgccgtgagaaagatcagaagcctgatgaagacccacagactggacaaggtgttcgtggccaccgacgccgtgagaaaggagtacgaggagctgaagaagctgctgcccgagatggtgagattcgagcccacctgggaggagctggagctgtacaaggacggcggcgtggccatcatcgaccagtggatctgcgcccacgccagattcttcatcggcaccagcgtgagcaccttcagcttcagaatccacgaggagagagagatcctgggcctggaccccaagaccacctacaacagattctgcggcgaccaggagaaggcctgcgagcagcccacccactggaagatcacctactag

SEQ ID NO: 21195 - DNA, 1179 bp, Artificial Sequence
  Description of Artificial Sequence: Synthetic coding sequence
atggagtggtgggccagcagccccctgagactgtggctgctgctgttcctgctgcccagcgcccagggcagacagaaggagagcggcagcaagtggaaggtgttcatcgaccagatcaacagaagcctggagaactacgagccctgcagcagccagaactgcagctgctaccacggcgtgatcgaggaggacctgacccccttcagaggcggcatcagcagaaagatgatggccgaggtggtgagaagaaagctgggcacccactaccagatcaccaagaacagactgtacagagagaacgactgcatgttccccagcagatgcagcggcgtggagcacttcatcctggaggtgatcggcagactgcccgacatggagatggtgatcaacgtgagagactacccccaggtgcccaagtggatggagcccgccatccccgtgttcagcttcagcaagaccagcgagtaccacgacatcatgtaccccgcctggaccttctgggagggcggccccgccgtgtggcccatctaccccaccggcctgggcagatgggacctgttcagagaggacctggtgagaagcgccgcccagtggccctggaagaagaagaacagcaccgcctacttcagaggcagcagaaccagccccgagagagaccccctgatcctgctgagcagaaagaaccccaagctggtggacgccgagtacaccaagaaccaggcctggaagagcatgaaggacaccctgggcaagcccgccgccaaggacgtgcacctggtggaccactgcaagtacaagtacctgttcaacttcagaggcgtggccgccagcttcagattcaagcacctgttcctgtgcggcagcctggtgttccacgtgggcgacgagtggctggagttcttctacccccagctgaagccctgggtgcactacatccccgtgaagaccgacctgagcaacgtgcaggagctgctgcagttcgtgaaggccaacgacgacgtggcccaggagatcgccgagagaggcagccagttcatcagaaaccacctgcagatggacgacatcacctgctactgggagaacctgctgagcgagtacagcaagttcctgagctacaacgtgaccagaagaaagggctacgaccagatcatccccaagatgctgaagaccgagctgtag

SEQ ID NO: 21196 - DNA, 3273 bp, Artificial Sequence
  Description of Artificial Sequence: Synthetic coding sequence
atgatgcccatgatcctgaccgtgttcctgagcaacaacgagcagatcctgaccgaggtgcccatcacccccgagaccacctgcagagacgtggtggagttctgcaaggagcccggcgagggcagctgccacctggccgaggtgtggagaggcaacgagagacccatccccttcgaccacatgatgtacgagcacctgcagaagtggggccccagaagagaggaggtgaagttcttcctgagacacgaggacagccccaccgagaacagcgagcagggcggcagacagacccaggagcagagaacccagagaaacgtgatcaacgtgcccggcgagaagagaaccgagaacggcgtgggcaaccccagagtggagctgaccctgagcgagctgcaggacatggccgccagacagcagcagcagatcgagaaccagcagcagatgctggtggccaaggagcagagactgcacttcctgaagcagcaggagagaagacagcagcagagcatcagcgagaacgagaagctgcagaagctgaaggagagagtggaggcccaggagaacaagctgaagaagatcagagccatgagaggccaggtggactacagcaagatcatgaacggcaacctgagcgccgagatcgagagattcagcgccatgttccaggagaagaagcaggaggtgcagaccgccatcctgagagtggaccagctgagccagcagctggaggacctgaagaagggcaagctgaacggcttccagagctacaacggcaagctgaccggccccgccgccgtggagctgaagagactgtaccaggagctgcagatcagaaaccagctgaaccaggagcagaacagcaagctgcagcagcagaaggagctgctgaacaagagaaacatggaggtggccatgatggacaagagaatcagcgagctgagagagagactgtacggcaagaagatccagctgaacagagtgaacggcaccagcagcccccagagccccctgagcaccagcggcagagtggccgccgtgggcccctacatccaggtgcccagcgccggcagcttccccgtgctgggcgaccccatcaagccccagagcctgagcatcgccagcaacgccgcccacggcagaagcaagagcgccaacgacggcaactggcccaccctgaagcagaacagcagcagcagcgtgaagcccgtgcaggtggccggcgccgactggaaggaccccagcgtggagggcagcgtgaagcagggcaccgtgagcagccagcccgtgcccttcagcgccctgggccccaccgagaagcccggcatcgagatcggcaaggtgcccccccccatccccggcgtgggcaagcagctgccccccagctacggcacctaccccagccccacccccctgggccccggcagcaccagcagcctggagagaagaaaggagggcagcctgcccagacccagcgccggcctgcccagcagacagagacccaccctgctgcccgccaccggcagcaccccccagcccggcagcagccagcagatccagcagagaatcagcgtgccccccagccccacctacccccccgccggcccccccgccttccccgccggcgacagcaagcccgagctgcccctgaccgtggccatcagacccttcctggccgacaagggcagcagaccccagagccccagaaagggcccccagaccgtgaacagcagcagcatctacagcatgtacctgcagcaggccaccccccccaagaactaccagcccgccgcccacagcgccctgaacaagagcgtgaaggccgtgtacggcaagcccgtgctgcccagcggcagcaccagccccagccccctgcccttcctgcacggcagcctgagcaccggcaccccccagccccagccccccagcgagagcaccgagaaggagcccgagcaggacggccccgccgcccccgccgacggcagcaccgtggagagcctgcccagacccctgagccccaccaagctgacccccatcgtgcacagccccctgagataccagagcgacgccgacctggaggccctgagaagaaagctggccaacgcccccagacccctgaagaagagaagcagcatcaccgagcccgagggccccggcggccccaacatccagaagctgctgtaccagagattcaacaccctggccggcggcatggagggcacccccttctaccagcccagccccagccaggacttcatgggcaccctggccgacgtggacaacggcaacaccaacgccaacggcaacctggaggagctgccccccgcccagcccaccgcccccctgcccgccgagcccgcccccagcagcgacgccaacgacaacgagctgcccagccccgagcccgaggagctgatctgcccccagaccacccaccagaccgccgagcccgccgaggacaacaacaacaacgtggccaccgtgcccaccaccgagcagatccccagccccgtggccgaggcccccagccccggcgaggagcaggtgccccccgcccccctgccccccgccagccacccccccgccaccagcaccaacaagagaaccaacctgaagaagcccaacagcgagagaaccggccacggcctgagagtgagattcaaccccctggccctgctgctggacgccagcctggagggcgagttcgacctggtgcagagaatcatctacgaggtggaggaccccagcaagcccaacgacgagggcatcacccccctgcacaacgccgtgtgcgccggccaccaccacatcgtgaagttcctgctggacttcggcgtgaacgtgaacgccgccgacagcgacggctggacccccctgcactgcgccgccagctgcaacagcgtgcacctgtgcaagcagctggtggagagcggcgccgccatcttcgccagcaccatcagcgacatcgagaccgccgccgacaagtgcgaggagatggaggagggctacatccagtgcagccagttcctgtacggcgtgcaggagaagctgggcgtgatgaacaagggcgtggcctacgccctgtgggactacgaggcccagaacagcgacgagctgagcttccacgagggcgacgccctgaccatcctgagaagaaaggacgagagcgagaccgagtggtggtgggccagactgggcgacagagagggctacgtgcccaagaacctgctgggcctgtaccccagaatcaagcccagacagagaaccctggcctag

SEQ ID NO: 21197 - DNA, 1884 bp, Artificial Sequence
  Description of Artificial Sequence: Synthetic coding sequence
atggccgccagacagcagcagcagatcgagaaccagcagcagatgctggtggccaaggagcagagactgcacttcctgaagcagcaggagagaagacagcagcagagcatcagcgagaacgagaagctgcagaagctgaaggagagagtggaggcccaggagaacaagctgaagaagatcagagccatgagaggccaggtggactacagcaagatcatgaacggcaacctgagcgccgagatcgagagattcagcgccatgttccaggagaagaagcaggaggtgcagaccgccatcctgagagtggaccagctgagccagcagctggaggacctgaagaagggcaagctgaacggcttccagagctacaacggcaagctgaccggccccgccgccgtggagctgaagagactgtaccaggagctgcagatcagaaaccagctgaaccaggagcagaacagcaagctgcagcagcagaaggagctgctgaacaagagaaacatggaggtggccatgatggacaagagaatcagcgagctgagagagagactgtacggcaagaagatccagctgaacagagtgaacggcaccagcagcccccagagccccctgagcaccagcggcagagtggccgccgtgggcccctacatccaggtgcccagcgccggcagcttccccgtgctgggcgaccccatcaagccccagagcctgagcatcgccagcaacgccgcccacggcagaagcaagagcgccaacgacggcaactggcccaccctgaagcagaacagcagcagcagcgtgaagcccgtgcaggtggccggcgccgactggaaggaccccagcgtggagggcagcgtgaagcagggcaccgtgagcagccagcccgtgcccttcagcgccctgggccccaccgagaagcccggcatcgagatcggcaaggtgcccccccccatccccggcgtgggcaagcagctgccccccagctacggcacctaccccagccccacccccctgggccccggcagcaccagcagcctggagagaagaaaggagggcagcctgcccagacccagcgccggcctgcccagcagacagagacccaccctgctgcccgccaccggcagcaccccccagcccggcagcagccagcagatccagcagagaatcagcgtgccccccagccccacctacccccccgccggcccccccgccttccccgccggcgacagcaagcccgagctgcccctgaccgtggccatcagacccttcctggccgacaagggcagcagaccccagagccccagaaagggcccccagaccgtgaacagcagcagcatctacagcatgtacctgcagcaggccaccccccccaagaactaccagcccgccgcccacagcgccctgaacaagagcgtgaaggccgtgtacggcaagcccgtgctgcccagcggcagcaccagccccagccccctgcccttcctgcacggcagcctgagcaccggcaccccccagccccagccccccagcgagagcaccgagaaggagcccgagcaggacggccccgccgcccccgccgacggcagcaccgtggagagcctgcccagacccctgagccccaccaagctgacccccatcgtgcacagccccctgagataccagagcgacgccgacctggaggccctgagaagaaagctggccaacgcccccagacccctgaagaagagaagcagcatcaccgagcccgagggcccccccttcctgcccgcccagcccctgcccggcctgcacggccacctgggcagatgcggccagtggaagcaccagtgccagtggaagcccggcagagcccccccctgccccgcccacagccccacccccagatag

SEQ ID NO: 21198 - DNA, 1197 bp, Artificial Sequence
  Description of Artificial Sequence: Synthetic coding sequence
atgtacctgcagcaggccaccccccccaagaactaccagcccgccgcccacagcgccctgaacaagagcgtgaaggccgtgtacggcaagcccgtgctgcccagcggcagcaccagccccagccccctgcccttcctgcacggcagcctgagcaccggcaccccccagccccagccccccagcgagagcaccgagaaggagcccgagcaggacggccccgccgcccccgccgacggcagcaccgtggagagcctgcccagacccctgagccccaccaagctgacccccatcgtgcacagccccctgagataccagagcgacgccgacctggaggccctgagaagaaagctggccaacgcccccagacccctgaagaagagaagcagcatcaccgagcccgagggccccggcggccccaacatccagaagctgctgtaccagagattcaacaccctggccggcggcatggagggcacccccttctaccagcccagccccagccaggacttcatgggcaccctggccgacgtggacaacggcaacaccaacgccaacggcaacctggaggagctgccccccgcccagcccaccgcccccctgcccgccgagcccgcccccagcagcgacgccaacgacaacgagctgcccagccccgagcccgaggagctgatctgcccccagaccacccaccagaccgccgagcccgccgaggacaacaacaacaacgtggccaccgtgcccaccaccgagcagatccccagccccgtggccgaggcccccagccccggcgaggagcaggtgccccccgcccccctgccccccgccagccacccccccgccaccagcaccaacaagagaaccaacctgaagaagcccaacagcgagagaaccggccacggcctgagagtgagattcaaccccctggccctgctgctggacgccagcctggagggcgagttcgacctggtgcagagaatcatctacgaggtggaggaccccagcaagcccaacgacgagggcatcacccccctgcacaacgccgtgtgcgccggccaccaccacatcgtgaagttcctgctggacttcggcgtgaacgtgaacgccgccgacagcgacggctggggcgccggcaaggccggctgcgacgagcagagatgcggcgtgtgcagcgtgggcctgagaggccccgagcagtag

SEQ ID NO: 21199 - DNA, 1908 bp, Artificial Sequence
  Description of Artificial Sequence: Synthetic coding sequence
tgagtgggcccctacatccaggtgcccagcgccggcagcttccccgtgctgggcgaccccatcaagccccagagcctgagcatcgccagcaacgccgcccacggcagaagcaagagcgccaacgacggcaactggcccaccctgaagcagaacagcagcagcagcgtgaagcccgtgcaggtggccggcgccgactggaaggaccccagcgtggagggcagcgtgaagcagggcaccgtgagcagccagcccgtgcccttcagcgccctgggccccaccgagaagcccggcatcgagatcggcaaggtgcccccccccatccccggcgtgggcaagcagctgccccccagctacggcacctaccccagccccacccccctgggccccggcagcaccagcagcctggagagaagaaaggagggcagcctgcccagacccagcgccggcctgcccagcagacagagacccaccctgctgcccgccaccggcagcaccccccagcccggcagcagccagcagatccagcagagaatcagcgtgccccccagccccacctacccccccgccggcccccccgccttccccgccggcgacagcaagcccgagctgcccctgaccgtggccatcagacccttcctggccgacaagggcagcagaccccagagccccagaaagggcccccagaccgtgaacagcagcagcatctacagcatgtacctgcagcaggccaccccccccaagaactaccagcccgccgcccacagcgccctgaacaagagcgtgaaggccgtgtacggcaagcccgtgctgcccagcggcagcaccagccccagccccctgcccttcctgcacggcagcctgagcaccggcaccccccagccccagccccccagcgagagcaccgagaaggagcccgagcaggacggccccgccgcccccgccgacggcagcaccgtggagagcctgcccagacccctgagccccaccaagctgacccccatcgtgcacagccccctgagataccagagcgacgccgacctggaggccctgagaagaaagctggccaacgcccccagacccctgaagaagagaagcagcatcaccgagcccgagggccccggcggccccaacatccagaagctgctgtaccagagattcaacaccctggccggcggcatggagggcacccccttctaccagcccagccccagccaggacttcatgggcaccctggccgacgtggacaacggcaacaccaacgccaacggcaacctggaggagctgccccccgcccagcccaccgcccccctgcccgccgagcccgcccccagcagcgacgccaacgacaacgagctgcccagccccgagcccgaggagctgatctgcccccagaccacccaccagaccgccgagcccgccgaggacaacaacaacaacgtggccaccgtgcccaccaccgagcagatccccagccccgtggccgaggcccccagccccggcgaggagcaggtgccccccgcccccctgccccccgccagccacccccccgccaccagcaccaacaagagaaccaacctgaagaagcccaacagcgagagaaccggccacggcctgagagtgagattcaaccccctggccctgctgctggacgccagcctggagggcgagttcgacctggtgcagagaatcatctacgaggtggaggaccccagcaagcccaacgacgagggcatcacccccctgcacaacgccgtgtgcgccggccaccaccacatcgtgaagttcctgctggacttcggcgtgaacgtgaacgccgccgacagcgacggctggggcgccggcaaggccggctgcgacgagcagagatgcggcgtgtgcagcgtgggcctgagaggccccgagcagtag

SEQ ID NO: 21200 - DNA, 1587 bp, Artificial Sequence
  Description of Artificial Sequence: Synthetic coding sequence
atggccgagcacctggagctgctggccgagatgcccatggtgggcagaatgagcacccaggagagactgaagcacgcccagaagagaagagcccagcaggtgaagatgtgggcccaggccgagaaggaggcccagggcaagaagggccccggcgagagacccagaaaggaggccgccagccagggcctgctgaagcaggtgctgttcccccccagcgtggtgctgctggaggccgccgccagaaacgacctggaggaggtgagacagttcctgggcagcggcgtgagccccgacctggccaacgaggacggcctgaccgccctgcaccagtgctgcatcgacgacttcagagagatggtgcagcagctgctggaggccggcgccaacatcaacgcctgcgacagcgagtgctggacccccctgcacgccgccgccacctgcggccacctgcacctggtggagctgctgatcgccagcggcgccaacctgctggccgtgaacaccgacggcaacatgccctacgacctgtgcgacgacgagcagaccctggactgcctggagaccgccatggccgacagaggcatcacccaggacagcatcgaggccgccagagccgtgcccgagctgagaatgctggacgacatcagaagcagactgcaggccggcgccgacctgcacgcccccctggaccacggcgccaccctgctgcacgtggccgccgccaacggcttcagcgaggccgccgccctgctgctggagcacagagccagcctgagcgccaaggaccaggacggctgggagcccctgcacgccgccgcctactggggccaggtgcccctggtggagctgctggtggcccacggcgccgacctgaacgccaagagcctgatggacgagacccccctggacgtgtgcggcgacgaggaggtgagagccaagctgctggagctgaagcacaagcacgacgccctgctgagagcccagagcagacagagaagcctgctgagaagaagaaccagcagcgccggcagcagaggcaaggtggtgagaagagtgagcctgacccagagaaccgacctgtacagaaagcagcacgcccaggaggccatcgtgtggcagcagcccccccccaccagccccgagccccccgaggacaacgacgacagacagaccggcgccgagctgagaccccccccccccgaggaggacaaccccgaggtggtgagaccccacaacggcagagtgggcggcagccccgtgagacacctgtacagcaagagactggacagaagcgtgagctaccagctgagccccctggacagcaccaccccccacaccctggtgcacgacaaggcccaccacaccctggccgacctgaagagacagagagccgccgccaagctgcagagacccccccccgagggccccgagagccccgagaccgccgagcccggcctgcccggcgacaccgtgaccccccagcccgactgcggcttcagagccggcggcgacccccccctgctgaagctgaccgcccccgccgtggaggcccccgtggagagaagaccctgctgcctgctgatgtag

SEQ ID NO: 21201 - DNA, 1587 bp, Artificial Sequence; identical to SEQ ID NO: 21200
  Description of Artificial Sequence: Synthetic coding sequence

SEQ ID NO: 21202 - DNA, 840 bp, Artificial Sequence
  Description of Artificial Sequence: Synthetic coding sequence
atgagcagagagagaccccccggcaccgacatccccagaaacctgagcttcatcgccgccctgaccgagagagcctactacagaagccagagacccagcctggaggaggagcccgaggaggagcccggcgagggcggcaccagattcggcgccagaagcagagcccacgcccccagcagaggcagaagagccagaagcgcccccgccggcggcggcggcgccagagcccccagaagcagaagccccgacaccagaaagagagtgagattcgccgacgccctgggcctggagctggccgtggtgagaagattcagacccggcgagctgcccagagtgcccagacacgtgcagatccagctgcagagagacgccctgagacacttcgccccctgccagcccagagccagaggcctgcaggaggccagagccgccctggagcccgccagcgagcccggcttcgccgccagactgctgacccagagaatctgcctggagagagccgaggccggccccctgggcgtggccggcagcgccagagtggtggacctggcctacgagaagagagtgagcgtgagatggagcgccgacggctggagaagccagagagaggcccccgccgcctacgccggccccgccccccccccccccagagccgacagattcgccttcagactgcccgccccccccatcggcggcgccctgctgttcgccctgagatacagagtgaccggccacgagttctgggacaacaacggcggcagagactacgccctgagaggccccgagcaccccggcagcggcggcgcccccgagccccagggctggatccacttcatctag

SEQ ID NO: 21203 - DNA, 150 bp, Artificial Sequence
  Description of Artificial Sequence: Synthetic coding sequence
tgaggcgccctgctgttcgccctgagatacagagtgaccggccacgagttctgggacaacaacggcggcagagactacgccctgagaggccccgagcaccccggcagcggcggcgcccccgagccccagggctggatccacttcatctag

SEQ ID NO: 21204 - DNA, 105 bp, Artificial Sequence
  Description of Artificial Sequence: Synthetic coding sequence
tgattctgggacaacaacggcggcagagactacgccctgagaggccccgagcaccccggcagcggcggcgcccccgagccccagggctggatccacttcatctag

SEQ ID NO: 21205 - DNA, 57 bp, Artificial Sequence
  Description of Artificial Sequence: Synthetic coding sequence
gagcaccccggcagcggcggcgcccccgagccccagggctggatccacttcatctag

SEQ ID NO: 21206 - DNA, 90 bp, Artificial Sequence
  Description of Artificial Sequence: Synthetic coding sequence
aacggcggcagagactacgccctgagaggccccgagcaccccggcagcggcggcgcccccgagccccagggctggatccacttcatctag

SEQ ID NO: 21207 - DNA, 42 bp, Artificial Sequence
  Description of Artificial Sequence: Synthetic coding sequence
tgaggcgcccccgagccccagggctggatccacttcatctag

SEQ ID NO: 21208 - DNA, 2400 bp, Artificial Sequence
  Description of Artificial Sequence: Synthetic coding sequence
atggccagaaccgcccccgtggagccccccctgagacacagcgccccccccagccccgccgccggcgagcccagaaccagcgtggaggccgccgtggcccccagaagagtgctgttcgccgacgaggccctgggcctgcccctggcccagctgagaagatacagaccctggggcggccccggcgccggcaagatggccgccgccgccggccaggacggcggcggcggcggcggcgccgacgaggacgacgacggcgaggacggcgacgagggcgaggaggaggaggaggcctgccccgagcccagccccctgtgccccgtgcccgccggcggcggcttctacctggtgcccaccttcagcctgccccccgcccccggcagactggagagactgggcagagtgatggtggagctggaggccctgctgcccccccccggcgccgtgcccggcggcgccggcgtgtgggtgcccggcggcagaccccccgtgctgagaggcctggtgagagtgctgaacagaagcttcgagaaggccgtgcacgtgagagccagccacgacggctgggccagcttctgcgaccaccccgccagatacgtgcccagaagccccccctgggccggcgccggcggcaccggcgccggcgaccccatcctggaccccggcctgggcctgggccccggccaggccagcgccagcagccccgacgacggcggcagaaccgacagattcgccttccagctgcccttcgccgagggcgccggcgacggcgccagactggacttcgtggtgagatacgagacccccgagggcaccttctgggccaacaaccacggcagaaactacaccgtgctgctgagaatcgcccccgcccccacccccaccgacgccgagggcctgccccagcagcagcagctgccccagctggagccccagcccgagtgccagggccccgtggaggccgaggccagacagctgaagagctgcatgaagcccgtgagaagaagacccgccgaggaggagctgaagaccaagaacatggacgacaacaccttcgccatggccgagcaccccgacgtgcaggagagcgtgggccccctggtggcccccacccccctgagaccctggccccagatgaccctgcaggtgagcgacgtgcccatgaccggcaaccccgccgaggagggcgacgtgcccagaagcagcccccccgtggccttcaccgaggtgctgcaggcccccgccatcagaatcccccccagcagccccctgtgcggcctgggcggcagccccagagaccaggccagcggccccgacgccagcgagggcgccaccggccccttcctggagcccagccagcagcaggccgaggccacctggggcgtgagcagcgagaacggcggcggcctggaggccgtgagcggcagcgaggagctgctgggcgaggacaccatcgaccaggagctggagcagctgtacctgagccacctgagcagactgagagccgccgtggccgccggcggcgccggcggcggcggcgagggcagcaccgacggcggcatgagccccagccaccccctgggcatcctgaccgacagagacctgatcctgaagtggcccggccccgagagagccctgaacagcgccctggccgaggagatcaccctgcactacgccagactgggcagaggcgtggagctgatcaaggacaccgaggaccccgacgacgagggcgagggcgaggagggcctgagcgtgacccccagcagccccgagggcgacagccccaaggagagcccccccgagatcctgagcggcgccagaagcgtggtggccaccatgggcgacgtgtggctgccctgggccgagggcagcggctgcgacggccccgtggtgctgggcaccgagggccagttcatcggcgaccccgagaagggcatgggcaaggacaccagcagcctgcacatgaacagagtgatcgccggcgtgaccgagagcctgggcgaggccggcaccgaggcccagatcgaggtgaccagcgagtgggccggcagcctggaccccatcagcggcaaggagcccgccagccccgtgctgctgcagggccagaaccccaccctgctgagccccctgggcgccgaggtgtgcctgagcagcgtggccagaccccacgtgagcagccaggacgagaaggacgccggccccagcctggagccccccaagaagagccccaccctggccgtgcccgccgagtgcgtgtgcgccctgcccccccagctgagaggccccctgacccagaccctgggcgtgctggccggcctggtggtggtgcccgtggccctgaacagcggcgtgagcctgctggtgctggccctgtgcctgagcctggcctggttcagctag

SEQ ID NO: 21209 - DNA, 1413 bp, Artificial Sequence
  Description of Artificial Sequence: Synthetic coding sequence
atgaagcccgtgagaagaagacccgccgaggaggagctgaagaccaagaacatggacgacaacaccttcgccatggagcaccccgacgtgcaggagagcgtgggccccctggtggcccccacccccctgagaccctggccccagatgaccctgcaggtgagcgacgtgcccatgaccggcaaccccgccgaggagggcgacgtgcccagaagcagcccccccgtggccttcaccgaggtgctgcaggcccccgccatcagaatcccccccagcagccccctgtgcggcctgggcggcagccccagagaccaggccagcggccccgacgccagcgagggcgccaccggccccttcctggagcccagccagcagcaggccgaggccacctggggcgtgagcagcgagaacggcggcggcctggaggccgtgagcggcagcgaggagctgctgggcgaggacaccatcgaccaggagctggagcagctgtacctgagccacctgagcagactgagagccgccgtggccgccggcggcgccggcggcggcggcgagggcagcaccgacggcggcatgagccccagccaccccctgggcatcctgaccgacagagacctgatcctgaagtggcccggccccgagagagccctgaacagcgccctggccgaggagatcaccctgcactacgccagactgggcagaggcgtggagctgatcaaggacaccgaggaccccgacgacgagggcgagggcgaggagggcctgagcgtgacccccagcagccccgagggcgacagccccaaggagagcccccccgagatcctgagcggcgccagaagcgtggtggccaccatgggcgacgtgtggctgccctgggccgagggcagcggctgcgacggccccgtggtgctgggcaccgagggccagttcatcggcgaccccgagaagggcatgggcaaggacaccagcagcctgcacatgaacagagtgatcgccggcgtgaccgagagcctgggcgaggccggcaccgaggcccagatcgaggtgaccagcgagtgggccggcagcctggaccccatcagcggcaaggagcccgccagccccgtgctgctgcagggccagaaccccaccctgctgagccccctgggcgccgaggtgtgcctgagcagcgtggccagaccccacgtgagcagccaggacgagaaggacgccggccccagcctggagccccccaagaagagccccaccctggccgtgcccgccgagtgcgtgtgcgccctgcccccccagctgagaggccccctgacccagaccctgggcgtgctggccggcctggtggtggtgcccgtggccctgaacagcggcgtgagcctgctggtgctggccctgtgcctgagcctggcctggttcagctag

SEQ ID NO: 21210 - DNA, 1368 bp, Artificial Sequence
  Description of Artificial Sequence: Synthetic coding sequence
atgttctgcagcggcagaaagtgggtggccgaggccaccatctgcaccaagctgatgaagagagagaagagaagaatgggcaagagaagagccaagaaggccaagagagaggagaagaagaagggcggcgagagaagaagaaacgagaagagaggcaaccagatgaagagaatgtgcgagagaaagaagtacgagaccgacctggaggaccaggacatcatgggcgccttcctggacaagcccaagatggagaagcacaacgcccagggccagggcaacggcctgagatacggcctgagcagcatgcagggctggagagtggagatggaggacgcccacaccgccgtgatcggcctgcccagcggcctggagagctggagcttcttcgccgtgtacgacggccacgccggcagccaggtggccaagtactgctgcgagcacctgctggaccacatcaccaacaaccaggacttcaagggcagcgccggcgcccccagcgtggagaacgtgaagaacggcatcagaaccggcttcctggagatcgacgagcacatgagagtgatgagcgagaagaagcacggcgccgacagaagcggcagcaccgccgtgggcgtgctgatcagcccccagcacacctacttcatcaactgcggcgacagcagaggcctgctgtgcagaaacagaaaggtgcacttcttcacccaggaccacaagcccagcaaccccctggagaaggagagaatccagaacgccggcggcagcgtgatgatccagagagtgaacggcagcctggccgtgagcagagccctgggcgacttcgactacaagtgcgtgcacggcaagggccccaccgagcagctggtgagccccgagcccgaggtgcacgacatcgagagaagcgaggaggacgaccagttcatcatcctggcctgcgacggcatctgggacgtgatgggcaacgaggagctgtgcgacttcgtgagaagcagactggaggtgaccgacgacctggagaaggtgtgcaacgaggtggtggacacctgcctgtacaagggcagcagagacaacatgagcgtgatcctgatctgcttccccaacgcccccaaggtgagccccgaggccgtgaagaaggaggccgagctggacaagtacctggagtgcagagtggaggagatcatcaagaagcagggcgagggcgtgcccgacctggtgcacgtgatgagaaccctggccagcgagaacatccccagcctgccccccggcggcgagctggccagcaagagaaacgtgatcgaggccgtgtacaacagactgaacccctacaagaacgacgacaccgacagcaccagcaccgacgacatgtggtag

SEQ ID NO: 21211 - DNA, 975 bp, Artificial Sequence
  Description of Artificial Sequence: Synthetic coding sequence
atgggcgccttcctggacaagcccaagatggagaagcacaacgcccagggccagggcaacggcctgagatacggcctgagcagcatgcagggctggagagtggagatggaggacgcccacaccgccgtgatcggcctgcccagcggcctggagagctggagcttcttcgccgtgtacgacggccacgccggcagccaggtggccaagtactgctgcgagcacctgctggaccacatcaccaacaaccaggacttcaagggcagcgccggcgcccccagcgtggagaacgtgaagaacggcatcagaaccggcttcctggagatcgacgagcacatgagagtgatgagcgagaagaagcacggcgccgacagaagcggcagcaccgccgtgggcgtgctgatcagcccccagcacacctacttcatcaactgcggcgacagcagaggcctgctgtgcagaaacagaaaggtgcacttcttcacccaggaccacaagcccagcaaccccctggagaaggagagaatccagaacgccggcggcagcgtgatgatccagagagtgaacggcagcctggccgtgagcagagccctgggcgacttcgactacaagtgcgtgcacggcaagggccccaccgagcagctggtgagccccgagcccgaggtgcacgacatcgagagaagcgaggaggacgaccagttcatcatcctggcctgcgacggcatctgggacgtgatgggcaacgaggagctgtgcgacttcgtgagaagcagactggaggtgaccgacgacctggagaaggtgtgcaacgaggtggtggacacctgcctgtacaagggcagcagagacaacatgagcgtgatcctgatctgcttccccaacgcccccaaggtgagccccgaggccgtgaagaaggaggccgagctggacaagtacctggagtgcagagtggagggcggcagcttcaacaagaagtag

SEQ ID NO: 21212 - DNA, 1149 bp, Artificial Sequence
  Description of Artificial Sequence: Synthetic coding sequence
atgggcgccttcctggacaagcccaagatggagaagcacaacgcccagggccagggcaacggcctgagatacggcctgagcagcatgcagggctggagagtggagatggaggacgcccacaccgccgtgatcggcctgcccagcggcctggagagctggagcttcttcgccgtgtacgacggccacgccggcagccaggtggccaagtactgctgcgagcacctgctggaccacatcaccaacaaccaggacttcaagggcagcgccggcgcccccagcgtggagaacgtgaagaacggcatcagaaccggcttcctggagatcgacgagcacatgagagtgatgagcgagaagaagcacggcgccgacagaagcggcagcaccgccgtgggcgtgctgatcagcccccagcacacctacttcatcaactgcggcgacagcagaggcctgctgtgcagaaacagaaaggtgcacttcttcacccaggaccacaagcccagcaaccccctggagaaggagagaatccagaacgccggcggcagcgtgatgatccagagagtgaacggcagcctggccgtgagcagagccctgggcgacttcgactacaagtgcgtgcacggcaagggccccaccgagcagctggtgagccccgagcccgaggtgcacgacatcgagagaagcgaggaggacgaccagttcatcatcctggcctgcgacggcatctgggacgtgatgggcaacgaggagctgtgcgacttcgtgagaagcagactggaggtgaccgacgacctggagaaggtgtgcaacgaggtggtggacacctgcctgtacaagggcagcagagacaacatgagcgtgatcctgatctgcttccccaacgcccccaaggtgagccccgaggccgtgaagaaggaggccgagctggacaagtacctggagtgcagagtggaggagatcatcaagaagcagggcgagggcgtgcccgacctggtgcacgtgatgagaaccctggccagcgagaacatccccagcctgccccccggcggcgagctggccagcaagagaaacgtgatcgaggccgtgtacaacagactgaacccctacaagaacgacgacaccgacagcaccagcaccgacgacatgtggtag

SEQ ID NO: 21213 - DNA, 564 bp, Artificial Sequence
  Description of Artificial Sequence: Synthetic coding sequence
atgggcgccttcctggacaagcccaagatggagaagcacaacgcccagggccagggcaacggcctgagatacggcctgagcagcatgcagggctggagagtggagatggaggacgcccacaccgccgtgatcggcctgcccagcggcctggagagctggagcttcttcgccgtgtacgacggccacgccggcagccaggtggccaagtactgctgcgagcacctgctggaccacatcaccaacaaccaggacttcaagggcagcgccggcgcccccagcgtggagaacgtgaagaacggcatcagaaccggcttcctggagatcgacgagcacatgagagtgatgagcgagaagaagcacggcgccgacagaagcggcagcaccgccgtgggcgtgctgatcagcccccagcacacctacttcatcaactgcggcgacagcagaggcctgctgtgcagaaacagaaaggtgcacttcttcacccaggaccacaagcccagcaaccccctggagaaggagagaatccagaacgccggcggcagcgtgatgatccagagagtgtag

SEQ ID NO: 21214 - DNA, 390 bp, Artificial Sequence
  Description of Artificial Sequence: Synthetic coding sequence
atgggcgccttcctggacaagcccaagatggagaagcacaacgcccagggccagggcaacggcctgagatacggcctgagcagcatgcagggctggagagtggagatggaggacgcccacaccgccgtgatcggcctgcccagcggcctggagagctggagcttcttcgccgtgtacgacggccacgccggcagccaggtggccaagtactgctgcgagcacctgctggaccacatcaccaacaaccaggacttcaagggcagcgccggcgcccccagcgtggagaacgtgaagaacggcatcagaaccggcttcctggagatcgacgagcacatgagagtgatgagcgagaagaagcacggcgccgacagaagcggcagcaccgcctag

SEQ ID NO: 21215 - DNA, 1149 bp, Artificial Sequence; identical to SEQ ID NO: 21212
  Description of Artificial Sequence: Synthetic coding sequence

SEQ ID NO: 21216 - DNA, 447 bp, Artificial Sequence
  Description of Artificial Sequence: Synthetic coding sequence
atgggcgccttcctggacaagcccaagatggagaagcacaacgcccagggccagggcaacggcctgagatacggcctgagcagcatgcagggctggagagtggagatggaggacgcccacaccgccgtgatcggcctgcccagcggcctggagagctggagcttcttcgccgtgtacgacggccacgccggcagccaggtggccaagtactgctgcgagcacctgctggaccacatcaccaacaaccaggacttcaagggcagcgccggcgcccccagcgtggagaacgtgaagaacggcatcagaaccggcttcctggagatcgacgagcacatgagagtgatgagcgagaagaagcacggcgccgacagaagcggcagcaccgccgtgggcgtgctgatcagcccccagcacacctacttcatcaactgcggcgacagcagatag

SEQ ID NO: 21217 - DNA, 2367 bp, Artificial Sequence
  Description of Artificial Sequence: Synthetic coding sequence
acccactacctgagccccggcctgagcgacttctacctgaaccacagccccgccagcacctgcaccctgagaagaagcctgggcagcgagaccggcaagtgcctgcccgcccacagcctgctgcccaagttcttcccctgcagagaggacgtgcacaaggtggacatcatgaccttctgccagcagaaggccgcccagagctgcaagagcgagaccctgggcagcagagacagcgccctgctgtggcagctgctggtgctgctgtgcagacagaacggcagcatggtgggcagcgacatcgccgagctgctgatgcaggactgcaagaagctggagaagtacaagagacagccccccgtggccaacctgatcaacctgaccgacgaggactggcccgtgctgagcagcggcacccccaacctgctgaccggcgagatcccccccagcgtggagacccccgcccagatcgtggagaagttcaccagactgctgtactacggcagaaagaaggaggccctggagtgggccatgaagaaccacctgtggggccacgccctgttcctgagcagcaagatggacccccagacctacagctgggtgatgagcggcttcaccagcaccctggccctgaacgaccccctgcagaccctgttccagctgatgagcggcagaatcccccaggccgccacctgctgcggcgagaagcagtggggcgactggagaccccacctggccgtgatcctgagcaaccaggccggcgaccccgagctgtaccagagagccatcgtggccatcggcgacaccctggccggcaagggcctggtggaggccgcccacttctgctacctgatggcccacgtgcccttcggccactacaccgtgaagaccgaccacctggtgctgctgggcagcagccacagccaggagttcctgaagttcgccaccaccgaggccatccagagaaccgagatcttcgagtactgccagatgctgggcagacccaagagcttcatccccagcttccaggtgtacaagctgctgtacgccagcagactggccgactacggcctggtgagccaggccctgcactactgcgaggccatcggcgccgccgtgctgagccagggcgagagcagccaccccgtgctgctggtggagctgatcaagctggccgagaagctgaagctgagcgaccccctggtgctggagagaagaagcggcgacagagacctggagcccgactggctggcccagctgagaagacagctggagcagaaggtggccggcgacatcggcgacccccaccccaccagaagcgacatcagcggcgccggcggcaccaccaccgagaacaccttctaccaggacttcagcggctgccagggctacagcgaggcccccggctacagaagcgccctgtggctgacccccgagcagacctgcctgctgcagcccagcccccagcagcccttccccctgcagcccggcagctaccccgccggcggcggcgccggccagaccggcacccccagacccttctacagcgtgcccgagacccacctgcccggcaccggcagcagcgtggccgtgaccgaggccaccggcggcaccgtgtgggaggagatgctgcagacccacctgggccccggcgagaacaccgtgagccaggagaccagccagccccccgacggccaggaggtgatcagcaagccccagacccccctggccgccagacccagaagcatcagcgagagcagcgccagcagcgccaaggaggacgagaaggagagcagcgacgaggccgacaagaacagccccagaaacaccgcccagagaggcaagctgggcgacggcaaggagcacaccaagagcagcggcttcggctggttcagctggttcagaagcaagcccaccaagaacgccagccccgccggcgacgaggacagcagcgacagccccgacagcgagcaggagacccccagagccagcagcccccaccaggccggcctgggcctgagcctgacccccagccccgagagcccccccctgcccgacgtgagcgccttcagcagaggcagaggcggcggcgagggcagaggcagcgccagcagcggcggcgccgccgccggcgccggcgtgggcggcctgagcggccccgagagcgtgagcttcgagctgtgcagcaaccccggcgtgctgctgcccccccccgccctgaagggcgccgtgcccctgtacaaccccagccaggtgccccagctgcccaccgccaccagcctgaacagacccaacagactgagcgccagcctgagccaccccgccatgctgagaatcaacaccagacccagactgatcagccaggactag

SEQ ID NO: 21218 - DNA, 3183 bp, Artificial Sequence
  Description of Artificial Sequence: Synthetic coding sequence
atggagctgtgggccccccagagactgccccagaccagaggcaaggccaccgcccccagcaaggaccccgacagaggcttcagaagagacggccaccacagacccgtgccccacagctggcacaacggcgagagattccaccagtggcaggacaacagaggcagcccccagccccagcaggagcccagagccgaccaccagcagcagccccactacgccagcagacccggcgactggcaccagcccgtgagcggcgtggactactacgagggcggctacagaaaccagctgtacagcagacccggctacgagaacagctaccagagctaccagagccccaccatgagagaggagtacgcctacggcagctactactaccacggccacccccagtggctgcaggaggagagagtgcccagacagagaagcccctacatctggcacgaggactacagagagcagaagtacctggacgagcaccactacgagaaccagcacagccccttcggcaccaacagcgagacccacttccagagcaacagcagaaacccctgcaaggacagccccgccagcaacagcggccaggagtggcccggcgagctgttccccggcagcctgctggccgaggcccagaagaacaagcccagcctggccagcgagagcaacctgctgcagcagagagagagcggcctgagcagcagcagctacgagctgagccagtacatcagagacgcccccgagagagacgacccccccgccagcgccgcctggagccccgtgcaggccgacgtgagcagcgccggccccaaggcccccatgaagttctacatcccccacgtgcccgtgagcttcggccccggcggccagctggtgcacgtgggccccagcagccccaccgacggccaggccgccctggtggagctgcacagcatggaggtgatcctgaacgacagcgaggagcaggaggagatgagaagcttcagcggccccctgatcagagaggacgtgcacaaggtggacatcatgaccttctgccagcagaaggccgcccagagctgcaagagcgagaccctgggcagcagagacagcgccctgctgtggcagctgctggtgctgctgtgcagacagaacggcagcatggtgggcagcgacatcgccgagctgctgatgcaggactgcaagaagctggagaagtacaagagacagccccccgtggccaacctgatcaacctgaccgacgaggactggcccgtgctgagcagcggcacccccaacctgctgaccggcgagatcccccccagcgtggagacccccgcccagatcgtggagaagttcaccagactgctgtactacggcagaaagaaggaggccctggagtgggccatgaagaaccacctgtggggccacgccctgttcctgagcagcaagatggacccccagacctacagctgggtgatgagcggcttcaccagcaccctggccctgaacgaccccctgcagaccctgttccagctgatgagcggcagaatcccccaggccgccacctgctgcggcgagaagcagtggggcgactggagaccccacctggccgtgatcctgagcaaccaggccggcgaccccgagctgtaccagagagccatcgtggccatcggcgacaccctggccggcaagggcctggtggaggccgcccacttctgctacctgatggcccacgtgcccttcggccactacaccgtgaagaccgaccacctggtgctgctgggcagcagccacagccaggagttcctgaagttcgccaccaccgaggccatccagagaaccgagatcttcgagtactgccagatgctgggcagacccaagagcttcatccccagcttccaggtgtacaagctgctgtacgccagcagactggccgactacggcctggtgagccaggccctgcactactgcgaggccatcggcgccgccgtgctgagccagggcgagagcagccaccccgtgctgctggtggagctgatcaagctggccgagaagctgaagctgagcgaccccctggtgctggagagaagaagcggcgacagagacctggagcccgactggctggcccagctgagaagacagctggagcagaaggtggccggcgacatcggcgacccccaccccaccagaagcgacatcagcggcgccggcggcaccaccaccgagaacaccttctaccaggacttcagcggctgccagggctacagcgaggcccccggctacagaagcgccctgtggctgacccccgagcagacctgcctgctgcagcccagcccccagcagcccttccccctgcagcccggcagctaccccgccggcggcggcgccggccagaccggcacccccagacccttctacagcgtgcccgagacccacctgcccggcaccggcagcagcgtggccgtgaccgaggccaccggcggcaccgtgtgggaggagatgctgcagacccacctgggccccggcgagaacaccgtgagccaggagaccagccagccccccgacggccaggaggtgatcagcaagccccagacccccctggccgccagacccagaagcatcagcgagagcagcgccagcagcgccaaggaggacgagaaggagagcagcgacgaggccgacaagaacagccccagaaacaccgcccagagaggcaagctgggcgacggcaaggagcacaccaagagcagcggcttcggctggttcagctggttcagaagcaagcccaccaagaacgccagccccgccggcgacgaggacagcagcgacagccccgacagcgaggagacccccagagccagcagcccccaccaggccggcctgggcctgagcctgacccccagccccgagagcccccccctgcccgacgtgagcgccttcagcagaggcagaggcggcggcgagggcagaggcagcgccagcagcggcggcgccgccgccggcgccggcgtgggcggcctgagcggccccgagagcgtgagcttcgagctgtgcagcaaccccggcgtgctgctgcccccccccgccctgaagggcgccgtgcccctgtacaaccccagccaggtgccccagctgcccaccgccaccagcctgaacagacccaacagactggcccagagaagataccccacccagccctgctag

SEQ ID NO: 21219 - DNA, 2238 bp, Artificial Sequence
  Description of Artificial Sequence: Synthetic coding sequence
atggagctgtgggccccccagagactgccccagaccagaggcaaggccaccgcccccagcaaggaccccgacagaggcttcagaagagacggccaccacagacccgtgccccacagctggcacaacggcgagagattccaccagtggcaggacaacagaggcagcccccagccccagcaggagcccagagccgaccaccagcagcagccccactacgccagcagacccggcgactggcaccagcccgtgagcggcgtggactactacgagggcggctacagaaaccagctgtacagcagacccgtgctgagcagcggcacccccaacctgctgaccggcgagatcccccccagcgtggagacccccgcccagatcgtggagaagttcaccagactgctgtactacggcagaaagaaggaggccctggagtgggccatgaagaaccacctgtggggccacgccctgttcctgagcagcaagatggacccccagacctacagctgggtgatgagcggcttcaccagcaccctggccctgaacgaccccctgcagaccctgttccagctgatgagcggcagaatcccccaggccgccacctgctgcggcgagaagcagtggggcgactggagaccccacctggccgtgatcctgagcaaccaggccggcgaccccgagctgtaccagagagccatcgtggccatcggcgacaccctggccggcaagggcctggtggaggccgcccacttctgctacctgatggcccacgtgcccttcggccactacaccgtgaagaccgaccacctggtgctgctgggcagcagccacagccaggagttcctgaagttcgccaccaccgaggccatccagagaaccgagatcttcgagtactgccagatgctgggcagacccaagagcttcatccccagcttccaggtgtacaagctgctgtacgccagcagactggccgactacggcctggtgagccaggccctgcactactgcgaggccatcggcgccgccgtgctgagccagggcgagagcagccaccccgtgctgctggtggagctgatcaagctggccgagaagctgaagctgagcgaccccctggtgctggagagaagaagcggcgacagagacctggagcccgactggctggcccagctgagaagacagctggagcagaaggtggccggcgacatcggcgacccccaccccaccagaagcgacatcagcggcgccggcggcaccaccaccgagaacaccttctaccaggacttcagcggctgccagggctacagcgaggcccccggctacagaagcgccctgtggctgacccccgagcagacctgcctgctgcagcccagcccccagcagcccttccccctgcagcccggcagctaccccgccggcggcggcgccggccagaccggcacccccagacccttctacagcgtgcccgagacccacctgcccggcaccggcagcagcgtggccgtgaccgaggccaccggcggcaccgtgtgggaggagatgctgcagacccacctgggccccggcgagaacaccgtgagccaggagaccagccagccccccgacggccaggaggtgatcagcaagccccagacccccctggccgccagacccagaagcatcagcgagagcagcgccagcagcgccaaggaggacgagaaggagagcagcgacgaggccgacaagaacagccccagaaacaccgcccagagaggcaagctgggcgacggcaaggagcacaccaagagcagcggcttcggctggttcagctggttcagaagcaagcccaccaagaacgccagccccgccggcgacgaggacagcagcgacagccccgacagcgagcaggagacccccagagccagcagcccccaccaggccggcctgggcctgagcctgacccccagccccgagagcccccccctgcccgacgtgagcgccttcagcagaggcagaggcggcggcgagggcagaggcagcgccagcagcggcggcgccgccgccggcgccggcgtgggcggcctgagcggccccgagagcgtgagcttcgagctgtgcagcaaccccggcgtgctgctgcccccccccgccctgaagggcgccgtgcccctgtacaaccccagccaggtgccccagctgcccaccgccaccagcctgaacagacccaacagactggcccagagaagataccccacccagccctgctag

SEQ ID NO: 21220 - DNA, 456 bp, Artificial Sequence
  Description of Artificial Sequence: Synthetic coding sequence
atggccgccaccgccctgctggaggccggcctggccagagtgctgttctaccccaccctgctgtacaccctgttcagaggcaaggtgcccggcagagcccacagagactggtaccacagaatcgaccccaccgtgctgctgggcgccctgcccctgagaagcctgaccagacaggtgagcagagccggcgagcccggccccctgcccagacccagaagaagcgtgcccgtgggccccctgggcagcccccccagcctgctgagccacctgttcgccagcgccgccggcaccggcagagagagagccagaggcgaccaccacgagagaggcgtgagagacgaggtgcccgtgcagctgttcaccggcgcccagatggagagcagaggcggctgcaagagccacagacaggaccccgtgatccacccccaccaggcctggcccgccggctgcagctag

SEQ ID NO: 21221 - DNA, 3459 bp, Artificial Sequence
  Description of Artificial Sequence: Synthetic coding sequence
atgatcttcagcgacatgaacaccgtgagcggcagccccaaggtgcacccccccaacggcaccagattctacaccttccaggagttcgccgccctgaccaaggagctgaacgcctgcagagagcagctgctggagaaggaggaggagatcagcgagctgaaggccgagagaaacaacaccagactgctgctggagcacctggagtgcctggtgagcagacacgagagaagcctgagaatgaccgtggtgaagagacaggcccagagccccagcggcgtgagcagcgaggtggaggtgctgaaggccctgaagagcctgttcgagcaccacaaggccctggacgagaagatcgtggccctgagagagcagaacgtgcacatccagagaaagatggccagcagcgagggcagcaccgagagcgagcacctggagggcatggagcccggccagaaggtgcacgagaagagactgagcaacggcagcatcgacagcaccgacgagaccagccagatcgtggagctgcaggagctgctggagaagcagaactacgagatggcccagatgaaggagagactggccgccctgagcagcagagtgggcgaggtggagcaggaggccgagaccgccagaaaggacctgatcaagaccgaggagatgaacaccaagtaccagagagacatcagagaggccatggcccagaaggaggacatggaggagagaatcaccaccctggagaagagatacctgagcgcccagagagagagcaccagcatccacgacatgaacgacaagctggagaacgagctggccaacaaggaggccatcctgagacagatggaggagaagaacagacagctgcaggagagactggagctggccgagcagaagctgcagcagaccatgagaaaggccgagaccctgcccgaggtggaggccgagctggcccagagaatcgccgccctgaccaaggccgaggagagacacggcaacatcgaggagagaatgagacacctggagggccagctggaggagaagaaccaggagctgcagagagccagacagagagagaagatgaacgaggagcacaacaagagactgagcgacaccgtggacagactgctgaccgagagcaacgagagactgcagctgcacctgaaggagagaatggccgccctggaggagaagaacgtgctgatccaggagagcgagaccttcagaaagaacctggaggagagcctgcacgacaaggagagactggccgaggagatcgagaagctgagaagcgagctggaccagctgaagatgagaaccggcagcctgatcgagcccaccatccccagaacccacctggacaccagcgccgagctgagatacagcgtgggcagcctggtggacagccagagcgactacagaaccaccaaggtgatcagaagacccagaagaggcagaatgggcgtgagaagagacgagcccaaggtgaagagcctgggcgaccacgagtggaacagaacccagcagatcggcgtgctgagcagccaccccttcgagagcgacaccgagatgagcgacatcgacgacgacgacagagagaccatcttcagcagcatggacctgctgagccccagcggccacagcgacgcccagaccctggccatgatgctgcaggagcagctggacgccatcaacaaggagatcagactgatccaggaggagaaggagagcaccgagctgagagccgaggagatcgagaacagagtggccagcgtgagcctggagggcctgaacctggccagagtgcaccccggcaccagcatcaccgccagcgtgaccgccagcagcctggccagcagcagcccccccagcggccacagcacccccaagctgacccccagaagccccgccagagagatggacagaatgggcgtgatgaccctgcccagcgacctgagaaagcacagaagaaagatcgccgtggtggaggaggacggcagagaggacaaggccaccatcaagtgcgagaccagccccccccccacccccagagccctgagaatgacccacaccctgcccagcagctaccacaacgacgccagaagcagcctgagcgtgagcctggagcccgagagcctgggcctgggcagcgccaacagcagccaggacagcctgcacaaggcccccaagaagaagggcatcaagagcagcatcggcagactgttcggcaagaaggagaaggccagactgggccagctgagaggcttcatggagaccgaggccgccgcccaggagagcctgggcctgggcaagctgggcacccaggccgagaaggacagaagactgaagaagaagcacgagctgctggaggaggccagaagaaagggcctgcccttcgcccagtgggacggccccaccgtggtggcctggctggagctgtggctgggcatgcccgcctggtacgtggccgcctgcagagccaacgtgaagagcggcgccatcatgagcgccctgagcgacaccgagatccagagagagatcggcatcagcaaccccctgcacagactgaagctgagactggccatccaggagatggtgagcctgaccagccccagcgccccccccaccagcagaacccccagcggcaacgtgtgggtgacccacgaggagatggagaacctggccgcccccgccaagaccaaggagagcgaggagggcagctgggcccagaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagagtgcacctgaagatggtggacagcttccacagaaccagcctgcagtacggcatcatgtgcctgaagagactgaactacgacagaaaggagctggagagaagaagagaggccagccagcacgagatcaaggacgtgctggtgtggagcaacgacagagtgatcagatggatccaggccatcggcctgagagagtacgccaacaacatcctggagagcggcgtgcacggcagcctgatcgccctggacgagaacttcgactacagcagcctggccctgctgctgcagatccccacccagaacacccaggccagacagatcctggagagagagtacaacaacctgctggccctgggcaccgagagaagactggacgagagcgacgacaagaacttcagaagaggcagcacctggagaagacagttcccccccagagaggtgcacggcatcagcatgatgcccggcagcagcgagaccctgcccgccggcttcagactgaccaccaccagcggccagagcagaaagatgaccaccgacgtggccagcagcagactgcagagactggacaacagcaccgtgagaacctacagctgctag

SEQ ID NO: 21222 - DNA, 2352 bp, Artificial Sequence
  Description of Artificial Sequence: Synthetic coding sequence
atgagacacctggagggccagctggaggagaagaaccaggagctgcagagagccagacagagagagaagatgaacgaggagcacaacaagagactgagcgacaccgtggacagactgctgaccgagagcaacgagagactgcagctgcacctgaaggagagaatggccgccctggaggagaagaacgtgctgatccaggagagcgagaccttcagaaagaacctggaggagagcctgcacgacaaggagagactggccgaggagatcgagaagctgagaagcgagctggaccagctgaagatgagaaccggcagcctgatcgagcccaccatccccagaacccacctggacaccagcgccgagctgagatacagcgtgggcagcctggtggacagccagagcgactacagaaccaccaaggtgatcagaagacccagaagaggcagaatgggcgtgagaagagacgagcccaaggtgaagagcctgggcgaccacgagtggaacagaacccagcagatcggcgtgctgagcagccaccccttcgagagcgacaccgagatgagcgacatcgacgacgacgacagagagaccatcttcagcagcatggacctgctgagccccagcggccacagcgacgcccagaccctggccatgatgctgcaggagcagctggacgccatcaacaaggagatcagactgatccaggaggagaaggagagcaccgagctgagagccgaggagatcgagaacagagtggccagcgtgagcctggagggcctgaacctggccagagtgcaccccggcaccagcatcaccgccagcgtgaccgccagcagcctggccagcagcagcccccccagcggccacagcacccccaagctgacccccagaagccccgccagagagatggacagaatgggcgtgatgaccctgcccagcgacctgagaaagcacagaagaaagatcgccgtggtggaggaggacggcagagaggacaaggccaccatcaagtgcgagaccagccccccccccacccccagagccctgagaatgacccacaccctgcccagcagctaccacaacgacgccagaagcagcctgagcgtgagcctggagcccgagagcctgggcctgggcagcgccaacagcagccaggacagcctgcacaaggcccccaagaagaagggcatcaagagcagcatcggcagactgttcggcaagaaggagaaggccagactgggccagctgagaggcttcatggagaccgaggccgccgcccaggagagcctgggcctgggcaagctgggcacccaggccgagaaggacagaagactgaagaagaagcacgagctgctggaggaggccagaagaaagggcctgcccttcgcccagtgggacggccccaccgtggtggcctggctggagctgtggctgggcatgcccgcctggtacgtggccgcctgcagagccaacgtgaagagcggcgccatcatgagcgccctgagcgacaccgagatccagagagagatcggcatcagcaaccccctgcacagactgaagctgagactggccatccaggagatggtgagcctgaccagccccagcgccccccccaccagcagaacctgccccgtgttcctgcagaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagagtgcacctgaagatggtggacagcttccacagaaccagcctgcagtacggcatcatgtgcctgaagagactgaactacgacagaaaggagctggagagaagaagagaggccagccagcacgagatcaaggacgtgctggtgtggagcaacgacagagtgatcagatggatccaggccatcggcctgagagagtacgccaacaacatcctggagagcggcgtgcacggcagcctgatcgccctggacgagaacttcgactacagcagcctggccctgctgctgcagatccccacccagaacacccaggccagacagatcctggagagagagtacaacaacctgctggccctgggcaccgagagaagactggacgagagcgacgacaagaacttcagaagaggcagcacctggagaagacagttcccccccagagaggtgcacggcatcagcatgatgcccggcagcagcgagaccctgcccgccggcttcagactgaccaccaccagcggccagagcagaaagatgaccaccgacgacggcgtgttcagcgtgtacagcacctag

SEQ ID NO: 21223 - DNA, 3756 bp, Artificial Sequence
  Description of Artificial Sequence: Synthetic coding sequence
atgatgtgcgaggtgatgcccaccatcaacgaggacacccccatgagccagagaggcagccagagcagcggcagcgacagcgacagccacttcgagcagctgatggtgaacatgctggacgagagagacagactgctggacaccctgagagagacccaggagagcctgagcctggcccagcagagactgcaggacgtgatctacgacagagacagcctgcagagacagctgaacagcgccctgccccaggacatcgagagcctgaccggcggcctggccggcagcaagggcgccgacccccccgagttcgccgccctgaccaaggagctgaacgcctgcagagagcagctgctggagaaggaggaggagatcagcgagctgaaggccgagagaaacaacaccagactgctgctggagcacctggagtgcctggtgagcagacacgagagaagcctgagaatgaccgtggtgaagagacaggcccagagccccagcggcgtgagcagcgaggtggaggtgctgaaggccctgaagagcctgttcgagcaccacaaggccctggacgagaaggtgagagagagactgagagtgagcctggagagagtgagcgccctggaggaggagctggccgccgccaaccaggagatcgtggccctgagagagcagaacgtgcacatccagagaaagatggccagcagcgagggcagcaccgagagcgagcacctggagggcatggagcccggccagaaggtgcacgagaagagactgagcaacggcagcatcgacagcaccgacgagaccagccagatcgtggagctgcaggagctgctggagaagcagaactacgagatggcccagatgaaggagagactggccgccctgagcagcagagtgggcgaggtggagcaggaggccgagaccgccagaaaggacctgatcaagaccgaggagatgaacaccaagtaccagagagacatcagagaggccatggcccagaaggaggacatggaggagagaatcaccaccctggagaagagatacctgagcgcccagagagagagcaccagcatccacgacatgaacgacaagctggagaacgagctggccaacaaggaggccatcctgagacagatggaggagaagaacagacagctgcaggagagactggagctggccgagcagaagctgcagcagaccatgagaaaggccgagaccctgcccgaggtggaggccgagctggcccagagaatcgccgccctgaccaaggccgaggagagacacggcaacatcgaggagagaatgagacacctggagggccagctggaggagaagaaccaggagctgcagagagccagacagagagagaagatgaacgaggagcacaacaagagactgagcgacaccgtggacagactgctgaccgagagcaacgagagactgcagctgcacctgaaggagagaatggccgccctggaggagaagaacgtgctgatccaggagagcgagaccttcagaaagaacctggaggagagcctgcacgacaaggagagactggccgaggagatcgagaagctgagaagcgagctggaccagctgaagatgagaaccggcagcctgatcgagcccaccatccccagaacccacctggacaccagcgccgagctgagatacagcgtgggcagcctggtggacagccagagcgactacagaaccaccaaggtgatcagaagacccagaagaggcagaatgggcgtgagaagagacgagcccaaggtgaagagcctgggcgaccacgagtggaacagaacccagcagatcggcgtgctgagcagccaccccttcgagagcgacaccgagatgagcgacatcgacgacgacgacagagagaccatcttcagcagcatggacctgctgagccccagcggccacagcgacgcccagaccctggccatgatgctgcaggagcagctggacgccatcaacaaggagatcagactgatccaggaggagaaggagagcaccgagctgagagccgaggagatcgagaacagagtggccagcgtgagcctggagggcctgaacctggccagagtgcaccccggcaccagcatcaccgccagcgtgaccgccagcagcctggccagcagcagcccccccagcggccacagcacccccaagctgacccccagaagccccgccagagagatggacagaatgggcgtgatgaccctgcccagcgacctgagaaagcacagaagaaagatcgccgtggtggaggaggacggcagagaggacaaggccaccatcaagtgcgagaccagccccccccccacccccagagccctgagaatgacccacaccctgcccagcagctaccacaacgacgccagaagcagcctgagcgtgagcctggagcccgagagcctgggcctgggcagcgccaacagcagccaggacagcctgcacaaggcccccaagaagaagggcatcaagagcagcatcggcagactgttcggcaagaaggagaaggccagactgggccagctgagaggcttcatggagaccgaggccgccgcccaggagagcctgggcctgggcaagctgggcacccaggccgagaaggacagaagactgaagaagaagcacgagctgctggaggaggccagaagaaagggcctgcccttcgcccagtgggacggccccaccgtggtggcctggctggagctgtggctgggcatgcccgcctggtacgtggccgcctgcagagccaacgtgaagagcggcgccatcatgagcgccctgagcgacaccgagatccagagagagatcggcatcagcaaccccctgcacagactgaagctgagactggccatccaggagatggtgagcctgaccagccccagcgccccccccaccagcagaacccccagcggcaacgtgtgggtgacccacgaggagatggagaacctggccgcccccgccaagaccaaggagagcgaggagggcagctgggcccagaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagagtgcacctgaagatggtggacagcttccacagaaccagcctgcagtacggcatcatgtgcctgaagagactgaactacgacagaaaggagctggagagaagaagagaggccagccagcacgagatcaaggacgtgctggtgtggagcaacgacagagtgatcagatggatccaggccatcggcctgagagagtacgccaacaacatcctggagagcggcgtgcacggcagcctgatcgccctggacgagaacttcgactacagcagcctggccctgctgctgcagatccccacccagaacacccaggccagacagatcctggagagagagtacaacaacctgctggccctgggcaccgagagaagactggacgagagcgacgacaagaacttcagaagaggcagcacctggagaagacagttcccccccagagaggtgcacggcatcagcatgatgcccggcagcagcgagaccctgcccgccggcttcagactgaccaccaccagcggccagagcagaaagatgaccaccgacgtggccagcagcagactgcagagactggacaacagcaccgtgagaacctacagctgctag

SEQ ID NO: 21224 - DNA, 3699 bp, Artificial Sequence
  Description of Artificial Sequence: Synthetic coding sequence
atgatgtgcgaggtgatgcccaccatcaacgaggacacccccatgagccagagaggcagccagagcagcggcagcgacagcgacagccacttcgagcagctgatggtgaacatgctggacgagagagacagactgctggacaccctgagagagacccaggagagcctgagcctggcccagcagagactgcaggacgtgatctacgacagagacagcctgcagagacagctgaacagcgccctgccccaggagttcgccgccctgaccaaggagctgaacgcctgcagagagcagctgctggagaaggaggaggagatcagcgagctgaaggccgagagaaacaacaccagactgctgctggagcacctggagtgcctggtgagcagacacgagagaagcctgagaatgaccgtggtgaagagacaggcccagagccccagcggcgtgagcagcgaggtggaggtgctgaaggccctgaagagcctgttcgagcaccacaaggccctggacgagaaggtgagagagagactgagagtgagcctggagagagtgagcgccctggaggaggagctggccgccgccaaccaggagatcgtggccctgagagagcagaacgtgcacatccagagaaagatggccagcagcgagggcagcaccgagagcgagcacctggagggcatggagcccggccagaaggtgcacgagaagagactgagcaacggcagcatcgacagcaccgacgagaccagccagatcgtggagctgcaggagctgctggagaagcagaactacgagatggcccagatgaaggagagactggccgccctgagcagcagagtgggcgaggtggagcaggaggccgagaccgccagaaaggacctgatcaagaccgaggagatgaacaccaagtaccagagagacatcagagaggccatggcccagaaggaggacatggaggagagaatcaccaccctggagaagagatacctgagcgcccagagagagagcaccagcatccacgacatgaacgacaagctggagaacgagctggccaacaaggaggccatcctgagacagatggaggagaagaacagacagctgcaggagagactggagctggccgagcagaagctgcagcagaccatgagaaaggccgagaccctgcccgaggtggaggccgagctggcccagagaatcgccgccctgaccaaggccgaggagagacacggcaacatcgaggagagaatgagacacctggagggccagctggaggagaagaaccaggagctgcagagagccagacagagagagaagatgaacgaggagcacaacaagagactgagcgacaccgtggacagactgctgaccgagagcaacgagagactgcagctgcacctgaaggagagaatggccgccctggaggagaagaacgtgctgatccaggagagcgagaccttcagaaagaacctggaggagagcctgcacgacaaggagagactggccgaggagatcgagaagctgagaagcgagctggaccagctgaagatgagaaccggcagcctgatcgagcccaccatccccagaacccacctggacaccagcgccgagctgagatacagcgtgggcagcctggtggacagccagagcgactacagaaccaccaaggtgatcagaagacccagaagaggcagaatgggcgtgagaagagacgagcccaaggtgaagagcctgggcgaccacgagtggaacagaacccagcagatcggcgtgctgagcagccaccccttcgagagcgacaccgagatgagcgacatcgacgacgacgacagagagaccatcttcagcagcatggacctgctgagccccagcggccacagcgacgcccagaccctggccatgatgctgcaggagcagctggacgccatcaacaaggagatcagactgatccaggaggagaaggagagcaccgagctgagagccgaggagatcgagaacagagtggccagcgtgagcctggagggcctgaacctggccagagtgcaccccggcaccagcatcaccgccagcgtgaccgccagcagcctggccagcagcagcccccccagcggccacagcacccccaagctgacccccagaagccccgccagagagatggacagaatgggcgtgatgaccctgcccagcgacctgagaaagcacagaagaaagatcgccgtggtggaggaggacggcagagaggacaaggccaccatcaagtgcgagaccagccccccccccacccccagagccctgagaatgacccacaccctgcccagcagctaccacaacgacgccagaagcagcctgagcgtgagcctggagcccgagagcctgggcctgggcagcgccaacagcagccaggacagcctgcacaaggcccccaagaagaagggcatcaagagcagcatcggcagactgttcggcaagaaggagaaggccagactgggccagctgagaggcttcatggagaccgaggccgccgcccaggagagcctgggcctgggcaagctgggcacccaggccgagaaggacagaagactgaagaagaacaccagcggccacgagctgctggaggaggccagaagaaagggcctgcccttcgcccagtgggacggccccaccgtggtggcctggctggagctgtggctgggcatgcccgcctggtacgtggccgcctgcagagccaacgtgaagagcggcgccatcatgagcgccctgagcgacaccgagatccagagagagatcggcatcagcaaccccctgcacagactgaagctgagactggccatccaggagatggtgagcctgaccagccccagcgccccccccaccagcagaacccccagcggcaacgtgtgggtgacccacgaggagatggagaacctggccgcccccgccaagaccaaggagagcgaggagggcagctgggcccagtgccccgtgttcctgcagaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagagtgcacctgaagatggtggacagcttccacagaaccagcctgcagtacggcatcatgtgcctgaagagactgaactacgacagaaaggagctggagagaagaagagaggccagccagcacgagatcaaggacgtgctggtgtggagcaacgacagagtgatcagatggatccaggccatcggcctgagagagtacgccaacaacatcctggagagcggcgtgcacggcagcctgatcgccctggacgagaacttcgactacagcagcctggccctgctgctgcagatccccacccagaacacccaggccagacagatcctggagagagagtacaacaacctgctggccctgggcaccgagagaagactggacgagagcgacgacaagaacttcagaagaggcagcacctggagaagacagttcccccccagagaggtgcacggcatcagcatgatgcccggcagcagcgagaccctgcccgccggcttcagactgaccaccaccagcggccagagcagaaagatgaccaccgacgacggcgtgttcagcgtgtacagcacctag

SEQ ID NO: 21225 - DNA, 3633 bp, Artificial Sequence
  Description of Artificial Sequence: Synthetic coding sequence
atgatgtgcgaggtgatgcccaccatcaacgaggacacccccatgagccagagaggcagccagagcagcggcagcgacagcgacagccacttcgagcagctgatggtgaacatgctggacgagagagacagactgctggacaccctgagagagacccaggagagcctgagcctggcccagcagagactgcaggacgtgatctacgacagagacagcctgcagagacagctgaacagcgccctgccccaggacatcgagagcctgaccggcggcctggccggcagcaagggcgccgacccccccgagttcgccgccctgaccaaggagctgaacgcctgcagagagcagctgctggagaaggaggaggagatcagcgagctgaaggccgagagaaacaacaccagactgctgctggagcacctggagtgcctggtgagcagacacgagagaagcctgagaatgaccgtggtgaagagacaggcccagagccccagcggcgtgagcagcgaggtggaggtgctgaaggccctgaagagcctgttcgagcaccacaaggccctggacgagaaggtgagagagagactgagagtgagcctggagagagtgagcgccctggaggaggagctggccgccgccaaccaggagatcgtggccctgagagagcagaacgtgcacatccagagaaagatggccagcagcgagggcagcaccgagagcgagcacctggagggcatggagcccggccagaaggtgcacgagaagagactgagcaacggcagcatcgacagcaccgacgagaccagccagatcgtggagctgcaggagctgctggagaagcagaactacgagatggcccagatgaaggagagactggccgccctgagcagcagagtgggcgaggtggagcaggaggccgagaccgccagaaaggacctgatcaagaccgaggagatgaacaccaagtaccagagagacatcagagaggccatggcccagaaggaggacatggaggagagaatcaccaccctggagaagagatacctgagcgcccagagagagagcaccagcatccacgacatgaacgacaagctggagaacgagctggccaacaaggaggccatcctgagacagatggaggagaagaacagacagctgcaggagagactggagctggccgagcagaagctgcagcagaccatgagaaaggccgagaccctgcccgaggtggaggccgagctggcccagagaatcgccgccctgaccaaggccgaggagagacacggcaacatcgaggagagaatgagacacctggagggccagctggaggagaagaaccaggagctgcagagagccagacagagagagaagatgaacgaggagcacaacaagagactgagcgacaccgtggacagactgctgaccgagagcaacgagagactgcagctgcacctgaaggagagaatggccgccctggaggagaagaacgtgctgatccaggagagcgagaccttcagaaagaacctggaggagagcctgcacgacaaggagagactggccgaggagatcgagaagctgagaagcgagctggaccagctgaagatgagaaccggcagcctgatcgagcccaccatccccagaacccacctggacaccagcgccgagctgagatacagcgtgggcagcctggtggacagccagagcgactacagaaccaccaaggtgatcagaagacccagaagaggcagaatgggcgtgagaagagacgagcccaaggtgaagagcctgggcgaccacgagtggaacagaacccagcagatcggcgtgctgagcagccaccccttcgagagcgacaccgagatgagcgacatcgacgacgacgacagagagaccatcttcagcagcatggacctgctgagccccagcggccacagcgacgcccagaccctggccatgatgctgcaggagcagctggacgccatcaacaaggagatcagactgatccaggaggagaaggagagcaccgagctgagagccgaggagatcgagaacagagtggccagcgtgagcctggagggcctgaacctggccagagtgcaccccggcaccagcatcaccgccagcgtgaccgccagcagcctggccagcagcagcccccccagcggccacagcacccccaagctgacccccagaagccccgccagagagatggacagaatgggcgtgatgaccctgcccagcgacctgagaaagcacagaagaaagatcgccgtggtggaggaggacggcagagaggacaaggccaccatcaagtgcgagaccagccccccccccacccccagagccctgagaatgacccacaccctgcccagcagctaccacaacgacgccagaagcagcctgagcgtgagcctggagcccgagagcctgggcctgggcagcgccaacagcagccaggacagcctgcacaaggcccccaagaagaagggcatcaagagcagcatcggcagactgttcggcaagaaggagaaggccagactgggccagctgagaggcttcatggagaccgaggccgccgcccaggagagcctgggcctgggcaagctgggcacccaggccgagaaggacagaagactgaagaagaagcacgagctgctggaggaggccagaagaaagggcctgcccttcgcccagtgggacggccccaccgtggtggcctggctggagctgtggctgggcatgcccgcctggtacgtggccgcctgcagagccaacgtgaagagcggcgccatcatgagcgccctgagcgacaccgagatccagagagagatcggcatcagcaaccccctgcacagactgaagctgagactggccatccaggagatggtgagcctgaccagccccagcgccccccccaccagcagaacccccagcggcaacgtgtgggtgacccacgaggagatggagaacctggccgcccccgccaagaccaaggagagcgaggagggcagctgggcccagtgccccgtgttcctgcagaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagagtgcacctgaagatggtggacagcttccacagaaccagcctgcagtacggcatcatgtgcctgaagagactgaactacgacagaaaggagctggagagaagaagagaggccagccagcacgagatcaaggacgtgctggtgtggagcaacgacagagtgatcagatggatccaggccatcggcctgagagagtacgccaacaacatcctggagagcggcgtgcacggcagcctgatcgccctggacgagaacttcgactacagcagcctggccctgctgctgcagatccccacccagaacacccaggccagcagattcctgaaggagaacaccatcaccagctggccctgggagctgaagggcgactggatgaaggtgatgaccagaaccagcgacgtggaccagcccggcgagggcagcttcctgctggtgaagtacatggagagcgcctag

SEQ ID NO: 21226 - DNA, 3711 bp, Artificial Sequence
  Description of Artificial Sequence: Synthetic coding sequence
atgatgtgcgaggtgatgcccaccatcaacgaggacacccccatgagccagagaggcagccagagcagcggcagcgacagcgacagccacttcgagcagctgatggtgaacatgctggacgagagagacagactgctggacaccctgagagagacccaggagagcctgagcctggcccagcagagactgcaggacgtgatctacgacagagacagcctgcagagacagctgaacagcgccctgccccaggacatcgagagcctgaccggcggcctggccggcagcaagggcgccgacccccccgagttcgccgccctgaccaaggagctgaacgcctgcagagagcagctgctggagaaggaggaggagatcagcgagctgaaggccgagagaaacaacaccagactgctgctggagcacctggagtgcctggtgagcagacacgagagaagcctgagaatgaccgtggtgaagagacaggcccagagccccagcggcgtgagcagcgaggtggaggtgctgaaggccctgaagagcctgttcgagcaccacaaggccctggacgagaaggtgagagagagactgagagtgagcctggagagagtgagcgccctggaggaggagctggccgccgccaaccaggagatcgtggccctgagagagcagaacgtgcacatccagagaaagatggccagcagcgagggcagcaccgagagcgagcacctggagggcatggagcccggccagaaggtgcacgagaagagactgagcaacggcagcatcgacagcaccgacgagaccagccagatcgtggagctgcaggagctgctggagaagcagaactacgagatggcccagatgaaggagagactggccgccctgagcagcagagtgggcgaggtggagcaggaggccgagaccgccagaaaggacctgatcaagaccgaggagatgaacaccaagtaccagagagacatcagagaggccatggcccagaaggaggacatggaggagagaatcaccaccctggagaagagatacctgagcgcccagagagagagcaccagcatccacgacatgaacgacaagctggagaacgagctggccaacaaggaggccatcctgagacagatggaggagaagaacagacagctgcaggagagactggagctggccgagcagaagctgcagcagaccatgagaaaggccgagaccctgcccgaggtggaggccgagctggcccagagaatcgccgccctgaccaaggccgaggagagacacggcaacatcgaggagagaatgagacacctggagggccagctggaggagaagaaccaggagctgcagagagccagacagagagagaagatgaacgaggagcacaacaagagactgagcgacaccgtggacagactgctgaccgagagcaacgagagactgcagctgcacctgaaggagagaatggccgccctggaggagaagaacgtgctgatccaggagagcgagaccttcagaaagaacctggaggagagcctgcacgacaaggagagactggccgaggagatcgagaagctgagaagcgagctggaccagctgaagatgagaaccggcagcctgatcgagcccaccatccccagaacccacctggacaccagcgccgagctgagatacagcgtgggcagcctggtggacagccagagcgactacagaaccaccaaggtgatcagaagacccagaagaggcagaatgggcgtgagaagagacgagcccaaggtgaagagcctgggcgaccacgagtggaacagaacccagcagatcggcgtgctgagcagccaccccttcgagagcgacaccgagatgagcgacatcgacgacgacgacagagagaccatcttcagcagcatggacctgctgagccccagcggccacagcgacgcccagaccctggccatgatgctgcaggagcagctggacgccatcaacaaggagatcagactgatccaggaggagaaggagagcaccgagctgagagccgaggagatcgagaacagagtggccagcgtgagcctggagggcctgaacctggccagagtgcaccccggcaccagcatcaccgccagcgtgaccgccagcagcctggccagcagcagcccccccagcggccacagcacccccaagctgacccccagaagccccgccagagagatggacagaatgggcgtgatgaccctgcccagcgacctgagaaagcacagaagaaagatcgccgtggtggaggaggacggcagagaggacaaggccaccatcaagtgcgagaccagccccccccccacccccagagccctgagaatgacccacaccctgcccagcagctaccacaacgacgccagaagcagcctgagcgtgagcctggagcccgagagcctgggcctgggcagcgccaacagcagccaggacagcctgcacaaggcccccaagaagaagggcatcaagagcagcatcggcagactgttcggcaagaaggagaaggccagactgggccagctgagaggcttcatggagaccgaggccgccgcccaggagagcctgggcctgggcaagctgggcacccaggccgagaaggacagaagactgaagaagaagcacgagctgctggaggaggccagaagaaagggcctgcccttcgcccagtgggacggccccaccgtggtggcctggctggagctgtggctgggcatgcccgcctggtacgtggccgcctgcagagccaacgtgaagagcggcgccatcatgagcgccctgagcgacaccgagatccagagagagatcggcatcagcaaccccctgcacagactgaagctgagactggccatccaggagatggtgagcctgaccagccccagcgccccccccaccagcagaaccaaggagagcgaggagggcagctgggcccagtgccccgtgttcctgcagaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagagtgcacctgaagatggtggacagcttccacagaaccagcctgcagtacggcatcatgtgcctgaagagactgaactacgacagaaaggagctggagagaagaagagaggccagccagcacgagatcaaggacgtgctggtgtggagcaacgacagagtgatcagatggatccaggccatcggcctgagagagtacgccaacaacatcctggagagcggcgtgcacggcagcctgatcgccctggacgagaacttcgactacagcagcctggccctgctgctgcagatccccacccagaacacccaggccagacagatcctggagagagagtacaacaacctgctggccctgggcaccgagagaagactggacgagagcgacgacaagaacttcagaagaggcagcacctggagaagacagttcccccccagagaggtgcacggcatcagcatgatgcccggcagcagcgagaccctgcccgccggcttcagactgaccaccaccagcggccagagcagaaagatgaccaccgacgtggccagcagcagactgcagagactggacaacagcaccgtgagaacctacagctgctag

SEQ ID NO: 21227 - DNA, 1638 bp, Artificial Sequence
  Description of Artificial Sequence: Synthetic coding sequence
atgcagagcatcagcaagcagaccctgcagatggacgtgaacaagctgaacatcaccctgctgagaatcttcagacagggcgtggccgccgccctgggcctgctgccccagcaggtgcacatcaacagactgatcggcaagaagaacagcatcgagctgttcgtgagccccatcaacagaaagaccggcatcagcgacgccctgcccagcgaggaggtgctgagaagcctgaacatcaacgtgctgcaccagagcctgagccagttcggcatcaccgaggtgagccccgagaagaacgtgctgcagggccagcacgaggccgacaagatctggagcaaggagggcttctacgccgtggtgatcttcctgagcatcttcgtgatcatcgtgacctgcctgatgatcctgtacagactgaaggagagattccagctgagcctgagacaggacaaggagaagaaccaggagatccacctgagccccatcaccctgcagcccgccctgagcgaggccaagaccgtgcacagcatggtgcagcccgagcaggcccccaaggtgctgaacgtggtggtggacccccagggcagaggcgcccccgagatcaaggccaccaccgccaccagcgtgtgccccagccccttcaagatgaagcccatcggcctgcaggagagaagaggcagcaacgtgagcctgaccctggacatgagcagcctgggcaacatcgagcccttcgtgagcatccccacccccagagagaaggtggccatggagtacctgcagagcgccagcagaatcctgaccagaagccagctgagagacgtggtggccagcagccacctgctgcagagcgagttcatggagatccccatgaacttcgtggaccccaaggagatcgacatccccagacacggcaccaagaacagatacaagaccatcctgcccaaccccctgagcagagtgtgcctgagacccaagaacgtgaccgacagcctgagcacctacatcaacgccaactacatcagaggctacagcggcaaggagaaggccttcatcgccacccagggccccatgatcaacaccgtggacgacttctggcagatggtgtggcaggaggacagccccgtgatcgtgatgatcaccaagctgaaggagaagaacgagaagtgcgtgctgtactggcccgagaagagaggcatctacggcaaggtggaggtgctggtgatcagcgtgaacgagtgcgacaactacaccatcagaaacctggtgctgaagcagggcagccacacccagcacgtgaagcactactggtacaccagctggcccgaccacaagacccccgacagcgcccagcccctgctgcagctgatgctggacgtggaggaggacagactggccagccagggcagaggccccgtggtggtgcactgcagcgccggcatcggcagaaccggctgcttcatcgccaccagcatcggctgccagcagctgaaggaggagggcgtggtggacgccctgagcatcgtgtgccagctgagaatggacagaggcggcatggtgcagaccagcgagcagtacgagttcgtgcaccacgccctgtgcctgtacgagagcagactgagcgccgagaccgtgcagtag

SEQ ID NO: 21228 - DNA, 606 bp, Artificial Sequence
  Description of Artificial Sequence: Synthetic coding sequence
atggccgccaccgccctgctggaggccggcctggccagagtgctgttctaccccaccctgctgtacaccctgttcagaggcaaggtgcccggcagagcccacagagactggtaccacagaatcgaccccaccgtgctgctgggcgccctgcccctgagaagcctgaccagacagctggtgcaggacgagaacgtgagaggcgtgatcaccatgaacgaggagtacgagaccagattcctgtgcaacagcagccaggagtggaagagactgggcgtggagcagctgagactgagcaccgtggacatgaccggcatccccaccctggacaacctgcagaagggcgtgcagttcgccctgaagtaccagagcctgggccagtgcgtgtacgtgcactgcaaggccggcagaagcagaagcgccaccatggtggccgcctacctgatccaggtgcacaagtggagccccgaggaggccgtgagagccatcgccaagatcagaagctacatccacatcagacccggccagctggacgtgctgaaggagttccacaagcagatcaccgccagagccaccaaggacggcaccttcgtgatcagcaagacctag

SEQ ID NO: 21229 - DNA, 2280 bp, Artificial Sequence
  Description of Artificial Sequence: Synthetic coding sequence
atggccggcagcaagcagagccaccaggaggccgtgaagagacacctgtacttcctgcagctgaagatggacatctgcgagggcagactgacctgccccctgaacagcgccgtggtgctggccagctacgccgtgcagagccacttcggcgactacaacagcagcatccaccaccccggctacctgagcgacagccacttcatccccgaccagaacgaggacttcctgaccaaggtggagagcctgcacgagcagcacagcggcctgaagcagagcgaggccgagagctgctacatcaacatcgccagaaccctggacttctacggcgtggagctgcacagcggcagagacctgcacaacctggacctgatgatcggcatcgccagcgccggcgtggccgtgtacagaaagtacatctgcaccagcttctacccctgggtgaacatcctgaagatcagcttcaagagaaagaagttcttcatccaccagagacagaagcaggccgagagcagagagcacatcgtggccttcaacatgctgaactacagaagctgcaagaacctgtggaagagctgcgtggagcaccacaccttcttccaggccaagaagctgctgccccaggagaagaacgtgctgagccagtactggaccatgggcagcagaaacaccaagaagagaagccccagactgagacacgagatcagaaagcccagacacagcagcgccgacaacctggccaacgagatgacctacatcaccgagaccgaggacgtgttctacacctacaagggcagcctggccccccaggacagcgacagcgaggtgagccagaacagaagcccccaccaggagagcctgagcgagaacaaccccgcccagagctacctgacccagaagagcagcagcagcgtgagccccagcagcaacgcccccggcagctgcagccccgacggcgtggaccagcagctgctggacgacttccacagagtgaccaagggcggcagcaccgaggacgccagccagtactactgcgacaagaacgacaacggcgacagctacctggtgctgatcagaatcacccccgacgaggacggcaagttcggcttcaacctgaagggcggcgtggaccagaagatgcccctggtggtgagcagaatcaaccccgagagccccgccgacacctgcatccccaagctgaacgagggcgaccagatcgtgctgatcaacggcagagacatcagcgagcacacccacgaccaggtggtgatgttcatcaaggccagcagagagagccacagcagagagctggccctggtgatcagaagaagagccgtgagaagcttcgccgacttcaagagcgaggacgagctgaaccagctgttccccgaggccatcttccccatgtgccccgagggcggcgacaccctggagggcagcatggcccagctgaagaagggcctggagagcggcaccgtgctgatccagttcgagcagctgtacagaaagaagcccggcctggccatcaccttcgccaagctgccccagaacctggacaagaacagatacaaggacgtgctgccctacgacaccaccagagtgctgctgcagggcaacgaggactacatcaacgccagctacgtgaacatggagatccccgccgccaacctggtgaacaagtacatcgccacccagggccccctgccccacacctgcgcccagttctggcaggtggtgtgggaccagaagctgagcctgatcgtgatgctgaccaccctgaccgagagaggcagaaccaagtgccaccagtactggcccgacccccccgacgtgatgaaccacggcggcttccacatccagtgccagagcgaggactgcaccatcgcctacgtgagcagagagatgctggtgaccaacacccagaccggcgaggagcacaccgtgacccacctgcagtacgtggcctggcccgaccacggcgtgcccgacgacagcagcgacttcctggagttcgtgaactacgtgagaagcctgagagtggacagcgagcccgtgctggtgcactgcagcgccggcatcggcagaaccggcgtgctggtgaccatggagaccgccatgtgcctgaccgagagaaacctgcccatctaccccctggacatcgtgagaaagatgagagaccagagagccatgatggtgcagaccagcagccagtacaagttcgtgtgcgaggccatcctgagagtgtacgaggagggcctggtgcagatgctggaccccagctag

SEQ ID NO: 21230 - DNA, 2742 bp, Artificial Sequence
  Description of Artificial Sequence: Synthetic coding sequence
atgaccagcagactgagagccctgggcggcagaatcaacaacatcagaaccagcgagctgcccaaggagaagaccagaagcgaggtgatctgcagcatccacttcctggacggcgtggtgcagaccttcaaggtgaccaagcaggacaccggccaggtgctgctggacatggtgcacaaccacctgggcgtgaccgagaaggagtacttcggcctgcagcacgacgacgacagcgtggacagccccagatggctggaggccagcaaggccatcagaaagcagctgaagggcggcttcccctgcaccctgcacttcagagtgagattcttcatccccgaccccaacaccctgcagcaggagcagaccagacacctgtacttcctgcagctgaagatggacatctgcgagggcagactgacctgccccctgaacagcgccgtggtgctggccagctacgccgtgcagagccacttcggcgactacaacagcagcatccaccaccccggctacctgagcgacagccacttcatccccgaccagaacgaggacttcctgaccaaggtggagagcctgcacgagcagcacagcggcctgaagcagagcgaggccgagagctgctacatcaacatcgccagaaccctggacttctacggcgtggagctgcacagcggcagagacctgcacaacctggacctgatgatcggcatcgccagcgccggcgtggccgtgtacagaaagtacatctgcaccagcttctacccctgggtgaacatcctgaagatcagcttcaagagaaagaagttcttcatccaccagagacagaagcaggccgagagcagagagcacatcgtggccttcaacatgctgaactacagaagctgcaagaacctgtggaagagctgcgtggagcaccacaccttcttccaggccaagaagctgctgccccaggagaagaacgtgctgagccagtactggaccatgggcagcagaaacaccaagaagagcgtgaacaaccagtactgcaagaaggtgatcggcggcatggtgtggaaccccgccatgagaagaagcctgagcgtggagcacctggagaccaagagcctgcccagcagaagcccccccatcacccccaactggagaagccccagactgagacacgagatcagaaagcccagacacagcagcgccgacaacctggccaacgagatgacctacatcaccgagaccgaggacgtgttctacacctacaagggcagcctggccccccaggacagcgacagcgaggtgagccagaacagaagcccccaccaggagagcctgagcgagaacaaccccgcccagagctacctgacccagaagagcagcagcagcgtgagccccagcagcaacgcccccggcagctgcagccccgacggcgtggaccagcagctgctggacgacttccacagagtgaccaagggcggcagcaccgaggacgccagccagtactactgcgacaagaacgacaacggcgacagctacctggtgctgatcagaatcacccccgacgaggacggcaagttcggcttcaacctgaagggcggcgtggaccagaagatgcccctggtggtgagcagaatcaaccccgagagccccgccgacacctgcatccccaagctgaacgagggcgaccagatcgtgctgatcaacggcagagacatcagcgagcacacccacgaccaggtggtgatgttcatcaaggccagcagagagagccacagcagagagctggccctggtgatcagaagaagagccgtgagaagcttcgccgacttcaagagcgaggacgagctgaaccagctgttccccgaggccatcttccccatgtgccccgagggcggcgacaccctggagggcagcatggcccagctgaagaagggcctggagagcggcaccgtgctgatccagttcgagcagctgtacagaaagaagcccggcctggccatcaccttcgccaagctgccccagaacctggacaagaacagatacaaggacgtgctgccctacgacaccaccagagtgctgctgcagggcaacgaggactacatcaacgccagctacgtgaacatggagatccccgccgccaacctggtgaacaagtacatcgccacccagggccccctgccccacacctgcgcccagttctggcaggtggtgtgggaccagaagctgagcctgatcgtgatgctgaccaccctgaccgagagaggcagaaccaagtgccaccagtactggcccgacccccccgacgtgatgaaccacggcggcttccacatccagtgccagagcgaggactgcaccatcgcctacgtgagcagagagatgctggtgaccaacacccagaccggcgaggagcacaccgtgacccacctgcagtacgtggcctggcccgaccacggcgtgcccgacgacagcagcgacttcctggagttcgtgaactacgtgagaagcctgagagtggacagcgagcccgtgctggtgcactgcagcgccggcatcggcagaaccggcgtgctggtgaccatggagaccgccatgtgcctgaccgagagaaacctgcccatctaccccctggacatcgtgagaaagatgagagaccagagagccatgatggtgcagaccagcagccagtacaagttcgtgtgcgaggccatcctgagagtgtacgaggagggcctggtgcagatgctggaccccagctag

SEQ ID NO: 21231 - DNA, 1146 bp, Artificial Sequence
  Description of Artificial Sequence: Synthetic coding sequence
atgcccctggtggtgagcagaatcaaccccgagagccccgccgacacctgcatccccaagctgaacgagggcgaccagatcgtgctgatcaacggcagagacatcagcgagcacacccacgaccaggtggtgatgttcatcaaggccagcagagagagccacagcagagagctggccctggtgatcagaagaagagccgtgagaagcttcgccgacttcaagagcgaggacgagctgaaccagctgttccccgaggccatcttccccatgtgccccgagggcggcgacaccctggagggcagcatggcccagctgaagaagggcctggagagcggcaccgtgctgatccagttcgagcagctgtacagaaagaagcccggcctggccatcaccttcgccaagctgccccagaacctggacaagaacagatacaaggacgtgctgccctacgacaccaccagagtgctgctgcagggcaacgaggactacatcaacgccagctacgtgaacatggagatccccgccgccaacctggtgaacaagtacatcgccacccagggccccctgccccacacctgcgcccagttctggcaggtggtgtgggaccagaagctgagcctgatcgtgatgctgaccaccctgaccgagagaggcagaaccaagtgccaccagtactggcccgacccccccgacgtgatgaaccacggcggcttccacatccagtgccagagcgaggactgcaccatcgcctacgtgagcagagagatgctggtgaccaacacccagaccggcgaggagcacaccgtgacccacctgcagtacgtggcctggcccgaccacggcgtgcccgacgacagcagcgacttcctggagttcgtgaactacgtgagaagcctgagagtggacagcgagcccgtgctggtgcactgcagcgccggcatcggcagaaccggcgtgctggtgaccatggagaccgccatgtgcctgaccgagagaaacctgcccatctaccccctggacatcgtgagaaagatgagagaccagagagccatgatggtgcagaccagcagccagtacaagttcgtgtgcgaggccatcctgagagtgtacgaggagggcctggtgcagatgctggaccccagctag

SEQ ID NO: 21232 - DNA, 2742 bp, Artificial Sequence; identical to SEQ ID NO: 21230
  Description of Artificial Sequence: Synthetic coding sequence

SEQ ID NO: 21233 - DNA, 2349 bp, Artificial Sequence
  Description of Artificial Sequence: Synthetic coding sequence
atggacatctgcgagggcagactgacctgccccctgaacagcgccgtggtgctggccagctacgccgtgcagagccacttcggcgactacaacagcagcatccaccaccccggctacctgagcgacagccacttcatccccgaccagaacgaggacttcctgaccaaggtggagagcctgcacgagcagcacagcggcctgaagcagagcgaggccgagagctgctacatcaacatcgccagaaccctggacttctacggcgtggagctgcacagcggcagagacctgcacaacctggacctgatgatcggcatcgccagcgccggcgtggccgtgtacagaaagtacatctgcaccagcttctacccctgggtgaacatcctgaagatcagcttcaagagaaagaagttcttcatccaccagagacagaagcaggccgagagcagagagcacatcgtggccttcaacatgctgaactacagaagctgcaagaacctgtggaagagctgcgtggagcaccacaccttcttccaggccaagaagctgctgccccaggagaagaacgtgctgagccagtactggaccatgggcagcagaaacaccaagaagagcgtgaacaaccagtactgcaagaaggtgatcggcggcatggtgtggaaccccgccatgagaagaagcctgagcgtggagcacctggagaccaagagcctgcccagcagaagcccccccatcacccccaactggagaagccccagactgagacacgagatcagaaagcccagacacagcagcgccgacaacctggccaacgagatgacctacatcaccgagaccgaggacgtgttctacacctacaagggcagcctggccccccaggacagcgacagcgaggtgagccagaacagaagcccccaccaggagagcctgagcgagaacaaccccgcccagagctacctgacccagaagagcagcagcagcgtgagccccagcagcaacgcccccggcagctgcagccccgacggcgtggaccagcagctgctggacgacttccacagagtgaccaagggcggcagcaccgaggacgccagccagtactactgcgacaagaacgacaacggcgacagctacctggtgctgatcagaatcacccccgacgaggacggcaagttcggcttcaacctgaagggcggcgtggaccagaagatgcccctggtggtgagcagaatcaaccccgagagccccgccgacacctgcatccccaagctgaacgagggcgaccagatcgtgctgatcaacggcagagacatcagcgagcacacccacgaccaggtggtgatgttcatcaaggccagcagagagagccacagcagagagctggccctggtgatcagaagaagagccgtgagaagcttcgccgacttcaagagcgaggacgagctgaaccagctgttccccgaggccatcttccccatgtgccccgagggcggcgacaccctggagggcagcatggcccagctgaagaagggcctggagagcggcaccgtgctgatccagttcgagcagctgtacagaaagaagcccggcctggccatcaccttcgccaagctgccccagaacctggacaagaacagatacaaggacgtgctgccctacgacaccaccagagtgctgctgcagggcaacgaggactacatcaacgccagctacgtgaacatggagatccccgccgccaacctggtgaacaagtacatcgccacccagggccccctgccccacacctgcgcccagttctggcaggtggtgtgggaccagaagctgagcctgatcgtgatgctgaccaccctgaccgagagaggcagaaccaagtgccaccagtactggcccgacccccccgacgtgatgaaccacggcggcttccacatccagtgccagagcgaggactgcaccatcgcctacgtgagcagagagatgctggtgaccaacacccagaccggcgaggagcacaccgtgacccacctgcagtacgtggcctggcccgaccacggcgtgcccgacgacagcagcgacttcctggagttcgtgaactacgtgagaagcctgagagtggacagcgagcccgtgctggtgcactgcagcgccggcatcggcagaaccggcgtgctggtgaccatggagaccgccatgtgcctgaccgagagaaacctgcccatctaccccctggacatcgtgagaaagatgagagaccagagagccatgatggtgcagaccagcagccagtacaagttcgtgtgcgaggccatcctgagagtgtacgaggagggcctggtgcagatgctggaccccagctag

SEQ ID NO: 21234 - DNA, 2214 bp, Artificial Sequence
  Description of Artificial Sequence: Synthetic coding sequence
atggacatctgcgagggcagactgacctgccccctgaacagcgccgtggtgctggccagctacgccgtgcagagccacttcggcgactacaacagcagcatccaccaccccggctacctgagcgacagccacttcatccccgaccagaacgaggacttcctgaccaaggtggagagcctgcacgagcagcacagcggcctgaagcagagcgaggccgagagctgctacatcaacatcgccagaaccctggacttctacggcgtggagctgcacagcggcagagacctgcacaacctggacctgatgatcggcatcgccagcgccggcgtggccgtgtacagaaagtacatctgcaccagcttctacccctgggtgaacatcctgaagatcagcttcaagagaaagaagttcttcatccaccagagacagaagcaggccgagagcagagagcacatcgtggccttcaacatgctgaactacagaagctgcaagaacctgtggaagagctgcgtggagcaccacaccttcttccaggccaagaagctgctgccccaggagaagaacgtgctgagccagtactggaccatgggcagcagaaacaccaagaagagaagccccagactgagacacgagatcagaaagcccagacacagcagcgccgacaacctggccaacgagatgacctacatcaccgagaccgaggacgtgttctacacctacaagggcagcctggccccccaggacagcgacagcgaggtgagccagaacagaagcccccaccaggagagcctgagcgagaacaaccccgcccagagctacctgacccagaagagcagcagcagcgtgagccccagcagcaacgcccccggcagctgcagccccgacggcgtggaccagcagctgctggacgacttccacagagtgaccaagggcggcagcaccgaggacgccagccagtactactgcgacaagaacgacaacggcgacagctacctggtgctgatcagaatcacccccgacgaggacggcaagttcggcttcaacctgaagggcggcgtggaccagaagatgcccctggtggtgagcagaatcaaccccgagagccccgccgacacctgcatccccaagctgaacgagggcgaccagatcgtgctgatcaacggcagagacatcagcgagcacacccacgaccaggtggtgatgttcatcaaggccagcagagagagccacagcagagagctggccctggtgatcagaagaagagccgtgagaagcttcgccgacttcaagagcgaggacgagctgaaccagctgttccccgaggccatcttccccatgtgccccgagggcggcgacaccctggagggcagcatggcccagctgaagaagggcctggagagcggcaccgtgctgatccagttcgagcagctgtacagaaagaagcccggcctggccatcaccttcgccaagctgccccagaacctggacaagaacagatacaaggacgtgctgccctacgacaccaccagagtgctgctgcagggcaacgaggactacatcaacgccagctacgtgaacatggagatccccgccgccaacctggtgaacaagtacatcgccacccagggccccctgccccacacctgcgcccagttctggcaggtggtgtgggaccagaagctgagcctgatcgtgatgctgaccaccctgaccgagagaggcagaaccaagtgccaccagtactggcccgacccccccgacgtgatgaaccacggcggcttccacatccagtgccagagcgaggactgcaccatcgcctacgtgagcagagagatgctggtgaccaacacccagaccggcgaggagcacaccgtgacccacctgcagtacgtggcctggcccgaccacggcgtgcccgacgacagcagcgacttcctggagttcgtgaactacgtgagaagcctgagagtggacagcgagcccgtgctggtgcactgcagcgccggcatcggcagaaccggcgtgctggtgaccatggagaccgccatgtgcctgaccgagagaaacctgcccatctaccccctggacatcgtgagaaagatgagagaccagagagccatgatggtgcagaccagcagccagtacaagttcgtgtgcgaggccatcctgagagtgtacgaggagggcctggtgcagatgctggaccccagctag

SEQ ID NO: 21235 - DNA, 2781 bp, Artificial Sequence
  Description of Artificial Sequence: Synthetic coding sequence
atgaccagcagattcagactgcccgccggcagaacctacaacgtgagagccagcgagctggccagagacagacagcacaccgaggtggtgtgcaacatcctgctgctggacaacaccgtgcaggccttcaaggtgaacaagcacgaccagggccaggtgctgctggacgtggtgttcaagcacctggacctgaccgagcaggactacttcggcctgcagctggccgacgacagcaccgacaaccccagatggctggaccccaacaagcccatcagaaagcagctgaagagaggcagcccctacagcctgaacttcagagtgaagttcttcgtgagcgaccccaacaagctgcaggaggagtacaccagataccagtacttcctgcagatcaagcaggacatcctgaccggcagactgccctgccccagcaacaccgccgccctgctggccagcttcgccgtgcagagcgagctgggcgactacgaccagagcgagaacctgagcggctacctgagcgactacagcttcatccccaaccagccccaggacttcgagaaggagatcgccaagctgcaccagcagcacatcggcctgagccccgccgaggccgagttcaactacctgaacaccgccagaaccctggagctgtacggcgtggagttccactacgccagagaccagagcaacaacgagatcatgatcggcgtgatgagcggcggcatcctgatctacaagaacagagtgagaatgaacaccttcccctggctgaagatcgtgaagatcagcttcaagtgcaagcagttcttcatccagctgagaaaggagctgcacgagagcagagagaccctgctgggcttcaacatggtgaactacagagcctgcaagaacctgtggaaggcctgcgtggagcaccacaccttcttcagactggacagacccctgcccccccagaagaacttcttcgcccactacttcaccctgggcagcaagttcagatactgcggcagaaccgaggtgcagagcgtgcagtacggcaaggagaaggccaacaaggacagagtgttcgccagaagccccagcaagcccctggccagaaagctgatggactgggaggtggtgagcagaaacagcatcagcgacgacagactggagacccagagcctgcccagcagaagcccccccggcacccccaaccacagaaacagcaccttcacccaggagggcaccagactgagacccagcagcgtgggccacctggtggaccacatggtgcacaccagccccagcgaggtgttcgtgaaccagagaagccccagcagcacccaggccaacagcatcgtgctggagagcagccccagccaggagacccccggcgacggcaagccccccgccctgccccccaagcagagcaagaagaacagctggaaccagatccactacagccacagccagcaggacctggagagccacatcaacgagaccttcgacatccccagcagccccgagaagcccacccccaacggcggcatcccccacgacaacctggtgctgatcagaatgaagcccgacgagaacggcagattcggcttcaacgtgaagggcggctacgaccagaagatgcccgtgatcgtgagcagagtggcccccggcacccccgccgacctgtgcgtgcccagactgaacgagggcgaccaggtggtgctgatcaacggcagagacatcgccgagcacacccacgaccaggtggtgctgttcatcaaggccagctgcgagagacacagcggcgagctgatgctgctggtgagacccaacgccgtgtacgacgtggtggaggagaagctggagaacgagcccgacttccagtacatccccgagaaggcccccctggacagcgtgcaccaggacgaccacagcctgagagagagcatgatccagctggccgagggcctgatcaccggcaccgtgctgacccagttcgaccagctgtacagaaagaagcccggcatgaccatgagctgcgccaagctgccccagaacatcagcaagaacagatacagagacatcagcccctacgacgccaccagagtgatcctgaagggcaacgaggactacatcaacgccaactacatcaacatggagatccccagcagcagcatcatcaaccagtacatcgcctgccagggccccctgccccacacctgcaccgacttctggcagatgacctgggagcagggcagcagcatggtggtgatgctgaccacccaggtggagagaggcagagtgaagtgccaccagtactggcccgagcccaccggcagcagcagctacggctgctaccaggtgacctgccacagcgaggagggcaacaccgcctacatcttcagaaagatgaccctgttcaaccaggagaagaacgagagcagacccctgacccagatccagtacatcgcctggcccgaccacggcgtgcccgacgacagcagcgacttcctggacttcgtgtgccacgtgagaaacaagagagccggcaaggaggagcccgtggtggtgcactgcagcgccggcatcggcagaaccggcgtgctgatcaccatggagaccgccatgtgcctgatcgagtgcaaccagcccgtgtaccccctggacatcgtgagaaccatgagagaccagagagccatgatgatccagacccccagccagtacagattcgtgtgcgaggccatcctgaaggtgtacgaggagggcttcgtgaagcccctgaccaccagcaccaacaagtag

SEQ ID NO: 21236 - DNA, 228 bp, Artificial Sequence
  Description of Artificial Sequence: Synthetic coding sequence
atgaccagcagattcagactgcccgccggcagaacctacaacgtgagagccagcgagctggccagagacagacagcacaccgaggtggtgtgcaacatcctgctgctggacaacaccgtgcaggccttcaaggtgaacaagcacgaccagggccaggtgctgctggacgtggtgttcaagcacctggacctgaccgagcaggactacttcggcctgcagctggcctag

SEQ ID NO: 21237 - DNA, 486 bp, Artificial Sequence
  Description of Artificial Sequence: Synthetic coding sequence
atgaccagcagattcagactgcccgccggcagaacctacaacgtgagagccagcgagctggccagagacagacagcacaccgaggtggtgtgcaacatcctgctgctggacaacaccgtgcaggccttcaaggtgaacaagcacgaccagggccaggtgctgctggacgtggtgttcaagcacctggacctgaccgagcaggactacttcggcctgcagctggccgacgacagcaccgacaaccccagatggctggaccccaacaagcccatcagaaagcagctgaagaagctgctgctgctgatcctgggcggcagcccctacagcctgaacttcagagtgaagttcttcgtgagcgaccccaacaagctgcaggaggagtacaccagataccagtacttcctgcagatcaagcaggacatcctgaccggcagactgccctgccccagcaacaccgccgccctgctggccagcttcgccgtgtag

SEQ ID NO: 21238 - DNA, 1680 bp, Artificial Sequence
  Description of Artificial Sequence: Synthetic coding sequence
atggactgggaggtggtgagcagaaacagcatcagcgacgacagactggagacccagagcctgcccagcagaagcccccccggcacccccaaccacagaaacagcaccttcacccaggagggcaccagactgagacccagcagcgtgggccacctggtggaccacatggtgcacaccagccccagcgaggtgttcgtgaaccagagaagccccagcagcacccaggccaacagcatcgtgctggagagcagccccagccaggagacccccggcgacggcaagccccccgccctgccccccaagcagagcaagaagaacagctggaaccagatccactacagccacagccagcaggacctggagagccacatcaacgagaccttcgacatccccagcagccccgagaagcccacccccaacggcggcatcccccacgacaacctggtgctgatcagaatgaagcccgacgagaacggcagattcggcttcaacgtgaagggcggctacgaccagaagatgcccgtgatcgtgagcagagtggcccccggcacccccgccgacctgtgcgtgcccagactgaacgagggcgaccaggtggtgctgatcaacggcagagacatcgccgagcacacccacgaccaggtggtgctgttcatcaaggccagctgcgagagacacagcggcgagctgatgctgctggtgagacccaacgccgtgtacgacgtggtggaggagaagctggagaacgagcccgacttccagtacatccccgagaaggcccccctggacagcgtgcaccaggacgaccacagcctgagagagagcatgatccagctggccgagggcctgatcaccggcaccgtgctgacccagttcgaccagctgtacagaaagaagcccggcatgaccatgagctgcgccaagctgccccagaacatcagcaagaacagatacagagacatcagcccctacgacgccaccagagtgatcctgaagggcaacgaggactacatcaacgccaactacatcaacatggagatccccagcagcagcatcatcaaccagtacatcgcctgccagggccccctgccccacacctgcaccgacttctggcagatgacctgggagcagggcagcagcatggtggtgatgctgaccacccaggtggagagaggcagagtgaagtgccaccagtactggcccgagcccaccggcagcagcagctacggctgctaccaggtgacctgccacagcgaggagggcaacaccgcctacatcttcagaaagatgaccctgttcaaccaggagaagaacgagagcagacccctgacccagatccagtacatcgcctggcccgaccacggcgtgcccgacgacagcagcgacttcctggacttcgtgtgccacgtgagaaacaagagagccggcaaggaggagcccgtggtggtgcactgcagcgccggcatcggcagaaccggcgtgctgatcaccatggagaccgccatgtgcctgatcgagtgcaaccagcccgtgtaccccctggacatcgtgagaaccatgagagaccagagagccatgatgatccagacccccagccagtacagattcgtgtgcgaggccatcctgaaggtgtacgaggagggcttcgtgaagcccctgaccaccagcaccaacaagtag

SEQ ID NO: 21239 - DNA, 3708 bp, Artificial Sequence
  Description of Artificial Sequence: Synthetic coding sequence
atgatgtgcgaggtgatgcccaccatcaacgaggacacccccatgagccagagaggcagccagagcagcggcagcgacagcgacagccacttcgagcagctgatggtgaacatgctggacgagagagacagactgctggacaccctgagagagacccaggagagcctgagcctggcccagcagagactgcaggacgtgatctacgacagagacagcctgcagagacagctgaacagcgccctgccccaggagttcgccgccctgaccaaggagctgaacgcctgcagagagcagctgctggagaaggaggaggagatcagcgagctgaaggccgagagaaacaacaccagactgctgctggagcacctggagtgcctggtgagcagacacgagagaagcctgagaatgaccgtggtgaagagacaggcccagagccccagcggcgtgagcagcgaggtggaggtgctgaaggccctgaagagcctgttcgagcaccacaaggccctggacgagaaggtgagagagagactgagagtgagcctggagagagtgagcgccctggaggaggagctggccgccgccaaccaggagatcgtggccctgagagagcagaacgtgcacatccagagaaagatggccagcagcgagggcagcaccgagagcgagcacctggagggcatggagcccggccagaaggtgcacgagaagagactgagcaacggcagcatcgacagcaccgacgagaccagccagatcgtggagctgcaggagctgctggagaagcagaactacgagatggcccagatgaaggagagactggccgccctgagcagcagagtgggcgaggtggagcaggaggccgagaccgccagaaaggacctgatcaagaccgaggagatgaacaccaagtaccagagagacatcagagaggccatggcccagaaggaggacatggaggagagaatcaccaccctggagaagagatacctgagcgcccagagagagagcaccagcatccacgacatgaacgacaagctggagaacgagctggccaacaaggaggccatcctgagacagatggaggagaagaacagacagctgcaggagagactggagctggccgagcagaagctgcagcagaccatgagaaaggccgagaccctgcccgaggtggaggccgagctggcccagagaatcgccgccctgaccaaggccgaggagagacacggcaacatcgaggagagaatgagacacctggagggccagctggaggagaagaaccaggagctgcagagagccagacagagagagaagatgaacgaggagcacaacaagagactgagcgacaccgtggacagactgctgaccgagagcaacgagagactgcagctgcacctgaaggagagaatggccgccctggaggagaagaacgtgctgatccaggagagcgagaccttcagaaagaacctggaggagagcctgcacgacaaggagagactggccgaggagatcgagaagctgagaagcgagctggaccagctgaagatgagaaccggcagcctgatcgagcccaccatccccagaacccacctggacaccagcgccgagctgagatacagcgtgggcagcctggtggacagccagagcgactacagaaccaccaaggtgatcagaagacccagaagaggcagaatgggcgtgagaagagacgagcccaaggtgaagagcctgggcgaccacgagtggaacagaacccagcagatcggcgtgctgagcagccaccccttcgagagcgacaccgagatgagcgacatcgacgacgacgacagagagaccatcttcagcagcatggacctgctgagccccagcggccacagcgacgcccagaccctggccatgatgctgcaggagcagctggacgccatcaacaaggagatcagactgatccaggaggagaaggagagcaccgagctgagagccgaggagatcgagaacagagtggccagcgtgagcctggagggcctgaacctggccagagtgcaccccggcaccagcatcaccgccagcgtgaccgccagcagcctggccagcagcagcccccccagcggccacagcacccccaagctgacccccagaagccccgccagagagatggacagaatgggcgtgatgaccctgcccagcgacctgagaaagcacagaagaaagatcgccgtggtggaggaggacggcagagaggacaaggccaccatcaagtgcgagaccagccccccccccacccccagagccctgagaatgacccacaccctgcccagcagctaccacaacgacgccagaagcagcctgagcgtgagcctggagcccgagagcctgggcctgggcagcgccaacagcagccaggacagcctgcacaaggcccccaagaagaagggcatcaagagcagcatcggcagactgttcggcaagaaggagaaggccagactgggccagctgagaggcttcatggagaccgaggccgccgcccaggagagcctgggcctgggcaagctgggcacccaggccgagaaggacagaagactgaagaagaaggtgatcagacacgagctgctggaggaggccagaagaaagggcctgcccttcgcccagtgggacggccccaccgtggtggcctggctggagctgtggctgggcatgcccgcctggtacgtggccgcctgcagagccaacgtgaagagcggcgccatcatgagcgccctgagcgacaccgagatccagagagagatcggcatcagcaaccccctgcacagactgaagctgagactggccatccaggagatggtgagcctgaccagccccagcgccccccccaccagcagaacccccagcggcaacgtgtgggtgacccacgaggagatggagaacctggccgcccccgccaagaccaaggagagcgaggagggcagctgggcccagtgccccgtgttcctgcagaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagagtgcacctgaagatggtggacagcttccacagaaagaagagaaccagcctgcagtacggcatcatgtgcctgaagagactgaactacgacagaaaggagctggagagaagaagagaggccagccagcacgagatcaaggacgtgctggtgtggagcaacgacagagtgatcagatggatccaggccatcggcctgagagagtacgccaacaacatcctggagagcggcgtgcacggcagcctgatcgccctggacgagaacttcgactacagcagcctggccctgctgctgcagatccccacccagaacacccaggccagacagatcctggagagagagtacaacaacctgctggccctgggcaccgagagaagactggacgagagcgacgacaagaacttcagaagaggcagcacctggagaagacagttcccccccagagaggtgcacggcatcagcatgatgcccggcagcagcgagaccctgcccgccggcttcagactgaccaccaccagcggccagagcagaaagatgaccaccgacgacggcgtgttcagcgtgtacagcacctag

SEQ ID NO: 21240 - DNA, 3471 bp, Artificial Sequence
  Description of Artificial Sequence: Synthetic coding sequence
atgatcttcagcgacatgaacaccgtgagcggcagccccaaggtgcacccccccaacggcaccagattctacaccttccaggagttcgccgccctgaccaaggagctgaacgcctgcagagagcagctgctggagaaggaggaggagatcagcgagctgaaggccgagagaaacaacaccagactgctgctggagcacctggagtgcctggtgagcagacacgagagaagcctgagaatgaccgtggtgaagagacaggcccagagccccagcggcgtgagcagcgaggtggaggtgctgaaggccctgaagagcctgttcgagcaccacaaggccctggacgagaaggtgagagagagactgagagtgagcctggagagagtgagcgccctggaggaggagctggccgccgccaaccaggagatcgtggccctgagagagcagaacgtgcacatccagagaaagatggccagcagcgagggcagcaccgagagcgagcacctggagggcatggagcccggccagaaggtgcacgagaagagactgagcaacggcagcatcgacagcaccgacgagaccagccagatcgtggagctgcaggagctgctggagaagcagaactacgagatggcccagatgaaggagagactggccgccctgagcagcagagtgggcgaggtggagcaggaggccgagaccgccagaaaggacctgatcaagaccgaggagatgaacaccaagtaccagagagacatcagagaggccatggcccagaaggaggacatggaggagagaatcaccaccctggagaagagatacctgagcgcccagagagagagcaccagcatccacgacatgaacgacaagctggagaacgagctggccaacaaggaggccatcctgagacagatggaggagaagaacagacagctgcaggagagactggagctggccgagcagaagctgcagcagaccatgagaaaggccgagaccctgcccgaggtggaggccgagctggcccagagaatcgccgccctgaccaaggccgaggagagacacggcaacatcgaggagagaatgagacacctggagggccagctggaggagaagaaccaggagctgcagagagccagacagagagagaagatgaacgaggagcacaacaagagactgagcgacaccgtggacagactgctgaccgagagcaacgagagactgcagctgcacctgaaggagagaatggccgccctggaggagaagaacgtgctgatccaggagagcgagaccttcagaaagaacctggaggagagcctgcacgacaaggagagactggccgaggagatcgagaagctgagaagcgagctggaccagctgaagatgagaaccggcagcctgatcgagcccaccatccccagaacccacctggacaccagcgccgagctgagatacagcgtgggcagcctggtggacagccagagcgactacagaaccaccaaggtgatcagaagacccagaagaggcagaatgggcgtgagaagagacgagcccaaggtgaagagcctgggcgaccacgagtggaacagaacccagcagatcggcgtgctgagcagccaccccttcgagagcgacaccgagatgagcgacatcgacgacgacgacagagagaccatcttcagcagcatggacctgctgagccccagcggccacagcgacgcccagaccctggccatgatgctgcaggagcagctggacgccatcaacaaggagatcagactgatccaggaggagaaggagagcaccgagctgagagccgaggagatcgagaacagagtggccagcgtgagcctggagggcctgaacctggccagagtgcaccccggcaccagcatcaccgccagcgtgaccgccagcagcctggccagcagcagcccccccagcggccacagcacccccaagctgacccccagaagccccgccagagagatggacagaatgggcgtgatgaccctgcccagcgacctgagaaagcacagaagaaagatcgccgtggtggaggaggacggcagagaggacaaggccaccatcaagtgcgagaccagccccccccccacccccagagccctgagaatgacccacaccctgcccagcagctaccacaacgacgccagaagcagcctgagcgtgagcctggagcccgagagcctgggcctgggcagcgccaacagcagccaggacagcctgcacaaggcccccaagaagaagggcatcaagagcagcatcggcagactgttcggcaagaaggagaaggccagactgggccagctgagaggcttcatggagaccgaggccgccgcccaggagagcctgggcctgggcaagctgggcacccaggccgagaaggacagaagactgaagaagaagcacgagctgctggaggaggccagaagaaagggcctgcccttcgcccagtgggacggccccaccgtggtggcctggctggagctgtggctgggcatgcccgcctggtacgtggccgcctgcagagccaacgtgaagagcggcgccatcatgagcgccctgagcgacaccgagatccagagagagatcggcatcagcaaccccctgcacagactgaagctgagactggccatccaggagatggtgagcctgaccagccccagcgccccccccaccagcagaaccaaggagagcgaggagggcagctgggcccagaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagagtgcacctgaagatggtggacagcttccacagaaccagcctgcagtacggcatcatgtgcctgaagagactgaactacgacagaaaggagctggagagaagaagagaggccagccagcacgagatcaaggacgtgctggtgtggagcaacgacagagtgatcagatggatccaggccatcggcctgagagagtacgccaacaacatcctggagagcggcgtgcacggcagcctgatcgccctggacgagaacttcgactacagcagcctggccctgctgctgcagatccccacccagaacacccaggccagacagatcctggagagagagtacaacaacctgctggccctgggcaccgagagaagactggacgagagcgacgacaagaacttcagaagaggcagcacctggagaagacagttcccccccagagaggtgcacggcatcagcatgatgcccggcagcagcgagaccctgcccgccggcttcagactgaccaccaccagcggccagagcagaaagatgaccaccgacgtggccagcagcagactgcagagactggacaacagcaccgtgagaacctacagctgctag

SEQ ID NO: 21241 - DNA, 1332 bp, Artificial Sequence
  Description of Artificial Sequence: Synthetic coding sequence
atgacccacaccctgcccagcagctaccacaacgacgccagaagcagcctgagcgtgagcctggagcccgagagcctgggcctgggcagcgccaacagcagccaggacagcctgcacaaggcccccaagaagaagggcatcaagagcagcatcggcagactgttcggcaagaaggagaaggccagactgggccagctgagaggcttcatggagaccgaggccgccgcccaggagagcctgggcctgggcaagctgggcacccaggccgagaaggacagaagactgaagaagaagcacgagctgctggaggaggccagaagaaagggcctgcccttcgcccagtgggacggccccaccgtggtggcctggctggagctgtggctgggcatgcccgcctggtacgtggccgcctgcagagccaacgtgaagagcggcgccatcatgagcgccctgagcgacaccgagatccagagagagatcggcatcagcaaccccctgcacagactgaagctgagactggccatccaggagatggtgagcctgaccagccccagcgccccccccaccagcagaacctgccccgtgttcctgcagaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagagtgcacctgaagatggtggacagcttccacagaaccagcctgcagtacggcatcatgtgcctgaagagactgaactacgacagaaaggagctggagagaagaagagaggccagccagcacgagatcaaggacgtgctggtgtggagcaacgacagagtgatcagatggatccaggccatcggcctgagagagtacgccaacaacatcctggagagcggcgtgcacggcagcctgatcgccctggacgagaacttcgactacagcagcctggccctgctgctgcagatccccacccagaacacccaggccagacagatcctggagagagagtacaacaacctgctggccctgggcaccgagagaagactggacgagagcgacgacaagaacttcagaagaggcagcacctggagaagacagttcccccccagagaggtgcacggcatcagcatgatgcccggcagcagcgagaccctgcccgccggcttcagactgaccaccaccagcggccagagcagaaagatgaccaccgacgtggccagcagcagactgcagagactggacaacagcaccgtgagaacctacagctgctag

SEQ ID NO: 21242 - DNA, 3783 bp, Artificial Sequence
  Description of Artificial Sequence: Synthetic coding sequence
agaagcaaggaccccaagagccagaccctggccatgatgtgcgaggtgatgcccaccatcaacgaggacacccccatgagccagagaggcagccagagcagcggcagcgacagcgacagccacttcgagcagctgatggtgaacatgctggacgagagagacagactgctggacaccctgagagagacccaggagagcctgagcctggcccagcagagactgcaggacgtgatctacgacagagacagcctgcagagacagctgaacagcgccctgccccaggacatcgagagcctgaccggcggcctggccggcagcaagggcgccgacccccccgagttcgccgccctgaccaaggagctgaacgcctgcagagagcagctgctggagaaggaggaggagatcagcgagctgaaggccgagagaaacaacaccagactgctgctggagcacctggagtgcctggtgagcagacacgagagaagcctgagaatgaccgtggtgaagagacaggcccagagccccagcggcgtgagcagcgaggtggaggtgctgaaggccctgaagagcctgttcgagcaccacaaggccctggacgagaaggtgagagagagactgagagtgagcctggagagagtgagcgccctggaggaggagctggccgccgccaaccaggagatcgtggccctgagagagcagaacgtgcacatccagagaaagatggccagcagcgagggcagcaccgagagcgagcacctggagggcatggagcccggccagaaggtgcacgagaagagactgagcaacggcagcatcgacagcaccgacgagaccagccagatcgtggagctgcaggagctgctggagaagcagaactacgagatggcccagatgaaggagagactggccgccctgagcagcagagtgggcgaggtggagcaggaggccgagaccgccagaaaggacctgatcaagaccgaggagatgaacaccaagtaccagagagacatcagagaggccatggcccagaaggaggacatggaggagagaatcaccaccctggagaagagatacctgagcgcccagagagagagcaccagcatccacgacatgaacgacaagctggagaacgagctggccaacaaggaggccatcctgagacagatggaggagaagaacagacagctgcaggagagactggagctggccgagcagaagctgcagcagaccatgagaaaggccgagaccctgcccgaggtggaggccgagctggcccagagaatcgccgccctgaccaaggccgaggagagacacggcaacatcgaggagagaatgagacacctggagggccagctggaggagaagaaccaggagctgcagagagccagacagagagagaagatgaacgaggagcacaacaagagactgagcgacaccgtggacagactgctgaccgagagcaacgagagactgcagctgcacctgaaggagagaatggccgccctggaggagaagaacgtgctgatccaggagagcgagaccttcagaaagaacctggaggagagcctgcacgacaaggagagactggccgaggagatcgagaagctgagaagcgagctggaccagctgaagatgagaaccggcagcctgatcgagcccaccatccccagaacccacctggacaccagcgccgagctgagatacagcgtgggcagcctggtggacagccagagcgactacagaaccaccaaggtgatcagaagacccagaagaggcagaatgggcgtgagaagagacgagcccaaggtgaagagcctgggcgaccacgagtggaacagaacccagcagatcggcgtgctgagcagccaccccttcgagagcgacaccgagatgagcgacatcgacgacgacgacagagagaccatcttcagcagcatggacctgctgagccccagcggccacagcgacgcccagaccctggccatgatgctgcaggagcagctggacgccatcaacaaggagatcagactgatccaggaggagaaggagagcaccgagctgagagccgaggagatcgagaacagagtggccagcgtgagcctggagggcctgaacctggccagagtgcaccccggcaccagcatcaccgccagcgtgaccgccagcagcctggccagcagcagcccccccagcggccacagcacccccaagctgacccccagaagccccgccagagagatggacagaatgggcgtgatgaccctgcccagcgacctgagaaagcacagaagaaagatcgccgtggtggaggaggacggcagagaggacaaggccaccatcaagtgcgagaccagccccccccccacccccagagccctgagaatgacccacaccctgcccagcagctaccacaacgacgccagaagcagcctgagcgtgagcctggagcccgagagcctgggcctgggcagcgccaacagcagccaggacagcctgcacaaggcccccaagaagaagggcatcaagagcagcatcggcagactgttcggcaagaaggagaaggccagactgggccagctgagaggcttcatggagaccgaggccgccgcccaggagagcctgggcctgggcaagctgggcacccaggccgagaaggacagaagactgaagaagaagcacgagctgctggaggaggccagaagaaagggcctgcccttcgcccagtgggacggccccaccgtggtggcctggctggagctgtggctgggcatgcccgcctggtacgtggccgcctgcagagccaacgtgaagagcggcgccatcatgagcgccctgagcgacaccgagatccagagagagatcggcatcagcaaccccctgcacagactgaagctgagactggccatccaggagatggtgagcctgaccagccccagcgccccccccaccagcagaacccccagcggcaacgtgtgggtgacccacgaggagatggagaacctggccgcccccgccaagaccaaggagagcgaggagggcagctgggcccagtgccccgtgttcctgcagaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagagtgcacctgaagatggtggacagcttccacagaaccagcctgcagtacggcatcatgtgcctgaagagactgaactacgacagaaaggagctggagagaagaagagaggccagccagcacgagatcaaggacgtgctggtgtggagcaacgacagagtgatcagatggatccaggccatcggcctgagagagtacgccaacaacatcctggagagcggcgtgcacggcagcctgatcgccctggacgagaacttcgactacagcagcctggccctgctgctgcagatccccacccagaacacccaggccaacgccagacagatcctggagagagagtacaacaacctgctggccctgggcaccgagagaagactggacgagagcgacgacaagaacttcagaagaggcagcacctggagaagacagttcccccccagagaggtgcacggcatcagcatgatgcccggcagcagcgagaccctgcccgccggcttcagactgaccaccaccagcggccagagcagaaagatgaccaccgacgacggcgtgttcagcgtgtacagcacctag

SEQ ID NO: 21243 - DNA, 366 bp, Artificial Sequence
  Description of Artificial Sequence: Synthetic coding sequence
atgatgtgcgaggtgatgcccaccatcaacgaggacacccccatgagccagagaggcagccagagcagcggcagcgacagcgacagccacttcgagcagctgatggtgaacatgctggacgagagagacagactgctggacaccctgagagagacccaggagagcctgagcctggcccagcagagactgcaggacgtgatctacgacagagacagcctgcagagacagctgaacagcgccctgccccaggacatcgagagcctgaccggcggcctggccggcagcaagggcgccgacccccccgagttcgccgccctgaccaaggagctgaacgcctgcagagagcagctgctggagaaggagtag

SEQ ID NO: 21244 - DNA, 3774 bp, Artificial Sequence
  Description of Artificial Sequence: Synthetic coding sequence
atgatgtgcgaggtgatgcccaccatcaacgaggacacccccatgagccagagaggcagccagagcagcggcagcgacagcgacagccacttcgagcagctgatggtgaacatgctggacgagagagacagactgctggacaccctgagagagacccaggagagcctgagcctggcccagcagagactgcaggacgtgatctacgacagagacagcctgcagagacagctgaacagcgccctgccccaggacatcgagagcctgaccggcggcctggccggcagcaagggcgccgacccccccgagttcgccgccctgaccaaggagctgaacgcctgcagagagcagctgctggagaaggaggaggagatcagcgagctgaaggccgagagaaacaacaccagactgctgctggagcacctggagtgcctggtgagcagacacgagagaagcctgagaatgaccgtggtgaagagacaggcccagagccccagcggcgtgagcagcgaggtggaggtgctgaaggccctgaagagcctgttcgagcaccacaaggccctggacgagaaggtgagagagagactgagagtgagcctggagagagtgagcgccctggaggaggagctggccgccgccaaccaggagatcgtggccctgagagagcagaacgtgcacatccagagaaagatggccagcagcgagggcagcaccgagagcgagcacctggagggcatggagcccggccagaaggtgcacgagaagagactgagcaacggcagcatcgacagcaccgacgagaccagccagatcgtggagctgcaggagctgctggagaagcagaactacgagatggcccagatgaaggagagactggccgccctgagcagcagagtgggcgaggtggagcaggaggccgagaccgccagaaaggacctgatcaagaccgaggagatgaacaccaagtaccagagagacatcagagaggccatggcccagaaggaggacatggaggagagaatcaccaccctggagaagagatacctgagcgcccagagagagagcaccagcatccacgacatgaacgacaagctggagaacgagctggccaacaaggaggccatcctgagacagatggaggagaagaacagacagctgcaggagagactggagctggccgagcagaagctgcagcagaccatgagaaaggccgagaccctgcccgaggtggaggccgagctggcccagagaatcgccgccctgaccaaggccgaggagagacacggcaacatcgaggagagaatgagacacctggagggccagctggaggagaagaaccaggagctgcagagagccagacagagagagaagatgaacgaggagcacaacaagagactgagcgacaccgtggacagactgctgaccgagagcaacgagagactgcagctgcacctgaaggagagaatggccgccctggaggagaagaacgtgctgatccaggagagcgagaccttcagaaagaacctggaggagagcctgcacgacaaggagagactggccgaggagatcgagaagctgagaagcgagctggaccagctgaagatgagaaccggcagcctgatcgagcccaccatccccagaacccacctggacaccagcgccgagctgagatacagcgtgggcagcctggtggacagccagagcgactacagaaccaccaaggtgatcagaagacccagaagaggcagaatgggcgtgagaagagacgagcccaaggtgaagagcctgggcgaccacgagtggaacagaacccagcagatcggcgtgctgagcagccaccccttcgagagcgacaccgagatgagcgacatcgacgacgacgacagagagaccatcttcagcagcatggacctgctgagccccagcggccacagcgacgcccagaccctggccatgatgctgcaggagcagctggacgccatcaacaaggagatcagactgatccaggaggagaaggagagcaccgagctgagagccgaggagatcgagaacagagtggccagcgtgagcctggagggcctgaacctggccagagtgcaccccggcaccagcatcaccgccagcgtgaccgccagcagcctggccagcagcagcccccccagcggccacagcacccccaagctgacccccagaagccccgccagagagatggacagaatgggcgtgatgaccctgcccagcgacctgagaaagcacagaagaaagatcgccgtggtggaggaggacggcagagaggacaaggccaccatcaagtgcgagaccagccccccccccacccccagagccctgagaatgacccacaccctgcccagcagctaccacaacgacgccagaagcagcctgagcgtgagcctggagcccgagagcctgggcctgggcagcgccaacagcagccaggacagcctgcacaaggcccccaagaagaagggcatcaagagcagcatcggcagactgttcggcaagaaggagaaggccagactgggccagctgagaggcttcatggagaccgaggccgccgcccaggagagcctgggcctgggcaagctgggcacccaggccgagaaggacagaagactgaagaagaagcacgagctgctggaggaggccagaagaaagggcctgcccttcgcccagtgggacggccccaccgtggtggcctggctggagctgtggctgggcatgcccgcctggtacgtggccgcctgcagagccaacgtgaagagcggcgccatcatgagcgccctgagcgacaccgagatccagagagagatcggcatcagcaaccccctgcacagactgaagctgagactggccatccaggagatggtgagcctgaccagccccagcgccccccccaccagcagaacccccagcggcaacgtgtgggtgacccacgaggagatggagaacctggccgcccccgccaagaccaaggagagcgaggagggcagctgggcccagtgccccgtgttcctgcagaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagagtgcacctgaagatggtggacagcttccacagaaccagcctgcagtacggcatcatgtgcctgaagagactgaactacgacagaaaggagctggagagaagaagagaggccagccagcacgagatcaaggacgtgctggtgtggagcaacgacagagtgatcagatggatccaggccatcggcctgagagagtacgccaacaacatcctggagagcggcgtgcacggcagcctgatcgccctggacgagaacttcgactacagcagcctggccctgctgctgcagatccccacccagaacacccaggccagacagatcctggagagagagtacaacaacctgctggccctgggcaccgagagaagactggacgagagcgacgacaagaacttcagaagaggcagcacctggagaagacagttcccccccagagaggtgcacggcatcagcatgatgcccggcagcagcgagaccctgcccgccggcttcagactgaccaccaccagcggccagagcagaaagatgaccaccgacgtggccagcagcagactgcagagactggacaacagcaccgtgagaacctacagctgctag

SEQ ID NO: 21245 - DNA, 1974 bp, Artificial Sequence
  Description of Artificial Sequence: Synthetic coding sequence
atgagaagagccgtgtgcttccccgccctgtgcctgctgctgaacctgcacgccgccggctgcttcagcggcaacaacgaccacttcctggccatcaaccagaagaagagcggcaagcccgtgttcatctacaagcacagccaggacatcgagaagagcctggacatcgccccccagaagatctacagacacagctaccacagcagcagcgaggcccaggtgagcaagagacaccagatcgtgaacagcgccttccccagacccgcctacgaccccagcctgaacctgctggccatggacggccaggacctggaggtggagaacctgcccatccccgccgccaacgtgatcgtggtgaccctgcagatggacgtgaacaagctgaacatcaccctgctgagaatcttcagacagggcgtggccgccgccctgggcctgctgccccagcaggtgcacatcaacagactgatcggcaagaagaacagcatcgagctgttcgtgagccccatcaacagaaagaccggcatcagcgacgccctgcccagcgaggaggtgctgagaagcctgaacatcaacgtgctgcaccagagcctgagccagttcggcatcaccgaggtgagccccgagaagaacgtgctgcagggccagcacgaggccgacaagatctggagcaaggagggcttctacgccgtggtgatcttcctgagcatcttcgtgatcatcgtgacctgcctgatgatcctgtacagactgaaggagagattccagctgagcctgagacaggacaaggagaagaaccaggagatccacctgagccccatcaccctgcagcccgccctgagcgaggccaagaccgtgcacagcatggtgcagcccgagcaggcccccaaggtgctgaacgtggtggtggacccccagggcagaggcgcccccgagatcaaggccaccaccgccaccagcgtgtgccccagccccttcaagatgaagcccatcggcctgcaggagagaagaggcagcaacgtgagcctgaccctggacatgagcagcctgggcaacatcgagcccttcgtgagcatccccacccccagagagaaggtggccatggagtacctgcagagcgccagcagaatcctgaccagaagccagctgagagacgtggtggccagcagccacctgctgcagagcgagttcatggagatccccatgaacttcgtggaccccaaggagatcgacatccccagacacggcaccaagaacagatacaagaccatcctgcccaaccccctgagcagagtgtgcctgagacccaagaacgtgaccgacagcctgagcacctacatcaacgccaactacatcagaggctacagcggcaaggagaaggccttcatcgccacccagggccccatgatcaacaccgtggacgacttctggcagatggtgtggcaggaggacagccccgtgatcgtgatgatcaccaagctgaaggagaagaacgagaagtgcgtgctgtactggcccgagaagagaggcatctacggcaaggtggaggtgctggtgatcagcgtgaacgagtgcgacaactacaccatcagaaacctggtgctgaagcagggcagccacacccagcacgtgaagcactactggtacaccagctggcccgaccacaagacccccgacagcgcccagcccctgctgcagctgatgctggacgtggaggaggacagactggccagccagggcagaggccccgtggtggtgcactgcagcgccggcatcggcagaaccggctgcttcatcgccaccagcatcggctgccagcagctgaaggaggagggcgtggtggacgccctgagcatcgtgtgccagctgagaatggacagaggcggcatggtgcagaccagcgagcagtacgagttcgtgcaccacgccctgtgcctgtacgagagcagactgagcgccgagaccgtgcagtag

SEQ ID NO: 21246 - DNA, 1356 bp, Artificial Sequence
  Description of Artificial Sequence: Synthetic coding sequence
atgaaccagaagaacgtgctgcagggccagcacgaggccgacaagatctggagcaaggagggcttctacgccgtggtgatcttcctgagcatcttcgtgatcatcgtgacctgcctgatgatcctgtacagactgaaggagagattccagctgagcctgagacaggacaaggagaagaaccaggagatccacctgagccccatcaccctgcagcccgccctgagcgaggccaagaccgtgcacagcatggtgcagcccgagcaggcccccaaggtgctgaacgtggtggtggacccccagggcagaggcgcccccgagatcaaggccaccaccgccaccagcgtgtgccccagccccttcaagatgaagcccatcggcctgcaggagagaagaggcagcaacgtgagcctgaccctggacatgagcagcctgggcaacatcgagcccttcgtgagcatccccacccccagagagaaggtggccatggagtacctgcagagcgccagcagaatcctgaccagaagccagctgagagacgtggtggccagcagccacctgctgcagagcgagttcatggagatccccatgaacttcgtggaccccaaggagatcgacatccccagacacggcaccaagaacagatacaagaccatcctgcccaaccccctgagcagagtgtgcctgagacccaagaacgtgaccgacagcctgagcacctacatcaacgccaactacatcagaggctacagcggcaaggagaaggccttcatcgccacccagggccccatgatcaacaccgtggacgacttctggcagatggtgtggcaggaggacagccccgtgatcgtgatgatcaccaagctgaaggagaagaacgagaagtgcgtgctgtactggcccgagaagagaggcatctacggcaaggtggaggtgctggtgatcagcgtgaacgagtgcgacaactacaccatcagaaacctggtgctgaagcagggcagccacacccagcacgtgaagcactactggtacaccagctggcccgaccacaagacccccgacagcgcccagcccctgctgcagctgatgctggacgtggaggaggacagactggccagccagggcagaggccccgtggtggtgcactgcagcgccggcatcggcagaaccggctgcttcatcgccaccagcatcggctgccagcagctgaaggaggagggcgtggtggacgccctgagcatcgtgtgccagctgagaatggacagaggcggcatggtgcagaccagcgagcagtacgagttcgtgcaccacgccctgtgcctgtacgagagcagactgagcgccgagaccgtgcagtag

SEQ ID NO: 21247 - DNA, 1239 bp, Artificial Sequence
  Description of Artificial Sequence: Synthetic coding sequence
atgatcctgtacagactgaaggagagattccagctgagcctgagacaggacaaggagaagaaccaggagatccacctgagccccatcaccctgcagcccgccctgagcgaggccaagaccgtgcacagcatggtgcagcccgagcaggcccccaaggtgctgaacgtggtggtggacccccagggcagaggcgcccccgagatcaaggccaccaccgccaccagcgtgtgccccagccccttcaagatgaagcccatcggcctgcaggagagaagaggcagcaacgtgagcctgaccctggacatgagcagcctgggcaacatcgagcccttcgtgagcatccccacccccagagagaaggtggccatggagtacctgcagagcgccagcagaatcctgaccagaagccagctgagagacgtggtggccagcagccacctgctgcagagcgagttcatggagatccccatgaacttcgtggaccccaaggagatcgacatccccagacacggcaccaagaacagatacaagaccatcctgcccaaccccctgagcagagtgtgcctgagacccaagaacgtgaccgacagcctgagcacctacatcaacgccaactacatcagaggctacagcggcaaggagaaggccttcatcgccacccagggccccatgatcaacaccgtggacgacttctggcagatggtgtggcaggaggacagccccgtgatcgtgatgatcaccaagctgaaggagaagaacgagaagtgcgtgctgtactggcccgagaagagaggcatctacggcaaggtggaggtgctggtgatcagcgtgaacgagtgcgacaactacaccatcagaaacctggtgctgaagcagggcagccacacccagcacgtgaagcactactggtacaccagctggcccgaccacaagacccccgacagcgcccagcccctgctgcagctgatgctggacgtggaggaggacagactggccagccagggcagaggccccgtggtggtgcactgcagcgccggcatcggcagaaccggctgcttcatcgccaccagcatcggctgccagcagctgaaggaggagggcgtggtggacgccctgagcatcgtgtgccagctgagaatggacagaggcggcatggtgcagaccagcgagcagtacgagttcgtgcaccacgccctgtgcctgtacgagagcagactgagcgccgagaccgtgcagtag

SEQ ID NO: 21248 - DNA, 1239 bp, Artificial Sequence; identical to SEQ ID NO: 21247
  Description of Artificial Sequence: Synthetic coding sequence

SEQ ID NO: 21249 - DNA, 597 bp, Artificial Sequence
  Description of Artificial Sequence: Synthetic coding sequence
atgatcctgtacagactgaaggagagattccagctgagcctgagacaggacaaggagaagaaccaggagatccacctgagccccatcaccctgcagcccgccctgagcgaggccaagaccgtgcacagcatggtgcagcccgagcaggcccccaaggtgctgaacgtggtggtggacccccagggcagaggcgcccccgagatcaaggccaccaccgccaccagcgtgtgccccagccccttcaagatgaagcccatcggcctgcaggagagaagaggcagcaacgtgagcctgaccctggacatgagcagcctgggcaacatcgagcccttcgtgagcatccccacccccagagagaaggtggccatggagtacctgcagagcgccagcagaatcctgaccagaagccagctgagagacgtggtggccagcagccacctgctgcagagcgagttcatggagatccccatgaacttcgtggaccccaaggagatcgacatccccagacacggcaccaagaacagatacaagaccatcctgcccaaccccctgagcagagtgtgcctgagacccaagaacgtgaccgacagcctgtag

SEQ ID NO: 21250 - DNA, 4353 bp, Artificial Sequence
  Description of Artificial Sequence: Synthetic coding sequence
atggccagcctggccgccctggccctgagcctgctgctgagactgcagctgccccccctgcccggcgccagagcccagagcgccgccggcggctgcagcttcgacgagcactacagcaactgcggctacagcgtggccctgggcaccaacggcttcacctgggagcagatcaacacctgggagaagcccatgctggaccaggccgtgcccaccggcagcttcatgatggtgaacagcagcggcagagccagcggccagaaggcccacctgctgctgcccaccctgaaggagaacgacacccactgcatcgacttccactactacttcagcagcagagacagaagcagccccggcgccctgaacgtgtacgtgaaggtgaacggcggcccccagggcaaccccgtgtggaacgtgagcggcgtggtgaccgagggctgggtgaaggccgagctggccatcagcaccttctggccccacttctaccaggtgatcttcgagagcgtgagcctgaagggccaccccggctacatcgccgtggacgaggtgagagtgctggcccacccctgcagaaaggccccccacttcctgagactgcagaacgtggaggtgaacgtgggccagaacgccaccttccagtgcatcgccggcggcaagtggagccagcacgacaagctgtggctgcagcagtggaacggcagagacaccgccctgatggtgaccagagtggtgaaccacagaagattcagcgccaccgtgagcgtggccgacaccgcccagagaagcgtgagcaagtacagatgcgtgatcagaagcgacggcggcagcggcgtgagcaactacgccgagctgatcgtgaaggagccccccacccccatcgccccccccgagctgctggccgtgggcgccacctacctgtggatcaagcccaacgccaacagcatcatcggcgacggccccatcatcctgaaggaggtggagtacagaaccaccaccggcacctgggccgagacccacatcgtggacagccccaactacaagctgtggcacctggaccccgacgtggagtacgagatcagagtgctgctgaccagacccggcgagggcggcaccggcccccccggcccccccctgaccaccagaaccaagtgcgccgaccccgtgcacggcccccagaacgtggagatcgtggacatcagagccagacagctgaccctgcagtgggagcccttcggctacgccgtgaccagatgccacagctacaacctgaccgtgcagtaccagtacgtgttcaaccagcagcagtacgaggccgaggaggtgatccagaccagcagccactacaccctgagaggcctgagacccttcatgaccatcagactgagactgctgctgagcaaccccgagggcagaatggagagcgaggagctggtggtgcagaccgaggaggacgtgcccggcgccgtgcccctggagagcatccagggcggccccttcgaggagaagatctacatccagtggaagccccccaacgagaccaacggcgtgatcaccctgtacgagatcaactacaaggccgtgggcagcctggaccccagcgccgacctgagcagccagagaggcaaggtgttcaagctgagaaacgagacccaccacctgttcgtgggcctgtaccccggcaccacctacagcttcaccatcaaggccagcaccgccaagggcttcggcccccccgtgaccaccagaatcgccaccaagatcagcgcccccagcatgcccgagtacgacaccgacacccccctgaacgagaccgacaccaccatcaccgtgatgctgaagcccgcccagagcagaggcgcccccgtgagcgtgtaccagctggtggtgaaggaggagagactgcagaagagcagaagagccgccgacatcatcgagtgcttcagcgtgcccgtgagctacagaaacgccagcagcctggacagcctgcactacttcgccgccgagctgaagcccgccaacctgcccgtgacccagcccttcaccgtgggcgacaacaagacctacaacggctactggaacccccccctgagccccctgaagagctacagcatctacttccaggccctgagcaaggccaacggcgagaccaagatcaactgcgtgagactggccaccaaggcccccatgggcagcgcccaggtgacccccggcacccccctgtgcctgctgaccaccggcgccagcacccagaacagcaacaccgtggagcccgagaagcaggtggacaacaccgtgaagatggccggcgtgatcgccggcctgctgatgttcatcatcatcctgctgggcgtgatgctgaccatcaagagaagaaagctggccaagaagcagaaggagacccagagcggcgcccagagagagatgggccccgtggccagcgccgacaagcccaccaccaagctgagcgccagcagaaacgacgagggcttcagcagcagcagccaggacgtgaacggcttcaccgacggcagcagaggcgagctgagccagcccaccctgaccatccagacccacccctacagaacctgcgaccccgtggagatgagctaccccagagaccagttccagcccgccatcagagtggccgacctgctgcagcacatcacccagatgaagagaggccagggctacggcttcaaggaggagtacgaggccctgcccgagggccagaccgccagctgggacaccgccaaggaggacgagaacagaaacaagaacagatacggcaacatcatcagctacgaccacagcagagtgagactgctggtgctggacggcgacccccacagcgactacatcaacgccaactacatcgacggctaccacagacccagacactacatcgccacccagggccccatgcaggagaccgtgaaggacttctggagaatgatctggcaggagaacagcgccagcatcgtgatggtgaccaacctggtggaggtgggcagagtgaagtgcgtgagatactggcccgacgacaccgaggtgtacggcgacatcaaggtgaccctgatcgagaccgagcccctggccgagtacgtgatcagaaccttcaccgtgcagaagaagggctaccacgagatcagagagctgagactgttccacttcaccagctggcccgaccacggcgtgccctgctacgccaccggcctgctgggcttcgtgagacaggtgaagttcctgaacccccccgaggccggccccatcgtggtgcactgcagcgccggcgccggcagaaccggctgcttcatcgccatcgacaccatgctggacatggccgagaacgagggcgtggtggacatcttcaactgcgtgagagagctgagagcccagagagtgaacctggtgcagaccgaggagcagtacgtgttcgtgcacgacgccatcctggaggcctgcctgtgcggcaacaccgccatccccgtgtgcgagttcagaagcctgtactacaacatcagcagactggacccccagaccaacagcagccagatcaaggacgagttccagaccctgaacatcgtgacccccagagtgagacccgaggactgcagcatcggcctgctgcccagaaaccacgacaagaacagaagcatggacgtgctgcccctggacagatgcctgcccttcctgatcagcgtggacggcgagagcagcaactacatcaacgccgccctgatggacagccacaagcagcccgccgccttcgtggtgacccagcaccccctgcccaacaccgtggccgacttctggagactggtgttcgactacaactgcagcagcgtggtgatgctgaacgagatggacaccgcccagttctgcatgcagtactggcccgagaagaccagcggctgctacggccccatccaggtggagttcgtgagcgccgacatcgacgaggacatcatccacagaatcttcagaatctgcaacatggccagaccccaggacggctacagaatcgtgcagcacctgcagtacatcggctggcccgcctacagagacaccccccccagcaagagaagcctgctgaaggtggtgagaagactggagaagtggcaggagcagtacgacggcagagagggcagaaccgtggtgcactgcctgaacggcggcggcagaagcggcaccttctgcgccatctgcagcgtgtgcgagatgatccagcagcagaacatcatcgacgtgttccacatcgtgaagaccctgagaaacaacaagagcaacatggtggagaccctggagcagtacaagttcgtgtacgaggtggccctggagtacctgagcagcttctag

SEQ ID NO: 21251 - DNA, 4356 bp, Artificial Sequence
  Description of Artificial Sequence: Synthetic coding sequence
atggccagcctggccgccctggccctgagcctgctgctgagactgcagctgccccccctgcccggcgccagagcccagagcgccgccggcggctgcagcttcgacgagcactacagcaactgcggctacagcgtggccctgggcaccaacggcttcacctgggagcagatcaacacctgggagaagcccatgctggaccaggccgtgcccaccggcagcttcatgatggtgaacagcagcggcagagccagcggccagaaggcccacctgctgctgcccaccctgaaggagaacgacacccactgcatcgacttccactactacttcagcagcagagacagaagcagccccggcgccctgaacgtgtacgtgaaggtgaacggcggcccccagggcaaccccgtgtggaacgtgagcggcgtggtgaccgagggctgggtgaaggccgagctggccatcagcaccttctggccccacttctaccaggtgatcttcgagagcgtgagcctgaagggccaccccggctacatcgccgtggacgaggtgagagtgctggcccacccctgcagaaaggccccccacttcctgagactgcagaacgtggaggtgaacgtgggccagaacgccaccttccagtgcatcgccggcggcaagtggagccagcacgacaagctgtggctgcagcagtggaacggcagagacaccgccctgatggtgaccagagtggtgaaccacagaagattcagcgccaccgtgagcgtggccgacaccgcccagagaagcgtgagcaagtacagatgcgtgatcagaagcgacggcggcagcggcgtgagcaactacgccgagctgatcgtgaaggagccccccacccccatcgccccccccgagctgctggccgtgggcgccacctacctgtggatcaagcccaacgccaacagcatcatcggcgacggccccatcatcctgaaggaggtggagtacagaaccaccaccggcacctgggccgagacccacatcgtggacagccccaactacaagctgtggcacctggaccccgacgtggagtacgagatcagagtgctgctgaccagacccggcgagggcggcaccggcccccccggcccccccctgaccaccagaaccaagtgcgccgaccccgtgcacggcccccagaacgtggagatcgtggacatcagagccagacagctgaccctgcagtgggagcccttcggctacgccgtgaccagatgccacagctacaacctgaccgtgcagtaccagtacgtgttcaaccagcagcagtacgaggccgaggaggtgatccagaccagcagccactacaccctgagaggcctgagacccttcatgaccatcagactgagactgctgctgagcaaccccgagggcagaatggagagcgaggagctggtggtgcagaccgaggaggacgtgcccggcgccgtgcccctggagagcatccagggcggccccttcgaggagaagatctacatccagtggaagccccccaacgagaccaacggcgtgatcaccctgtacgagatcaactacaaggccgtgggcagcctggaccccagcgccgacctgagcagccagagaggcaaggtgttcaagctgagaaacgagacccaccacctgttcgtgggcctgtaccccggcaccacctacagcttcaccatcaaggccagcaccgccaagggcttcggcccccccgtgaccaccagaatcgccaccaagatcagcgcccccagcatgcccgagtacgacaccgacacccccctgaacgagaccgacaccaccatcaccgtgatgctgaagcccgcccagagcagaggcgcccccgtgagcgtgtaccagctggtggtgaaggaggagagactgcagaagagcagaagagccgccgacatcatcgagtgcttcagcgtgcccgtgagctacagaaacgccagcagcctggacagcctgcactacttcgccgccgagctgaagcccgccaacctgcccgtgacccagcccttcaccgtgggcgacaacaagacctacaacggctactggaacccccccctgagccccctgaagagctacagcatctacttccaggccctgagcaaggccaacggcgagaccaagatcaactgcgtgagactggccaccaagggcgccagcacccagaacagcaacaccgtggagcccgagaagcaggtggacaacaccgtgaagatggccggcgtgatcgccggcctgctgatgttcatcatcatcctgctgggcgtgatgctgaccatcaagagaagaaagctggccaagaagcagaaggagacccagagcggcgcccagagagagatgggccccgtggccagcgccgacaagcccaccaccaagctgagcgccagcagaaacgacgagggcttcagcagcagcagccaggacgtgaacggcttcaccgacggcagcagaggcgagctgagccagcccaccctgaccatccagacccacccctacagaacctgcgaccccgtggagatgagctaccccagagaccagttccagcccgccatcagagtggccgacctgctgcagcacatcacccagatgaagagaggccagggctacggcttcaaggaggagtacgaggccctgcccgagggccagaccgccagctgggacaccgccaaggaggacgagaacagaaacaagaacagatacggcaacatcatcagctacgaccacagcagagtgagactgctggtgctggacggcgacccccacagcgactacatcaacgccaactacatcgacggctaccacagacccagacactacatcgccacccagggccccatgcaggagaccgtgaaggacttctggagaatgatctggcaggagaacagcgccagcatcgtgatggtgaccaacctggtggaggtgggcagacaccccgccgagcacaccgtgggcaacgccaccctgggcagagccgccagccccggcatggtgaagtgcgtgagatactggcccgacgacaccgaggtgtacggcgacatcaaggtgaccctgatcgagaccgagcccctggccgagtacgtgatcagaaccttcaccgtgcagaagaagggctaccacgagatcagagagctgagactgttccacttcaccagctggcccgaccacggcgtgccctgctacgccaccggcctgctgggcttcgtgagacaggtgaagttcctgaacccccccgaggccggccccatcgtggtgcactgcagcgccggcgccggcagaaccggctgcttcatcgccatcgacaccatgctggacatggccgagaacgagggcgtggtggacatcttcaactgcgtgagagagctgagagcccagagagtgaacctggtgcagaccgaggagcagtacgtgttcgtgcacgacgccatcctggaggcctgcctgtgcggcaacaccgccatccccgtgtgcgagttcagaagcctgtactacaacatcagcagactggacccccagaccaacagcagccagatcaaggacgagttccagaccctgaacatcgtgacccccagagtgagacccgaggactgcagcatcggcctgctgcccagaaaccacgacaagaacagaagcatggacgtgctgcccctggacagatgcctgcccttcctgatcagcgtggacggcgagagcagcaactacatcaacgccgccctgatggacagccacaagcagcccgccgccttcgtggtgacccagcaccccctgcccaacaccgtggccgacttctggagactggtgttcgactacaactgcagcagcgtggtgatgctgaacgagatggacaccgcccagttctgcatgcagtactggcccgagaagaccagcggctgctacggccccatccaggtggagttcgtgagcgccgacatcgacgaggacatcatccacagaatcttcagaatctgcaacatggccagaccccaggacggctacagaatcgtgcagcacctgcagtacatcggctggcccgcctacagagacaccccccccagcaagagaagcctgctgaaggtggtgagaagactggagaagtggcaggagcagtacgacggcagagagggcagaaccgtggtgcactgcctgaacggcggcggcagaagcggcaccttctgcgccatctgcagcgtgtgcgagatgatccagcagcagaacatcatcgacgtgttccacatcgtgaagaccctgagaaacaacaagagcaacatggtggagaccctggagcagtacaagttcgtgtacgaggtggccctggagtacctgagcagcttctag

SEQ ID NO: 21252 - DNA, 4326 bp, Artificial Sequence
  Description of Artificial Sequence: Synthetic coding sequence
atggccagcctggccgccctggccctgagcctgctgctgagactgcagctgccccccctgcccggcgccagagcccagagcgccgccggcggctgcagcttcgacgagcactacagcaactgcggctacagcgtggccctgggcaccaacggcttcacctgggagcagatcaacacctgggagaagcccatgctggaccaggccgtgcccaccggcagcttcatgatggtgaacagcagcggcagagccagcggccagaaggcccacctgctgctgcccaccctgaaggagaacgacacccactgcatcgacttccactactacttcagcagcagagacagaagcagccccggcgccctgaacgtgtacgtgaaggtgaacggcggcccccagggcaaccccgtgtggaacgtgagcggcgtggtgaccgagggctgggtgaaggccgagctggccatcagcaccttctggccccacttctaccaggtgatcttcgagagcgtgagcctgaagggccaccccggctacatcgccgtggacgaggtgagagtgctggcccacccctgcagaaaggccccccacttcctgagactgcagaacgtggaggtgaacgtgggccagaacgccaccttccagtgcatcgccggcggcaagtggagccagcacgacaagctgtggctgcagcagtggaacggcagagacaccgccctgatggtgaccagagtggtgaaccacagaagattcagcgccaccgtgagcgtggccgacaccgcccagagaagcgtgagcaagtacagatgcgtgatcagaagcgacggcggcagcggcgtgagcaactacgccgagctgatcgtgaaggagccccccacccccatcgccccccccgagctgctggccgtgggcgccacctacctgtggatcaagcccaacgccaacagcatcatcggcgacggccccatcatcctgaaggaggtggagtacagaaccaccaccggcacctgggccgagacccacatcgtggacagccccaactacaagctgtggcacctggaccccgacgtggagtacgagatcagagtgctgctgaccagacccggcgagggcggcaccggcccccccggcccccccctgaccaccagaaccaagtgcgccgaccccgtgcacggcccccagaacgtggagatcgtggacatcagagccagacagctgaccctgcagtgggagcccttcggctacgccgtgaccagatgccacagctacaacctgaccgtgcagtaccagtacgtgttcaaccagcagcagtacgaggccgaggaggtgatccagaccagcagccactacaccctgagaggcctgagacccttcatgaccatcagactgagactgctgctgagcaaccccgagggcagaatggagagcgaggagctggtggtgcagaccgaggaggacgtgcccggcgccgtgcccctggagagcatccagggcggccccttcgaggagaagatctacatccagtggaagccccccaacgagaccaacggcgtgatcaccctgtacgagatcaactacaaggccgtgggcagcctggaccccagcgccgacctgagcagccagagaggcaaggtgttcaagctgagaaacgagacccaccacctgttcgtgggcctgtaccccggcaccacctacagcttcaccatcaaggccagcaccgccaagggcttcggcccccccgtgaccaccagaatcgccaccaagatcagcgcccccagcatgcccgagtacgacaccgacacccccctgaacgagaccgacaccaccatcaccgtgatgctgaagcccgcccagagcagaggcgcccccgtgagcgtgtaccagctggtggtgaaggaggagagactgcagaagagcagaagagccgccgacatcatcgagtgcttcagcgtgcccgtgagctacagaaacgccagcagcctggacagcctgcactacttcgccgccgagctgaagcccgccaacctgcccgtgacccagcccttcaccgtgggcgacaacaagacctacaacggctactggaacccccccctgagccccctgaagagctacagcatctacttccaggccctgagcaaggccaacggcgagaccaagatcaactgcgtgagactggccaccaagggcgccagcacccagaacagcaacaccgtggagcccgagaagcaggtggacaacaccgtgaagatggccggcgtgatcgccggcctgctgatgttcatcatcatcctgctgggcgtgatgctgaccatcaagagaagaagaaacgcctacagctacagctactacctgaagctggccaagaagcagaaggagacccagagcggcgcccagagagagatgggccccgtggccagcgccgacaagcccaccaccaagctgagcgccagcagaaacgacgagggcttcagcagcagcagccaggacgtgaacggcttcaccgacggcagcagaggcgagctgagccagcccaccctgaccatccagacccacccctacagaacctgcgaccccgtggagatgagctaccccagagaccagttccagcccgccatcagagtggccgacctgctgcagcacatcacccagatgaagagaggccagggctacggcttcaaggaggagtacgaggccctgcccgagggccagaccgccagctgggacaccgccaaggaggacgagaacagaaacaagaacagatacggcaacatcatcagctacgaccacagcagagtgagactgctggtgctggacggcgacccccacagcgactacatcaacgccaactacatcgacggctaccacagacccagacactacatcgccacccagggccccatgcaggagaccgtgaaggacttctggagaatgatctggcaggagaacagcgccagcatcgtgatggtgaccaacctggtggaggtgggcagagtgaagtgcgtgagatactggcccgacgacaccgaggtgtacggcgacatcaaggtgaccctgatcgagaccgagcccctggccgagtacgtgatcagaaccttcaccgtgcagaagaagggctaccacgagatcagagagctgagactgttccacttcaccagctggcccgaccacggcgtgccctgctacgccaccggcctgctgggcttcgtgagacaggtgaagttcctgaacccccccgaggccggccccatcgtggtgcactgcagcgccggcgccggcagaaccggctgcttcatcgccatcgacaccatgctggacatggccgagaacgagggcgtggtggacatcttcaactgcgtgagagagctgagagcccagagagtgaacctggtgcagaccgaggagcagtacgtgttcgtgcacgacgccatcctggaggcctgcctgtgcggcaacaccgccatccccgtgtgcgagttcagaagcctgtactacaacatcagcagactggacccccagaccaacagcagccagatcaaggacgagttccagaccctgaacatcgtgacccccagagtgagacccgaggactgcagcatcggcctgctgcccagaaaccacgacaagaacagaagcatggacgtgctgcccctggacagatgcctgcccttcctgatcagcgtggacggcgagagcagcaactacatcaacgccgccctgatggacagccacaagcagcccgccgccttcgtggtgacccagcaccccctgcccaacaccgtggccgacttctggagactggtgttcgactacaactgcagcagcgtggtgatgctgaacgagatggacaccgcccagttctgcatgcagtactggcccgagaagaccagcggctgctacggccccatccaggtggagttcgtgagcgccgacatcgacgaggacatcatccacagaatcttcagaatctgcaacatggccagaccccaggacggctacagaatcgtgcagcacctgcagtacatcggctggcccgcctacagagacaccccccccagcaagagaagcctgctgaaggtggtgagaagactggagaagtggcaggagcagtacgacggcagagagggcagaaccgtggtgcactgcctgaacggcggcggcagaagcggcaccttctgcgccatctgcagcgtgtgcgagatgatccagcagcagaacatcatcgacgtgttccacatcgtgaagaccctgagaaacaacaagagcaacatggtggagaccctggagcagtacaagttcgtgtacgaggtggccctggagtacctgagcagcttctag

SEQ ID NO: 21253 - DNA, 4323 bp, Artificial Sequence
  Description of Artificial Sequence: Synthetic coding sequence
atggccagcctggccgccctggccctgagcctgctgctgagactgcagctgccccccctgcccggcgccagagcccagagcgccgccggcggctgcagcttcgacgagcactacagcaactgcggctacagcgtggccctgggcaccaacggcttcacctgggagcagatcaacacctgggagaagcccatgctggaccaggccgtgcccaccggcagcttcatgatggtgaacagcagcggcagagccagcggccagaaggcccacctgctgctgcccaccctgaaggagaacgacacccactgcatcgacttccactactacttcagcagcagagacagaagcagccccggcgccctgaacgtgtacgtgaaggtgaacggcggcccccagggcaaccccgtgtggaacgtgagcggcgtggtgaccgagggctgggtgaaggccgagctggccatcagcaccttctggccccacttctaccaggtgatcttcgagagcgtgagcctgaagggccaccccggctacatcgccgtggacgaggtgagagtgctggcccacccctgcagaaaggccccccacttcctgagactgcagaacgtggaggtgaacgtgggccagaacgccaccttccagtgcatcgccggcggcaagtggagccagcacgacaagctgtggctgcagcagtggaacggcagagacaccgccctgatggtgaccagagtggtgaaccacagaagattcagcgccaccgtgagcgtggccgacaccgcccagagaagcgtgagcaagtacagatgcgtgatcagaagcgacggcggcagcggcgtgagcaactacgccgagctgatcgtgaaggagccccccacccccatcgccccccccgagctgctggccgtgggcgccacctacctgtggatcaagcccaacgccaacagcatcatcggcgacggccccatcatcctgaaggaggtggagtacagaaccaccaccggcacctgggccgagacccacatcgtggacagccccaactacaagctgtggcacctggaccccgacgtggagtacgagatcagagtgctgctgaccagacccggcgagggcggcaccggcccccccggcccccccctgaccaccagaaccaagtgcgccgaccccgtgcacggcccccagaacgtggagatcgtggacatcagagccagacagctgaccctgcagtgggagcccttcggctacgccgtgaccagatgccacagctacaacctgaccgtgcagtaccagtacgtgttcaaccagcagcagtacgaggccgaggaggtgatccagaccagcagccactacaccctgagaggcctgagacccttcatgaccatcagactgagactgctgctgagcaaccccgagggcagaatggagagcgaggagctggtggtgcagaccgaggaggacgtgcccggcgccgtgcccctggagagcatccagggcggccccttcgaggagaagatctacatccagtggaagccccccaacgagaccaacggcgtgatcaccctgtacgagatcaactacaaggccgtgggcagcctggaccccagcgccgacctgagcagccagagaggcaaggtgttcaagctgagaaacgagacccaccacctgttcgtgggcctgtaccccggcaccacctacagcttcaccatcaaggccagcaccgccaagggcttcggcccccccgtgaccaccagaatcgccaccaagatcagcgcccccagcatgcccgagtacgacaccgacacccccctgaacgagaccgacaccaccatcaccgtgatgctgaagcccgcccagagcagaggcgcccccgtgagcgtgtaccagctggtggtgaaggaggagagactgcagaagagcagaagagccgccgacatcatcgagtgcttcagcgtgcccgtgagctacagaaacgccagcagcctggacagcctgcactacttcgccgccgagctgaagcccgccaacctgcccgtgacccagcccttcaccgtgggcgacaacaagacctacaacggctactggaacccccccctgagccccctgaagagctacagcatctacttccaggccctgagcaaggccaacggcgagaccaagatcaactgcgtgagactggccaccaagggcgccagcacccagaacagcaacaccgtggagcccgagaagcaggtggacaacaccgtgaagatggccggcgtgatcgccggcctgctgatgttcatcatcatcctgctgggcgtgatgctgaccatcaagagaagaagaaacgcctacagctacagctactacctgaagctggccaagaagcagaaggagacccagagcggcgcccagagagagatgggccccgtggccagcgccgacaagcccaccaccaagctgagcgccagcagaaacgacgagggcttcagcagcagcagccaggacgtgaacggcttcaacggcagcagaggcgagctgagccagcccaccctgaccatccagacccacccctacagaacctgcgaccccgtggagatgagctaccccagagaccagttccagcccgccatcagagtggccgacctgctgcagcacatcacccagatgaagagaggccagggctacggcttcaaggaggagtacgaggccctgcccgagggccagaccgccagctgggacaccgccaaggaggacgagaacagaaacaagaacagatacggcaacatcatcagctacgaccacagcagagtgagactgctggtgctggacggcgacccccacagcgactacatcaacgccaactacatcgacggctaccacagacccagacactacatcgccacccagggccccatgcaggagaccgtgaaggacttctggagaatgatctggcaggagaacagcgccagcatcgtgatggtgaccaacctggtggaggtgggcagagtgaagtgcgtgagatactggcccgacgacaccgaggtgtacggcgacatcaaggtgaccctgatcgagaccgagcccctggccgagtacgtgatcagaaccttcaccgtgcagaagaagggctaccacgagatcagagagctgagactgttccacttcaccagctggcccgaccacggcgtgccctgctacgccaccggcctgctgggcttcgtgagacaggtgaagttcctgaacccccccgaggccggccccatcgtggtgcactgcagcgccggcgccggcagaaccggctgcttcatcgccatcgacaccatgctggacatggccgagaacgagggcgtggtggacatcttcaactgcgtgagagagctgagagcccagagagtgaacctggtgcagaccgaggagcagtacgtgttcgtgcacgacgccatcctggaggcctgcctgtgcggcaacaccgccatccccgtgtgcgagttcagaagcctgtactacaacatcagcagactggacccccagaccaacagcagccagatcaaggacgagttccagaccctgaacatcgtgacccccagagtgagacccgaggactgcagcatcggcctgctgcccagaaaccacgacaagaacagaagcatggacgtgctgcccctggacagatgcctgcccttcctgatcagcgtggacggcgagagcagcaactacatcaacgccgccctgatggacagccacaagcagcccgccgccttcgtggtgacccagcaccccctgcccaacaccgtggccgacttctggagactggtgttcgactacaactgcagcagcgtggtgatgctgaacgagatggacaccgcccagttctgcatgcagtactggcccgagaagaccagcggctgctacggccccatccaggtggagttcgtgagcgccgacatcgacgaggacatcatccacagaatcttcagaatctgcaacatggccagaccccaggacggctacagaatcgtgcagcacctgcagtacatcggctggcccgcctacagagacaccccccccagcaagagaagcctgctgaaggtggtgagaagactggagaagtggcaggagcagtacgacggcagagagggcagaaccgtggtgcactgcctgaacggcggcggcagaagcggcaccttctgcgccatctgcagcgtgtgcgagatgatccagcagcagaacatcatcgacgtgttccacatcgtgaagaccctgagaaacaacaagagcaacatggtggagaccctggagcagtacaagttcgtgtacgaggtggccctggagtacctgagcagcttctag

SEQ ID NO: 21254 - DNA, 4335 bp, Artificial Sequence
  Description of Artificial Sequence: Synthetic coding sequence
atggccagcctggccgccctggccctgagcctgctgctgagactgcagctgccccccctgcccggcgccagagcccagagcgccgccggcggctgcagcttcgacgagcactacagcaactgcggctacagcgtggccctgggcaccaacggcttcacctgggagcagatcaacacctgggagaagcccatgctggaccaggccgtgcccaccggcagcttcatgatggtgaacagcagcggcagagccagcggccagaaggcccacctgctgctgcccaccctgaaggagaacgacacccactgcatcgacttccactactacttcagcagcagagacagaagcagccccggcgccctgaacgtgtacgtgaaggtgaacggcggcccccagggcaaccccgtgtggaacgtgagcggcgtggtgaccgagggctgggtgaaggccgagctggccatcagcaccttctggccccacttctaccaggtgatcttcgagagcgtgagcctgaagggccaccccggctacatcgccgtggacgaggtgagagtgctggcccacccctgcagaaaggccccccacttcctgagactgcagaacgtggaggtgaacgtgggccagaacgccaccttccagtgcatcgccggcggcaagtggagccagcacgacaagctgtggctgcagcagtggaacggcagagacaccgccctgatggtgaccagagtggtgaaccacagaagattcagcgccaccgtgagcgtggccgacaccgcccagagaagcgtgagcaagtacagatgcgtgatcagaagcgacggcggcagcggcgtgagcaactacgccgagctgatcgtgaaggagccccccacccccatcgccccccccgagctgctggccgtgggcgccacctacctgtggatcaagcccaacgccaacagcatcatcggcgacggccccatcatcctgaaggaggtggagtacagaaccaccaccggcacctgggccgagacccacatcgtggacagccccaactacaagctgtggcacctggaccccgacgtggagtacgagatcagagtgctgctgaccagacccggcgagggcggcaccggcccccccggcccccccctgaccaccagaaccaagtgcgccgaccccgtgcacggcccccagaacgtggagatcgtggacatcagagccagacagctgaccctgcagtgggagcccttcggctacgccgtgaccagatgccacagctacaacctgaccgtgcagtaccagtacgtgttcaaccagcagcagtacgaggccgaggaggtgatccagaccagcagccactacaccctgagaggcctgagacccttcatgaccatcagactgagactgctgctgagcaaccccgagggcagaatggagagcgaggagctggtggtgcagaccgaggaggacgtgcccggcgccgtgcccctggagagcatccagggcggccccttcgaggagaagatctacatccagtggaagccccccaacgagaccaacggcgtgatcaccctgtacgagatcaactacaaggccgtgggcagcctggaccccagcgccgacctgagcagccagagaggcaaggtgttcaagctgagaaacgagacccaccacctgttcgtgggcctgtaccccggcaccacctacagcttcaccatcaaggccagcaccgccaagggcttcggcccccccgtgaccaccagaatcgccaccaagatcagcgcccccagcatgcccgagtacgacaccgacacccccctgaacgagaccgacaccaccatcaccgtgatgctgaagcccgcccagagcagaggcgcccccgtgagcgtgtaccagctggtggtgaaggaggagagactgcagaagagcagaagagccgccgacatcatcgagtgcttcagcgtgcccgtgagctacagaaacgccagcagcctggacagcctgcactacttcgccgccgagctgaagcccgccaacctgcccgtgacccagcccttcaccgtgggcgacaacaagacctacaacggctactggaacccccccctgagccccctgaagagctacagcatctacttccaggccctgagcaaggccaacggcgagaccaagatcaactgcgtgagactggccaccaagggcgccagcacccagaacagcaacaccgtggagcccgagaagcaggtggacaacaccgtgaagatggccggcgtgatcgccggcctgctgatgttcatcatcatcctgctgggcgtgatgctgaccatcaagagaagaagaaacgcctacagctacagctactacctgagccagagaaagctggccaagaagcagaaggagacccagagcggcgcccagagagagatgggccccgtggccagcgccgacaagcccaccaccaagctgagcgccagcagaaacgacgagggcttcagcagcagcagccaggacgtgaacggcttcaccgacggcagcagaggcgagctgagccagcccaccctgaccatccagacccacccctacagaacctgcgaccccgtggagatgagctaccccagagaccagttccagcccgccatcagagtggccgacctgctgcagcacatcacccagatgaagagaggccagggctacggcttcaaggaggagtacgaggccctgcccgagggccagaccgccagctgggacaccgccaaggaggacgagaacagaaacaagaacagatacggcaacatcatcagctacgaccacagcagagtgagactgctggtgctggacggcgacccccacagcgactacatcaacgccaactacatcgacggctaccacagacccagacactacatcgccacccagggccccatgcaggagaccgtgaaggacttctggagaatgatctggcaggagaacagcgccagcatcgtgatggtgaccaacctggtggaggtgggcagagtgaagtgcgtgagatactggcccgacgacaccgaggtgtacggcgacatcaaggtgaccctgatcgagaccgagcccctggccgagtacgtgatcagaaccttcaccgtgcagaagaagggctaccacgagatcagagagctgagactgttccacttcaccagctggcccgaccacggcgtgccctgctacgccaccggcctgctgggcttcgtgagacaggtgaagttcctgaacccccccgaggccggccccatcgtggtgcactgcagcgccggcgccggcagaaccggctgcttcatcgccatcgacaccatgctggacatggccgagaacgagggcgtggtggacatcttcaactgcgtgagagagctgagagcccagagagtgaacctggtgcagaccgaggagcagtacgtgttcgtgcacgacgccatcctggaggcctgcctgtgcggcaacaccgccatccccgtgtgcgagttcagaagcctgtactacaacatcagcagactggacccccagaccaacagcagccagatcaaggacgagttccagaccctgaacatcgtgacccccagagtgagacccgaggactgcagcatcggcctgctgcccagaaaccacgacaagaacagaagcatggacgtgctgcccctggacagatgcctgcccttcctgatcagcgtggacggcgagagcagcaactacatcaacgccgccctgatggacagccacaagcagcccgccgccttcgtggtgacccagcaccccctgcccaacaccgtggccgacttctggagactggtgttcgactacaactgcagcagcgtggtgatgctgaacgagatggacaccgcccagttctgcatgcagtactggcccgagaagaccagcggctgctacggccccatccaggtggagttcgtgagcgccgacatcgacgaggacatcatccacagaatcttcagaatctgcaacatggccagaccccaggacggctacagaatcgtgcagcacctgcagtacatcggctggcccgcctacagagacaccccccccagcaagagaagcctgctgaaggtggtgagaagactggagaagtggcaggagcagtacgacggcagagagggcagaaccgtggtgcactgcctgaacggcggcggcagaagcggcaccttctgcgccatctgcagcgtgtgcgagatgatccagcagcagaacatcatcgacgtgttccacatcgtgaagaccctgagaaacaacaagagcaacatggtggagaccctggagcagtacaagttcgtgtacgaggtggccctggagtacctgagcagcttctag

SEQ ID NO: 21255 - DNA, 4392 bp, Artificial Sequence
  Description of Artificial Sequence: Synthetic coding sequence
atggccagcctggccgccctggccctgagcctgctgctgagactgcagctgccccccctgcccggcgccagagcccagagcgccgccggcggctgcagcttcgacgagcactacagcaactgcggctacagcgtggccctgggcaccaacggcttcacctgggagcagatcaacacctgggagaagcccatgctggaccaggccgtgcccaccggcagcttcatgatggtgaacagcagcggcagagccagcggccagaaggcccacctgctgctgcccaccctgaaggagaacgacacccactgcatcgacttccactactacttcagcagcagagacagaagcagccccggcgccctgaacgtgtacgtgaaggtgaacggcggcccccagggcaaccccgtgtggaacgtgagcggcgtggtgaccgagggctgggtgaaggccgagctggccatcagcaccttctggccccacttctaccaggtgatcttcgagagcgtgagcctgaagggccaccccggctacatcgccgtggacgaggtgagagtgctggcccacccctgcagaaaggccccccacttcctgagactgcagaacgtggaggtgaacgtgggccagaacgccaccttccagtgcatcgccggcggcaagtggagccagcacgacaagctgtggctgcagcagtggaacggcagagacaccgccctgatggtgaccagagtggtgaaccacagaagattcagcgccaccgtgagcgtggccgacaccgcccagagaagcgtgagcaagtacagatgcgtgatcagaagcgacggcggcagcggcgtgagcaactacgccgagctgatcgtgaaggagccccccacccccatcgccccccccgagctgctggccgtgggcgccacctacctgtggatcaagcccaacgccaacagcatcatcggcgacggccccatcatcctgaaggaggtggagtacagaaccaccaccggcacctgggccgagacccacatcgtggacagccccaactacaagctgtggcacctggaccccgacgtggagtacgagatcagagtgctgctgaccagacccggcgagggcggcaccggcccccccggcccccccctgaccaccagaaccaagtgcgccgaccccgtgcacggcccccagaacgtggagatcgtggacatcagagccagacagctgaccctgcagtgggagcccttcggctacgccgtgaccagatgccacagctacaacctgaccgtgcagtaccagtacgtgttcaaccagcagcagtacgaggccgaggaggtgatccagaccagcagccactacaccctgagaggcctgagacccttcatgaccatcagactgagactgctgctgagcaaccccgagggcagaatggagagcgaggagctggtggtgcagaccgaggaggacgtgcccggcgccgtgcccctggagagcatccagggcggccccttcgaggagaagatctacatccagtggaagccccccaacgagaccaacggcgtgatcaccctgtacgagatcaactacaaggccgtgggcagcctggaccccagcgccgacctgagcagccagagaggcaaggtgttcaagctgagaaacgagacccaccacctgttcgtgggcctgtaccccggcaccacctacagcttcaccatcaaggccagcaccgccaagggcttcggcccccccgtgaccaccagaatcgccaccaagatcagcgcccccagcatgcccgagtacgacaccgacacccccctgaacgagaccgacaccaccatcaccgtgatgctgaagcccgcccagagcagaggcgcccccgtgagcgtgtaccagctggtggtgaaggaggagagactgcagaagagcagaagagccgccgacatcatcgagtgcttcagcgtgcccgtgagctacagaaacgccagcagcctggacagcctgcactacttcgccgccgagctgaagcccgccaacctgcccgtgacccagcccttcaccgtgggcgacaacaagacctacaacggctactggaacccccccctgagccccctgaagagctacagcatctacttccaggccctgagcaaggccaacggcgagaccaagatcaactgcgtgagactggccaccaaggcccccatgggcagcgcccaggtgacccccggcacccccctgtgcctgctgaccaccggcgccagcacccagaacagcaacaccgtggagcccgagaagcaggtggacaacaccgtgaagatggccggcgtgatcgccggcctgctgatgttcatcatcatcctgctgggcgtgatgctgaccatcaagagaagaagaaacgcctacagctacagctactacctgagccagagaaagctggccaagaagcagaaggagacccagagcggcgcccagagagagatgggccccgtggccagcgccgacaagcccaccaccaagctgagcgccagcagaaacgacgagggcttcagcagcagcagccaggacgtgaacggcttcaccgacggcagcagaggcgagctgagccagcccaccctgaccatccagacccacccctacagaacctgcgaccccgtggagatgagctaccccagagaccagttccagcccgccatcagagtggccgacctgctgcagcacatcacccagatgaagagaggccagggctacggcttcaaggaggagtacgaggccctgcccgagggccagaccgccagctgggacaccgccaaggaggacgagaacagaaacaagaacagatacggcaacatcatcagctacgaccacagcagagtgagactgctggtgctggacggcgacccccacagcgactacatcaacgccaactacatcgacggctaccacagacccagacactacatcgccacccagggccccatgcaggagaccgtgaaggacttctggagaatgatctggcaggagaacagcgccagcatcgtgatggtgaccaacctggtggaggtgggcagagtgaagtgcgtgagatactggcccgacgacaccgaggtgtacggcgacatcaaggtgaccctgatcgagaccgagcccctggccgagtacgtgatcagaaccttcaccgtgcagaagaagggctaccacgagatcagagagctgagactgttccacttcaccagctggcccgaccacggcgtgccctgctacgccaccggcctgctgggcttcgtgagacaggtgaagttcctgaacccccccgaggccggccccatcgtggtgcactgcagcgccggcgccggcagaaccggctgcttcatcgccatcgacaccatgctggacatggccgagaacgagggcgtggtggacatcttcaactgcgtgagagagctgagagcccagagagtgaacctggtgcagaccgaggagcagtacgtgttcgtgcacgacgccatcctggaggcctgcctgtgcggcaacaccgccatccccgtgtgcgagttcagaagcctgtactacaacatcagcagactggacccccagaccaacagcagccagatcaaggacgagttccagaccctgaacatcgtgacccccagagtgagacccgaggactgcagcatcggcctgctgcccagaaaccacgacaagaacagaagcatggacgtgctgcccctggacagatgcctgcccttcctgatcagcgtggacggcgagagcagcaactacatcaacgccgccctgatggacagccacaagcagcccgccgccttcgtggtgacccagcaccccctgcccaacaccgtggccgacttctggagactggtgttcgactacaactgcagcagcgtggtgatgctgaacgagatggacaccgcccagttctgcatgcagtactggcccgagaagaccagcggctgctacggccccatccaggtggagttcgtgagcgccgacatcgacgaggacatcatccacagaatcttcagaatctgcaacatggccagaccccaggacggctacagaatcgtgcagcacctgcagtacatcggctggcccgcctacagagacaccccccccagcaagagaagcctgctgaaggtggtgagaagactggagaagtggcaggagcagtacgacggcagagagggcagaaccgtggtgcactgcctgaacggcggcggcagaagcggcaccttctgcgccatctgcagcgtgtgcgagatgatccagcagcagaacatcatcgacgtgttccacatcgtgaagaccctgagaaacaacaagagcaacatggtggagaccctggagcagtacaagttcgtgtacgaggtggccctggagtacctgagcagcttctag

SEQ ID NO: 21256 - DNA, 4296 bp, Artificial Sequence
  Description of Artificial Sequence: Synthetic coding sequence
atggccagcctggccgccctggccctgagcctgctgctgagactgcagctgccccccctgcccggcgccagagcccagagcgccgccggcggctgcagcttcgacgagcactacagcaactgcggctacagcgtggccctgggcaccaacggcttcacctgggagcagatcaacacctgggagaagcccatgctggaccaggccgtgcccaccggcagcttcatgatggtgaacagcagcggcagagccagcggccagaaggcccacctgctgctgcccaccctgaaggagaacgacacccactgcatcgacttccactactacttcagcagcagagacagaagcagccccggcgccctgaacgtgtacgtgaaggtgaacggcggcccccagggcaaccccgtgtggaacgtgagcggcgtggtgaccgagggctgggtgaaggccgagctggccatcagcaccttctggccccacttctaccaggtgatcttcgagagcgtgagcctgaagggccaccccggctacatcgccgtggacgaggtgagagtgctggcccacccctgcagaaaggccccccacttcctgagactgcagaacgtggaggtgaacgtgggccagaacgccaccttccagtgcatcgccggcggcaagtggagccagcacgacaagctgtggctgcagcagtggaacggcagagacaccgccctgatggtgaccagagtggtgaaccacagaagattcagcgccaccgtgagcgtggccgacaccgcccagagaagcgtgagcaagtacagatgcgtgatcagaagcgacggcggcagcggcgtgagcaactacgccgagctgatcgtgaaggagccccccacccccatcgccccccccgagctgctggccgtgggcgccacctacctgtggatcaagcccaacgccaacagcatcatcggcgacggccccatcatcctgaaggaggtggagtacagaaccaccaccggcacctgggccgagacccacatcgtggacagccccaactacaagctgtggcacctggaccccgacgtggagtacgagatcagagtgctgctgaccagacccggcgagggcggcaccggcccccccggcccccccctgaccaccagaaccaagtgcgccgaccccgtgcacggcccccagaacgtggagatcgtggacatcagagccagacagctgaccctgcagtgggagcccttcggctacgccgtgaccagatgccacagctacaacctgaccgtgcagtaccagtacgtgttcaaccagcagcagtacgaggccgaggaggtgatccagaccagcagccactacaccctgagaggcctgagacccttcatgaccatcagactgagactgctgctgagcaaccccgagggcagaatggagagcgaggagctggtggtgcagaccgaggaggacgtgcccggcgccgtgcccctggagagcatccagggcggccccttcgaggagaagatctacatccagtggaagccccccaacgagaccaacggcgtgatcaccctgtacgagatcaactacaaggccgtgggcagcctggaccccagcgccgacctgagcagccagagaggcaaggtgttcaagctgagaaacgagacccaccacctgttcgtgggcctgtaccccggcaccacctacagcttcaccatcaaggccagcaccgccaagggcttcggcccccccgtgaccaccagaatcgccaccaagatcagcgcccccagcatgcccgagtacgacaccgacacccccctgaacgagaccgacaccaccatcaccgtgatgctgaagcccgcccagagcagaggcgcccccgtgagcgtgtaccagctggtggtgaaggaggagagactgcagaagagcagaagagccgccgacatcatcgagtgcttcagcgtgcccgtgagctacagaaacgccagcagcctggacagcctgcactacttcgccgccgagctgaagcccgccaacctgcccgtgacccagcccttcaccgtgggcgacaacaagacctacaacggctactggaacccccccctgagccccctgaagagctacagcatctacttccaggccctgagcaaggccaacggcgagaccaagatcaactgcgtgagactggccaccaagggcgccagcacccagaacagcaacaccgtggagcccgagaagcaggtggacaacaccgtgaagatggccggcgtgatcgccggcctgctgatgttcatcatcatcctgctgggcgtgatgctgaccatcaagagaagaaagctggccaagaagcagaaggagacccagagcggcgcccagagagagatgggccccgtggccagcgccgacaagcccaccaccaagctgagcgccagcagaaacgacgagggcttcagcagcagcagccaggacgtgaacggcttcaccgacggcagcagaggcgagctgagccagcccaccctgaccatccagacccacccctacagaacctgcgaccccgtggagatgagctaccccagagaccagttccagcccgccatcagagtggccgacctgctgcagcacatcacccagatgaagagaggccagggctacggcttcaaggaggagtacgaggccctgcccgagggccagaccgccagctgggacaccgccaaggaggacgagaacagaaacaagaacagatacggcaacatcatcagctacgaccacagcagagtgagactgctggtgctggacggcgacccccacagcgactacatcaacgccaactacatcgacggctaccacagacccagacactacatcgccacccagggccccatgcaggagaccgtgaaggacttctggagaatgatctggcaggagaacagcgccagcatcgtgatggtgaccaacctggtggaggtgggcagagtgaagtgcgtgagatactggcccgacgacaccgaggtgtacggcgacatcaaggtgaccctgatcgagaccgagcccctggccgagtacgtgatcagaaccttcaccgtgcagaagaagggctaccacgagatcagagagctgagactgttccacttcaccagctggcccgaccacggcgtgccctgctacgccaccggcctgctgggcttcgtgagacaggtgaagttcctgaacccccccgaggccggccccatcgtggtgcactgcagcgccggcgccggcagaaccggctgcttcatcgccatcgacaccatgctggacatggccgagaacgagggcgtggtggacatcttcaactgcgtgagagagctgagagcccagagagtgaacctggtgcagaccgaggagcagtacgtgttcgtgcacgacgccatcctggaggcctgcctgtgcggcaacaccgccatccccgtgtgcgagttcagaagcctgtactacaacatcagcagactggacccccagaccaacagcagccagatcaaggacgagttccagaccctgaacatcgtgacccccagagtgagacccgaggactgcagcatcggcctgctgcccagaaaccacgacaagaacagaagcatggacgtgctgcccctggacagatgcctgcccttcctgatcagcgtggacggcgagagcagcaactacatcaacgccgccctgatggacagccacaagcagcccgccgccttcgtggtgacccagcaccccctgcccaacaccgtggccgacttctggagactggtgttcgactacaactgcagcagcgtggtgatgctgaacgagatggacaccgcccagttctgcatgcagtactggcccgagaagaccagcggctgctacggccccatccaggtggagttcgtgagcgccgacatcgacgaggacatcatccacagaatcttcagaatctgcaacatggccagaccccaggacggctacagaatcgtgcagcacctgcagtacatcggctggcccgcctacagagacaccccccccagcaagagaagcctgctgaaggtggtgagaagactggagaagtggcaggagcagtacgacggcagagagggcagaaccgtggtgcactgcctgaacggcggcggcagaagcggcaccttctgcgccatctgcagcgtgtgcgagatgatccagcagcagaacatcatcgacgtgttccacatcgtgaagaccctgagaaacaacaagagcaacatggtggagaccctggagcagtacaagttcgtgtacgaggtggccctggagtacctgagcagcttctag

SEQ ID NO: 21257 - DNA, 765 bp, Artificial Sequence
  Description of Artificial Sequence: Synthetic coding sequence
atggccgccgtggccgccaccgccgccgccaagggcaacggcggcggcggcggcagagccggcgccggcgacgccagcggcaccagaaagaagaagggccccggccccctggccaccgcctacctggtgatctacaacgtggtgatgaccgccggctggctggtgatcgccgtgggcctggtgagagcctacctggccaagggcagctaccacagcctgtactacagcatcgagaagcccctgaagttcttccagaccggcgccctgctggagatcctgcactgcgccatcggcatcgtgcccagcagcgtggtgctgaccagcttccaggtgatgagcagagtgttcctgatctgggccgtgacccacagcgtgaaggaggtgcagagcgaggacagcgtgctgctgttcgtgatcgcctggaccatcaccgagatcatcagatacagcttctacaccttcagcctgctgaaccacctgccctacctgatcaagtgggccagatacaccctgttcatcgtgctgtaccccatgggcgtgagcggcgagctgctgaccatctacgccgccctgcccttcgtgagacaggccggcctgtacagcatcagcctgcccaacaagtacaacttcagcttcgactactacgccttcctgatcctgatcatgatcagctacatccccatcttcccccagctgtacttccacatgatccaccagagaagaaagatcctgagccacaccgaggagcacaagaagttcgagtag

SEQ ID NO: 21258 - DNA, 1089 bp, Artificial Sequence
  Description of Artificial Sequence: Synthetic coding sequence
atggagaaccaggtgctgaccccccacgtgtactgggcccagagacacagagagctgtacctgagagtggagctgagcgacgtgcagaaccccgccatcagcatcaccgagaacgtgctgcacttcaaggcccagggccacggcgccaagggcgacaacgtgtacgagttccacctggagttcctggacctggtgaagcccgagcccgtgtacaagctgacccagagacaggtgaacatcaccgtgcagaagaaggtgagccagtggtgggagagactgaccaagcaggagaagagacccctgttcctggcccccgacttcgacagatggctggacgagagcgacgccgagatggagctgagagccaaggaggaggagagactgaacaagctgagactggagagcgagggcagccccgagaccctgaccaacctgagaaagggctacctgttcatgtacaacctggtgcagttcctgggcttcagctggatcttcgtgaacctgaccgtgagattctgcatcctgggcaaggagagcttctacgacaccttccacaccgtggccgacatgatgtacttctgccagatgctggccgtggtggagaccatcaacgccgccatcggcgtgaccaccagccccgtgctgcccagcctgatccagctgctgggcagaaacttcatcctgttcatcatcttcggcaccatggaggagatgcagaacaaggccgtggtgttcttcgtgttctacctgtggagcgccatcgagatcttcagatacagcttctacatgctgacctgcatcgacatggactggaaggtgctgacctggctgagatacaccctgtggatccccctgtaccccctgggctgcctggccgaggccgtgagcgtgatccagagcatccccatcttcaacgagaccggcagattcagcttcaccctgccctaccccgtgaagatcaaggtgagattcagcttcttcctgcagatctacctgatcatgatcttcctgggcctgtacatcaacttcagacacctgtacaagcagagaagaagaagatacggccagaagaagaagaagatccactag

SEQ ID NO: 21259 - DNA, 699 bp, Artificial Sequence
  Description of Artificial Sequence: Synthetic coding sequence
atgggccccctggccctgcccgcctggctgcagcccagatacagaaagaacgcctacctgttcatctactacctgatccagttctgcggccacagctggatcttcaccaacatgaccgtgagattcttcagcttcggcaaggacagcatggtggacaccttctacgccatcggcctggtgatgagactgtgccagagcgtgagcctgctggagctgctgcacatctacgtgggcatcgagagcaaccacctgctgcccagattcctgcagctgaccgagagaatcatcatcctgttcgtggtgatcaccagccaggaggaggtgcaggagaagtacgtggtgtgcgtgctgttcgtgttctggaacctgctggacatggtgagatacacctacagcatgctgagcgtgatcggcatcagctacgccgtgctgacctggctgagccagaccctgtggatgcccatctaccccctgtgcgtgctggccgaggccttcgccatctaccagagcctgccctacttcgagagcttcggcacctacagcaccaagctgcccttcgacctgagcatctacttcccctacgtgctgaagatctacctgatgatgctgttcatcggcatgtacttcacctacagccacctgtacagcgagagaagagacatcctgggcatcttccccatcaagaagaagaagatgtag

SEQ ID NO: 21260 - DNA, 699 bp, Artificial Sequence; identical to SEQ ID NO: 21259
  Description of Artificial Sequence: Synthetic coding sequence

SEQ ID NO: 21261 - DNA, 2397 bp, Artificial Sequence
  Description of Artificial Sequence: Synthetic coding sequence
atggagttcagctggggcagcggccaggagagcagaagactgctgctgctgctgctgctgctggccgcctgggaggccggcaacggccagctgcactacagcgtgagcgaggaggccaagcacggcaccttcgtgggcagaatcgcccaggacctgggcctggagctggccgagctggtgcccagactgttcagagtggccagcaagggcagaggcggcctgctggaggtgaacctgcagaacggcatcctgttcgtgaacagcagaatcgacagagaggagctgtgcagaagaagcgccgagtgcagcatccacctggaggtgatcgtggacagacccctgcaggtgttccacgtggacgtggaggtgagagacatcaacgacaacccccccgtgttccccgccacccagaagaacctgagcatcgccgagagcagacccctggacagcagattccccctggagggcgccagcgacgccgacatcggcgagaacgccctgctgacctacagactgagccccaacgagtacttcagcctggagaagccccccgacgacgagctggtgaagggcctgggcctgatcctgagaaagagcctggacagagaggaggcccccgagatcttcctggtgctgaccgccaccgacggcggcaagcccgagctgaccggcaccgtgcagctgctgatcaccgtgctggacgccaacgacaacgcccccgccttcgacagaaccatctacaaggtgagactgctggagaacgtgcccaacggcaccctggtgatcaagctgaacgccagcgacctggacgagggcctgaacggcgacatcgtgtacagcttcagcaacgacatcagccccaacgtgaagagcaagttccacatcgaccccatcaccggccagatcatcgtgaagggctacatcgacttcgaggagagcaagagctacgagatcatcgtggagggcatcgacaagggccagctgcccctgagcggccactgcagagtgatcgtggaggtggaggacaacaacgacaacgtgcccgacctggagttcaagagcctgagcctgcccatcagagaggacgcccccctgggcaccgtgatcgccctgatcagcgtgagcgacaaggacatgggcgtgaacggcctggtgacctgcagcctgaccagccacgtgcccttcaagctggtgagcaccttcaagaactactacagcctggtgctggacagcgccctggacagagagagcgtgagcgcctacgagctggtggtgaccgccagagacggcggcagccccagcctgtgggccaccgccagcgtgagcgtggaggtggccgacgtgaacgacaacgcccccgccttcgcccagcccgagtacaccgtgttcgtgaaggagaacaacccccccggctgccacatcttcaccgtgagcgcctgggacgccgacgcccaggagaacgccctggtgagctacagcctggtggagagaagagtgggcgagagagccctgagcagctacgtgagcgtgcacgccgagagcggcaaggtgtacgccctgcagcccctggaccacgaggagctggagctgctgcagttccaggtgaccgccagagacgccggcgtgccccccctgggcagcaacgtgaccctgcaggtgttcgtgctggacgagaacgacaacgcccccgccctgctggcccccagagccggcggcaccggcggcgccgtgagcgagctggtgccctggagcgtgggcgtgggccacgtggtggccaaggtgagagccgtggacgccgacagcggctacaacgcctggctgagctacgagctgcagcccggcaccggcggcgccagaatccccttcagagtgggcctgtacaccggcgagatcagcaccaccagagccctggacgagaccgacgcccccagacacagactgctggtgctggtgaaggaccacggcgagcccgccctgaccgccaccgccaccgtgctggtgagcctggtggagagcggccaggcccccaaggccagcagcagagccctggtgggcgccgtgggccccgacgccgccctggtggacgtgaacgtgtacctgatcatcgccatctgcgccgtgagcagcctgctggtgctgaccctgctgctgtacaccgccctgagatgcagcgccctgcccaccgagggcgcctgcgcccccggcaagcccaccctggtgtgcagcagcgccgtgggcagctggagctacagccagcagagaagacccagagtgtgcagcggcgagggcccccccaagaccgacctgatggccttcagccccagcctgcccgacagcagagacagagaggaccagctgcagaccaccgaggagagcttcgccaaggtgagcgtgtag

SEQ ID NO: 21262 - DNA, 2706 bp, Artificial Sequence
  Description of Artificial Sequence: Synthetic coding sequence
atggagttcagctggggcagcggccaggagagcagaagactgctgctgctgctgctgctgctggccgcctgggaggccggcaacggccagctgcactacagcgtgagcgaggaggccaagcacggcaccttcgtgggcagaatcgcccaggacctgggcctggagctggccgagctggtgcccagactgttcagagtggccagcaagggcagaggcggcctgctggaggtgaacctgcagaacggcatcctgttcgtgaacagcagaatcgacagagaggagctgtgcagaagaagcgccgagtgcagcatccacctggaggtgatcgtggacagacccctgcaggtgttccacgtggacgtggaggtgagagacatcaacgacaacccccccgtgttccccgccacccagaagaacctgagcatcgccgagagcagacccctggacagcagattccccctggagggcgccagcgacgccgacatcggcgagaacgccctgctgacctacagactgagccccaacgagtacttcagcctggagaagccccccgacgacgagctggtgaagggcctgggcctgatcctgagaaagagcctggacagagaggaggcccccgagatcttcctggtgctgaccgccaccgacggcggcaagcccgagctgaccggcaccgtgcagctgctgatcaccgtgctggacgccaacgacaacgcccccgccttcgacagaaccatctacaaggtgagactgctggagaacgtgcccaacggcaccctggtgatcaagctgaacgccagcgacctggacgagggcctgaacggcgacatcgtgtacagcttcagcaacgacatcagccccaacgtgaagagcaagttccacatcgaccccatcaccggccagatcatcgtgaagggctacatcgacttcgaggagagcaagagctacgagatcatcgtggagggcatcgacaagggccagctgcccctgagcggccactgcagagtgatcgtggaggtggaggacaacaacgacaacgtgcccgacctggagttcaagagcctgagcctgcccatcagagaggacgcccccctgggcaccgtgatcgccctgatcagcgtgagcgacaaggacatgggcgtgaacggcctggtgacctgcagcctgaccagccacgtgcccttcaagctggtgagcaccttcaagaactactacagcctggtgctggacagcgccctggacagagagagcgtgagcgcctacgagctggtggtgaccgccagagacggcggcagccccagcctgtgggccaccgccagcgtgagcgtggaggtggccgacgtgaacgacaacgcccccgccttcgcccagcccgagtacaccgtgttcgtgaaggagaacaacccccccggctgccacatcttcaccgtgagcgcctgggacgccgacgcccaggagaacgccctggtgagctacagcctggtggagagaagagtgggcgagagagccctgagcagctacgtgagcgtgcacgccgagagcggcaaggtgtacgccctgcagcccctggaccacgaggagctggagctgctgcagttccaggtgaccgccagagacgccggcgtgccccccctgggcagcaacgtgaccctgcaggtgttcgtgctggacgagaacgacaacgcccccgccctgctggcccccagagccggcggcaccggcggcgccgtgagcgagctggtgccctggagcgtgggcgtgggccacgtggtggccaaggtgagagccgtggacgccgacagcggctacaacgcctggctgagctacgagctgcagcccggcaccggcggcgccagaatccccttcagagtgggcctgtacaccggcgagatcagcaccaccagagccctggacgagaccgacgcccccagacacagactgctggtgctggtgaaggaccacggcgagcccgccctgaccgccaccgccaccgtgctggtgagcctggtggagagcggccaggcccccaaggccagcagcagagccctggtgggcgccgtgggccccgacgccgccctggtggacgtgaacgtgtacctgatcatcgccatctgcgccgtgagcagcctgctggtgctgaccctgctgctgtacaccgccctgagatgcagcgccctgcccaccgagggcgcctgcgcccccggcaagcccaccctggtgtgcagcagcgccgtgggcagctggagctacagccagcagagaagacccagagtgtgcagcggcgagggcccccccaagaccgacctgatggccttcagccccagcctgcccgacagcagagacagagaggaccagctgcagaccaccgaggagagcttcgccaagcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccgagcccaagaagcagacccaggtgagcttcctgctgagaagaaagggcgaggccagccagcccagacagtag

SEQ ID NO: 21263 - DNA, 2844 bp, Artificial Sequence
  Description of Artificial Sequence: Synthetic coding sequence
atggagttcagctggggcagcggccaggagagcagaagactgctgctgctgctgctgctgctggccgcctgggaggccggcaacggccagctgcactacagcgtgagcgaggaggccaagcacggcaccttcgtgggcagaatcgcccaggacctgggcctggagctggccgagctggtgcccagactgttcagagtggccagcaagggcagaggcggcctgctggaggtgaacctgcagaacggcatcctgttcgtgaacagcagaatcgacagagaggagctgtgcagaagaagcgccgagtgcagcatccacctggaggtgatcgtggacagacccctgcaggtgttccacgtggacgtggaggtgagagacatcaacgacaacccccccgtgttccccgccacccagaagaacctgagcatcgccgagagcagacccctggacagcagattccccctggagggcgccagcgacgccgacatcggcgagaacgccctgctgacctacagactgagccccaacgagtacttcagcctggagaagccccccgacgacgagctggtgaagggcctgggcctgatcctgagaaagagcctggacagagaggaggcccccgagatcttcctggtgctgaccgccaccgacggcggcaagcccgagctgaccggcaccgtgcagctgctgatcaccgtgctggacgccaacgacaacgcccccgccttcgacagaaccatctacaaggtgagactgctggagaacgtgcccaacggcaccctggtgatcaagctgaacgccagcgacctggacgagggcctgaacggcgacatcgtgtacagcttcagcaacgacatcagccccaacgtgaagagcaagttccacatcgaccccatcaccggccagatcatcgtgaagggctacatcgacttcgaggagagcaagagctacgagatcatcgtggagggcatcgacaagggccagctgcccctgagcggccactgcagagtgatcgtggaggtggaggacaacaacgacaacgtgcccgacctggagttcaagagcctgagcctgcccatcagagaggacgcccccctgggcaccgtgatcgccctgatcagcgtgagcgacaaggacatgggcgtgaacggcctggtgacctgcagcctgaccagccacgtgcccttcaagctggtgagcaccttcaagaactactacagcctggtgctggacagcgccctggacagagagagcgtgagcgcctacgagctggtggtgaccgccagagacggcggcagccccagcctgtgggccaccgccagcgtgagcgtggaggtggccgacgtgaacgacaacgcccccgccttcgcccagcccgagtacaccgtgttcgtgaaggagaacaacccccccggctgccacatcttcaccgtgagcgcctgggacgccgacgcccaggagaacgccctggtgagctacagcctggtggagagaagagtgggcgagagagccctgagcagctacgtgagcgtgcacgccgagagcggcaaggtgtacgccctgcagcccctggaccacgaggagctggagctgctgcagttccaggtgaccgccagagacgccggcgtgccccccctgggcagcaacgtgaccctgcaggtgttcgtgctggacgagaacgacaacgcccccgccctgctggcccccagagccggcggcaccggcggcgccgtgagcgagctggtgccctggagcgtgggcgtgggccacgtggtggccaaggtgagagccgtggacgccgacagcggctacaacgcctggctgagctacgagctgcagcccggcaccggcggcgccagaatccccttcagagtgggcctgtacaccggcgagatcagcaccaccagagccctggacgagaccgacgcccccagacacagactgctggtgctggtgaaggaccacggcgagcccgccctgaccgccaccgccaccgtgctggtgagcctggtggagagcggccaggcccccaaggccagcagcagagccctggtgggcgccgtgggccccgacgccgccctggtggacgtgaacgtgtacctgatcatcgccatctgcgccgtgagcagcctgctggtgctgaccctgctgctgtacaccgccctgagatgcagcgccctgcccaccgagggcgcctgcgcccccggcaagcccaccctggtgtgcagcagcgccgtgggcagctggagctacagccagcagagaagacccagagtgtgcagcggcgagggcccccccaagaccgacctgatggccttcagccccagcctgcccgacagcagagacagagaggaccagctgcagaccaccgaggagagcttcgccaagcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 21264 - DNA, 2403 bp, Artificial Sequence
  Description of Artificial Sequence: Synthetic coding sequence
atggccgtgagagagctgtgcttccccagacagagacaggtgctgttcctgttcctgttctggggcgtgagcctggccggcagcggcttcggcagatacagcgtgaccgaggagaccgagaagggcagcttcgtggtgaacctggccaaggacctgggcctggccgagggcgagctggccgccagaggcaccagagtggtgagcgacgacaacaagcagtacctgctgctggacagccacaccggcaacctgctgaccaacgagaagctggacagagagaagctgtgcggccccaaggagccctgcatgctgtacttccagatcctgatggacgaccccttccagatctacagagccgagctgagagtgagagacatcaacgaccacgcccccgtgttccaggacaaggagaccgtgctgaagatcagcgagaacaccgccgagggcaccgccttcagactggagagagcccaggaccccgacggcggcctgaacggcatccagaactacaccatcagccccaacagcttcttccacatcaacatcagcggcggcgacgagggcatgatctaccccgagctggtgctggacaaggccctggacagagaggagcagggcgagctgagcctgaccctgaccgccctggacggcggcagccccagcagaagcggcaccagcaccgtgagaatcgtggtgctggacgtgaacgacaacgccccccagttcgcccaggccctgtacgagacccaggcccccgagaacagccccatcggcttcctgatcgtgaaggtgtgggccgaggacgtggacagcggcgtgaacgccgaggtgagctacagcttcttcgacgccagcgagaacatcagaaccaccttccagatcaaccccttcagcggcgagatcttcctgagagagctgctggactacgagctggtgaacagctacaagatcaacatccaggccatggacggcggcggcctgagcgccagatgcagagtgctggtggaggtgctggacaccaacgacaacccccccgagctgatcgtgagcagcttcagcaacagcgtggccgagaacagccccgagacccccctggccgtgttcaagatcaacgacagagacagcggcgagaacggcaagatggtgtgctacatccaggagaacctgcccttcctgctgaagcccagcgtggagaacttctacatcctgatcaccgagggcgccctggacagagagatcagagccgagtacaacatcaccatcaccgtgaccgacctgggcacccccagactgaagaccgagcacaacatcaccgtgctggtgagcgacgtgaacgacaacgcccccgccttcacccagaccagctacaccctgttcgtgagagagaacaacagccccgccctgcacatcggcagcgtgagcgccaccgacagagacagcggcaccaacgcccaggtgacctacagcctgctgcccccccaggacccccacctgcccctggccagcctggtgagcatcaacgccgacaacggccacctgttcgccctgagaagcctggactacgaggccctgcaggccttcgagttcagagtgggcgccaccgacagaggcagccccgccctgagcagagaggccctggtgagagtgctggtgctggacgccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagcccggcctgttcggcgtgtgggcccacaacggcgaggtgagaaccgccagactgctgagcgagagagacgccgccaagcacagactggtggtgctggtgaaggacaacggcgagccccccagaagcgccaccgccaccctgcacctgctgctggtggacggcttcagccagccctacctgcccctgcccgaggccgcccccgcccaggcccaggccgaggccgacctgctgaccgtgtacctggtggtggccctggccagcgtgagcagcctgttcctgctgagcgtgctgctgttcgtggccgtgagactgtgcagaagaagcagagccgccagcgtgggcagatgcagcgtgcccgagggccccttccccggccacctggtggacgtgagaggcgccgagaccctgagccagagctaccagtacgaggtgtgcctgaccggcggccccggcaccagcgagttcaagttcctgaagcccgtgatcagcgacatccaggcccagggccccggcagaaagggcgaggagaacagcaccttcagaaacagcttcggcttcaacatccagtag

SEQ ID NO: 21265 - DNA, 1764 bp, Artificial Sequence
  Description of Artificial Sequence: Synthetic coding sequence
atgatggagacccccctgcccaaggcccccgagaagagacaggtgaccgccatcatcttcctgctgctgctgtgggaggccggcagcgccaccatcaagtacagcgtgctggaggagagagacagcggcagcttcgtggccaacctggccaaggacctgggcctgggcgtgggcgagctggccgccagaggcgccagaatcctgagcaagggcaacaagcagtacctgcagctggagagaaagagcggcaacctgctgctgaaggagaagctggacagagaggagctgtgcggcgacatcgacccctgcatcctgcacttccagatgctgctgaagaaccccgtgcagttcatccagggcgagctgcagctgcaggacgtgaacgaccacgcccccgagttcctggagaacgagatcctgctgaagatcagcgagggcagccaccccggcaccagcttccccctgaagatcgcccaggacctggacgtgggcagcaacaccgtgcagaactacagcatcagcaccaacagctacttccacctgttcaccagaaaccacagcgacggcaagaagtaccccgagctggtgctggaccaggccctggacagagaggagcagccccagctgagactgaccctgaccgccctggacggcggcagcccccccagaaccggcaccagccaggtgctgatcgtgatcgtggacatcaacgacaacgtgcccgagttcgcccagagaagatacgaggtgcaggtgcccgagaacacccccatcggcagcctggtgatcaccgtgagcgccagagacctggacgccggcacccacggcgagctgagctacagcttcttccagtacagcaaccagatcatccaggccttcgagatcaacagcatcaccggcgagatcagattcaagaaggccctggacttcgaggagatccagagctaccacatggaggtggaggccagcgacggcggcggcctgagcggcaagtgcaccgtggccatcgaggtgatggacatcaacgacaacgcccccgagctgaccatgagcctgctgatcagcgacatcctggagaacagccccgagaccgtggtggccgtgttcggcatcagcgaccccgacagcggcaacaacggcaagatgatgtgcagcatccaggaccacctgcccttcctgctgaagcccaccctggagaacttctacaccctgctgaccgagggcgccctggacagagagagcagagccgagtacaacatcaccatcaccgtgaccgacctgggcacccccagactgaagaccgagtacaacatcaccctgagagtgagcgacgtgaacgacaacgcccccgccttcacccagaccagctacaccctgttcgtgagagagaacaacagccccgccctgcacatcggcagcgtgagcgccaccgacagagacagcggcaccaacgcccaggtgacctacagcctgctgcccccccagaacccccacctgcccctggccagcctggtgagcatcaacaccgacaacggccacctgttcgccctgagaagcctggactacgaggccctgcaggagttcgagttcagagtgggcgccagcgacagaggcagccccgccctgagcagcgaggccctggtgagagtgctggtgtgctggacccccaccaccaccagacccagctgctgcaccagatgcagaaccgcccccagacccgcccccagctggtgccccggcagacccagcagagccacctggtag

SEQ ID NO: 21266 - DNA, 726 bp, Artificial Sequence
  Description of Artificial Sequence: Synthetic coding sequence
atggaggactacctgcagggctgcagagccgccctgcaggagagaaccatcatcctggactgcgtgaacatggacctgaagatcggcaaggccacccccaaggacagcaagtacgtggagaagctggaggccctgttccccgacctgcccaagagaaacgacatcttcgacagcctgcagaaggccaagttcgacgtgagcggcctgaccaccgagcagatgctgagaaaggaccagaagaccatctacagacagggcgtgaaggtggccatcagcgccatctacatggacctggagatctgcgaggtgctggagagaagccacagcccccccctgaagctgacccccgccagcagcacccaccccaacctgcacgcctacctgcagggcaacacccaggtgagcagaaagaagctgctgcccctgctgcaggaggccctgagcgcctacttcgacagcatgaagatccccagcggccagcccgagaccgccgacgtgagcagagagcaggtggacaaggagctggacagagccagcaacagcctgatcagcggcctgagccaggacgaggaggacccccccctgccccccacccccatgaacagcctggtggacgagtgccccctggaccagggcctgcccaagctgagcgccgaggccgtgttcgagaagtgcagccagatcagcctgagccagagcaccaccgccagcctgagcaagaagtag

SEQ ID NO: 21267 - DNA, 1362 bp, Artificial Sequence
  Description of Artificial Sequence: Synthetic coding sequence
atggaggactacctgcagggctgcagagccgccctgcaggagagcagacccctgcacgtggtgctgggcaacgaggcctgcgacctggacagcaccgtgagcgccctggccctggccttctacctggccaagaccaccgaggccgaggaggtgttcgtgcccgtgctgaacatcaagagaagcgagctgcccctgagaggcgacatcgtgttcttcctgcagaaggtgcacatccccgagagcatcctgatcttcagagacgagatcgacctgcacgccctgtaccaggccggccagctgaccctgatcctggtggaccaccacatcctgagcaagagcgacaccgccctggaggaggccgtggccgaggtgctggaccacagacccatcgagcccaagcactgccccccctgccacgtgagcgtggagctggtgggcagctgcgccaccctggtgaccgagagaatcctgcagggcgcccccgagatcctggacagacagaccgccgccctgctgcacggcaccatcatcctggactgcgtgaacatggacctgaagatcggcaaggccacccccaaggacagcaagtacgtggagaagctggaggccctgttccccgacctgcccaagagaaacgacatcttcgacagcctgcagaaggccaagttcgacgtgagcggcctgaccaccgagcagatgctgagaaaggaccagaagaccatctacagacagggcgtgaaggtggccatcagcgccatctacatggacctggaggccttcctgcagagaagcaacctgctggccgacctgcacgccttctgccaggcccacagctacgacgtgctggtggccatgaccatcttcttcaacacccacaacgagcccgtgagacagctggccatcttctgcccccacgtggccctgcagaccaccatctgcgaggtgctggagagaagccacagcccccccctgaagctgacccccgccagcagcacccaccccaacctgcacgcctacctgcagggcaacacccaggtgagcagaaagaagctgctgcccctgctgcaggaggccctgagcgcctacttcgacagcatgaagatccccagcggccagcccgagaccgccgacgtgagcagagagcaggtggacaaggagctggacagagccagcaacagcctgatcagcggcctgagccaggacgaggaggacccccccctgccccccacccccatgaacagcctggtggacgagtgccccctggaccagggcctgcccaagctgagcgccgaggccgtgttcgagaagtgcagccagatcagcctgagccagagcaccaccgccagcctgagcaagaagtag

SEQ ID NO: 21268 - DNA, 1161 bp, Artificial Sequence
  Description of Artificial Sequence: Synthetic coding sequence
atggaggactacctgcagggctgcagagccgccctgcaggagagcagacccctgcacgtggtgctgggcaacgaggcctgcgacctggacagcaccgtgagcgccctggccctggccttctacctggccaagagaagcgacaccgccctggaggaggccgtggccgaggtgctggaccacagacccatcgagcccaagcactgccccccctgccacgtgagcgtggagctggtgggcagctgcgccaccctggtgaccgagagaatcctgcagggcgcccccgagatcctggacagacagaccgccgccctgctgcacggcaccatcatcctggactgcgtgaacatggacctgaagatcggcaaggccacccccaaggacagcaagtacgtggagaagctggaggccctgttccccgacctgcccaagagaaacgacatcttcgacagcctgcagaaggccaagttcgacgtgagcggcctgaccaccgagcagatgctgagaaaggaccagaagaccatctacagacagggcgtgaaggtggccatcagcgccatctacatggacctggaggccttcctgcagagaagcaacctgctggccgacctgcacgccttctgccaggcccacagctacgacgtgctggtggccatgaccatcttcttcaacacccacaacgagcccgtgagacagctggccatcttctgcccccacgtggccctgcagaccaccatctgcgaggtgctggagagaagccacagcccccccctgaagctgacccccgccagcagcacccaccccaacctgcacgcctacctgcagggcaacacccaggtgagcagaaagaagctgctgcccctgctgcaggaggccctgagcgcctacttcgacagcatgaagatccccagcggccagcccgagaccgccgacgtgagcagagagcaggtggacaaggagctggacagagccagcaacagcctgatcagcggcctgagccaggacgaggaggacccccccctgccccccacccccatgaacagcctggtggacgagtgccccctggaccagggcctgcccaagctgagcgccgaggccgtgttcgagaagtgcagccagatcagcctgagccagagcaccaccgccagcctgagcaagaagtag

SEQ ID NO: 21269 - DNA, 657 bp, Artificial Sequence
  Description of Artificial Sequence: Synthetic coding sequence
atggacctgaagatcggcaaggccacccccaaggacagcaagtacgtggagaagctggaggccctgttccccgacctgcccaagagaaacgacatcttcgacagcctgcagaaggccaagttcgacgtgagcggcctgaccaccgagcagatgctgagaaaggaccagaagaccatctacagacagggcgtgaaggtggccatcagcgccatctacatggacctggagatctgcgaggtgctggagagaagccacagcccccccctgaagctgacccccgccagcagcacccaccccaacctgcacgcctacctgcagggcaacacccaggtgagcagaaagaagctgctgcccctgctgcaggaggccctgagcgcctacttcgacagcatgaagatccccagcggccagcccgagaccgccgacgtgagcagagagcaggtggacaaggagctggacagagccagcaacagcctgatcagcggcctgagccaggacgaggaggacccccccctgccccccacccccatgaacagcctggtggacgagtgccccctggaccagggcctgcccaagctgagcgccgaggccgtgttcgagaagtgcagccagatcagcctgagccagagcaccaccgccagcctgagcaagaagtag

SEQ ID NO: 21270 - DNA, 507 bp, Artificial Sequence
  Description of Artificial Sequence: Synthetic coding sequence
atgctgagaaaggaccagaagaccatctacagacagggcgtgaaggtggccatcagcgccatctacatggacctggagatctgcgaggtgctggagagaagccacagcccccccctgaagctgacccccgccagcagcacccaccccaacctgcacgcctacctgcagggcaacacccaggtgagcagaaagaagctgctgcccctgctgcaggaggccctgagcgcctacttcgacagcatgaagatccccagcggccagcccgagaccgccgacgtgagcagagagcaggtggacaaggagctggacagagccagcaacagcctgatcagcggcctgagccaggacgaggaggacccccccctgccccccacccccatgaacagcctggtggacgagtgccccctggaccagggcctgcccaagctgagcgccgaggccgtgttcgagaagtgcagccagatcagcctgagccagagcaccaccgccagcctgagcaagaagtag

SEQ ID NO: 21271 - DNA, 816 bp, Artificial Sequence
  Description of Artificial Sequence: Synthetic coding sequence
atggacctgaagatcggcaaggccacccccaaggacagcaagtacgtggagaagctggaggccctgttccccgacctgcccaagagaaacgacatcttcgacagcctgcagaaggccaagttcgacgtgagcggcctgaccaccgagcagatgctgagaaaggaccagaagaccatctacagacagggcgtgaaggtggccatcagcgccatctacatggacctggaggccttcctgcagagaagcaacctgctggccgacctgcacgccttctgccaggcccacagctacgacgtgctggtggccatgaccatcttcttcaacacccacaacgagcccgtgagacagctggccatcttctgcccccacgtggccctgcagaccaccatctgcgaggtgctggagagaagccacagcccccccctgaagctgacccccgccagcagcacccaccccaacctgcacgcctacctgcagggcaacacccaggtgagcagaaagaagctgctgcccctgctgcaggaggccctgagcgcctacttcgacagcatgaagatccccagcggccagcccgagaccgccgacgtgagcagagagcaggtggacaaggagctggacagagccagcaacagcctgatcagcggcctgagccaggacgaggaggacccccccctgccccccacccccatgaacagcctggtggacgagtgccccctggaccagggcctgcccaagctgagcgccgaggccgtgttcgagaagtgcagccagatcagcctgagccagagcaccaccgccagcctgagcaagaagtag

SEQ ID NO: 21272 - DNA, 657 bp, Artificial Sequence; identical to SEQ ID NO: 21269
  Description of Artificial Sequence: Synthetic coding sequence

SEQ ID NO: 21273 - DNA, 537 bp, Artificial Sequence
  Description of Artificial Sequence: Synthetic coding sequence
atggacctgaagatcggcaaggccacccccaaggacagcaagtacgtggagaagctggaggccctgttccccgacctgcccaagagaaacgacatcttcgacagcctgcagaaggccaagttcgacgtgagcggcctgaccaccgagcagatgctgagaaaggaccagaagaccatctacagacagggcgtgaaggtggccatcagcgccatctacatggacctggagatctgcgaggtgctggagagaagccacagcccccccctgaagctgacccccgccagcagcacccaccccaacctgcacgcctacctgcagggcaacacccaggtgagcagaaagaagctgctgcccctgctgcaggaggccctgagcgcctacttcgacagcatgaagatccccagcggccagcccgagaccgccgacgtgagcagagagcaggtggacaaggagctggacagagccagcaacagcctgatcagcggcctgagccaggacgaggaggacccccccctgccccccacccccatgaactag

SEQ ID NO: 21274 - DNA, 423 bp, Artificial Sequence
  Description of Artificial Sequence: Synthetic coding sequence
atggacctgaagatcggcaaggccacccccaaggacagcaagtacgtggagaagctggaggccctgttccccgacctgcccaagagaaacgacatcttcgacagcctgcagaaggccaagttcgacgtgagcggcctgaccaccgagcagatgctgagaaaggaccagaagaccatctacagacagggcgtgaaggtggccatcagcgccatctacatggacctggaggccttcctgcagagaagcaacctgctggccgacctgcacgccttctgccaggcccacagctacgacgtgctggtggccatgaccatcttcttcaacacccacaacgagcccgtgagacagctggccatcttctgcccccacgtggccctgcagaccaccatctgcgaggtgctggagagaagccacagcccctag

SEQ ID NO: 21275 - DNA, 5241 bp, Artificial Sequence
  Description of Artificial Sequence: Synthetic coding sequence
atgagcgcctgcaacaccttcaccgagcacgtgtggaagcccggcgagtgcaagaactgcttcaagcccaagagcctgcaccagctgccccccgaccccgagaaggcccccatcacccacggcaacgtgaagaccaacgccaaccacagcaacaaccacagaatcagaaacaccggcaacttcagaccccccgtggccaagaagcccaccatcgccgtgaagcccaccatgatcgtggccgacggccagagcatctgcggcgagctgagcatccaggagcactgcgagaacaagcccgtgatcatcggctggaacagaaacagagccgccctgagccagaagcccctgaacaacaacaacgaggacgacgagggcatcagccacgtgcccaagccctacggcaacaacgacagcgccaagaagatgagcgacaacaacaacggcctgaccgaggtgctgaaggagatcgccggcctggacaccgccccccagatcagaggcaacgagaccaacagcagagagaccttcctgggcagaatcaacgactgctacaagagaagcctggagagaaagctgccccccagctgcatgatcggcggcatcaaggagacccagggcaagcacgtgatcctgagcggcagcaccgaggtgatcagcaacgagggcggcagattctgctaccccgagttcagcagcggcgaggagagcgaggaggacgtgctgttcagcaacatggaggaggagcacgagagctgggacgagagcgacgaggagctgctggccatggagatcagaatgagaggccagcccagattcgccaacttcagagccaacaccctgagccccgtgagattcttcgtggacaagaagtggaacaccatccccctgagaaacaagagcctgcagagaatctgcgccgtggactacgacgacagctacgacgagatcctgaacggctacgaggagaacagcgtggtgagctacggccagggcagcatccagagcatggtgagcagcgacagcaccagccccgacagcagcctgaccgaggagagcagaagcgagaccgccagcagcctgagccagaagatctgcaacggcggcctgagccccggcaaccccggcgacagcaaggacatgaaggagatcgagcccaactacgagagccccagcagcaacaaccaggacaaggacagcagccaggccagcaagagcagcatcaaggtgcccgagacccacaaggccgtgctggccctgagactggaggagaaggacggcaagatcgccgtgcagaccgagaaggaggagagcaaggccagcaccgacgtggccggccaggccgtgaccatcaacctggtgcccaccgaggagcaggccaagccctacagagtggtgaacctggagcagcccctgtgcaagccctacaccgtggtggacgtgagcgccgccatggccagcgagcacctggagggccccgtgaacagccccaagaccaagagcagcagcagcacccccaacagccccgtgaccagcagcagcctgacccccggccagatcagcgcccacttccagaagagcagcgccatcagataccaggaggtgtggaccagcagcaccagccccagacagaagatccccaaggtggagctgatcaccagcggcaccggccccaacgtgccccccagaaagaactgccacaagagcgcccccaccagccccaccgccaccaacatcagcagcaagaccatccccgtgaagagccccaacctgagcgagatcaagttcaacagctacaacaacgccggcatgccccccttccccatcatcatccacgacgagcccacctacgccagaagcagcaagaacgccatcaaggtgcccatcgtgatcaaccccaacgcctacgacaacctggccatctacaagagcttcctgggcaccagcggcgagctgagcgtgaaggagaagaccaccagcgtgatcagccacacctacgaggagatcgagaccgagagcaaggtgcccgacaacaccaccagcaagaccaccgactgcctgcagaccaagggcttcagcaacagcaccgagcacaagagaggcagcgtggcccagaaggtgcaggagttcaacaactgcctgaacagaggccagagcagcccccagagaagctacagcagcagccacagcagccccgccaagatccagagagccacccaggagcccgtggccaagatcgagggcacccaggagagccagatggtgggcagcagcagcaccagagagaaggccagcaccgtgctgagccagatcgtggccagcatccagcccccccagagcccccccgagaccccccagagcggccccaaggcctgcagcgtggaggagctgtacgccatcccccccgacgccgacgtggccaagagcacccccaagagcacccccgtgagacccaagagcctgttcaccagccagcccagcggcgaggccgaggccccccagaccaccgacagccccaccaccaaggtgcagaaggaccccagcatcaagcccgtgacccccagccccagcaagctggtgaccagcccccagagcgagccccccgcccccttccccccccccagaagcaccagcagcccctaccacgccggcaacctgctgcagagacacttcaccaactggaccaagcccaccagccccaccagaagcaccgaggccgagagcgtgctgcacagcgagggcagcagaagagccgccgacgccaagcccaagagatggatcagcttcaagagcttcttcagaagaagaaagaccgacgaggaggacgacaaggagaaggagagagagaagggcaagctggtgggcctggacggcaccgtgatccacatgctgccccccccccccgtgcagagacaccactggttcaccgaggccaagggcgagagcagcgagaagcccgccatcgtgttcatgtacagatgcgaccccgcccagggccagctgagcgtggaccagagcaaggccagaaccgaccaggccgccgtgatggagaagggcagagccgagaacgccctgctgcaggacagcgagaagaagagaagccacagcagccccagccagatccccaagaagatcctgagccacatgacccacgaggtgaccgaggacttcagccccagagaccccagaaccgtggtgggcaagcaggacggcagaggctgcaccagcgtgaccaccgccctgagcctgcccgagctggagagagaggacggcaaggaggacatcagcgaccccatggaccccaacccctgcagcgccacctacagcaacctgggccagagcagagccgccatgatcccccccaagcagcccagacagcccaagggcgccgtggacgacgccatcgccttcggcggcaagaccgaccaggaggcccccaacgccagccagcccacccccccccccctgcccaagaagatgatcatcagagccaacaccgagcccatcagcaaggacctgcagaagagcatggagagcagcctgtgcgtgatggccaaccccacctacgacatcgaccccaactgggacgccagcagcgccggcagcagcatcagctacgagctgaagggcctggacatcgagagctacgacagcctggagagacccctgagaaaggagagacccgtgcccagcgccgccaacagcatcagcagcctgaccaccctgagcatcaaggacagattcagcaacagcatggagagcctgagcagcagaagaggccccagctgcagacagggcagaggcatccagaagccccagagacaggccctgtacagaggcctggagaacagagaggaggtggtgggcaagatcagaagcctgcacaccgacgccctgaagaagctggccgtgaagtgcgaggacctgttcatggccggccagaaggaccagctgagattcggcgtggacagctggagcgacttcagactgaccagcgacaagccctgctgcgaggccggcgacgccgtgtactacaccgccagctacgccaaggaccccctgaacaactacgccgtgaagatctgcaagagcaaggccaaggagagccagcagtactaccacagcctggccgtgagacagagcctggccgtgcacttcaacatccagcaggactgcggccacttcctggccgaggtgcccaacagactgctgccctgggaggaccccgacgaccccgagaaggacgaggacgacatggaggagaccgaggaggacgccaagggcgagaccgacggcaagaaccccaagccctgcagcgaggccgccagcagccagaaggagaaccagggcgtgatgagcaagaagcagagaagccacgtggtggtgatcaccagagaggtgccctgcctgaccgtggccgacttcgtgagagacagcctggcccagcacggcaagagccccgacctgtacgagagacaggtgtgcctgctgctgctgcagctgtgcagcggcctggagcacctgaagccctaccacgtgacccactgcgacctgagactggagaacctgctgctggtgcactaccagcccggcggcaccgcccagggcttcggccccgccgagcccagccccaccagcagctaccccaccagactgatcgtgagcaacttcagccaggccaagcagaagagccacctggtggaccccgagatcctgagagaccagagcagactggcccccgagatcatcaccgccacccagtacaagaagtgcgacgagttccagaccggcatcctgatctacgagatgctgcacctgcccaaccccttcgacgagaaccccgagctgaaggagagagagtacaccagagccgacctgcccagaatccccttcagaagcccctacagcagaggcctgcagcagctggccagctgcctgctgaaccccaaccccagcgagagaatcctgatcagcgacgccaagggcatcctgcagtgcctgctgtggggccccagagaggacctgttccagaccttcaccgcctgccccagcctggtgcagagaaacaccctgctgcagaactggctggacatcaagagaaccctgctgatgatcaagttcgccgagaagagcctggacagagagggcggcatcagcctggaggactggctgtgcgcccagtacctggccttcgccaccaccgacagcctgagctgcatcgtgaagatcctgcagcacagatag

SEQ ID NO: 21276 - DNA, 5241 bp, Artificial Sequence; identical to SEQ ID NO: 21275
  Description of Artificial Sequence: Synthetic coding sequence

SEQ ID NO: 21277 - DNA, 3402 bp, Artificial Sequence
  Description of Artificial Sequence: Synthetic coding sequence
atggacgtgctggccgaggagttcggcaacctgacccccgagcagctggccgcccccatccccaccgtggaggagaagtggagactgctgcccgccttcctgaaggtgaagggcctggtgaagcagcacatcgacagcttcaactacttcatcaacgtggagatcaagaagatcatgaaggccaacgagaaggtgaccagcgacgccgaccccatgtggtacctgaagtacctgaacatctacgtgggcctgcccgacgtggaggagagcttcaacgtgaccagacccgtgagcccccacgagtgcagactgagagacatgacctacagcgcccccatcaccgtggacatcgagtacaccagaggcagccagagaatcatcagaaacgccctgcccatcggcagaatgcccatcatgctgagaagcagcaactgcgtgctgaccggcaagacccccgccgagttcgccaagctgaacgagtgccccctggaccccggcggctacttcatcgtgaagggcgtggagaaggtgatcctgatccaggagcagctgagcaagaacagaatcatcgtggaggccgacagaaagggcgccgtgggcgccagcgtgaccagcagcacccacgagaagaagagcagaaccaacatggccgtgaagcagggcagattctacctgagacacaacaccctgagcgaggacatccccatcgtgatcatcttcaaggccatgggcgtggagagcgaccaggagatcgtgcagatgatcggcaccgaggagcacgtgatggccgccttcggccccagcctggaggagtgccagaaggcccagatcttcacccagatgcaggccctgaagtacatcggcaacaaggtgagaagacagagaatgtggggcggcggccccaagaagaccaagatcgaggaggccagagagctgctggccagcaccatcctgacccacgtgcccgtgaaggagttcaacttcagagccaagtgcatctacaccgccgtgatggtgagaagagtgatcctggcccagggcgacaacaaggtggacgacagagactactacggcaacaagagactggagctggccggccagctgctgagcctgctgttcgaggacctgttcaagaagttcaacagcgagatgaagaagatcgccgaccaggtgatccccaagcagagagccgcccagttcgacgtggtgaagcacatgagacaggaccagatcaccaacggcatggtgaacgccatcagcaccggcaactggagcctgaagagattcaagatggacagacagggcgtgacccaggtgctgagcagactgagctacatcagcgccctgggcatgatgaccagaatcagcagccagttcgagaagaccagaaaggtgagcggccccagaagcctgcagcccagccagtggggcatgctgtgccccagcgacacccccgagggcgaggcctgcggcctggtgaagaacctggccctgatgacccacatcaccaccgacatggaggacggccccatcgtgaagctggccagcaacctgggcgtggaggacgtgaacctgctgtgcggcgaggagctgagctaccccaacgtgttcctggtgttcctgaacggcaacatcctgggcgtgatcagagaccacaagaagctggtgaacaccttcagactgatgagaagagccggctacatcaacgagttcgtgagcatcagcaccaacctgaccgacagatgcgtgtacatcagcagcgacggcggcagactgtgcagaccctacatcatcgtgaagaagcagaagcccgccgtgaccaacaagcacatggaggagctggcccagggctacagaaacttcgaggacttcctgcacgagagcctggtggagtacctggacgtgaacgaggagaacgactgcaacatcgccctgtacgagcacaccatcaacaaggacaccacccacctggagatcgagcccttcaccctgctgggcgtgtgcgccggcctgatcccctacccccaccacaaccagagccccagaaacacctaccagtgcgccatgggcaagcaggccatgggcaccatcggctacaaccagagaaacagaatcgacaccctgatgtacctgctggcctacccccagaagcccatggtgaagaccaagaccatcgagctgatcgagttcgagaagctgcccgccggccagaacgccaccgtggccgtgatgagctacagcggctacgacatcgaggacgccctggtgctgaacaaggccagcctggacagaggcttcggcagatgcctggtgtacaagaacgccaagtgcaccctgaagagatacaccaaccagaccttcgacaaggtgatgggccccatgctggacgccgccaccagaaagcccatctggagacacgagatcctggacgccgacggcatctgcagccccggcgagaaggtggagaacaagcaggtgctggtgaacaagagcatgcccaccgtgacccagatccccctggagggcagcaacgtgccccagcagccccagtacaaggacgtgcccatcacctacaagggcgccaccgacagctacatcgagaaggtgatgatcagcagcaacgccgaggacgccttcctgatcaagatgctgctgagacagaccagaagacccgagatcggcgacaagttcagcagcagacacggccagaagggcgtgtgcggcctgatcgtgccccaggaggacatgcccttctgcgacagcggcatctgccccgacatcatcatgaacccccacggcttccccagcagaatgaccgtgggcaagctgatcgagctgctggccggcaaggccggcgtgctggacggcagattccactacggcaccgccttcggcggcagcaaggtgaaggacgtgtgcgaggacctggtgagacacggctacaactacctgggcaaggactacgtgaccagcggcatcaccggcgagcccctggaggcctacatctacttcggccccgtgtactaccagaagctgaagcacatggtgctggacaagatgcacgccagagccagaggccccagagccgtgctgaccagacagcccaccgagggcagaagcagagacggcggcctgagactgggcgagatggagagagactgcctgatcggctacggcgccagcatgctgctgctggagagactgatgatcagcagcgacgccttcgaggtggacgtgtgcggccagtgcggcctgctgggctacagcggctggtgccactactgcaagagcagctgccacgtgagcagcctgagaatcccctacgcctgcaagctgctgttccaggagctgcagagcatgaacatcatccccagactgaagctgagcaagtacaacgagtag

SEQ ID NO: 21278 - DNA, 3036 bp, Artificial Sequence
  Description of Artificial Sequence: Synthetic coding sequence
atgatgagcgacgccagcgacatgctggccgccgccctggagcagatggacggcatcatcgccggcagcaaggccctggagtacagcaacggcatcttcgactgccagagccccaccagccccttcatgggcagcctgagagccctgcacctggtggaggacctgagaggcctgctggagatgatggagaccgacgagaaggagggcctgagatgccagatccccgacagcaccgccgagaccctggtggagtggctgcagagccagatgaccaacggccacctgcccggcaacggcgacgtgtaccaggagagactggccagactggagaacgacaaggagagcctggtgctgcaggtgagcgtgctgaccgaccaggtggaggcccagggcgagaagatcagagacctggagttctgcctggaggagcacagagagaaggtgaacgccaccgaggagatgctgcagcaggagctgctgagcagaaccagcctggagacccagaagctggacctgatggccgagatcagcaacctgaagctgaagctgaccgccgtggagaaggacagactggactacgaggacaagttcagagacaccgagggcctgatccaggagatcaacgacctgagactgaaggtgagcgagatggacagcgagagactgcagtacgagaagaagctgaagagcaccaagagcctgatggccaagctgagcagcatgaagatcaaggtgggccagatgcagtacgagaagcagagaatggagcagaagtgggagagcctgaaggacgagctggccagcctgaaggagcagctggaggagaaggagagcgaggtgaagagactgcaggagaagctggtgtgcaagatgaagggcgagggcgtggagatcgtggacagagacatcgaggtgcagaagatgaagaaggccgtggagagcctgatggccgccaacgaggagaaggacagaaagatcgaggacctgagacagtgcctgaacagatacaagaagatgcaggacaccgtggtgctggcccagggcaaggacggcgagtacgaggagctgctgaacagcagcagcatcagcagcctgctggacgcccagggcttcagcgacctggagaagagccccagccccacccccgtgatgggcagccccagctgcgaccccttcaacaccagcgtgcccgaggagttccacaccaccatcctgcaggtgagcatccccagcctgctgcccgccaccgtgagcatggagaccagcgagaagagcaagctgacccccaagcccgagaccagcttcgaggagaacgacggcaacatcatcctgggcgccaccgtggacacccagctgtgcgacaagctgctgaccagcagcctgcagaagagcagcagcctgggcaacctgaagaaggagaccagcgacggcgagaaggagaccatccagaagaccagcgaggacagagcccccgccgagagcagacccttcggcaccctgccccccagaccccccggccaggacaccagcatggacgacaaccccttcggcaccagaaaggtgagaagcagcttcggcagaggcttcttcaagatcaagagcaacaagagaaccgccagcgcccccaacctggccgagaccgagaaggagaccgccgagcacctggacctggccggcgccagcagcagacccaaggacagccagagaaacagccccttccagatccccccccccagccccgacagcaagaagaagagcagaggcatcatgaagctgttcggcaagctgagaagaagccagagcaccaccttcaaccccgacgacatgagcgagcccgagttcaagagaggcggcaccagagccaccgccggccccagactgggctggagcagagacctgggccagagcaacagcgacctggacatgcccttcgccaagtggaccaaggagcaggtgtgcaactggctgatggagcagggcctgggcagctacctgaacagcggcaagcactggatcgccagcggccagaccctgctgcaggccagccagcaggacctggagaaggagctgggcatcaagcacagcctgcacagaaagaagctgcagctggccctgcaggccctgggcagcgaggaggagaccaaccacggcaagctggacttcaactgggtgaccagatggctggacgacatcggcctgccccagtacaagacccagttcgacgagggcagagtggacggcagaatgctgcactacatgaccgtggacgacctgctgagcctgaaggtggtgagcgtgctgcaccacctgagcatcaagagagccatccaggtgctgagaatcaacaacttcgagcccaactgcctgagaagaagacccagcgacgagaacaccatcgcccccagcgaggtgcagaagtggaccaaccacagagtgatggagtggctgagaagcgtggacctggccgagtacgcccccaacctgagaggcagcggcgtgcacggcggcctgatggtgctggagcccagattcaacgtggagaccatggcccagctgctgaacatcccccccaacaagaccctgctgagaagacacctggccacccacttcaacctgctgatcggcgccgaggcccagcaccagaagagagacgccatggagctgcccgactacgtgctgctgaccgccaccgccaaggtgaagcccaagaagctggccttcagcaacttcggcaacctgagaaagaagaagcaggaggacggcgaggagtacgtgtgccccatggagctgggccaggccagcggcagcgccagcaagaagggcttcaagcccggcctggacatgagactgtacgaggaggacgacctggacagactggagcagatggaggacagcgagggcaccgtgagacagatcggcgccttcagcgagggcatcaacaacctgacccacatgctgaaggaggacgacatgttcaaggacttcgccgccagaagccccagcgccagcatcaccgacgaggacagcaacgtgtag

SEQ ID NO: 21279 - DNA, 513 bp, Artificial Sequence
  Description of Artificial Sequence: Synthetic coding sequence
atgatgagcgacgccagcgacatgctggccgccgccctggagcagatggacggcatcatcgccggcagcaaggccctggagtacagcaacggcatcttcgactgccagagccccaccagccccttcatgggcagcctgagagccctgcacctggtggaggacctgagaggcctgctggagatgatggagaccgacgagaaggagggcctgagatgccagatccccgacagcaccgccgagaccctggtggagtggctgcagagccagatgaccaacggccacctgcccggcaacggcgacgtgtaccaggagagactggccagactggagaacgacaaggagagcctggtgctgcaggtgagcgtgctgaccgaccaggtggaggcccagggcgagaagatcagagacctggagttctgcctggaggagcacagagagaaggtgaacgccaccgaggagatgctgcagcaggtgtgcgccgaggccagaaccaagatgggcttcccctgctag

SEQ ID NO: 21280 - DNA, 261 bp, Artificial Sequence
  Description of Artificial Sequence: Synthetic coding sequence
atgatgagcgacgccagcgacatgctggccgccgccctggagcagatggacggcatcatcgccggcagcaaggccctggagtacagcaacggcatcttcgactgccagagccccaccagccccttcatgggcagcctgagagccctgcacctggtggaggacctgagaggcctgctggagatgatggagaccgacgagaaggagggcctgagatgccagatccccgacagcaccgccgagaccctggtggagtggctgtag

SEQ ID NO: 21281 - DNA, 2577 bp, Artificial Sequence
  Description of Artificial Sequence: Synthetic coding sequence
atgctgcagcaggagctgctgagcagaaccagcctggagacccagaagctggacctgatggccgagatcagcaacctgaagctgaagctgaccgccgtggagaaggacagactggactacgaggacaagttcagagacaccgagggcctgatccaggagatcaacgacctgagactgaaggtgagcgagatggacagcgagagactgcagtacgagaagaagctgaagagcaccaagagcctgatggccaagctgagcagcatgaagatcaaggtgggccagatgcagtacgagaagcagagaatggagcagaagtgggagagcctgaaggacgagctggccagcctgaaggagcagctggaggagaaggagagcgaggtgaagagactgcaggagaagctggtgtgcaagatgaagggcgagggcgtggagatcgtggacagagacatcgaggtgcagaagatgaagaaggccgtggagagcctgatggccgccaacgaggagaaggacagaaagatcgaggacctgagacagtgcctgaacagatacaagaagatgcaggacaccgtggtgctggcccagggcaaggacggcgagtacgaggagctgctgaacagcagcagcatcagcagcctgctggacgcccagggcttcagcgacctggagaagagccccagccccacccccgtgatgggcagccccagctgcgaccccttcaacaccagcgtgcccgaggagttccacaccaccatcctgcaggtgagcatccccagcctgctgcccgccaccgtgagcatggagaccagcgagaagagcaagctgacccccaagcccgagaccagcttcgaggagaacgacggcaacatcatcctgggcgccaccgtggacacccagctgtgcgacaagctgctgaccagcagcctgcagaagagcagcagcctgggcaacctgaagaaggagaccagcgacggcgagaaggagaccatccagaagaccagcgaggacagagcccccgccgagagcagacccttcggcaccctgccccccagaccccccggccaggacaccagcatggacgacaaccccttcggcaccagaaaggtgagaagcagcttcggcagaggcttcttcaagatcaagagcaacaagagaaccgccagcgcccccaacctggccgagaccgagaaggagaccgccgagcacctggacctggccggcgccagcagcagacccaaggacagccagagaaacagccccttccagatccccccccccagccccgacagcaagaagaagagcagaggcatcatgaagctgttcggcaagctgagaagaagccagagcaccaccttcaaccccgacgacatgagcgagcccgagttcaagagaggcggcaccagagccaccgccggccccagactgggctggagcagagacctgggccagagcaacagcgacctggacatgcccttcgccaagtggaccaaggagcaggtgtgcaactggctgatggagcagggcctgggcagctacctgaacagcggcaagcactggatcgccagcggccagaccctgctgcaggccagccagcaggacctggagaaggagctgggcatcaagcacagcctgcacagaaagaagctgcagctggccctgcaggccctgggcagcgaggaggagaccaaccacggcaagctggacttcaactgggtgaccagatggctggacgacatcggcctgccccagtacaagacccagttcgacgagggcagagtggacggcagaatgctgcactacatgaccgtggacgacctgctgagcctgaaggtggtgagcgtgctgcaccacctgagcatcaagagagccatccaggtgctgagaatcaacaacttcgagcccaactgcctgagaagaagacccagcgacgagaacaccatcgcccccagcgaggtgcagaagtggaccaaccacagagtgatggagtggctgagaagcgtggacctggccgagtacgcccccaacctgagaggcagcggcgtgcacggcggcctgatggtgctggagcccagattcaacgtggagaccatggcccagctgctgaacatcccccccaacaagaccctgctgagaagacacctggccacccacttcaacctgctgatcggcgccgaggcccagcaccagaagagagacgccatggagctgcccgactacgtgctgctgaccgccaccgccaaggtgaagcccaagaagctggccttcagcaacttcggcaacctgagaaagaagaagcaggaggacggcgaggagtacgtgtgccccatggagctgggccaggccagcggcagcgccagcaagaagggcttcaagcccggcctggacatgagactgtacgaggaggacgacctggacagactggagcagatggaggacagcgagggcaccgtgagacagatcggcgccttcagcgagggcatcaacaacctgacccacatgctgaaggaggacgacatgttcaaggacttcgccgccagaagccccagcgccagcatcaccgacgaggacagcaacgtgtag

SEQ ID NO: 21282 - DNA, 57 bp, Artificial Sequence
  Description of Artificial Sequence: Synthetic coding sequence
atgctgcagcaggagctgctgagcagaaccagcctggagacccagaagctggactag

SEQ ID NO: 21283 - DNA, 2943 bp, Artificial Sequence
  Description of Artificial Sequence: Synthetic coding sequence
atgatgagcgacgccagcgacatgctggccgccgccctggagcagatggacggcatcatcgccggcagcaaggccctggagtacagcaacggcatcttcgactgccagagccccaccagccccttcatgggcagcctgagagccctgcacctggtggaggacctgagaggcctgctggagatgatggagaccgacgagaaggagggcctgagatgccagatccccgacagcaccgccgagaccctggtggagtggctgcagagccagatgaccaacggccacctgcccggcaacggcgacgtgtaccaggagagactggccagactggagaacgacaaggagagcctggtgctgcaggtgagcgtgctgaccgaccaggtggaggcccagggcgagaagatcagagacctggagttctgcctggaggagcacagagagaaggtgaacgccaccgaggagatgctgcagcaggagctgctgagcagaaccagcctggagacccagaagctggacctgatggccgagatcagcaacctgaagctgaagctgaccgccgtggagaaggacagactggactacgaggacaagttcagagacaccgagggcctgatccaggagatcaacgacctgagactgaaggtgagcgagatggacagcgagagactgcagtacgagaagaagctgaagagcaccaaggacgagctggccagcctgaaggagcagctggaggagaaggagagcgaggtgaagagactgcaggagaagctggtgtgcaagatgaagggcgagggcgtggagatcgtggacagagacatcgaggtgcagaagatgaagaaggccgtggagagcctgatggccgccaacgaggagaaggacagaaagatcgaggacctgagacagtgcctgaacagatacaagaagatgcaggacaccgtggtgctggcccagggcaaggacggcgagtacgaggagctgctgaacagcagcagcatcagcagcctgctggacgcccagggcttcagcgacctggagaagagccccagccccacccccgtgatgggcagccccagctgcgaccccttcaacaccagcgtgcccgaggagttccacaccaccatcctgcaggtgagcatccccagcctgctgcccgccaccgtgagcatggagaccagcgagaagagcaagctgacccccaagcccgagaccagcttcgaggagaacgacggcaacatcatcctgggcgccaccgtggacacccagctgtgcgacaagctgctgaccagcagcctgcagaagagcagcagcctgggcaacctgaagaaggagaccagcgacggcgagaaggagaccatccagaagaccagcgaggacagagcccccgccgagagcagacccttcggcaccctgccccccagaccccccggccaggacaccagcatggacgacaaccccttcggcaccagaaaggtgagaagcagcttcggcagaggcttcttcaagatcaagagcaacaagagaaccgccagcgcccccaacctggccgagaccgagaaggagaccgccgagcacctggacctggccggcgccagcagcagacccaaggacagccagagaaacagccccttccagatccccccccccagccccgacagcaagaagaagagcagaggcatcatgaagctgttcggcaagctgagaagaagccagagcaccaccttcaaccccgacgacatgagcgagcccgagttcaagagaggcggcaccagagccaccgccggccccagactgggctggagcagagacctgggccagagcaacagcgacctggacatgcccttcgccaagtggaccaaggagcaggtgtgcaactggctgatggagcagggcctgggcagctacctgaacagcggcaagcactggatcgccagcggccagaccctgctgcaggccagccagcaggacctggagaaggagctgggcatcaagcacagcctgcacagaaagaagctgcagctggccctgcaggccctgggcagcgaggaggagaccaaccacggcaagctggacttcaactgggtgaccagatggctggacgacatcggcctgccccagtacaagacccagttcgacgagggcagagtggacggcagaatgctgcactacatgaccgtggacgacctgctgagcctgaaggtggtgagcgtgctgcaccacctgagcatcaagagagccatccaggtgctgagaatcaacaacttcgagcccaactgcctgagaagaagacccagcgacgagaacaccatcgcccccagcgaggtgcagaagtggaccaaccacagagtgatggagtggctgagaagcgtggacctggccgagtacgcccccaacctgagaggcagcggcgtgcacggcggcctgatggtgctggagcccagattcaacgtggagaccatggcccagctgctgaacatcccccccaacaagaccctgctgagaagacacctggccacccacttcaacctgctgatcggcgccgaggcccagcaccagaagagagacgccatggagctgcccgactacgtgctgctgaccgccaccgccaaggtgaagcccaagaagctggccttcagcaacttcggcaacctgagaaagaagaagcaggaggacggcgaggagtacgtgtgccccatggagctgggccaggccagcggcagcgccagcaagaagggcttcaagcccggcctggacatgagactgtacgaggaggacgacctggacagactggagcagatggaggacagcgagggcaccgtgagacagatcggcgccttcagcgagggcatcaacaacctgacccacatgctgaaggaggacgacatgttcaaggacttcgccgccagaagccccagcgccagcatcaccgacgaggacagcaacgtgtag

SEQ ID NO: 21284 - DNA, 852 bp, Artificial Sequence
  Description of Artificial Sequence: Synthetic coding sequence
atgatgagcgacgccagcgacatgctggccgccgccctggagcagatggacggcatcatcgccggcagcaaggccctggagtacagcaacggcatcttcgactgccagagccccaccagccccttcatgggcagcctgagagccctgcacctggtggaggacctgagaggcctgctggagatgatggagaccgacgagaaggagggcctgagatgccagatccccgacagcaccgccgagaccctggtggagtggctgcagagccagatgaccaacggccacctgcccggcaacggcgacgtgtaccaggagagactggccagactggagaacgacaaggagagcctggtgctgcaggccatggtgagcgtgctgaccgaccaggtggaggcccagggcgagaagatcagagacctggagttctgcctggaggagcacagagagaaggtgaacgccaccgaggagatgctgcagcaggagctgctgagcagaaccagcctggagacccagaagctggacctgatggccgagatcagcaacctgaagctgaagctgaccgccgtggagaaggacagactggactacgaggacaagttcagagacaccgagggcctgatccaggagatcaacgacctgagactgaaggtgagcgagatggacagcgagagactgcagtacgagaagaagctgaagagcaccaaggacgagctggccagcctgaaggagcagctggaggagaaggagagcgaggtgaagagactgcaggagaagctggtgtgcaagatgaagggcgagggcgtggagatcgtggacagagacgagaacttcaagaagaagctgaaggagaagtag

SEQ ID NO: 21285 - DNA, 846 bp, Artificial Sequence
  Description of Artificial Sequence: Synthetic coding sequence
atgatgagcgacgccagcgacatgctggccgccgccctggagcagatggacggcatcatcgccggcagcaaggccctggagtacagcaacggcatcttcgactgccagagccccaccagccccttcatgggcagcctgagagccctgcacctggtggaggacctgagaggcctgctggagatgatggagaccgacgagaaggagggcctgagatgccagatccccgacagcaccgccgagaccctggtggagtggctgcagagccagatgaccaacggccacctgcccggcaacggcgacgtgtaccaggagagactggccagactggagaacgacaaggagagcctggtgctgcaggtgagcgtgctgaccgaccaggtggaggcccagggcgagaagatcagagacctggagttctgcctggaggagcacagagagaaggtgaacgccaccgaggagatgctgcagcaggagctgctgagcagaaccagcctggagacccagaagctggacctgatggccgagatcagcaacctgaagctgaagctgaccgccgtggagaaggacagactggactacgaggacaagttcagagacaccgagggcctgatccaggagatcaacgacctgagactgaaggtgagcgagatggacagcgagagactgcagtacgagaagaagctgaagagcaccaaggacgagctggccagcctgaaggagcagctggaggagaaggagagcgaggtgaagagactgcaggagaagctggtgtgcaagatgaagggcgagggcgtggagatcgtggacagagacgagaacttcaagaagaagctgaaggagaagtag

SEQ ID NO: 21286 - DNA, 1197 bp, Artificial Sequence
  Description of Artificial Sequence: Synthetic coding sequence
atgggccaggccggctgcaagggcctgtgcctgagcctgttcgactacaagaccgagaagtacgtgatcgccaagaacaagaaggtgggcctgctgtacagactgctgcaggccagcatcctggcctacctggtggtgtgggtgttcctgatcaagaagggctaccaggacgtggacaccagcctgcagagcgccgtgatcaccaaggtgaagggcgtggccttcaccaacaccagcgacctgggccagagaatctgggacgtggccgactacgtgatccccgcccagaacgagggcatccccgacggcgcctgcagcaaggacagcgactgccacgccggcgaggccgtgaccgccggcaacggcgtgaagaccggcagatgcctgagaagagagaacctggccagaggcacctgcgagatcttcgcctggtgccccctggagaccagcagcagacccgaggagcccttcctgaaggaggccgaggacttcaccatcttcatcaagaaccacatcagattccccaagttcaacttcagcaagagcaacgtgatggacgtgaaggacagaagcttcctgaagagctgccacttcggccccaagaaccactactgccccatcttcagactgggcagcgtgatcagatgggccggcagcgacttccaggacatcgccctggagggcggcgtgatcggcatcaacatcgagtggaactgcgacctggacaaggccgccagcgagtgccacccccactacagcttcagcagactggacaacaagctgagcaagagcgtgagcagcggctacaacttcagattcgccagatactacagagacgccgccggcgtggagttcagaaccctgatgaaggcctacggcatcagattcgacgtgatggtgaacggcaagggcgccttcttctgcgacctggtgctgatctacctgatcaagaagagagagttctacagagacaagaagtacgaggaggtgagaggcctggaggacagcagccaggaggccgaggacgaggccagcggcctgggcctgagcgagcagctgaccagcggccccggcctgctgggcatgcccgagcagcaggagctgcaggagccccccgaggccaagagaggcagcagcagccagaagggcaacggcagcgtgtgcccccagctgctggagccccacagaagcacctag

SEQ ID NO: 21287 - DNA, 1248 bp, Artificial Sequence
  Description of Artificial Sequence: Synthetic coding sequence
atgtgcccccagctggccggcgccggcagcatgggcagccccggcgccaccaccggctggggcctgctggactacaagaccgagaagtgggccctgctggccaagaagggctaccaggagagagacctggagccccagttcagcatcatcaccaagctgaagggcgtgagcgtgacccagatcaaggagctgggcaacagactgtgggacgtggccgacttcgtgaagcccccccagggcgagaacgtgttcttcctggtgaccaacttcctggtgacccccgcccaggtgcagggcagatgccccgagcaccccagcgtgcccctggccaactgctgggtggacgaggactgccccgagggcgagggcggcacccacagccacggcgtgaagaccggccagtgcgtggtgttcaacggcacccacagaacctgcgagatctggagctggtgccccgtggagagcggcgtggtgcccagcagacccctgctggcccaggcccagaacttcaccctgttcatcaagaacaccgtgaccttcagcaagttcaacttcagcaagagcaacgccctggagacctgggaccccacctacttcaagcactgcagatacgagccccagttcagcccctactgccccgtgttcagaatcggcgacctggtggccaaggccggcggcaccttcgaggacctggccctgctgggcggcagcgtgggcatcagagtgcactgggactgcgacctggacaccggcgacagcggctgctggccccactacagcttccagctgcaggagaagagctacaacttcagaaccgccacccactggtgggagcagcccggcgtggaggccagaaccctgctgaagctgtacggcatcagattcgacatcctggtgaccggccaggccggcaagttcggcctgatccccaccgccgtgaccctgggcaccggcgccgcctggctgggcgtggtgaccttcttctgcgacctgctgctgctgtacgtggacagagaggcccacttctactggagaaccaagtacgaggaggccaaggcccccaaggccaccgccaacagcgtgtggagagagctggccctggccagccaggccagactggccgagtgcctgagaagaagcagcgcccccgcccccaccgccaccgccgccggcagccagacccagacccccggctggccctgccccagcagcgacacccacctgcccacccacagcggcagcctgtag

SEQ ID NO: 21288 - DNA, 1494 bp, Artificial Sequence
  Description of Artificial Sequence: Synthetic coding sequence
atggccgccgcccagcccaagtaccccgccggcgccaccgccagaagactggccagaggctgctggagcgccctgtgggactacgagacccccaaggtgatcgtggtgagaaacagaagactgggcgtgctgtacagagccgtgcagctgctgatcctgctgtacttcgtgtggtacgtgttcatcgtgcagaagagctaccaggagagcgagaccggccccgagagcagcatcatcaccaaggtgaagggcatcaccaccagcgagcacaaggtgtgggacgtggaggagtacgtgaagccccccgagggcggcagcgtgttcagcatcatcaccagagtggaggccacccacagccagacccagggcacctgccccgagagcatcagagtgcacaacgccacctgcctgagcgacgccgactgcgtggccggcgagctggacatgctgggcaacggcctgagaaccggcagatgcgtgccctactaccagggccccagcaagacctgcgaggtgttcggctggtgccccgtggaggacggcgccagcgtgagccagttcctgggcaccatggcccccaacttcaccatcctgatcaagaacagcatccactaccccaagttccacttcagcaagggcaacatcgccgacagaaccgacggctacctgaagagatgcaccttccacgaggccagcgacctgtactgccccatcttcaagctgggcttcatcgtggagaaggccggcgagagcttcaccgagctggcccacaagggcggcgtgatcggcgtgatcatcaactgggactgcgacctggacctgcccgccagcgagtgcaaccccaagtacagcttcagaagactggaccccaagcacgtgcccgccagcagcggctacaacttcagattcgccaagtactacaagatcaacggcaccaccaccagaaccctgatcaaggcctacggcatcagaatcgacgtgatcgtgcacggccaggccggcaagttcagcctgatccccaccatcatcaacctggccaccgccctgaccagcgtgggcgtggtgagaaaccccctgtggggccccagcggctgcggcggcagcaccagacccctgcacaccggcctgtgctggccccagggcagcttcctgtgcgactggatcctgctgaccttcatgaacaagaacaaggtgtacagccacaagaagttcgacaaggtgtgcacccccagccaccccagcggcagctggcccgtgaccctggccagagtgctgggccaggccccccccgagcccggccacagaagcgaggaccagcaccccagcccccccagcggccaggagggccagcagggcgccgagtgcggccccgccttcccccccctgagaccctgccccatcagcgcccccagcgagcagatggtggacacccccgccagcgagcccgcccaggccagcacccccaccgaccccaagggcctggcccagctgtag

SEQ ID NO: 21289 - DNA, 1215 bp, Artificial Sequence
  Description of Artificial Sequence: Synthetic coding sequence
atggccgccgcccagcccaagtaccccgccggcgccaccgccagaagactggccagaggctgctggagcgccctgtgggactacgagacccccaaggtgatcgtggtgagaaacagaagactgggcgtgctgtacagagccgtgcagctgctgatcctgctgtacttcgtgtggtacgtgttcatcgtgcagaagagctaccaggagagcgagaccggccccgagagcagcatcatcaccaaggtgaagggcatcaccaccagcgagcacaaggtgtgggacgtggaggagtacgtgaagccccccgagggcggcagcgtgttcagcatcatcaccagagtggaggccacccacagccagacccagggcacctgccccgagagcatcagagtgcacaacgccacctgcctgagcgacgccgactgcgtggccggcgagctggacatgctgggcaacggcctgagaaccggcagatgcgtgccctactaccagggccccagcaagacctgcgaggtgttcggctggtgccccgtggaggacggcgccagcgtgagccagttcctgggcaccatggcccccaacttcaccatcctgatcaagaacagcatccactaccccaagttccacttcagcaagggcaacatcgccgacagaaccgacggctacctgaagagatgcaccttccacgaggccagcgacctgtactgccccatcttcaagctgggcttcatcgtggagaaggccggcgagagcttcaccgagctggcccacaagggcggcgtgatcggcgtgatcatcaactgggactgcgacctggacctgcccgccagcgagtgcaaccccaagtacagcttcagaagactggaccccaagcacgtgcccgccagcagcggctacaacttcagattcgccaagtactacaagatcaacggcaccaccaccagaaccctgatcaaggcctacggcatcagaatcgacgtgatcgtgcacggccaggccggcaagttcagcctgatccccaccatcatcaacctggccaccgccctgaccagcgtgggcgtgggcagcttcctgtgcgactggatcctgctgaccttcatgaacaagaacaaggtgtacagccacaagaagttcgacaagatggtggacacccccgccagcgagcccgcccaggccagcacccccaccgaccccaagggcctggcccagctgtag

SEQ ID NO: 21290 - DNA, 1344 bp, Artificial Sequence
  Description of Artificial Sequence: Synthetic coding sequence
atggccgccgcccagcccaagtaccccgccggcgccaccgccagaagactggccagaggctgctggagcgccctgtgggactacgagacccccaaggtgatcgtggtgagaaacagaagactgggcgtgctgtacagagccgtgcagctgctgatcctgctgtacttcgtgtggtacgtgttcatcgtgcagaagagctaccaggagagcgagaccggccccgagagcagcatcatcaccaaggtgaagggcatcaccaccagcgagcacaaggtgtgggacgtggaggagtacgtgaagccccccgagagcatcagagtgcacaacgccacctgcctgagcgacgccgactgcgtggccggcgagctggacatgctgggcaacggcctgagaaccggcagatgcgtgccctactaccagggccccagcaagacctgcgaggtgttcggctggtgccccgtggaggacggcgccagcgtgagccagttcctgggcaccatggcccccaacttcaccatcctgatcaagaacagcatccactaccccaagttccacttcagcaagggcaacatcgccgacagaaccgacggctacctgaagagatgcaccttccacgaggccagcgacctgtactgccccatcttcaagctgggcttcatcgtggagaaggccggcgagagcttcaccgagctggcccacaagggcggcgtgatcggcgtgatcatcaactgggactgcgacctggacctgcccgccagcgagtgcaaccccaagtacagcttcagaagactggaccccaagcacgtgcccgccagcagcggctacaacttcagattcgccaagtactacaagatcaacggcaccaccaccagaaccctgatcaaggcctacggcatcagaatcgacgtgatcgtgcacggccaggccggcaagttcagcctgatccccaccatcatcaacctggccaccgccctgaccagcgtgggcgtgggcagcttcctgtgcgactggatcctgctgaccttcatgaacaagaacaaggtgtacagccacaagaagttcgacaaggtgtgcacccccagccaccccagcggcagctggcccgtgaccctggccagagtgctgggccaggccccccccgagcccggccacagaagcgaggaccagcaccccagcccccccagcggccaggagggccagcagggcgccgagtgcggccccgccttcccccccctgagaccctgccccatcagcgcccccagcgagcagatggtggacacccccgccagcgagcccgcccaggccagcacccccaccgaccccaagggcctggcccagctgtag

SEQ ID NO: 21291 - DNA, 1140 bp, Artificial Sequence
  Description of Artificial Sequence: Synthetic coding sequence
atggccgccgcccagcccaagtaccccgccggcgccaccgccagaagactggccagaggctgctggagcgccctgtgggactacgagacccccaaggtgatcgtgagcatcagagtgcacaacgccacctgcctgagcgacgccgactgcgtggccggcgagctggacatgctgggcaacggcctgagaaccggcagatgcgtgccctactaccagggccccagcaagacctgcgaggtgttcggctggtgccccgtggaggacggcgccagcgtgagccagttcctgggcaccatggcccccaacttcaccatcctgatcaagaacagcatccactaccccaagttccacttcagcaagggcaacatcgccgacagaaccgacggctacctgaagagatgcaccttccacgaggccagcgacctgtactgccccatcttcaagctgggcttcatcgtggagaaggccggcgagagcttcaccgagctggcccacaagggcggcgtgatcggcgtgatcatcaactgggactgcgacctggacctgcccgccagcgagtgcaaccccaagtacagcttcagaagactggaccccaagcacgtgcccgccagcagcggctacaacttcagattcgccaagtactacaagatcaacggcaccaccaccagaaccctgatcaaggcctacggcatcagaatcgacgtgatcgtgcacggccaggccggcaagttcagcctgatccccaccatcatcaacctggccaccgccctgaccagcgtgggcgtgggcagcttcctgtgcgactggatcctgctgaccttcatgaacaagaacaaggtgtacagccacaagaagttcgacaaggtgtgcacccccagccaccccagcggcagctggcccgtgaccctggccagagtgctgggccaggccccccccgagcccggccacagaagcgaggaccagcaccccagcccccccagcggccaggagggccagcagggcgccgagtgcggccccgccttcccccccctgagaccctgccccatcagcgcccccagcgagcagatggtggacacccccgccagcgagcccgcccaggccagcacccccaccgaccccaagggcctggcccagctgtag

SEQ ID NO: 21292 - DNA, 1200 bp, Artificial Sequence
  Description of Artificial Sequence: Synthetic coding sequence
atggccgccgcccagcccaagtaccccgccggcgccaccgccagaagactggccagaggctgctggagcgccctgtgggactacgagacccccaaggtgatcgtggtgagaatccacagagccgagaagctgcccggcgagagagacggccccagagagctgcaccaccaccagggccagggcgaccaccacgtgagagcccagagcgtgggcagaggcggcgtgagagaggcccccagaggcctgagaaccggcagatgcgtgccctactaccagggccccagcaagacctgcgaggtgttcggctggtgccccgtggaggacggcgccagcgtgagccagttcctgggcaccatggcccccaacttcaccatcctgatcaagaacagcatccactaccccaagttccacttcagcaagggcaacatcgccgacagaaccgacggctacctgaagagatgcaccttccacgaggccagcgacctgtactgccccatcttcaagctgggcttcatcgtggagaaggccggcgagagcttcaccgagctggcccacaagggcggcgtgatcggcgtgatcatcaactgggactgcgacctggacctgcccgccagcgagtgcaaccccaagtacagcttcagaagactggaccccaagcacgtgcccgccagcagcggctacaacttcagattcgccaagtactacaagatcaacggcaccaccaccagaaccctgatcaaggcctacggcatcagaatcgacgtgatcgtgcacggccaggccggcaagttcagcctgatccccaccatcatcaacctggccaccgccctgaccagcgtgggcgtgggcagcttcctgtgcgactggatcctgctgaccttcatgaacaagaacaaggtgtacagccacaagaagttcgacaaggtgtgcacccccagccaccccagcggcagctggcccgtgaccctggccagagtgctgggccaggccccccccgagcccggccacagaagcgaggaccagcaccccagcccccccagcggccaggagggccagcagggcgccgagtgcggccccgccttcccccccctgagaccctgccccatcagcgcccccagcgagcagatggtggacacccccgccagcgagcccgcccaggccagcacccccaccgaccccaagggcctggcccagctgtag

SEQ ID NO: 21293 - DNA, 1416 bp, Artificial Sequence
  Description of Artificial Sequence: Synthetic coding sequence
atggccgccgcccagcccaagtaccccgccggcgccaccgccagaagactggccagaggctgctggagcgccctgtgggactacgagacccccaaggtgatcgtggtgagaaacagaagactgggcgtgctgtacagagccgtgcagctgctgatcctgctgtacttcgtgtggtacgtgttcatcgtgcagaagagctaccaggagagcgagaccggccccgagagcagcatcatcaccaaggtgaagggcatcaccaccagcgagcacaaggtgtgggacgtggaggagtacgtgaagccccccgagggcggcagcgtgttcagcatcatcaccagagtggaggccacccacagccagacccagggcacctgccccgagagcatcagagtgcacaacgccacctgcctgagcgacgccgactgcgtggccggcgagctggacatgctgggcaacggcctgagaaccggcagatgcgtgccctactaccagggccccagcaagacctgcgaggtgttcggctggtgccccgtggaggacggcgccagcgtgagccagttcctgggcaccatggcccccaacttcaccatcctgatcaagaacagcatccactaccccaagttccacttcagcaagggcaacatcgccgacagaaccgacggctacctgaagagatgcaccttccacgaggccagcgacctgtactgccccatcttcaagctgggcttcatcgtggagaaggccggcgagagcttcaccgagctggcccacaagggcggcgtgatcggcgtgatcatcaactgggactgcgacctggacctgcccgccagcgagtgcaaccccaagtacagcttcagaagactggaccccaagcacgtgcccgccagcagcggctacaacttcagattcgccaagtactacaagatcaacggcaccaccaccagaaccctgatcaaggcctacggcatcagaatcgacgtgatcgtgcacggccaggccggcaagttcagcctgatccccaccatcatcaacctggccaccgccctgaccagcgtgggcgtgggcagcttcctgtgcgactggatcctgctgaccttcatgaacaagaacaaggtgtacagccacaagaagttcgacaaggtgtgcacccccagccaccccagcggcagctggcccgtgaccctggccagagtgctgggccaggccccccccgagcccggccacagaagcgaggaccagcaccccagcccccccagcggccaggagggccagcagggcgccgagtgcggccccgccttcccccccctgagaccctgccccatcagcgcccccagcgagcagatggtggacacccccgccagcgagcccgcccaggccagcacccccaccgaccccaagggcctggcccagctgtag

SEQ ID NO: 21294 - DNA, 1113 bp, Artificial Sequence
  Description of Artificial Sequence: Synthetic coding sequence
atggccgccgcccagcccaagtaccccgccggcgccaccgccagaagactggccagaggctgctggagcgccctgtgggactacgagacccccaaggtgatcgtggtgagaaacagaagactgggcgtgctgtacagagccgtgcagctgctgatcctgctgtacttcgtgtggtacgtgttcatcgtgcagaagagctaccaggagagcgagaccggccccgagagcagcatcatcaccaaggtgaagggcatcaccaccagcgagcacaaggtgtgggacgtggaggagtacgtgaagccccccgagagcatcagagtgcacaacgccacctgcctgagcgacgccgactgcgtggccggcgagctggacatgctgggcaacggcgccctgcaggacctgagaggcgtgagactggtgcccggcggcagatggggcctgtgccagcccatcagcggctacgacggccccaagttccaccacccccaccaggagcagcaccccctgccccagatccccctgctgcagggccagcacagaagaccccacagaagagtgcccgaggccctgcacgtgcccagaggcctgagacccctgctgccccacctgcaggccggcctgtacagaggcgagggctggggcgagctgcacagagccagaacccagggcagaggcggcgtgatcggcgtgatcatcaactgggactgcgacctggacctgcccgccagcgagtgcaaccccaagtacagcttcagaagactggaccccaagcacgtgcccgccagcagcggctacaacttcagattcgccaagtactacaagatcaacggcaccaccaccagaaccctgatcaaggcctacggcatcagaatcgacgtgatcgtgcacggccaggccggcaagttcagcctgatccccaccatcatcaacctggccaccgccctgaccagcgtgggcgtgggcagcttcctgtgcgactggatcctgctgaccttcatgaacaagaacaaggtgtacagccacaagaagttcgacaagatggtggacacccccgccagcgagcccgcccaggccagcacccccaccgaccccaagggcctggcccagctgtag

SEQ ID NO: 21295 - DNA, 1056 bp, Artificial Sequence
  Description of Artificial Sequence: Synthetic coding sequence
atggccgaccaggaccccgccggcatcagccccctgcagcagatggtggccagcggcaccggcgccgtggtgaccagcctgttcatgacccccctggacgtggtgaaggtgagactgcagagccagagacccagcatggccagcgagctgatgcccagcagcagactgtggagcctgagctacaccaagtggaagtgcctgctgtactgcaacggcgtgctggagcccctgtacctgtgccccaacggcgccagatgcgccacctggttccaggaccccaccagattcaccggcaccatggacgccttcgtgaagatcgtgagacacgagggcaccagaaccctgtggagcggcctgcccgccaccctggtgatgaccgtgcccgccaccgccatctacttcaccgcctacgaccagctgaaggccttcctgtgcggcagagccctgaccagcgacctgtacgcccccatggtggccggcgccctggccagactgggcaccgtgaccgtgatcagccccctggagctgatgagaaccaagctgcaggcccagcacgtgagctacagagagctgggcgcctgcgtgagaaccgccgtggcccagggcggctggagaagcctgtggctgggctggggccccaccgccctgagagacgtgcccttcagcgccctgtactggttcaactacgagctggtgaagagctggctgaacggcttcagacccaaggaccagaccagcgtgggcatgagcttcgtggccggcggcatcagcggcaccgtggccgccgtgctgaccctgcccttcgacgtggtgaagacccagagacaggtggccctgggcgccatggaggccgtgagagtgaaccccctgcacgtggacagcacctggctgctgctgagaagaatcagagccgagagcggcaccaagggcctgttcgccggcttcctgcccagaatcatcaaggccgcccccagctgcgccatcatgatcagcacctacgagttcggcaagagcttcttccagagactgaaccaggacagactgctgggcggctag

SEQ ID NO: 21296 - DNA, 1299 bp, Artificial Sequence
  Description of Artificial Sequence: Synthetic coding sequence
atgggccaggccggctgcaagggcctgtgcctgagcctgttcgactacaagaccgagaagtacgtgatcgccaagaacaagaaggtgggcctgctgtacagactgctgcaggccagcatcctggcctacctggtggtgtgggtgttcctgatcaagaagggctaccaggacgtggacaccagcctgcagagcgccgtgatcaccaaggtgaagggcgtggccttcaccaacaccagcgacctgggccagagaatctgggacgtggccgactacgtgatccccgcccagggcgagaacgtgttcttcgtggtgaccaacctgatcgtgacccccaaccagagacagaacgtgtgcgccgagaacgagggcatccccgacggcgcctgcagcaaggacagcgactgccacgccggcgaggccgtgaccgccggcaacggcgtgaagaccggcagatgcctgagaagagagaacctggccagaggcacctgcgagatcttcgcctggtgccccctggagaccagcagcagacccgaggagcccttcctgaaggaggccgaggacttcaccatcttcatcaagaaccacatcagattccccaagttcaacttcagcaagagcaacgtgatggacgtgaaggacagaagcttcctgaagagctgccacttcggccccaagaaccactactgccccatcttcagactgggcagcgtgatcagatgggccggcagcgacttccaggacatcgccctggagggcggcgtgatcggcatcaacatcgagtggaactgcgacctggacaaggccgccagcgagtgccacccccactacagcttcagcagactggacaacaagctgagcaagagcgtgagcagcggctacaacttcagattcgccagatactacagagacgccgccggcgtggagttcagaaccctgatgaaggcctacggcatcagattcgacgtgatggtgaacggcaagggcgccttcttctgcgacctggtgctgatctacctgatcaagaagagagagttctacagagacaagaagtacgaggaggtgagaggcctggaggacagcagccaggaggccgaggacgaggccagcggcctgggcctgagcgagcagctgaccagcggccccggcctgctgggcatgcccgagcagcaggagctgcaggagccccccgaggccaagagaggcagcagcagccagaagggcaacggcagcgtgtgcccccagctgctggagccccacagactgagaacccccagcgccagccccctgcaccaggagtag

SEQ ID NO: 21297 - DNA, 1266 bp, Artificial Sequence
  Description of Artificial Sequence: Synthetic coding sequence
atgggccaggccggctgcaagggcctgtgcctgagcctgttcgactacaagaccgagaagtacgtgatcgccaagaacaagaaggtgggcctgctgtacagactgctgcaggccagcatcctggcctacctggtggtgtgggtgttcctgatcaagaagggctaccaggacgtggacaccagcctgcagagcgccgtgatcaccaaggtgaagggcgtggccttcaccaacaccagcgacctgggccagagaatctgggacgtggccgactacgtgatccccgcccagggcgagaacgtgttcttcgtggtgaccaacctgatcgtgacccccaaccagagacagaacgtgtgcgccgagaacgagggcatccccgacggcgcctgcagcaaggacagcgactgccacgccggcgaggccgtgaccgccggcaacggcgtgaagaccggcagatgcctgagaagagagaacctggccagaggcacctgcgagatcttcgcctggtgccccctggagaccagcagcagacccgaggagcccttcctgaaggaggccgaggacttcaccatcttcatcaagaaccacatcagattccccaagttcaacttcagcaacaacgtgatggacgtgaaggacagaagcttcctgaagagctgccacttcggccccaagaaccactactgccccatcttcagactgggcagcgtgatcagatgggccggcagcgacttccaggacatcgccctggagggcggcgtgatcggcatcaacatcgagtggaactgcgacctggacaaggccgccagcgagtgccacccccactacagcttcagcagactggacaacaagctgagcaagagcgtgagcagcggctacaacttcagattcgccagatactacagagacgccgccggcgtggagttcagaaccctgatgaaggcctacggcatcagattcgacgtgatggtgaacggcaagggcgccttcttctgcgacctggtgctgatctacctgatcaagaagagagagttctacagagacaagaagtacgaggaggtgagaggcctggaggacagcagccaggaggccgaggacgaggccagcggcctgggcctgagcgagcagctgaccagcggccccggcctgctgggcatgcccgagcagcaggagctgcaggagccccccgaggccaagagaggcagcagcagccagaagggcaacggcagcgtgtgcccccagctgctggagccccacagaagcacctag

SEQ ID NO: 21298 - DNA, 1194 bp, Artificial Sequence
  Description of Artificial Sequence: Synthetic coding sequence
atgggccaggccggctgcaagggcctgtgcctgagcctgttcgactacaagaccgagaagtacgtgatcgccaagaacaagaaggtgggcctgctgtacagactgctgcaggccagcatcctggcctacctggtggtgtgggtgttcctgatcaagaagggctaccaggacgtggacaccagcctgcagagcgccgtgatcaccaaggtgaagggcgtggccttcaccaacaccagcgacctgggccagagaatctgggacgtggccgactacgtgatccccgcccagaacgagggcatccccgacggcgcctgcagcaaggacagcgactgccacgccggcgaggccgtgaccgccggcaacggcgtgaagaccggcagatgcctgagaagagagaacctggccagaggcacctgcgagatcttcgcctggtgccccctggagaccagcagcagacccgaggagcccttcctgaaggaggccgaggacttcaccatcttcatcaagaaccacatcagattccccaagttcaacttcagcaacaacgtgatggacgtgaaggacagaagcttcctgaagagctgccacttcggccccaagaaccactactgccccatcttcagactgggcagcgtgatcagatgggccggcagcgacttccaggacatcgccctggagggcggcgtgatcggcatcaacatcgagtggaactgcgacctggacaaggccgccagcgagtgccacccccactacagcttcagcagactggacaacaagctgagcaagagcgtgagcagcggctacaacttcagattcgccagatactacagagacgccgccggcgtggagttcagaaccctgatgaaggcctacggcatcagattcgacgtgatggtgaacggcaagggcgccttcttctgcgacctggtgctgatctacctgatcaagaagagagagttctacagagacaagaagtacgaggaggtgagaggcctggaggacagcagccaggaggccgaggacgaggccagcggcctgggcctgagcgagcagctgaccagcggccccggcctgctgggcatgcccgagcagcaggagctgcaggagccccccgaggccaagagaggcagcagcagccagaagggcaacggcagcgtgtgcccccagctgctggagccccacagaagcacctag

SEQ ID NO: 21299 - DNA, 1089 bp, Artificial Sequence
  Description of Artificial Sequence: Synthetic coding sequence
atgcccacctacagaccccccagccacagatgggtgttcctgatcaagaagggctaccaggacgtggacaccagcctgcagagcgccgtgatcaccaaggtgaagggcgtggccttcaccaacaccagcgacctgggccagagaatctgggacgtggccgactacgtgatccccgcccagaacgagggcatccccgacggcgcctgcagcaaggacagcgactgccacgccggcgaggccgtgaccgccggcaacggcgtgaagaccggcagatgcctgagaagagagaacctggccagaggcacctgcgagatcttcgcctggtgccccctggagaccagcagcagacccgaggagcccttcctgaaggaggccgaggacttcaccatcttcatcaagaaccacatcagattccccaagttcaacttcagcaagagcaacgtgatggacgtgaaggacagaagcttcctgaagagctgccacttcggccccaagaaccactactgccccatcttcagactgggcagcgtgatcagatgggccggcagcgacttccaggacatcgccctggagggcggcgtgatcggcatcaacatcgagtggaactgcgacctggacaaggccgccagcgagtgccacccccactacagcttcagcagactggacaacaagctgagcaagagcgtgagcagcggctacaacttcagattcgccagatactacagagacgccgccggcgtggagttcagaaccctgatgaaggcctacggcatcagattcgacgtgatggtgaacggcaagggcgccttcttctgcgacctggtgctgatctacctgatcaagaagagagagttctacagagacaagaagtacgaggaggtgagaggcctggaggacagcagccaggaggccgaggacgaggccagcggcctgggcctgagcgagcagctgaccagcggccccggcctgctgggcatgcccgagcagcaggagctgcaggagccccccgaggccaagagaggcagcagcagccagaagggcaacggcagcgtgtgcccccagctgctggagccccacagaagcacctag

SEQ ID NO: 21300 - DNA, 1296 bp, Artificial Sequence
  Description of Artificial Sequence: Synthetic coding sequence
atgggcagccccggcgccaccaccggctggggcctgctggactacaagaccgagaagtacgtgatgaccagaaactggagagtgggcgccctgcagagactgctgcagttcggcatcgtggtgtacgtggtgggctgggccctgctggccaagaagggctaccaggagagagacctggagccccagttcagcatcatcaccaagctgaagggcgtgagcgtgacccagatcaaggagctgggcaacagactgtgggacgtggccgacttcgtgaagcccccccagggcgagaacgtgttcttcctggtgaccaacttcctggtgacccccgcccaggtgcagggcagatgccccgagcaccccagcgtgcccctggccaactgctgggtggacgaggactgccccgagggcgagggcggcacccacagccacggcgtgaagaccggccagtgcgtggtgttcaacggcacccacagaacctgcgagatctggagctggtgccccgtggagagcggcgtggtgcccagcagacccctgctggcccaggcccagaacttcaccctgttcatcaagaacaccgtgaccttcagcaagttcaacttcagcaagagcaacgccctggagacctgggaccccacctacttcaagcactgcagatacgagccccagttcagcccctactgccccgtgttcagaatcggcgacctggtggccaaggccggcggcaccttcgaggacctggccctgctgggcggcagcgtgggcatcagagtgcactgggactgcgacctggacaccggcgacagcggctgctggccccactacagcttccagctgcaggagaagagctacaacttcagaaccgccacccactggtgggagcagcccggcgtggaggccagaaccctgctgaagctgtacggcatcagattcgacatcctggtgaccggccaggccggcaagttcggcctgatccccaccgccgtgaccctgggcaccggcgccgcctggctgggcgtggtgaccttcttctgcgacctgctgctgctgtacgtggacagagaggcccacttctactggagaaccaagtacgaggaggccaaggcccccaaggccaccgccaacagcgtgtggagagagctggccctggccagccaggccagactggccgagtgcctgagaagaagcagcgcccccgcccccaccgccaccgccgccggcagccagacccagacccccggctggccctgccccagcagcgacacccacctgcccacccacagcggcagcctgtag

SEQ ID NO: 21301 - DNA, 213 bp, Artificial Sequence
  Description of Artificial Sequence: Synthetic coding sequence
atgggcagccccggcgccaccaccggctggggcctgctggactacaagaccgagaagtgggccctgctggccaagaagggctaccaggagagagacctggagccccagttcagcatcatcaccaagctgaagggcgtgagcgtgacccagatcaaggagctgggcaacagactgtgggacgtggccgacttcgtgaagcccccccaggtgtag

SEQ ID NO: 21302 - DNA, 1326 bp, Artificial Sequence
  Description of Artificial Sequence: Synthetic coding sequence
atgtgcccccagctggccggcgccggcagcatgggcagccccggcgccaccaccggctggggcctgctggactacaagaccgagaagtacgtgatgaccagaaactggagagtgggcgccctgcagagactgctgcagttcggcatcgtggtgtacgtggtgggctgggccctgctggccaagaagggctaccaggagagagacctggagccccagttcagcatcatcaccaagctgaagggcgtgagcgtgacccagatcaaggagctgggcaacagactgtgggacgtggccgacttcgtgaagcccccccagggcgagaacgtgttcttcctggtgaccaacttcctggtgacccccgcccaggtgcagggcagatgccccgagcaccccagcgtgcccctggccaactgctgggtggacgaggactgccccgagggcgagggcggcacccacagccacggcgtgaagaccggccagtgcgtggtgttcaacggcacccacagaacctgcgagatctggagctggtgccccgtggagagcggcgtggtgcccagcagacccctgctggcccaggcccagaacttcaccctgttcatcaagaacaccgtgaccttcagcaagttcaacttcagcaagagcaacgccctggagacctgggaccccacctacttcaagcactgcagatacgagccccagttcagcccctactgccccgtgttcagaatcggcgacctggtggccaaggccggcggcaccttcgaggacctggccctgctgggcggcagcgtgggcatcagagtgcactgggactgcgacctggacaccggcgacagcggctgctggccccactacagcttccagctgcaggagaagagctacaacttcagaaccgccacccactggtgggagcagcccggcgtggaggccagaaccctgctgaagctgtacggcatcagattcgacatcctggtgaccggccaggccggcaagttcggcctgatccccaccgccgtgaccctgggcaccggcgccgcctggctgggcgtggtgaccttcttctgcgacctgctgctgctgtacgtggacagagaggcccacttctactggagaaccaagtacgaggaggccaaggcccccaaggccaccgccaacagcgtgtggagagagctggccctggccagccaggccagactggccgagtgcctgagaagaagcagcgcccccgcccccaccgccaccgccgccggcagccagacccagacccccggctggccctgccccagcagcgacacccacctgcccacccacagcggcagcctgtag

SEQ ID NO: 21303 - DNA, 243 bp, Artificial Sequence
  Description of Artificial Sequence: Synthetic coding sequence
atgtgcccccagctggccggcgccggcagcatgggcagccccggcgccaccaccggctggggcctgctggactacaagaccgagaagtgggccctgctggccaagaagggctaccaggagagagacctggagccccagttcagcatcatcaccaagctgaagggcgtgagcgtgacccagatcaaggagctgggcaacagactgtgggacgtggccgacttcgtgaagcccccccaggtgtag

SEQ ID NO: 21304 - DNA, 1167 bp, Artificial Sequence
  Description of Artificial Sequence: Synthetic coding sequence
atgtggtgggccctgctggccaagaagggctaccaggagagagacctggagccccagttcagcatcatcaccaagctgaagggcgtgagcgtgacccagatcaaggagctgggcaacagactgtgggacgtggccgacttcgtgaagcccccccagggcgagaacgtgttcttcctggtgaccaacttcctggtgacccccgcccaggtgcagggcagatgccccgagcaccccagcgtgcccctggccaactgctgggtggacgaggactgccccgagggcgagggcggcacccacagccacggcgtgaagaccggccagtgcgtggtgttcaacggcacccacagaacctgcgagatctggagctggtgccccgtggagagcggcgtggtgcccagcagacccctgctggcccaggcccagaacttcaccctgttcatcaagaacaccgtgaccttcagcaagttcaacttcagcaagagcaacgccctggagacctgggaccccacctacttcaagcactgcagatacgagccccagttcagcccctactgccccgtgttcagaatcggcgacctggtggccaaggccggcggcaccttcgaggacctggccctgctgggcggcagcgtgggcatcagagtgcactgggactgcgacctggacaccggcgacagcggctgctggccccactacagcttccagctgcaggagaagagctacaacttcagaaccgccacccactggtgggagcagcccggcgtggaggccagaaccctgctgaagctgtacggcatcagattcgacatcctggtgaccggccaggccggcaagttcggcctgatccccaccgccgtgaccctgggcaccggcgccgcctggctgggcgtggtgaccttcttctgcgacctgctgctgctgtacgtggacagagaggcccacttctactggagaaccaagtacgaggaggccaaggcccccaaggccaccgccaacagcgtgtggagagagctggccctggccagccaggccagactggccgagtgcctgagaagaagcagcgcccccgcccccaccgccaccgccgccggcagccagacccagacccccggctggccctgccccagcagcgacacccacctgcccacccacagcggcagcctgtag

SEQ ID NO: 21305 - DNA, 1020 bp, Artificial Sequence
  Description of Artificial Sequence: Synthetic coding sequence
atggccaacctggacaagtacaccgagaccttcaagatgggcagcaacagcaccagcaccgccgagatctactgcaacgtgaccaacgtgaagttccagtacagcctgtacgccaccacctacatcctgatcttcatccccggcctgctggccaacagcgccgccctgtgggtgctgtgcagattcatcagcaagaagaacaaggccatcatcttcatgatcaacctgagcgtggccgacctggcccacgtgctgagcctgcccctgagaatctactactacatcagccaccactggcccttccagagagccctgtgcctgctgtgcttctacctgaagtacctgaacatgtacgccagcatctgcttcctgacctgcatcagcctgcagagatgcttcttcctgctgaagcccttcagagccagagactggaagagaagatacgacgtgggcatcagcgccgccatctggatcgtggtgggcaccgcctgcctgcccttccccatcctgagaagcaccgacctgaacaacaacaagagctgcttcgccgacctgggctacaagcagatgaacgccgtggccctggtgggcatgatcaccgtggccgagctggccggcttcgtgatccccgtgatcatcatcgcctggtgcacctggaagaccaccatcagcctgagacagccccccatggccttccagggcatcagcgagagacagaaggccctgagaatggtgttcatgtgcgccgccgtgttcttcatctgcttcaccccctaccacatcaacttcatcttctacaccatggtgaaggagaccatcatcagcagctgccccgtggtgagaatcgccctgtacttccaccccttctgcctgtgcctggccagcctgtgctgcctgctggaccccatcctgtactacttcatggccagcgagttcagagaccagctgagcagacacggcagcagcgtgaccagaagcagactgatgagcaaggagagcggcagcagcatgatcggctag

SEQ ID NO: 21306 - DNA, 1020 bp, Artificial Sequence; identical to SEQ ID NO: 21305
  Description of Artificial Sequence: Synthetic coding sequence

SEQ ID NO: 21307 - DNA, 1065 bp, Artificial Sequence
  Description of Artificial Sequence: Synthetic coding sequence
atgaccgccgccatcagaagacagagagagctgagcatcctgcccaaggtgaccctggaggccatgaacaccaccgtgatgcagggcttcaacagaagcgagagatgccccagagacaccagaatcgtgcagctggtgttccccgccctgtacaccgtggtgttcctgaccggcatcctgctgaacaccctggccctgtgggtgttcgtgcacatccccagcagcagcaccttcatcatctacctgaagaacaccctggtggccgacctgatcatgaccctgatgctgcccttcaagatcctgagcgacagccacctggccccctggcagctgagagccttcgtgtgcagattcagcagcgtgatcttctacgagaccatgtacgtgggcatcgtgctgctgggcctgatcgccttcgacagattcctgaagatcatcagacccctgagaaacatcttcctgaagaagcccgtgttcgccaagaccgtgagcatcttcatctggttcttcctgttcttcatcagcctgcccaacaccatcctgagcaacaaggaggccacccccagcagcgtgaagaagtgcgccagcctgaagggccccctgggcctgaagtggcaccagatggtgaacaacatctgccagttcatcttctggaccgtgttcatcctgatgctggtgttctacgtggtgatcgccaagaaggtgtacgacagctacagaaagagcaagagcaaggacagaaagaacaacaagaagctggagggcaaggtgttcgtggtggtggccgtgttcttcgtgtgcttcgcccccttccacttcgccagagtgccctacacccacagccagaccaacaacaagaccgactgcagactgcagaaccagctgttcatcgccaaggagaccaccctgttcctggccgccaccaacatctgcatggaccccctgatctacatcttcctgtgcaagaagttcaccgagaagctgccctgcatgcagggcagaaagaccaccgccagcagccaggagaaccacagcagccagaccgacaacatcaccctgggctag

SEQ ID NO: 21308 - DNA, 1017 bp, Artificial Sequence
  Description of Artificial Sequence: Synthetic coding sequence
atgatcaacagcaccagcacccagccccccgacgagagctgcagccagaacctgctgatcacccagcagatcatccccgtgctgtactgcatggtgttcatcgccggcatcctgctgaacggcgtgagcggctggatcttcttctacgtgcccagcagcaagagcttcatcatctacctgaagaacatcgtgatcgccgacttcgtgatgagcctgaccttccccttcaagatcctgggcgacagcggcctgggcccctggcagctgaacgtgttcgtgtgcagagtgagcgccgtgctgttctacgtgaacatgtacgtgagcatcgtgttcttcggcctgatcagcttcgacagatactacaagatcgtgaagcccctgtggaccagcttcatccagagcgtgagctacagcaagctgctgagcgtgatcgtgtggatgctgatgctgctgctggccgtgcccaacatcatcctgaccaaccagagcgtgagagaggtgacccagatcaagtgcatcgagctgaagagcgagctgggcagaaagtggcacaaggccagcaactacatcttcgtggccatcttctggatcgtgttcctgctgctgatcgtgttctacaccgccatcaccaagaagatcttcaagagccacctgaagagcagcagaaacagcaccagcgtgaagaagaagagcagcagaaacatcttcagcatcgtgttcgtgttcttcgtgtgcttcgtgccctaccacatcgccagaatcccctacaccaagagccagaccgaggcccactacagctgccagagcaaggagatcctgagatacatgaaggagttcaccctgctgctgagcgccgccaacgtgtgcctggaccccatcatctacttcttcctgtgccagcccttcagagagatcctgtgcaagaagctgcacatccccctgaaggcccagaacgacctggacatcagcagaatcaagagaggcaacaccaccctggagagcaccgacaccctgtag

SEQ ID NO: 21309 - DNA, 1017 bp, Artificial Sequence; identical to SEQ ID NO: 21308
  Description of Artificial Sequence: Synthetic coding sequence

SEQ ID NO: 21310 - DNA, 291 bp, Artificial Sequence
  Description of Artificial Sequence: Synthetic coding sequence
atgatcaacagcaccagcacccagccccccgacgagagctgcagccagaacctgctgatcacccagcagatcatccccgtgctgtactgcatggtgttcatcgccggcatcctgctgaacggcgtgagcggctggatcttcttctacgtgcccagcagcaagagcttcatcatctacctgaagaacatcgtgatcgccgacttcgtgatgagcctgaccttccccttcaagatcctgggcgacagcggcctgggcccctggcagctgaacgtgttcgtgtgcagagtgtag

SEQ ID NO: 21311 - DNA, 2358 bp, Artificial Sequence
  Description of Artificial Sequence: Synthetic coding sequence
atggccagcaaggtgaccgacgccatcgtgtggtaccagaagaaggagttcctgagcgtggccaccaccgcccccggcccccagcaggtgctgcccggctactgccagtgcagcctgaaggaccagggcctgttcatccagtgcctgatcggcgcctacgaccagcagatctgggagaagagcgtggagcagagagagatcaagttcatcaagctgggcctgagaaacaagcccaagaagaccgcccacgtgaagcccgacctgatcgacgtggacctggtgagaggcagcgccttcgccaaggccaagcccgagagcccctggaccagcctgaccagaaagggcatcgtgagagtggtgttcttccccttcttcttcagatggtggctgcaggtgaccagcaaggtgatcttcttctggctgctggtgctgtacctgctgcaggtggccgccatcgtgctgttctgcagcaccagcagcccccacagcatccccctgaccgaggtgatcggccccatctggctgatgctgctgctgggcaccgtgcactgccagatcgtgagcaccagaacccccaagccccccctgagcaccggcggcaagagaagaagaaagctgagaaaggccgcccacctggaggtgcacagagagggcgacggcagcagcaccaccgacaacacccaggagggcgccgtgcagaaccacggcaccagcaccagccacagcgtgggcaccgtgttcagagacctgtggcacgccgccttcttcctgagcggcagcaagaaggccaagaacagcatcgacaagagcaccgagaccgacaacggctacgtgagcctggacggcaagaagaccgtgaagagcggcgaggacggcatccagaaccacgagccccagtgcgagaccatcagacccgaggagaccgcctggaacaccggcaccctgagaaacggccccagcaaggacacccagagaaccatcaccaacgtgagcgacgaggtgagcagcgaggagggccccgagaccggctacagcctgagaagacacgtggacagaaccagcgagggcgtgctgagaaacagaaagagccaccactacaagaagcactaccccaacgaggacgcccccaagagcggcaccagctgcagcagcagatgcagcagcagcagacaggacagcgagagcgccagacccgagagcgagaccgaggacgtgctgtgggaggacctgctgcactgcgccgagtgccacagcagctgcaccagcgagaccgacgtggagaaccaccagatcaacccctgcgtgaagaaggagtacagagacgaccccttccaccagagccacctgccctggctgcacagcagccaccccggcctggagaagatcagcgccatcgtgtgggagggcaacgactgcaagaaggccgacatgagcgtgctggagatcagcggcatgatcatgaacagagtgaacagccacatccccggcatcggctaccagatcttcggcaacgccgtgagcctgatcctgggcctgacccccttcgtgttcagactgagccaggccaccgacctggagcagctgaccgcccacagcgccagcgagctgtacgtgatcgccttcggcagcaacgaggacgtgatcgtgctgagcatggtgatcatcagcttcgtggtgagagtgagcctggtgtggatcttcttcttcctgctgtgcgtggccgagagaacctacaagcagagactgctgttcgccaagctgttcggccacctgaccagcgccagaagagccagaaagagcgaggtgccccacttcagactgaagaaggtgcagaacatcaagatgtggctgagcctgagaagctacctgaagagaagaggcccccagagaagcgtggacgtgatcgtgagcagcgccttcctgctgaccatcagcgtggtgttcatctgctgcgcccagctgctgcacgtgcacgagatcttcctggactgccactacaactgggagctggtgatctggtgcatcagcctgaccctgttcctgctgagattcgtgaccctgggcagcgagaccagcaagaagtacagcaacaccagcatcctgctgaccgagcagatcaacctgtacctgaagatggagaagaagcccaacaagaaggaggagctgaccctggtgaacaacgtgctgaagctggccaccaagctgctgaaggagctggacagccccttcagactgtacggcctgaccatgaaccccctgctgtacaacatcacccaggtggtgatcctgagcgccgtgagcggcgtgatcagcgacctgctgggcttcaacctgaagctgtggaagatcaagagctag

SEQ ID NO: 21312 - DNA, 2088 bp, Artificial Sequence
  Description of Artificial Sequence: Synthetic coding sequence
atggccagcaaggtgaccgacgccatcgtgtggtaccagaagaagatcggcgcctacgaccagcagatctgggagaagagcgtggagcagagagagatcaagggcctgagaaacaagcccaagaagaccgcccacgtgaagcccgacctgatcgacgtggacctggtgagaggcagcgccttcgccaaggccaagcccgagagcccctggaccagcctgaccagaaagggcatcgtgagagtggtgttcttccccttcttcttcagatggtggctgcaggtgaccagcaaggtgatcttcttctggctgctggtgctgtacctgctgcaggtggccgccatcgtgctgttctgcagcaccagcagcccccacagcatccccctgaccgaggtgatcggccccatctggctgatgctgctgctgggcaccgtgcactgccagatcgtgagcaccagaacccccaagccccccctgagcaccggcggcaagagaagaagaaagctgagaaaggccgcccacctggaggtgcacagagagggcgacggcagcagcaccaccgacaacacccaggagggcgccgtgcagaaccacggcaccagcaccagccacagcgtgggcaccgtgttcagagacctgtggcacgccgccttcttcctgagcggcagcaagaaggccaagaacagcatcgacaagagcaccgagaccgacaacggctacgtgagcctggacggcaagaagaccgtgaagagcggcgaggacggcatccagaaccacgagccccagtgcgagaccatcagacccgaggagaccgcctggaacaccggcaccctgagaaacggccccagcaaggacacccagagaaccatcaccaacgtgagcgacgaggtgagcagcgaggagggccccgagaccggctacagcctgagaagacacgtggacagaaccagcgagggcgtgctgagaaacagaaagagccaccactacaagaagcactaccccaacgaggacgcccccaagagcggcaccagctgcagcagcagatgcagcagcagcagacaggacagcgagagcgccagacccgagagcgagaccgaggacgtgctgtgggaggacctgctgcactgcgccgagtgccacagcagctgcaccagcgagaccgacgtggagaaccaccagatcaacccctgcgtgaagaaggagtacagagacgaccccttccaccagagccacctgccctggctgcacagcagccaccccggcctggagaagatcagcgccatcgtgtgggagggcaacgactgcaagaaggccgacatgagcgtgctggagatcagcggcatgatcatgaacagagtgaacagccacatccccggcatcggctaccagatcttcggcaacgccgtgagcctgatcctgggcctgacccccttcgtgttcagactgagccaggccaccgacctggagcagctgaccgcccacagcgccagcgagctgtacgtgatcgccttcggcagcaacgaggacgtgatcgtgctgagcatggtgatcatcagcttcgtggtgagagtgagcctggtgtggatcttcttcttcctgctgtgcgtggccgagagaacctacaagcagagactgctgttcgccaagctgttcggccacctgaccagcgccagaagagccagaaagagcgaggtgccccacttcagactgaagaaggtgcagaacatcaagatgtggctgagcctgagaagctacctgaagagaagaggcccccagagaagcgtggacgtgatcgtgagcagcgccttcctgctgaccatcagcgtggtgttcatctgctgcgcccagatcaacctgtacctgaagatggagaagaagcccaacaagaaggaggagctgaccctggtgaacaacgtgctgaagctggccaccaagctgctgaaggagctggacagccccttcagactgtacggcctgaccatgaaccccctgctgtacaacatcacccaggtggtgatcctgagcgccgtgagcggcgtgatcagcgacctgctgggcttcaacctgaagctgtggaagatcaagagctag

SEQ ID NO: 21313 - DNA, 2244 bp, Artificial Sequence
  Description of Artificial Sequence: Synthetic coding sequence
atggccagcaaggtgaccgacgccatcgtgtggtaccagaagaagatcggcgcctacgaccagcagatctgggagaagagcgtggagcagagagagatcaagggcctgagaaacaagcccaagaagaccgcccacgtgaagcccgacctgatcgacgtggacctggtgagaggcagcgccttcgccaaggccaagcccgagagcccctggaccagcctgaccagaaagggcatcgtgagagtggtgttcttccccttcttcttcagatggtggctgcaggtgaccagcaaggtgatcttcttctggctgctggtgctgtacctgctgcaggtggccgccatcgtgctgttctgcagcaccagcagcccccacagcatccccctgaccgaggtgatcggccccatctggctgatgctgctgctgggcaccgtgcactgccagatcgtgagcaccagaacccccaagccccccctgagcaccggcggcaagagaagaagaaagctgagaaaggccgcccacctggaggtgcacagagagggcgacggcagcagcaccaccgacaacacccaggagggcgccgtgcagaaccacggcaccagcaccagccacagcgtgggcaccgtgttcagagacctgtggcacgccgccttcttcctgagcggcagcaagaaggccaagaacagcatcgacaagagcaccgagaccgacaacggctacgtgagcctggacggcaagaagaccgtgaagagcggcgaggacggcatccagaaccacgagccccagtgcgagaccatcagacccgaggagaccgcctggaacaccggcaccctgagaaacggccccagcaaggacacccagagaaccatcaccaacgtgagcgacgaggtgagcagcgaggagggccccgagaccggctacagcctgagaagacacgtggacagaaccagcgagggcgtgctgagaaacagaaagagccaccactacaagaagcactaccccaacgaggacgcccccaagagcggcaccagctgcagcagcagatgcagcagcagcagacaggacagcgagagcgccagacccgagagcgagaccgaggacgtgctgtgggaggacctgctgcactgcgccgagtgccacagcagctgcaccagcgagaccgacgtggagaaccaccagatcaacccctgcgtgaagaaggagtacagagacgaccccttccaccagagccacctgccctggctgcacagcagccaccccggcctggagaagatcagcgccatcgtgtgggagggcaacgactgcaagaaggccgacatgagcgtgctggagatcagcggcatgatcatgaacagagtgaacagccacatccccggcatcggctaccagatcttcggcaacgccgtgagcctgatcctgggcctgacccccttcgtgttcagactgagccaggccaccgacctggagcagctgaccgcccacagcgccagcgagctgtacgtgatcgccttcggcagcaacgaggacgtgatcgtgctgagcatggtgatcatcagcttcgtggtgagagtgagcctggtgtggatcttcttcttcctgctgtgcgtggccgagagaacctacaagcagagactgctgttcgccaagctgttcggccacctgaccagcgccagaagagccagaaagagcgaggtgccccacttcagactgaagaaggtgcagaacatcaagatgtggctgagcctgagaagctacctgaagagaagaggcccccagagaagcgtggacgtgatcgtgagcagcgccttcctgctgaccatcagcgtggtgttcatctgctgcgcccagctgctgcacgtgcacgagatcttcctggactgccactacaactgggagctggtgatctggtgcatcagcctgaccctgttcctgctgagattcgtgaccctgggcagcgagaccagcaagaagtacagcaacaccagcatcctgctgaccgagcagatcaacctgtacctgaagatggagaagaagcccaacaagaaggaggagctgaccctggtgaacaacgtgctgaagctggccaccaagctgctgaaggagctggacagccccttcagactgtacggcctgaccatgaaccccctgctgtacaacatcacccaggtggtgatcctgagcgccgtgagcggcgtgatcagcgacctgctgggcttcaacctgaagctgtggaagatcaagagctag

SEQ ID NO: 21314 - DNA, 2256 bp, Artificial Sequence
  Description of Artificial Sequence: Synthetic coding sequence
atggccagcaaggtgaccgacgccatcgtgtggtaccagaagaagatcggcgcctacgaccagcagatctgggagaagagcgtggagcagagagagatcaagttcatcaagctgggcctgagaaacaagcccaagaagaccgcccacgtgaagcccgacctgatcgacgtggacctggtgagaggcagcgccttcgccaaggccaagcccgagagcccctggaccagcctgaccagaaagggcatcgtgagagtggtgttcttccccttcttcttcagatggtggctgcaggtgaccagcaaggtgatcttcttctggctgctggtgctgtacctgctgcaggtggccgccatcgtgctgttctgcagcaccagcagcccccacagcatccccctgaccgaggtgatcggccccatctggctgatgctgctgctgggcaccgtgcactgccagatcgtgagcaccagaacccccaagccccccctgagcaccggcggcaagagaagaagaaagctgagaaaggccgcccacctggaggtgcacagagagggcgacggcagcagcaccaccgacaacacccaggagggcgccgtgcagaaccacggcaccagcaccagccacagcgtgggcaccgtgttcagagacctgtggcacgccgccttcttcctgagcggcagcaagaaggccaagaacagcatcgacaagagcaccgagaccgacaacggctacgtgagcctggacggcaagaagaccgtgaagagcggcgaggacggcatccagaaccacgagccccagtgcgagaccatcagacccgaggagaccgcctggaacaccggcaccctgagaaacggccccagcaaggacacccagagaaccatcaccaacgtgagcgacgaggtgagcagcgaggagggccccgagaccggctacagcctgagaagacacgtggacagaaccagcgagggcgtgctgagaaacagaaagagccaccactacaagaagcactaccccaacgaggacgcccccaagagcggcaccagctgcagcagcagatgcagcagcagcagacaggacagcgagagcgccagacccgagagcgagaccgaggacgtgctgtgggaggacctgctgcactgcgccgagtgccacagcagctgcaccagcgagaccgacgtggagaaccaccagatcaacccctgcgtgaagaaggagtacagagacgaccccttccaccagagccacctgccctggctgcacagcagccaccccggcctggagaagatcagcgccatcgtgtgggagggcaacgactgcaagaaggccgacatgagcgtgctggagatcagcggcatgatcatgaacagagtgaacagccacatccccggcatcggctaccagatcttcggcaacgccgtgagcctgatcctgggcctgacccccttcgtgttcagactgagccaggccaccgacctggagcagctgaccgcccacagcgccagcgagctgtacgtgatcgccttcggcagcaacgaggacgtgatcgtgctgagcatggtgatcatcagcttcgtggtgagagtgagcctggtgtggatcttcttcttcctgctgtgcgtggccgagagaacctacaagcagagactgctgttcgccaagctgttcggccacctgaccagcgccagaagagccagaaagagcgaggtgccccacttcagactgaagaaggtgcagaacatcaagatgtggctgagcctgagaagctacctgaagagaagaggcccccagagaagcgtggacgtgatcgtgagcagcgccttcctgctgaccatcagcgtggtgttcatctgctgcgcccagctgctgcacgtgcacgagatcttcctggactgccactacaactgggagctggtgatctggtgcatcagcctgaccctgttcctgctgagattcgtgaccctgggcagcgagaccagcaagaagtacagcaacaccagcatcctgctgaccgagcagatcaacctgtacctgaagatggagaagaagcccaacaagaaggaggagctgaccctggtgaacaacgtgctgaagctggccaccaagctgctgaaggagctggacagccccttcagactgtacggcctgaccatgaaccccctgctgtacaacatcacccaggtggtgatcctgagcgccgtgagcggcgtgatcagcgacctgctgggcttcaacctgaagctgtggaagatcaagagctag

SEQ ID NO: 21315 - DNA, 2256 bp, Artificial Sequence; identical to SEQ ID NO: 21314
  Description of Artificial Sequence: Synthetic coding sequence

SEQ ID NO: 21316 - DNA, 2256 bp, Artificial Sequence
  Description of Artificial Sequence: Synthetic coding sequence
atggccagcaaggtgaccgacgccatcgtgtggtaccagaagaagatcggcgcctacgaccagcagatctgggagaagagcgtggagcagagagagatcaagttcatcaagtacggcctgagaaacaagcccaagaagaccgcccacgtgaagcccgacctgatcgacgtggacctggtgagaggcagcgccttcgccaaggccaagcccgagagcccctggaccagcctgaccagaaagggcatcgtgagagtggtgttcttccccttcttcttcagatggtggctgcaggtgaccagcaaggtgatcttcttctggctgctggtgctgtacctgctgcaggtggccgccatcgtgctgttctgcagcaccagcagcccccacagcatccccctgaccgaggtgatcggccccatctggctgatgctgctgctgggcaccgtgcactgccagatcgtgagcaccagaacccccaagccccccctgagcaccggcggcaagagaagaagaaagctgagaaaggccgcccacctggaggtgcacagagagggcgacggcagcagcaccaccgacaacacccaggagggcgccgtgcagaaccacggcaccagcaccagccacagcgtgggcaccgtgttcagagacctgtggcacgccgccttcttcctgagcggcagcaagaaggccaagaacagcatcgacaagagcaccgagaccgacaacggctacgtgagcctggacggcaagaagaccgtgaagagcggcgaggacggcatccagaaccacgagccccagtgcgagaccatcagacccgaggagaccgcctggaacaccggcaccctgagaaacggccccagcaaggacacccagagaaccatcaccaacgtgagcgacgaggtgagcagcgaggagggccccgagaccggctacagcctgagaagacacgtggacagaaccagcgagggcgtgctgagaaacagaaagagccaccactacaagaagcactaccccaacgaggacgcccccaagagcggcaccagctgcagcagcagatgcagcagcagcagacaggacagcgagagcgccagacccgagagcgagaccgaggacgtgctgtgggaggacctgctgcactgcgccgagtgccacagcagctgcaccagcgagaccgacgtggagaaccaccagatcaacccctgcgtgaagaaggagtacagagacgaccccttccaccagagccacctgccctggctgcacagcagccaccccggcctggagaagatcagcgccatcgtgtgggagggcaacgactgcaagaaggccgacatgagcgtgctggagatcagcggcatgatcatgaacagagtgaacagccacatccccggcatcggctaccagatcttcggcaacgccgtgagcctgatcctgggcctgacccccttcgtgttcagactgagccaggccaccgacctggagcagctgaccgcccacagcgccagcgagctgtacgtgatcgccttcggcagcaacgaggacgtgatcgtgctgagcatggtgatcatcagcttcgtggtgagagtgagcctggtgtggatcttcttcttcctgctgtgcgtggccgagagaacctacaagcagagactgctgttcgccaagctgttcggccacctgaccagcgccagaagagccagaaagagcgaggtgccccacttcagactgaagaaggtgcagaacatcaagatgtggctgagcctgagaagctacctgaagagaagaggcccccagagaagcgtggacgtgatcgtgagcagcgccttcctgctgaccatcagcgtggtgttcatctgctgcgcccagctgctgcacgtgcacgagatcttcctggactgccactacaactgggagctggtgatctggtgcatcagcctgaccctgttcctgctgagattcgtgaccctgggcagcgagaccagcaagaagtacagcaacaccagcatcctgctgaccgagcagatcaacctgtacctgaagatggagaagaagcccaacaagaaggaggagctgaccctggtgaacaacgtgctgaagctggccaccaagctgctgaaggagctggacagccccttcagactgtacggcctgaccatgaaccccctgctgtacaacatcacccaggtggtgatcctgagcgccgtgagcggcgtgatcagcgacctgctgggcttcaacctgaagctgtggaagatcaagagctag

SEQ ID NO: 21317 - DNA, 1059 bp, Artificial Sequence
  Description of Artificial Sequence: Synthetic coding sequence
atggccagcaaggtgaccgacgccatcgtgtggtaccagaagaagatcggcgcctacgaccagcagatctgggagaagagcgtggagcagagagagatcaagggcctgagaaacaagcccaagaagaccgcccacgtgaagcccgacctgatcgacgtggacctggtgagaggcagcgccttcgccaaggccaagcccgagagcccctggaccagcctgaccagaaagggcatcgtgagagtggtgttcttccccttcttcttcagatggtggctgcaggtgaccagcaaggtgatcttcttctggctgctggtgctgtacctgctgcaggtggccgccatcgtgctgttctgcagcaccagcagcccccacagcatccccctgaccgaggtgatcggccccatctggctgatgctgctgctgggcaccgtgcactgccagatcgtgagcaccagaacccccaagccccccctgagcaccggcggcaagagaagaagaaagctgagaaaggccgcccacctggaggtgcacagagagggcgacggcagcagcaccaccgacaacacccaggagggcgccgtgcagaaccacggcaccagcaccagccacagcgtgggcaccgtgttcagagacctgtggcacgccgccttcttcctgagcggcagcaagaaggccaagaacagcatcgacaagagcaccgagaccgacaacggctacgtgagcctggacggcaagaagaccgtgaagagcggcgaggacggcatccagaaccacgagccccagtgcgagaccatcagacccgaggagaccgcctggaacaccggcaccctgagaaacggccccagcaaggacacccagagaaccatcaccaacgtgagcgacgaggtgagcagcgaggagggccccgagaccggctacagcctgagaagacacgtggacagaaccagcgagggcgtgctgagaaacagaaagagccaccactacaagaagcactaccccaacgaggtgtacaccctgagcctgagcgtgtacatcagaatctacttcatctgctactag

SEQ ID NO: 21318 - DNA, 1071 bp, Artificial Sequence
  Description of Artificial Sequence: Synthetic coding sequence
atggccagcaaggtgaccgacgccatcgtgtggtaccagaagaagatcggcgcctacgaccagcagatctgggagaagagcgtggagcagagagagatcaagttcatcaagctgggcctgagaaacaagcccaagaagaccgcccacgtgaagcccgacctgatcgacgtggacctggtgagaggcagcgccttcgccaaggccaagcccgagagcccctggaccagcctgaccagaaagggcatcgtgagagtggtgttcttccccttcttcttcagatggtggctgcaggtgaccagcaaggtgatcttcttctggctgctggtgctgtacctgctgcaggtggccgccatcgtgctgttctgcagcaccagcagcccccacagcatccccctgaccgaggtgatcggccccatctggctgatgctgctgctgggcaccgtgcactgccagatcgtgagcaccagaacccccaagccccccctgagcaccggcggcaagagaagaagaaagctgagaaaggccgcccacctggaggtgcacagagagggcgacggcagcagcaccaccgacaacacccaggagggcgccgtgcagaaccacggcaccagcaccagccacagcgtgggcaccgtgttcagagacctgtggcacgccgccttcttcctgagcggcagcaagaaggccaagaacagcatcgacaagagcaccgagaccgacaacggctacgtgagcctggacggcaagaagaccgtgaagagcggcgaggacggcatccagaaccacgagccccagtgcgagaccatcagacccgaggagaccgcctggaacaccggcaccctgagaaacggccccagcaaggacacccagagaaccatcaccaacgtgagcgacgaggtgagcagcgaggagggccccgagaccggctacagcctgagaagacacgtggacagaaccagcgagggcgtgctgagaaacagaaagagccaccactacaagaagcactaccccaacgaggtgtacaccctgagcctgagcgtgtacatcagaatctacttcatctgctactag

SEQ ID NO: 21319 - DNA, 1449 bp, Artificial Sequence
  Description of Artificial Sequence: Synthetic coding sequence
atggccagaaagctgagcgtgctggaggtgctgctgatcatcttctgcctgatcgtggtgaccatcgacatcctgctgctgctgctggtgctggaggagaccagcgacaccagcttcacccccgagtgccccgagatcccccagagcgagagaatcgactgcacccccgaccaggaggtgaccgaggacatctgcagatggcagtacaagtgctgctggagccccgtggccgacgccaacgtgcccagatgcttcttcccctggaactggggctacgaggccagcaacggccacaccaacaccagcaccggcttcaccgcccagctgaagagactgcccagccccagcctgttcggcaacgacgtggccaccaccctgttcaccgccgagtaccagaccagcaacagattccacttcaagatcaccgacttcaacaacatcagatacgaggtgagccacgagaacatcaacctggtggacggcatcgccgacgccagcaacctgagctactacgtggaggtgaccgacaagcccttcagcatcaagatcatgagaaccagcaacagaagagtgctgctggacaccagcatcggccccctgcagttcgcccagcagtacctgcagctgagcttcagactgcccagcgccaacgtgtacggcctgggcgagcacgtgcaccagcagtacagacacaacatgacctggaagacctggcccatcttcaccagagacgccacccccaccgagggcatgatcaacctgtacggcgcccacaccttcttcctgtgcctggaggacgccagaggcagcagcttcggcgtgttcctgatgaacagcaacgccatggaggtgaccctgcagcccgcccccgccatcacctacagaaccatcggcggcatcctggacttctacgtgttcctgggcaacacccccgagcaggtggtgcaggagtacctggagctggtgggcagacccttcttccccccctactggagcctgggcttccagctgagcagaagagactacggcggcatcaacaagctgaaggaggtggtgagcagaaacagactggccgagatcccctacgacgtgcagtacagcgacatcgactacatggacggcaagaaggacttcaccgtggacgaggtggcctacagcggcctgcccgacttcgtgaaggagctgcacgacaacggccagaagtacctgatcatcatgaaccccggcatcagcaagaacagcaactacgagccctacaacaacggcagcctgaagagagtgtggatcctgggcagcaacggcttcgccgtgggcgagggctaccccggccccaccgtgttccccgactacaccaaccccgtgtgcaccgagtggtggaccgaccaggtggccaagttccacgaccacctggagttcgacggcgtgtggatcgtgagctactacagctag

SEQ ID NO: 21320 - DNA, 1941 bp, Artificial Sequence
  Description of Artificial Sequence: Synthetic coding sequence
atgttcctgagcatcagcaccagactgcccagccagtacatctacggcttcggcgagaccgagcacaccaccttcagaagaaacatgaactggaacacctggggcatgttcgcccacgacgagccccccgcctacaagaagaacagctacggcgtgcacccctactacatggccctggaggaggacggcagcgcccacggcgtgctgctgctgaacagcaacgccatggacgtgaccctgcagcccacccccgccctgacctacagaaccaccggcggcatcctggacttctacatcgtgctgggccccacccccgagctggtgacccagcagtacaccgagctgatcggcagacccgccatgatcccctactgggccctgggcttccacctgagcagatacggctaccagaacgacgccgagatcagcagcctgtacgacgccatggtggccgcccagatcccctacgacgtgcagcacgtggacatcgactacatgaacagaaagctggacttcaccctgagcgccaacttccagaacctgagcctgctgatcgagcagatgaagaagaacggcatgagattcatcctgatcctggaccccgccatcagcggcaacgagacccagtacctgcccttcatcagaggccaggagaacaacgtgttcatcaagtggcccgacaccaacgacatcgtgtggggcaaggtgtggcccgacctgcccaacgtgatcgtggacggcagcctggaccacgagacccaggtgaagctgtacagagcctacgtggccttccccgacttcttcagaaacagcaccgccgcctggtggaagaaggagatcgaggagctgtacgccaaccccagagagcccgagaagagcctgaagttcgacggcctgtggatcgacatgaacgagcccagcaacttcgtggacggcagcgtgagaggctgcagcaacgagatgctgaacaaccccccctacatgccctacctggagagcagagacaagggcctgagcagcaagaccctgtgcatggagagccagcagatcctgcccgacagcagccccgtggagcactacaacgtgcacaacctgtacggctggagccagaccagacccacctacgaggccgtgcaggaggtgaccggccagagaggcgtgatcatcaccagaagcaccttccccagcagcggcagatggggcggccacagactgggcaacaacaccgccgcctgggaccagctgggcaagagcatcatcggcatgatggagttcagcctgttcggcatcccctacaccggcgccgacatctgcggcttcttcggcgacgccgagtacgagatgtgcgtgagatggatgcagctgggcgccttctaccccttcagcagaaaccacaacaacatcggcaccagaagacaggaccccgtggcctggaacagcaccttcgagatgctgagcagaaaggtgctggagaccagatacaccctgctgccctacctgtacaccctgatgcacaaggcccacgtggagggcagcaccgtggtgagacccctgctgcacgagttcaccgacgacagaaccacctgggacatcgacagacagttcatgctgggccccgccatcctgatcagccccgtgctggagaccagcaccttcgagatcagcgcctacttccccagagccagatggtacgactacagcaccggcaccagcagcaccagcaccggccagagaaagatcctgaaggcccccctggaccacatcaacctgcacgtgagaggcggctacatcctgccctggcaggagcccgccatgaacacccacagcagcagacagaacttcatgggcctgatcgtggccctggacgacaacggcaccgccgagggccaggtgttctgggacgacggccagagcatcgtgttcaacaccaccgccatgtag

SEQ ID NO: 21321 - DNA, 3381 bp, Artificial Sequence
  Description of Artificial Sequence: Synthetic coding sequence
atggtgaagctgagcatcgtgctgaccccccagttcctgagccacgaccagggccagctgaccaaggagctgcagcagcacgtgaagagcgtgacctgcccctgcgagtacctgagaaaggtgatcaacaccctggccgaccaccaccacagaggcaccgacttcggcggcagcccctggctgcacgtgatcatcgccttccccaccagctacaaggtggtgatcaccctgtggatcgtgtacctgtgggtgagcctgctgaagaccatcttctggagcagaaacggccacgacggcagcaccgacgtgcagcagagagcctggagaagcaacagaagaagacaggagggcctgagaagcatctgcatgcacaccaagaagagagtgagcagcttcagaggcaacaagatcggcctgaaggacgtgatcaccctgagaagacacgtggagaccaaggtgagagccaagatcagaaagagaaaggtgaccaccaagatcaaccaccacgacaagatcaacggcaagagaaagaccgccagaaagcagaagatgttccagagagcccaggagctgagaagaagagccgaggactaccacaagtgcaagatcccccccagcgccagaaaggccctgtgcaactgggtgagaatggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcctgctgacccccctgccccccagcgccgacgacaacctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaacctgaagaccccccccgagtgcctgctgacccccctgccccccagcgccctgcccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgaccgccctgccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccctgccccccagcgccgacgacctgaagacccccagcgagagacagctgacccccctgccccccagcgccccccccagcgccgacgacaacatcaagatccccggcttccaccaccagcccatgatcatcagcagacacctgcccagcgtgagcagcctgcccttccacccccagctgcacccccagcagatgatcatcagcagacacctgcccagcgtgtgcggcggcagattccaccccgagagaatgatcatcagcagacacctgcccagcgtgagcagcctgcccttccacccccagctgcacccccagcagatgatcatcagcagacacctgcccagcgtgtgcggcggcagattccacccccagcagatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagcagatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 21322 - DNA, 2220 bp, Artificial Sequence
  Description of Artificial Sequence: Synthetic coding sequence
atgttctgctgcctgggctacgagtggctgagcggcggctgcaagacctggcacagcgcctgggtgatcaacaccctggccgaccaccaccacagaggcaccgacttcggcggcagcccctggctgcacgtgatcatcgccttccccaccagctacaaggtggtgatcaccctgtggatcgtgtacctgtgggtgagcctgctgaagaccatcttctggagcagaaacggccacgacggcagcaccgacgtgcagcagagagcctggagaagcaacagaagaagacaggagggcctgagaagcatctgcatgcacaccaagaagagagtgagcagcttcagaggcaacaagatcggcctgaaggacgtgatcaccctgagaagacacgtggagaccaaggtgagagccaagatcagaaagagaaaggtgaccaccaagatcaaccaccacgacaagatcaacggcaagagaaagaccgccagaaagcagaagatgttccagagagcccaggagctgagaagaagagccgaggactaccacaagtgcaagatcccccccagcgccagaaaggccctgtgcaactgggtgagaatggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcctgctgacccccctgccccccagcgccgacgacaacctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaacctgaagaccccccccgagtgcctgctgacccccctgccccccagcgccctgcccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgaccgccctgccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 21323 - DNA, 3402 bp, Artificial Sequence
  Description of Artificial Sequence: Synthetic coding sequence
atggtgaagctgagcatcgtgctgaccccccagttcctgagccacgaccagggccagctgaccaaggagctgcagcagcacgtgaagagcgtgacctgcccctgcgagtacctgagaaaggtgatcaacaccctggccgaccaccaccacagaggcaccgacttcggcggcagcccctggctgcacgtgatcatcgccttccccaccagctacaaggtggtgatcaccctgtggatcgtgtacctgtgggtgagcctgctgaagaccatcttctggagcagaaacggccacgacggcagcaccgacgtgcagcagagagcctggagaagcaacagaagaagacaggagggcctgagaagcatctgcatgcacaccaagaagagagtgagcagcttcagaggcaacaagatcggcctgaaggacgtgatcaccctgagaagacacgtggagaccaaggtgagagccaagatcagaaagagaaaggtgaccaccaagatcaaccaccacgacaagatcaacggcaagagaaagaccgccagaaagcagaagatgttccagagagcccaggagctgagaagaagagccgaggactaccacaagtgcaagatcccccccagcgccagaaaggccctgtgcaactgggtgagaatggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcctgctgacccccctgccccccagcgccgacgacaacctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaacctgaagaccccccccgagtgcctgctgacccccctgccccccagcgccctgcccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgaccgccctgccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccttccacccccagagaatgatcagcagacacctgcccagcgtgagcagcctgcccttccacccccagctgcacccccagcagatgatcatcagcagatacctgctgagcgtgtgcggcttcagattccaccaccagcccatgatcatcagcagacacctgcccagcgtgagcagcctgcccttccacccccagctgcacccccagcagatgatcatcagcagacacctgcccagcgtgtgcggcggcagattccaccccgagagaatgatcatcagcagacacctgcccagcgtgagcagcctgcccttccacccccagctgcacccccagcagatgatcatcagcagacacctgcccagcgtgtgcggcggcagattccacccccagcagatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagcagatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 21324 - DNA, 2037 bp, Artificial Sequence
  Description of Artificial Sequence: Synthetic coding sequence
atggtgaagctgagcatcgtgctgaccccccagttcctgagccacgaccagggccagctgaccaaggagctgcagcagcacgtgaagagcgtgacctgcccctgcgagtacctgagaaaggtgatcaacaccctggccgaccaccaccacagaggcaccgacttcggcggcagcccctggctgcacgtgatcatcgccttccccaccagctacaaggtggtgatcaccctgtggatcgtgtacctgtgggtgagcctgctgaagaccatcttctggagcagaaacggccacgacggcagcaccgacgtgcagcagagagcctggagaagcaacagaagaagacaggagggcctgagaagcatctgcatgcacaccaagaagagagtgagcagcttcagaggcaacaagatcggcctgaaggacgtgatcaccctgagaagacacgtggagaccaaggtgagagccaagatcagaaagagaaaggtgaccaccaagatcaaccaccacgacaagatcaacggcaagagaaagaccgccagaaagcagaagatgttccagagagcccaggagctgagaagaagagccgaggactaccacaagtgcaagatcccccccagcgccagaaaggccctgtgcaactgggtgagaatggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcctgctgacccccctgccccccagcgccgacgacaacctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaacctgaagaccccccccgagtgcctgctgacccccctgccccccagcgccctgcccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 21325 - DNA, 2547 bp, Artificial Sequence
  Description of Artificial Sequence: Synthetic coding sequence
atggtgaagctgagcatcgtgctgaccccccagttcctgagccacgaccagggccagctgaccaaggagctgcagcagcacgtgaagagcgtgacctgcccctgcgagtacctgagaaaggtgatcaacaccctggccgaccaccaccacagaggcaccgacttcggcggcagcccctggctgcacgtgatcatcgccttccccaccagctacaaggtggtgatcaccctgtggatcgtgtacctgtgggtgagcctgctgaagaccatcttctggagcagaaacggccacgacggcagcaccgacgtgcagcagagagcctggagaagcaacagaagaagacaggagggcctgagaagcatctgcatgcacaccaagaagagagtgagcagcttcagaggcaacaagatcggcctgaaggacgtgatcaccctgagaagacacgtggagaccaaggtgagagccaagatcagaaagagaaaggtgaccaccaagatcaaccaccacgacaagatcaacggcaagagaaagaccgccagaaagcagaagatgttccagagagcccaggagctgagaagaagagccgaggactaccacaagtgcaagatcccccccagcgccagaaaggccctgtgcaactgggtgagaatggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcctgctgacccccctgccccccagcgccgacgacaacctgaagaccccccccgagtgcgtgctgacccccctgccccccagcgccgacgacaacctgaagaccccccccgagtgcctgctgacccccctgccccccagcgccctgcccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccttccacccccagagaatgatcatcagcagacacctgcccagcgtgagcagcctgcccttccacccccagctgcacccccagcagatgatcatcagcagacacctgcccagcgtgtgcggcggcagattccaccccgagagaatgatcatcagcagacacctgcccagcgtgagcagcctgcccttccacccccagctgcacccccagcagatgatcatcagcagacacctgcccagcgtgtgcggcggcagattccacccccagcagatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagcagatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 21326 - DNA, 3033 bp, Artificial Sequence
  Description of Artificial Sequence: Synthetic coding sequence
atgcacaccaagaagagagtgagcagcttcagaggcaacaagatcggcctgaaggacgtgatcaccctgagaagacacgtggagaccaaggtgagagccaagatcagaaagagaaaggtgaccaccaagatcaaccaccacgacaagatcaacggcaagagaaagaccgccagaaagcagaagatgttccagagagcccaggagctgagaagaagagccgaggactaccacaagtgcaagatcccccccagcgccagaaaggccctgtgcaactgggtgagaatggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcctgctgacccccctgccccccagcgccgacgacaacctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaacctgaagaccccccccgagtgcctgctgacccccctgccccccagcgccctgcccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgaccgccctgccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccttccacccccagagaatgatcagcagacacctgcccagcgtgagcagcctgcccttccacccccagctgcacccccagcagatgatcatcagcagatacctgctgagcgtgtgcggcttcagattccaccaccagcccatgatcatcagcagacacctgcccagcgtgagcagcctgcccttccacccccagctgcacccccagcagatgatcatcagcagacacctgcccagcgtgtgcggcggcagattccaccccgagagaatgatcatcagcagacacctgcccagcgtgagcagcctgcccttccacccccagctgcacccccagcagatgatcatcagcagacacctgcccagcgtgtgcggcggcagattccacccccagcagatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagcagatgatcatcagcagacacctgcccagcgtgagcagcctgcccttccacccccagctgcacccccagcagatgatcatcagcagacacctgcccagcgtgtgcggccccctgccccccagcgccgacgacaacctgaagacccccagcgagagacagctgacccccttcccccccagcgccccccccagcgccgacgacaacatcaagacccccgccgagagactgagagagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 21327 - DNA, 3402 bp, Artificial Sequence; identical to SEQ ID NO: 21323
  Description of Artificial Sequence: Synthetic coding sequence

SEQ ID NO: 21328 - DNA, 708 bp, Artificial Sequence
  Description of Artificial Sequence: Synthetic coding sequence
atgcccaagggcagagccggcagcctgcccaccaccagcatcggctggagattccagctgtggttcctgggcctgacctgccccgagagacacctggccagaagactgaagaacaacagcttctaccccttcgtgcagcaggagcccaacgtgttcgtgctggagtactacctggacaccctgtggaagggcatgctgctgttcatcatcagcgtggtgctggtgagcttcagcagcctgagagaggtgcagaagcaggagacctgggtgttcctggtgtacggcgtgggcgtgggcctgtggctggtgatcagcagcctgcccagaagaagactggtgctgaaccacaccagaggcgtgtaccacttcagcatccagggcagaaccgtgtgccagggccccctgcacctggtgtacgtgagactggccctgagcagcgacgcccacggcagatgcttcttccacctggtgctgggcggccacagactggagcccctggtgctggtgcagctgagcgagcactacgagcagatggagtacctgggcagatacatcgccagaaagctgaacatcaactacttcgactacctggccaccagctacagacacgtggtgagacactggcccccccccggcgccggcaccgtgatgggcaagagccccatgggccacaagcccagcagcagccagagcagcctggaggtgtag

SEQ ID NO: 21329 - DNA, 708 bp, Artificial Sequence; identical to SEQ ID NO: 21328
  Description of Artificial Sequence: Synthetic coding sequence

SEQ ID NO: 21330 - DNA, 180 bp, Artificial Sequence
  Description of Artificial Sequence: Synthetic coding sequence
atgaccagcgtgagcacccagctgagcctggtgctgatgagcctgctgctggtgctgcccgtggtggaggccgtggaggccggcgacgccatcgccctgctgctgggcgtggtgctgagcatcaccggcatctgcgcctgcctgggcgtgtacgccagaaagagaaacggccagatgtag

SEQ ID NO: 21331 - DNA, 180 bp, Artificial Sequence; identical to SEQ ID NO: 21330
  Description of Artificial Sequence: Synthetic coding sequence

SEQ ID NO: 21332 - DNA, 180 bp, Artificial Sequence; identical to SEQ ID NO: 21330
  Description of Artificial Sequence: Synthetic coding sequence

SEQ ID NO: 21333 - DNA, 399 bp, Artificial Sequence
  Description of Artificial Sequence: Synthetic coding sequence
atgaccggcgagctggaggtgaagaacatggacatgaagcccggcagcaccctgaagatcaccggcagcatcgccgacggcaccgacggcttcgtgatcaacctgggccagggcaccgacaagctgaacctgcacttcaaccccagattcagcgagagcaccatcgtgtgcaacagcctggacggcagcaactggggccaggagcagagagaggaccacctgtgcttcagccccggcagcgaggtgaagttcaccgtgaccttcgagagcgacaagttcaaggtgaagctgcccgacggccacgagctgaccttccccaacagactgggccacagccacctgagctacctgagcgtgagaggcggcttcaacatgagcagcttcaagctgaaggagtag

SEQ ID NO: 21334 - DNA, 240 bp, Artificial Sequence
  Description of Artificial Sequence: Synthetic coding sequence
atgttcgagtgcatcaccgagaacttcagcatcgaccccgccagaaccctgatggtgggcgacagactggagaccgacatcctgttcggccacagatgcggcatgaccaccgtgctgaccctgaccggcgtgagcagactggaggaggcccaggcctacctggccgccggccagcacgacctggtgccccactactacgtggagagcatcgccgacctgaccgagggcctggaggactag

SEQ ID NO: 21335 - DNA, 1296 bp, Artificial Sequence
  Description of Artificial Sequence: Synthetic coding sequence
atgcaggccctgaacatcacccccgagcagttcagcagactgctgagagaccacaacctgaccagagagcagttcatcgccctgtacagactgagacccctggtgtacacccccgagctgcccggcagagccaagctggccctggtgctgaccggcgtgctgatcttcgccctggccctgttcggcaacgccctggtgttctacgtggtgaccagaagcaaggccatgagaaccgtgaccaacatcttcatctgcagcctggccctgagcgacctgctgatcaccttcttctgcatccccgtgaccatgctgcagaacatcagcgacaactggctgggcggcgccttcatctgcaagatggtgcccttcgtgcagagcaccgccgtggtgaccgagatcctgaccatgacctgcatcgccgtggagagacaccagggcctggtgcaccccttcaagatgaagtggcagtacaccaacagaagagccttcaccatgctgggcgtggtgtggctggtggccgtgatcgtgggcagccccatgtggcacgtgcagcagctggagatcaagtacgacttcctgtacgagaaggagcacatctgctgcctggaggagtggaccagccccgtgcaccagaagatctacaccaccttcatcctggtgatcctgttcctgctgcccctgatggtgatgctgatcctgtacagcaagatcggctacgagctgtggatcaagaagagagtgggcgacggcagcgtgctgagaaccatccacggcaaggagatgagcaagatcgccagaaagaagaagagagccgtgatcatgatggtgaccgtggtggccctgttcgccgtgtgctgggcccccttccacgtggtgcacatgatgatcgagtacagcaacttcgagaaggagtacgacgacgtgaccatcaagatgatcttcgccatcgtgcagatcatcggcttcagcaacagcatctgcaaccccatcgtgtacgccttcatgaacgagaacttcaagaagaacgtgctgagcgccgtgtgctactgcatcgtgaacaagaccttcagccccgcccagagacacggcaacagcggcatcaccatgatgagaaagaaggccaagttcagcctgagagagaaccccgtggaggagaccaagggcgaggccttcagcgacggcaacatcgaggtgaagctgtgcgagcagaccgaggagaagaagaagctgaagagacacctggccctgttcagaagcgagctggccgagaacagccccctggacagcggccactag

SEQ ID NO: 21336 - DNA, 825 bp, Artificial Sequence
  Description of Artificial Sequence: Synthetic coding sequence
atggccgccagctggagactgggctgcgaccccagactgctgagatacctggtgggcttccccggcagaagaagcgtgggcctggtgaagggcgccctgggctggagcgtgagcagaggcgccaactggagatggttccacagcacccagtggctgagaggcgaccccatcaagatcctgatgcccagcctgagccccaccatggaggagggcaacatcgtgaagtggctgaagaaggagggcgaggccgtgagcgccggcgacgccctgtgcgagatcgagaccgacaaggccgtggtgaccctggacgccagcgacgacggcatcctggccaagatcgtgcagatgcccgacgtgaacgtgagctgggacggcgagggccccaagcagctgcccttcatcgacatcagcgtggccgtggccaccgacaagggcctgctgacccccatcatcaaggacgccgccgccaagggcatccaggagatcgccgacagcgtgaaggccctgagcaagaaggccagagacggcaagctgctgcccgaggagtaccagggcggcagcttcagcatcagcaacctgggcatgttcggcatcgacgagttcaccgccgtgatcaaccccccccaggcctgcatcctggccgtgggcagattcagacccgtgctgaagctgaccgaggacgaggagggcaacgccaagctgcagcagagacagctgatcaccgtgaccatgagcagcgacagcagagtggtggacgacgagctggccaccagattcctgaagagcttcaaggccaacctggagaaccccatcagactggcctag

SEQ ID NO: 21337 - DNA, 1857 bp, Artificial Sequence
  Description of Artificial Sequence: Synthetic coding sequence
atgcacaagaccgccagccagagactgttccccggccccagctaccagaacatcaagagcatcatggaggacagcaccatcctgagcgactggaccaacagcaacaagcagaagatgaagtacgacttcagctgcgagctgtacagaatgagcacctacagcaccttccccgccggcgtgcccgtgagcgagagaagcctggccagagccggcttctactacaccggcgtgaacgacaaggtgaagtgcttctgctgcggcctgatgctggacaactggaagctgggcgacagccccatccagaagcacaagcagctgtaccccagctgcagcttcatccagaacctggtgagcgccagcctgggcagcaccagcaagaacaccagccccatgagaaacagcttcgcccacagcctgagccccaccctggagcacagcagcctgttcagcggcagctacagcagcctgagccccaaccccctgaacagcagagccgtggaggacatcagcagcagcagaaccaacccctacagctacgccatgagcaccgaggaggccagattcctgacctaccacatgtggcccctgaccttcctgagccccagcgagctggccagagccggcttctactacatcggccccggcgacagagtggcctgcttcgcctgcggcggcaagctgagcaactgggagcccaaggacgacgccatgagcgagcacagaagacacttccccaactgccccttcctggagaacagcctggagaccctgagattcagcatcagcaacctgagcatgcagacccacgccgccagaatgagaaccttcatgtactggcccagcagcgtgcccgtgcagcccgagcagctggccagcgccggcttctactacgtgggcagaaacgacgacgtgaagtgcttctgctgcgacggcggcctgagatgctgggagagcggcgacgacccctgggtggagcacgccaagtggttccccagatgcgagttcctgatcagaatgaagggccaggagttcgtggacgagatccagggcagatacccccacctgctggagcagctgctgagcaccagcgacaccaccggcgaggagaacgccgacccccccatcatccacttcggccccggcgagagcagcagcgaggacgccgtgatgatgaacacccccgtggtgaagagcgccctggagatgggcttcaacagagacctggtgaagcagaccgtgcagagcaagatcctgaccaccggcgagaactacaagaccgtgaacgacatcgtgagcgccctgctgaacgccgaggacgagaagagagaggaggagaaggagaagcaggccgaggagatggccagcgacgacctgagcctgatcagaaagaacagaatggccctgttccagcagctgacctgcgtgctgcccatcctggacaacctgctgaaggccaacgtgatcaacaagcaggagcacgacatcatcaagcagaagacccagatccccctgcaggccagagagctgatcgacaccatcctggtgaagggcaacgccgccgccaacatcttcaagaactgcctgaaggagatcgacagcaccctgtacaagaacctgttcgtggacaagaacatgaagtacatccccaccgaggacgtgagcggcctgagcctggaggagcagctgagaagactgcaggaggagagaacctgcaaggtgtgcatggacaaggaggtgagcgtggtgttcatcccctgcggccacctggtggtgtgccaggagtgcgcccccagcctgagaaagtgccccatctgcagaggcatcatcaagggcaccgtgagaaccttcctgagctag

SEQ ID NO: 21338 - DNA, 1461 bp, Artificial Sequence
  Description of Artificial Sequence: Synthetic coding sequence
atgcagagcggcggcgccgagggcagccccggcgccggcagaaccggcagaggccccggcagcggcaaggccccccccgccgagatcagcagcggcgcccccgacttccccggcggcgaccccatcaagatcctgatgcccagcctgagccccaccatggaggagggcaacatcgtgaagtggctgaagaaggagggcgaggccgtgagcgccggcgacgccctgtgcgagatcgagaccgacaaggccgtggtgaccctggacgccagcgacgacggcatcctggccaagatcgtggtggaggagggcagcaagaacatcagactgggcagcctgatcggcctgatcgtggaggagggcgaggactggaagcacgtggagatccccaaggacgtgggcccccccccccccgtgagcaagcccagcgagcccagacccagccccgagccccagatcagcatccccgtgaagaaggagcacatccccggcaccctgagattcagactgagccccgccgccagaaacatcctggagaagcacagcctggacgccagccagggcaccgccaccggccccagaggcatcttcaccaaggaggacgccctgaagctggtgcagctgaagcagaccggcaagatcaccgagagcagacccacccccgcccccaccgccacccccaccgcccccagccccctgcaggccaccgccggccccagctaccccagacccgtgatcccccccgtgagcacccccggccagcccaacgccgtgggcaccttcaccgagatccccgccagcaacatcagaagagtgatcgccaagagactgaccgagagcaagagcaccgtgccccacgcctacgccaccgccgactgcgacctgggcgccgtgctgaaggtgagacaggacctggtgaaggacgacatcaaggtgagcgtgaacgacttcatcatcaaggccgccgccgtgaccctgaagcagatgcccgacgtgaacgtgagctgggacggcgagggccccaagcagctgcccttcatcgacatcagcgtggccgtggccaccgacaagggcctgctgacccccatcatcaaggacgccgccgccaagggcatccaggagatcgccgacagcgtgaaggccctgagcaagaaggccagagacggcaagctgctgcccgaggagtaccagggcggcagcttcagcatcagcaacctgggcatgttcggcatcgacgagttcaccgccgtgatcaaccccccccaggcctgcatcctggccgtgggcagattcagacccgtgctgaagctgaccgaggacgaggagggcaacgccaagctgcagcagagacagctgatcaccgtgaccatgagcagcgacagcagagtggtggacgacgagctggccaccagattcctgaagagcttcaaggccaacctggagaaccccatcagactggcctag

SEQ ID NO: 21339 - DNA, 1221 bp, Artificial Sequence
  Description of Artificial Sequence: Synthetic coding sequence
atgagactgttcagatggctgctgaagcagcccgtgcccaagcagatcgagagatacagcagattcagccccagccccctgagcatcaagcagttcctggacttcggcagagacaacgcctgcgagaagaccagctacatgttcctgagaaaggagctgcccgtgagactggccaacaccatgagagaggtgaacctgctgcccgacaacctgctgaacagacccagcgtgggcctggtgcagagctggtacatgcagagcttcctggagctgctggagtacgagaacaagagccccgaggacccccaggtgctggacaacttcctgcaggtgctgatcaaggtgagaaacagacacaacgacgtggtgcccaccatggcccagggcgtgatcgagtacaaggagaagttcggcttcgaccccttcatcagcaccaacatccagtacttcctggacagattctacaccaacagaatcagcttcagaatgctgatcaaccagcacaccctgctgttcggcggcgacaccaaccccgtgcaccccaagcacatcggcagcatcgaccccacctgcaacgtggccgacgtggtgaaggacgcctacgagaccgccaagatgctgtgcgagcagtactacctggtggcccccgagctggaggtggaggagttcaacgccaaggcccccgacaagcccatccaggtggtgtacgtgcccagccacctgttccacatgctgttcgagctgttcaagaacagcatgagagccaccgtggagctgtacgaggacagaaaggagggctaccccgccgtgaagaccctggtgaccctgggcaaggaggacctgagcatcaagatcagcgacctgggcggcggcgtgcccctgagaaagatcgacagactgttcaactacatgtacagcaccgcccccagacccagcctggagcccaccagagccgcccccctggccggcttcggctacggcctgcccatcagcagactgtacgccagatacttccagggcgacctgaagctgtacagcatggagggcgtgggcaccgacgccgtgatctacctgaaggccctgagcagcgagagcttcgagagactgcccgtgttcaacaagagcgcctggagacactacaagaccacccccgaggccgacgactggagcaaccccagcagcgagcccagagacgccagcaagtacaaggccaagcagtag

SEQ ID NO: 21340 - DNA, 1248 bp, Artificial Sequence
  Description of Artificial Sequence: Synthetic coding sequence
atgagactgttcagatggctgctgaagcagcccgtgcccaagcagatcgagagatacagcagattcagccccagccccctgagcatcaagcagttcctggacttcggcagagacaacgcctgcgagaagaccagctacatgttcctgagaaaggagctgcccgtgagactggccaacaccatgagagaggtgaacctgctgcccgacaacctgctgaacagacccagcgtgggcctggtgcagagctggtacatgcagagcttcctggagctgctggagtacgagaacaagagccccgaggacccccaggtgctggacaacttcctgcaggtgctgatcaaggtgagaaacagacacaacgacgtggtgcccaccatggcccagggcgtgatcgagtacaaggagaagttcggcttcgaccccttcatcagcaccaacatccagtacttcctggacagattctacaccaacagaatcagcttcagaatgctgatcaaccagcacaccctgctgttcggcggcgacaccaaccccgtgcaccccaagcacatcggcagcatcgaccccacctgcaacgtggccgacgtggtgaaggacgcctacgagaccgccaagatgctgtgcgagcagtactacctggtggcccccgagctggaggtggaggagttcaacgccaaggcccccgacaagcccatccaggtggtgtacgtgcccagccacctgttccacatgctgttcgagctgttcaagaacagcatgagagccaccgtggagctgtacgaggacagaaaggagggctaccccgccgtgaagaccctggtgaccctgggcaaggaggacctgagcatcaagatcagcgacctgggcggcggcgtgcccctgagaaagatcgacagactgttcaactacatgtacagcaccgcccccagacccagcctggagcccaccagagccgcccccctggccggcttcggctacggcctgcccatcagcagactgtacgccagatacttccagggcgacctgaagctgtacagcatggagggcgtgggcaccgacgccgtgatctacctgaaggccctgagcagcgagagcttcgagagactgcccgtgttcaacaagagcgcctggagacactacaagaccacccccgaggccgacgactggagcaaccccagcagcgagcccagagacgccagcaagtacaaggccaagcaggacaagatcaagaccaacagaaccttctag

SEQ ID NO: 21341 - DNA, 1590 bp, Artificial Sequence
  Description of Artificial Sequence: Synthetic coding sequence
atgagcagcaccgtgagctactggatcctgaacagcaccagaaacagcatcgccaccctgcagggcggcagaagactgtacagcagatacgtgagcaacagaaacaagctgaagtggagactgttcagcagagtgccccccaccctgaacagcagcccctgcggcggcttcaccctgtgcaaggcctacagacacaccagcaccgaggaggacgacttccacctgcagctgagccccgagcagatcaacgaggtgctgagagccggcgagaccacccacaagatcctggacctggagagcagagtgcccaacagcgtgctgagattcgagagcaaccagctggccgccaacagccccgtggaggacagaagaggcgtggccagctgcctgcagaccaacggcctgatgttcggcatcttcgacggccacggcggccacgcctgcgcccaggccgtgagcgagagactgttctactacgtggccgtgagcctgatgagccaccagaccctggagcacatggagggcgccatggagagcatgaagcccctgctgcccatcctgcactggctgaagcaccccggcgacagcatctacaaggacgtgaccagcgtgcacctggaccacctgagagtgtactggcaggagctgctggacctgcacatggagatgggcctgagcatcgaggaggccctgatgtacagcttccagagactggacagcgacatcagcctggagatccaggcccccctggaggacgaggtgaccagaaacctgagcctgcaggtggccttcagcggcgccaccgcctgcatggcccacgtggacggcatccacctgcacgtggccaacgccggcgactgcagagccatcctgggcgtgcaggaggacaacggcatgtggagctgcctgcccctgaccagagaccacaacgcctggaaccaggccgagctgagcagactgaagagagagcaccccgagagcgaggacagaaccatcatcatggaggacagactgctgggcgtgctgatcccctgcagagccttcggcgacgtgcagctgaagtggagcaaggagctgcagagaagcatcctggagagaggcttcaacaccgaggccctgaacatctaccagttcacccccccccactactacacccccccctacctgaccgccgagcccgaggtgacctaccacagactgagaccccaggacaagttcctggtgctggccagcgacggcctgtgggacatgctgagcaacgaggacgtggtgagactggtggtgggccacctggccgaggccgactggcacaagaccgacctggcccagagacccgccaacctgggcctgatgcagagcctgctgctgcagagaaaggccagcggcctgcacgaggccgaccagaacgccgccaccagactgatcagacacgccatcggcaacaacgagtacggcgagatggaggccgagagactggccgccatgctgaccctgcccgaggacctggccagaatgtacagagacgacatcaccgtgaccgtggtgtacttcaacagcgagagcatcggcgcctactacaagggcggctag

SEQ ID NO: 21342 - DNA, 978 bp, Artificial Sequence
  Description of Artificial Sequence: Synthetic coding sequence
atggtgggcgagatggagaccaaggagaagcccaagcccacccccgactacctgatgcagctgatgaacgacaagaagctgatgagcagcctgcccaacttctgcggcatcttcaaccacctggagagactgctggacgaggagatcagcagagtgagaaaggacatgtacaacgacaccctgaacggcagcaccgagaagagaagcgccgagctgcccgacgccgtgggccccatcgtgcagctgcaggagaagctgtacgtgcccgtgaaggagtaccccgacttcaacttcgtgggcagaatcctgggccccagaggcctgaccgccaagcagctggaggccgagaccggctgcaagatcatggtgagaggcaagggcagcatgagagacaagaagaaggaggagcagaacagaggcaagcccaactgggagcacctgaacgaggacctgcacgtgctgatcaccgtggaggacgcccagaacagagccgagatcaagctgaagagagccgtggaggaggtgaagaagctgctggtgcccgccgccgagggcgaggacagcctgaagaagatgcagctgatggagctggccatcctgaacggcacctacagagacgccaacatcaagagccccgccctggccttcagcctggccgccaccgcccaggccgcccccagaatcatcaccggccccgcccccgtgctgccccccgccgccctgagaacccccacccccgccggccccaccatcatgcccctgatcagacagatccagaccgccgtgatgcccaacggcaccccccaccccaccgccgccatcgtgccccccggccccgaggccggcctgatctacaccccctacgagtacccctacaccctggcccccgccaccagcatcctggagtaccccatcgagcccagcggcgtgctggagtggatcgagatgcccgtgatgcccgacatcagcgcccactag

SEQ ID NO: 21343 - DNA, 1002 bp, Artificial Sequence
  Description of Artificial Sequence: Synthetic coding sequence
atggtgggcgagatggagaccaaggagaagcccaagcccacccccgactacctgatgcagctgatgaacgacaagaagctgatgagcagcctgcccaacttctgcggcatcttcaaccacctggagagactgctggacgaggagatcagcagagtgagaaaggacatgtacaacgacaccctgaacggcagcaccgagaagagaagcgccgagctgcccgacgccgtgggccccatcgtgcagctgcaggagaagctgtacgtgcccgtgaaggagtaccccgacttcaacttcgtgggcagaatcctgggccccagaggcctgaccgccaagcagctggaggccgagaccggctgcaagatcatggtgagaggcaagggcagcatgagagacaagaagaaggaggagcagaacagaggcaagcccaactgggagcacctgaacgaggacctgcacgtgctgatcaccgtggaggacgcccagaacagagccgagatcaagctgaagagagccgtggaggaggtgaagaagctgctggtgcccgccgccgagggcgaggacagcctgaagaagatgcagctgatggagctggccatcctgaacggcacctacagagacgccaacatcaagagccccaccgcccaggccgcccccagaatcatcaccggccccgcccccgtgctgccccccgccgccctgagaacccccacccccgccggccccaccatcatgcccctgatcagacagatccagaccgccgtgatgcccaacggcaccccccaccccaccgccgccatcgtgccccccggccccgaggccggcctgatctacaccccctacgagtacccctacaccctggcccccgccaccagcatcctggagtaccccatcgagcccagcggcgtgctgggcgccgtggccaccaaggtgagaagacacgacatgagagtgcacccctaccagagaatcgtgaccgccgacagagccgccaccggcaactag

SEQ ID NO: 21344 - DNA, 1026 bp, Artificial Sequence
  Description of Artificial Sequence: Synthetic coding sequence
atggtgggcgagatggagaccaaggagaagcccaagcccacccccgactacctgatgcagctgatgaacgacaagaagctgatgagcagcctgcccaacttctgcggcatcttcaaccacctggagagactgctggacgaggagatcagcagagtgagaaaggacatgtacaacgacaccctgaacggcagcaccgagaagagaagcgccgagctgcccgacgccgtgggccccatcgtgcagctgcaggagaagctgtacgtgcccgtgaaggagtaccccgacttcaacttcgtgggcagaatcctgggccccagaggcctgaccgccaagcagctggaggccgagaccggctgcaagatcatggtgagaggcaagggcagcatgagagacaagaagaaggaggagcagaacagaggcaagcccaactgggagcacctgaacgaggacctgcacgtgctgatcaccgtggaggacgcccagaacagagccgagatcaagctgaagagagccgtggaggaggtgaagaagctgctggtgcccgccgccgagggcgaggacagcctgaagaagatgcagctgatggagctggccatcctgaacggcacctacagagacgccaacatcaagagccccgccctggccttcagcctggccgccaccgcccaggccgcccccagaatcatcaccggccccgcccccgtgctgccccccgccgccctgagaacccccacccccgccggccccaccatcatgcccctgatcagacagatccagaccgccgtgatgcccaacggcaccccccaccccaccgccgccatcgtgccccccggccccgaggccggcctgatctacaccccctacgagtacccctacaccctggcccccgccaccagcatcctggagtaccccatcgagcccagcggcgtgctgggcgccgtggccaccaaggtgagaagacacgacatgagagtgcacccctaccagagaatcgtgaccgccgacagagccgccaccggcaactag

SEQ ID NO: 21345 - DNA, 960 bp, Artificial Sequence
  Description of Artificial Sequence: Synthetic coding sequence
atggtgggcgagatggagaccaaggagaagcccaagcccacccccgactacctgatgcagctgatgaacgacaagaagctgatgagcagcctgcccaacttctgcggcatcttcaaccacctggagagactgctggacgaggagatcagcagagtgagaaaggacatgtacaacgacaccctgaacggcagcaccgagaagagaagcgccgagctgcccgacgccgtgggccccatcgtgcagctgcaggagaagctgtacgtgcccgtgaaggagtaccccgacttcaacttcgtgggcagaatcctgggccccagaggcctgaccgccaagcagctggaggccgagaccggctgcaagatcatggtgagaggcaagggcagcatgagagacaagaagaaggaggagcagaacagaggcaagcccaactgggagcacctgaacgaggacctgcacgtgctgatcaccgtggaggacgcccagaacagagccgagatcaagctgaagagagccgtggaggaggtgaagaagctgctggtgcccgccgccgagggcgaggacagcctgaagaagatgcagctgatggagctggccatcctgaacggcacctacagagacgccaacatcaagagccccgccctggccttcagcctggccgccaccgcccaggccgcccccagaatcatcaccggccccgcccccgtgctgccccccgccgccctgagaacccccacccccgccggccccaccatcatgcccctgatcagacagatccagaccgccgtgatgcccaacggcaccccccaccccaccgccgccatcgtgccccccggccccgaggccggcctgatctacaccccctacgagtacccctacaccctggcccccgccaccagcatcctggagtaccccatcgagcccagcggcgtgctgggcaagttcttcagcccctggggctag

SEQ ID NO: 21346 - DNA, 960 bp, Artificial Sequence
  Description of Artificial Sequence: Synthetic coding sequence
atggtgggcgagatggagaccaaggagaagcccaagcccacccccgactacctgatgcagctgatgaacgacaagaagctgatgagcagcctgcccaacttctgcggcatcttcaaccacctggagagactgctggacgaggagatcagcagagtgagaaaggacatgtacaacgacaccctgaacggcagcaccgagaagagaagcgccgagctgcccgacgccgtgggccccatcgtgcagctgcaggagaagctgtacgtgcccgtgaaggagtaccccgacttcaacttcgtgggcagaatcctgggccccagaggcctgaccgccaagcagctggaggccgagaccggctgcaagatcatggtgagaggcaagggcagcatgagagacaagaagaaggaggagcagaacagaggcaagcccaactgggagcacctgaacgaggacctgcacgtgctgatcaccgtggaggacgcccagaacagagccgagatcaagctgaagagagccgtggaggaggtgaagaagctgctggtgcccgccgccgagggcgaggacagcctgaagaagatgcagctgatggagctggccatcctgaacggcacctacagagacgccaacatcaagagccccgccctggccttcagcctggccgccaccgcccaggccgcccccagaatcatcaccggccccgcccccgtgctgccccccgccgccctgagaacccccacccccgccggccccaccatcatgcccctgatcagacagatccagaccgccgtgatgcccaacggcaccccccaccccaccgccgccatcgtgccccccggccccgaggccggcctgatctacaccccctacgagtacccctacaccctggcccccgccaccagcatcctggagtaccccatcgagcccagcggcgtgctgggcatggccttccccaccaagggctag

SEQ ID NO: 21347 - DNA, 1137 bp, Artificial Sequence
  Description of Artificial Sequence: Synthetic coding sequence
atggtggactacagcgtgtgggaccacatcgaggtgagcgacgacgaggacgagacccaccccaacatcgacaccgccagcctgttcagatggagacaccaggccagagtggagagaatggagcagttccagaaggagaaggaggagctggacagaggctgcagagagtgcaagagaaaggtggccgagtgccagagaaagctgaaggagctggaggtggccgagggcggcaaggccgagctggagagactgcaggccgaggcccagcagctgagaaaggaggagagaagctgggagcagaagctggaggagatgagaaagaaggagaagagcatgccctggaacgtggacaccctgagcaaggacggcttcagcaagagcatggtgaacaccaagcccgagaagaccgaggaggacagcgaggaggtgagagagcagaagcacaagaccttcgtggagaagtacgagaagcagatcaagcacttcggcatgctgagaagatgggacgacagccagaagtacctgagcgacaacgtgcacctggtgtgcgaggagaccgccaactacctggtgatctggtgcatcgacctggaggtggaggagaagtgcgccctgatggagcaggtggcccaccagaccatcgtgatgcagttcatcctggagctggccaagagcctgaaggtggaccccagagcctgcttcagacagttcttcaccaagatcaagaccgccgacagacagtacatggagggcttcaacgacgagctggaggccttcaaggagagagtgagaggcagagccaagctgagaatcgagaaggccatgaaggagtacgaggaggaggagagaaagaagagactgggccccggcggcctggaccccgtggaggtgtacgagagcctgcccgaggagctgcagaagtgcttcgacgtgaaggacgtgcagatgctgcaggacgccatcagcaagatggaccccaccgacgccaagtaccacatgcagagatgcatcgacagcggcctgtgggtgcccaacagcaaggccagcgaggccaaggagggcgaggaggccggccccggcgaccccctgctggaggccgtgcccaagaccggcgacgagaaggacgtgagcgtgtag

SEQ ID NO: 21348 - DNA, 1962 bp, Artificial Sequence
  Description of Artificial Sequence: Synthetic coding sequence
atggccctggtgagaggcgccgagcccgccgccggccccagcagatggctgcccacccacgtgcaggtgaccgtgctgagagccagaggcctgagaggcaagagcagcggcgccggcagcaccagcgacgcctacaccgtgatccaggtgggcagagagaagtacagcaccagcgtggtggagaagacccacggctgccccgagtggagagaggagtgcagcttcgagctgccccccggcgccctggacggcctgctgagagcccaggaggccgacgccggccccgccccctgggccgccagcagcgccgccgcctgcgagctggtgctgaccaccatgcacagaagcctgatcggcgtggacaagttcctgggccaggccaccgtggccctggacgaggtgttcggcgccggcagagcccagcacacccagtggtacaagctgcacagcaagcccggcaagaaggagaaggagagaggcgagatcgaggtgaccatccagttcaccagaaacaacctgagcgccagcatgttcgacctgagcatgaaggacaagcccagaagccccttcagcaagatcagagacaagatgaagggcaagaagaagtacgacctggagagcgccagcgccatcctgcccagcagcgccatcgaggaccccgacctgggcagcctgggcaagatgggcaaggccaagggcttcttcctgagaaacaagctgagaaagagcagcctgacccagagcaacaccagcctgggcagcgacagcaccctgagcagcgccagcggcagcctggcctaccagggccccggcgccgagctgctgaccagaagccccagcagaagcagctggctgagcaccgagggcggcagagacagcgcccagagccccaagctgttcacccacaagagaacctacagcgacgaggccaaccagatgagagtggccccccccagagccctgctggacctgcagggccacctggacgccgccagcagaagcagcctgtgcgtgaacggcagccacatctacaacgaggagccccagggccccgtgagacacagaagcagcatcagcggcagcctgcccagcagcggcagcctgcaggccgtgagcagcagattcagcgaggagggccccagaagcaccgacgacacctggcccagaggcagcagaagcaacagcagcagcgaggccgtgctgggccaggaggagctgagcgcccaggccaaggtgctggcccccggcgccagccaccccggcgaggaggagggcgccagactgcccgagggcaagcccgtgcaggtggccacccccatcgtggccagcagcgaggccgtggccgagaaggagggcgccagaaaggaggagagaaagcccagaatgggcctgttccaccaccaccaccagggcctgagcagaagcgagctgggcagaagaagcagcctgggcgagaagggcggccccatcctgggcgccagcccccaccacagcagcagcggcgaggagaaggccaagagcagctggttcggcctgagagaggccaaggaccccacccagaagcccagcccccaccccgtgaagcccctgagcgccgcccccgtggagggcagccccgacagaaagcagagcagaagcagcctgagcatcgccctgagcagcggcctggagaagctgaagaccgtgaccagcggcagcatccagcccgtgacccaggccccccaggccggccagatggtggacaccaagagactgaaggacagcgccgtgctggaccagagcgccaagtactaccacctgacccacgacgagctgatcagcctgctgctgcagagagagagagagctgagccagagagacgagcacgtgcaggagctggagagctacatcgacagactgctggtgagaatcatggagaccagccccaccctgctgcagatcccccccggcccccccaagtag

SEQ ID NO: 21349 - DNA, 657 bp, Artificial Sequence
  Description of Artificial Sequence: Synthetic coding sequence
atgggcaccagagacgacgagtacgactacctgttcaaggtggtgctgatcggcgacagcggcgtgggcaagagcaacctgctgagcagattcaccagaaacgagttcaacctggagagcaagagcaccatcggcgtggagttcgccaccagaagcatccaggtggacggcaagaccatcaaggcccagatctgggacaccgccggccaggagagatacagagccatcaccagcgcctactacagaggcgccgtgggcgccctgctggtgtacgacatcgccaagcacctgacctacgagaacgtggagagatggctgaaggagctgagagaccacgccgacagcaacatcgtgatcatgctggtgggcaacaagagcgacctgagacacctgagagccgtgcccaccgacgaggccagagccttcgccgagaagaacaacctgagcttcatcgagaccagcgccctggacagcaccaacgtggaggaggccttcaagaacatcctgaccgagatctacagaatcgtgagccagaagcagatcgccgacagagccgcccacgacgagagccccggcaacaacgtggtggacatcagcgtgccccccaccaccgacggccagaagcccaacaagctgcagtgctgccagaacctgtag

SEQ ID NO: 21350 - DNA, 627 bp, Artificial Sequence
  Description of Artificial Sequence: Synthetic coding sequence
atggccaagcagtacgacgtgctgttcagactgctgctgatcggcgacagcggcgtgggcaagacctgcctgctgtgcagattcaccgacaacgagttccacagcagccacatcagcaccatcggcgtggacttcaagatgaagaccatcgaggtggacggcatcaaggtgagaatccagatctgggacaccgccggccaggagagataccagaccatcaccaagcagtactacagaagagcccagggcatcttcctggtgtacgacatcagcagcgagagaagctaccagcacatcatgaagtgggtgagcgacgtggacgaggtgggcgacgccaccagcctgcccggctgcggcgagggcgccagccccggcaaggccagaagaggccccgacggcaaggccaacgccagcagaaagctgtgcctgccccagccctggatgaagaccagcggcacccaccagaaggccagcagaagaagcctgctgggcatcagactgatgagaagcagaaacggcagatgggaggagagcaagggcagcagctggagaagaagcatggcctggaccagcatgaagcaggtgcccgcccccaccagcaccctgaagagccacagcagagtgtag

SEQ ID NO: 21351 - DNA, 639 bp, Artificial Sequence
  Description of Artificial Sequence: Synthetic coding sequence
atggccaagcagtacgacgtgctgttcagactgctgctgatcggcgacagcggcgtgggcaagacctgcctgctgtgcagattcaccgacaacgagttccacagcagccacatcagcaccatcggcgtggacttcaagatgaagaccatcgaggtggacggcatcaaggtgagaatccagatctgggacaccgccggccaggagagataccagaccatcaccaagcagtactacagaagagcccagggcatcttcctggtgtacgacatcagcagcgagagaagctaccagcacatcatgaagtgggtgagcgacgtggacgagtacgcccccgagggcgtgcagaagatcctgatcggcaacaaggccgacgaggagcagaagagacaggtgggcagagagcagggccagcagctggccaaggagtacggcatggacttctacgagaccagcgcctgcaccaacctgaacatcaaggagagcttcaccagactgaccgagctggtgctgcaggcccacagaaaggagctggagggcctgagaatgagagccagcaacgagctggccctggccgagctggaggaggaggagggcaagcccgagggccccgccaacagcagcaagacctgctggtgctag

SEQ ID NO: 21352 - DNA, 795 bp, Artificial Sequence
  Description of Artificial Sequence: Synthetic coding sequence
atgcacttcagcagcagcgccagagccgccgacgagaacttcgactacctgttcaagatcatcctgatcggcgacagcaacgtgggcaagacctgcgtggtgcagcacttcaagagcggcgtgtacaccgagacccagcagaacaccatcggcgtggacttcaccgtgagaagcctggacatcgacggcaagaaggtgaagaacagcagcgccagcatcatcaccttcgccagcatccagatccacggccagacccagaagatgagcccccagatctggaccaagagcagccactacctgtgggagcccctgatctggaccctgctgcccgtgctgctgcagatgcaggtgtgggacaccgccggccaggagagattcagaaccatcacccagagctactacagaagcgcccacgccgccatcatcgcctacgacctgaccagaagaagcaccttcgagagcatcccccactggatccacgagatcgagaagtacggcgccgccaacgtggtgatcatgctgatcggcaacaagtgcgacctgtgggagaagagacacgtgctgttcgaggacgcctgcaccctggccgagaagtacggcctgctggccgtgctggagaccagcgccaaggagagcaagaacatcgaggaggtgttcgtgctgatggccaaggagctgatcgccagaaacagcctgcacctgtacggcgagagcgccctgaacggcctgcccctggacagcagccccgtgctgatggcccagggccccagcgagaagacccactgcacctgctag

SEQ ID NO: 21353 - DNA, 654 bp, Artificial Sequence
  Description of Artificial Sequence: Synthetic coding sequence
atgcacttcagcagcagcgccagagccgccgacgagaacttcgactacctgttcaagatcatcctgatcggcgacagcaacgtgggcaagacctgcgtggtgcagcacttcaagagcggcgtgtacaccgagacccagcagaacaccatcggcgtggacttcaccgtgagaagcctggacatcgacggcaagaaggtgaagatgcaggtgtgggacaccgccggccaggagagattcagaaccatcacccagagctactacagaagcgcccacgccgccatcatcgcctacgacctgaccagaagaagcaccttcgagagcatcccccactggatccacgagatcgagaagtacggcgccgccaacgtggtgatcatgctgatcggcaacaagtgcgacctgtgggagaagagacacgtgctgttcgaggacgcctgcaccctggccgagaagtacggcctgctggccgtgctggagaccagcgccaaggagagcaagaacatcgaggaggtgttcgtgctgatggccaaggagctgatcgccagaaacagcctgcacctgtacggcgagagcgccctgaacggcctgcccctggacagcagccccgtgctgatggcccagggccccagcgagaagacccactgcacctgctag

SEQ ID NO: 21354 - DNA, 450 bp, Artificial Sequence
  Description of Artificial Sequence: Synthetic coding sequence
atgcacttcagcagcagcgccagagccgccgacgagaacttcgactacctgttcaagatcatcctgatcggcgacagcaacgtgggcaagacctgcgtggtgcagcacttcaagagcggcgtgtacaccgagacccagcagaacaccatcggcgtggacttcaccgtgagaagcctggacatcgacggcaagaaggtgaagatgcaggtgtgggacaccgccggccaggagagattcagaaccatcacccagagctactacagaagcgcccacgccgccatcatcgcctacgacctgaccagaagaagcaccttcgagagcatcccccactggatccacgagatcgagaagtacggcgccgccaacgtggtgatcatgctgatcggcaacaagtgcgacctgtgggagaagagacacgtgctgttcgaggacgcctgcaccctggcctag

SEQ ID NO: 21355 - DNA, 654 bp, Artificial Sequence; identical to SEQ ID NO: 21353
  Description of Artificial Sequence: Synthetic coding sequence

SEQ ID NO: 21356 - DNA, 705 bp, Artificial Sequence
  Description of Artificial Sequence: Synthetic coding sequence
atgagaaagcccgacagcaagatcgtgctgctgggcgacatgaacgtgggcaagaccagcctgctgcagagatacatggagagaagattccccgacaccgtgagcaccgtgggcggcgccttctacctgaagcagtggagaagctacaacatcagcatctgggacaccgccggcagagagcagttccacggcctgggcagcatgtactgcagaggcgccgccgccatcatcctgacctacgacgtgaaccacagacagagcctggtggagctggaggacagattcctgggcctgaccgacaccgccagcaaggactgcctgttcgccatcgtgggcaacaaggtggacctgaccgaggagggcgccctggccggccaggagaaggaggagtgcagccccaacatggacgccggcgacagagtgagccccagagcccccaagcaggtgcagctggaggacgccgtggccctgtacaagaagatcctgaagtacaagatgctggacgagcaggacgtgcccgccgccgagcagatgtgcttcgagaccagcgccaagaccggctacaacgtggacctgctgttcgagaccctgttcgacctggtggtgcccatgatcctgcagcagagagccgagagacccagccacaccgtggacatcagcagccacaagccccccaagagaaccagaagcggctgctgcgcctag

SEQ ID NO: 21357 - DNA, 657 bp, Artificial Sequence
  Description of Artificial Sequence: Synthetic coding sequence
atgaccgacggcgactacgactacctgatcaagctgctggccctgggcgacagcggcgtgggcaagaccaccttcctgtacagatacaccgacaacaagttcaaccccaagttcatcaccaccgtgggcatcgacttcagagagaagagagtggtgtacaacgcccagggccccaacggcagcagcggcaaggccttcaaggtgcacctgcagctgtgggacaccgccggccaggagagattcagaagcctgaccaccgccttcttcagagacgccatgggcttcctgctgatgttcgacctgaccagccagcagagcttcctgaacgtgagaaactggatgagccagctgcaggccaacgcctactgcgagaaccccgacatcgtgctgatcggcaacaaggccgacctgcccgaccagagagaggtgaacgagagacaggccagagagctggccgacaagtacggcatcccctacttcgagaccagcgccgccaccggccagaacgtggagaaggccgtggagaccctgctggacctgatcatgaagagaatggagcagtgcgtggagaagacccagatccccgacaccgtgaacggcggcaacagcggcaacctggacggcgagaagccccccgagaagaagtgcatctgctag

SEQ ID NO: 21358 - DNA, 654 bp, Artificial Sequence
  Description of Artificial Sequence: Synthetic coding sequence
atggagaccatctggatctaccagttcagactgatcgtgatcggcgacagcaccgtgggcaagagctgcctgctgcacagattcacccagggcagattccccggcctgagaagccccgcctgcgaccccaccgtgggcgtggacttcttcagcagactgctggagatcgagcccggcaagagaatcaagctgcagctgtgggacaccgccggccaggagagattcagaagcatcaccagaagctactacagaaacagcgtgggcggcttcctggtgttcgacatcaccaacagaagaagcttcgagcacgtgaaggactggctggaggaggccaagatgtacgtgcagcccttcagaatcgtgttcctgctggtgggccacaagtgcgacctggccagccagagacaggtgaccagagaggaggccgagaagctgagcgccgactgcggcatgaagtacatcgagaccagcgccaaggacgccaccaacgtggaggagagcttcaccatcctgaccagagacatctacgagctgatcaagaagggcgagatctgcatccaggacggctgggagggcgtgaagagcggcttcgtgcccaacaccgtgcacagcagcgaggaggccgtgaagcccagaaaggagtgcttctgctag

SEQ ID NO: 21359 - DNA, 1737 bp, Artificial Sequence
  Description of Artificial Sequence: Synthetic coding sequence
atgagacagcaggacgcccccaagcccacccccgccgcctgcagatgcagcggcctggccagaagagtgctgaccatcgccttcgccctgctgatcctgggcctgatgacctgggcctacgccgccggcgtgcccctggccagcgacagatacggcctgctggccttcggcctgtacggcgccttcctgagcgcccacctggtggcccagagcctgttcgcctacctggagcacagaagagtggccgccgccgccagaggccccctggacgccgccaccgccagaagcgtggccctgaccatcagcgcctaccaggaggaccccgcctacctgagacagtgcctggccagcgccagagccctgctgtaccccagagccagactgagagtgctgatggtggtggacggcaacagagccgaggacctgtacatggtggacatgttcagagaggtgttcgccgacgaggaccccgccacctacgtgtgggacggcaactaccaccagccctgggagcccgccgccgccggcgccgtgggcgccggcgcctacagagaggtggaggccgaggaccccggcagactggccgtggaggccctggtgagaaccagaagatgcgtgtgcgtggcccagagatggggcggcaagagagaggtgatgtacaccgccttcaaggccctgggcgacagcgtggactacgtgcaggtgtgcgacagcgacaccagactggaccccatggccctgctggagctggtgagagtgctggacgaggaccccagagtgggcgccgtgggcggcgacgtgagaatcctgaaccccctggacagctgggtgagcttcctgagcagcctgagatactgggtggccttcaacgtggagagagcctgccagagctacttccactgcgtgagctgcatcagcggccccctgggcctgtacagaaacaacctgctgcagcagttcctggaggcctggtacaaccagaagttcctgggcacccactgcaccttcggcgacgacagacacctgaccaacagaatgctgagcatgggctacgccaccaagtacaccagcagaagcagatgctacagcgagacccccagcagcttcctgagatggctgagccagcagaccagatggagcaagagctacttcagagagtggctgtacaacgccctgtggtggcacagacaccacgcctggatgacctacgaggccgtggtgagcggcctgttccccttcttcgtggccgccaccgtgctgagactgttctacgccggcagaccctgggccctgctgtgggtgctgctgtgcgtgcagggcgtggccctggccaaggccgccttcgccgcctggctgagaggctgcctgagaatggtgctgctgagcctgtacgcccccctgtacatgtgcggcctgctgcccgccaagttcctggccctggtgaccatgaaccagagcggctggggcaccagcggcagaagaaagctggccgccaactacgtgcccctgctgcccctggccctgtgggccctgctgctgctgggcggcctggtgagaagcgtggcccacgaggccagagccgactggagcggccccagcagagccgccgaggcctaccacctggccgccggcgccggcgcctacgtgggctactgggtggccatgctgaccctgtactgggtgggcgtgagaagactgtgcagaagaagaaccggcggctacagagtgcaggtgtag

SEQ ID NO: 21360 - DNA, 834 bp, Artificial Sequence
  Description of Artificial Sequence: Synthetic coding sequence
atgagcgcccccggcagccccgaccaggcctacgacttcctgctgaagttcctgctggtgggcgacagagacgtgggcaagagcgagatcctggagagcctgcaggacggcgccgccgagagcccctacagccacctgggcggcatcgactacaagaccaccaccatcctgctggacggccagagagtgaagctgaagctgtgggacaccagcggccagggcagattctgcaccatcttcagaagctacagcagaggcgcccagggcgtgatcctggtgtacgacatcgccaacagatggagcttcgagggcatggacagatggatcaagaagatcgaggagcacgcccccggcgtgcccaagatcctggtgggcaacagactgcacctggccttcaagagacaggtgcccagagagcaggcccaggcctacgccgagagactgggcgtgaccttcttcgaggtgagccccctgtgcaacttcaacatcatcgagagcttcaccgagctggccagaatcgtgctgctgagacacagaatgaactggctgggcagacccagcaaggtgctgagcctgcaggacctgtgctgcagaaccatcgtgagctgcacccccgtgcacctggtggacaagctgcccctgcccagcaccctgagaagccacctgaagagcttcagcatggccaagggcctgaacgccagaatgatgagaggcctgagctacagcctgaccaccagcagcacccacaagagcagcctgtgcaaggtggagatcgtgtgccccccccagagcccccccaagaactgcaccagaaacagctgcaagatcagctag

SEQ ID NO: 21361 - DNA, 834 bp, Artificial Sequence; identical to SEQ ID NO: 21360
  Description of Artificial Sequence: Synthetic coding sequence

SEQ ID NO: 21362 - DNA, 837 bp, Artificial Sequence
  Description of Artificial Sequence: Synthetic coding sequence
atgagcgccctgggcagccccgtgagagcctacgacttcctgctgaagttcctgctggtgggcgacagcgacgtgggcaagggcgagatcctggccagcctgcaggacggcgccgccgagagcccctacggccaccccgccggcatcgactacaagaccaccaccatcctgctggacggcagaagagtgaagctgcagctgtgggacaccagcggccagggcagattctgcaccatcttcagaagctacagcagaggcgcccagggcgtgatcctggtgtacgacatcgccaacagatggagcttcgacggcatcgacagatggatcaaggagatcgacgagcacgcccccggcgtgcccaagatcctggtgggcaacagactgcacctggccttcaagagacaggtgcccaccgagcaggcccaggcctacgccgagagactgggcgtgaccttcttcgaggtgagccccctgtgcaacttcaacatcaccgagagcttcaccgagctggccagaatcgtgctgctgagacacggcatggacagactgtggagacccagcaaggtgctgagcctgcaggacctgtgctgcagagccgtggtgagctgcacccccgtgcacctggtggacaagctgcccctgcccatcgccctgagaagccacctgaagagcttcagcatggccaacggcctgaacgccagaatgatgcacggcggcagctacagcctgaccaccagcagcacccacaagagaagcagcctgagaaaggtgaagctggtgagacccccccagagcccccccaagaactgcaccagaaacagctgcaagatcagctag

SEQ ID NO: 21363 - DNA, 837 bp, Artificial Sequence; identical to SEQ ID NO: 21362
  Description of Artificial Sequence: Synthetic coding sequence

SEQ ID NO: 21364 - DNA, 1140 bp, Artificial Sequence
  Description of Artificial Sequence: Synthetic coding sequence
gagcagggcctgggcgccagagccgcccccctgggcgccggccccccccccctgagaagcgccccccaggccggccacggctggggcagaagagccgtgaccatgagcgccctgggcagccccgtgagagcctacgacttcctgctgaagttcctgctggtgggcgacagcgacgtgggcaagggcgagatcctggccagcctgcaggacggcgccgccgagagcccctacggccaccccgccggcatcgactacaagaccaccaccatcctgctggacggcagaagagtgaagctgcagctgtgggacaccagcggccagggcagattctgcaccatcttcagaagctacagcagaggcgcccagggcgtgatcctggtgtacgacatcgccaacagatggagcttcgacggcatcgacagatggatcaaggagatcgacgagcacgcccccggcgtgcccaagatcctggtgggcaacagactgcacctggccttcaagagacaggtgcccaccgagcaggcccaggcctacgccgagagactgggcgtgaccttcttcgaggtgagccccctgtgcaacttcaacatcaccgagagcttcaccgagctggccagaatcgtgctgctgagacacggcatggacagactgtggagacccagcaaggtgctgagcctgcaggacctgtgctgcagagccgtggtgagctgcacccccgtgcacctggtggacaagctgcccctgcccatcgccctgagaagccacctgaagagcttcagcatggccaacggcctgaacgccagaatgatgcacggcggcagctacagcctgaccaccagcagcacccacaagagaagcagcctgagaaaggtgaagctggtgagacccccccagcccccccagaagctgcaccagaagcagctgcagaacttcctgagaaaggccctgaaggagaccagaagaaacctgagcagaagaagcagcgccctgccccccgccgccggcggctgcatcagcgaccccggcagcagcagaagaatgctgctggccaacgtgtgcgacgccttcagagtgatggagacccactaccccgtgggcctgagaatcagcacctggatgtgcatgaagctgctgttctag

SEQ ID NO: 21365 - DNA, 846 bp, Artificial Sequence
  Description of Artificial Sequence: Synthetic coding sequence
atgggcagccagggcagccccgtgaagagctacgactacctgctgaagttcctgctggtgggcgacagcgacgtgggcaagggcgagatcctggagagcctgcaggacggcgccgccgagagcccctacgcctacagcaacggcatcgactacaagaccaccaccatcctgctggacggcagaagagtgaagctggagctgtgggacaccagcggccagggcagattctgcaccatcttcagaagctacagcagaggcgcccagggcatcctgctggtgtacgacatcaccaacagatggagcttcgacggcatcgacagatggatcaaggagatcgacgagcacgcccccggcgtgcccagaatcctggtgggcaacagactgcacctggccttcaagagacaggtgcccaccgagcaggccagagcctacgccgagaagaactgcatgaccttcttcgaggtgagccccctgtgcaacttcaacgtgatcgagagcttcaccgagctgagcagaatcgtgctgatgagacacggcatggagaagatctggagacccaacagagtgttcagcctgcaggacctgtgctgcagagccatcgtgagctgcacccccgtgcacctgatcgacaagctgcccctgcccgtgaccatcaagagccacctgaagagcttcagcatggccaacggcatgaacgccgtgatgatgcacggcagaagctacagcctggccagcggcgccggcggcggcggcagcaagggcaacagcctgaagagaagcaagagcatcagacccccccagagccccccccagaactgcagcagaagcaactgcaagatcagctag

SEQ ID NO: 21366 - DNA, 846 bp, Artificial Sequence; identical to SEQ ID NO: 21365
  Description of Artificial Sequence: Synthetic coding sequence

SEQ ID NO: 21367 - DNA, 846 bp, Artificial Sequence; identical to SEQ ID NO: 21365
  Description of Artificial Sequence: Synthetic coding sequence

SEQ ID NO: 21368 - DNA, 846 bp, Artificial Sequence; identical to SEQ ID NO: 21365
  Description of Artificial Sequence: Synthetic coding sequence

SEQ ID NO: 21369 - DNA, 468 bp, Artificial Sequence
  Description of Artificial Sequence: Synthetic coding sequence
atggccggccccggccccggccccggcgaccccgacgagcagtacgacttcctgttcaagctggtgctggtgggcgacgccagcgtgggcaagacctgcgtggtgcagagattcaagaccggcgccttcagcgagagacagggcagcaccatcggcgtggacttcaccatgaagaccctggagatccagggcaagagagtgaagctgcagatctgggacaccgccggccaggagagattcagaaccatcacccagagctactacagaagcgccaacggcgccatcctggcctacgacatcaccaagagaagcagcttcctgagcgtgccccactggatcgaggacgtgagaaagtacgccggcagcaacatcgtgcagctgctgatcgagatgcagagctgctacgtggcccaggccgacctggagctgctggccagcagcaacccccccgccagcaccagcaagtag

SEQ ID NO: 21370 - DNA, 639 bp, Artificial Sequence
  Description of Artificial Sequence: Synthetic coding sequence
atggccggccccggccccggccccggcgaccccgacgagcagtacgacttcctgttcaagctggtgctggtgggcgacgccagcgtgggcaagacctgcgtggtgcagagattcaagaccggcgccttcagcgagagacagggcagcaccatcggcgtggacttcaccatgaagaccctggagatccagggcaagagagtgaagctgcagatctgggacaccgccggccaggagagattcagaaccatcacccagagctactacagaagcgccaacggcgccatcctggcctacgacatcaccaagagaagcagcttcctgagcgtgccccactggatcgaggacgtgagaaagtacgccggcagcaacatcgtgcagctgctgatcggcaacaagagcgacctgagcgagctgagagaggtgagcctggccgaggcccagagcctggccgagcactacgacatcctgtgcgccatcgagaccagcgccaaggacagcagcaacgtggaggaggccttcctgagagtggccaccgagctgatcatgagacacggcggccccctgttcagcgagaagagccccgaccacatccagctgaacagcaaggacatcggcgagggctggggctgcggctgctag

SEQ ID NO: 21371 - DNA, 639 bp, Artificial Sequence; identical to SEQ ID NO: 21370
  Description of Artificial Sequence: Synthetic coding sequence

SEQ ID NO: 21372 - DNA, 639 bp, Artificial Sequence; identical to SEQ ID NO: 21370
  Description of Artificial Sequence: Synthetic coding sequence

SEQ ID NO: 21373 - DNA, 639 bp, Artificial Sequence; identical to SEQ ID NO: 21370
  Description of Artificial Sequence: Synthetic coding sequence

SEQ ID NO: 21374 - DNA, 639 bp, Artificial Sequence; identical to SEQ ID NO: 21370
  Description of Artificial Sequence: Synthetic coding sequence

SEQ ID NO: 21375 - DNA, 261 bp, Artificial Sequence
  Description of Artificial Sequence: Synthetic coding sequence
atggccggccccggccccggccccggcgaccccgacgagcagtacgacttcctgttcaagctggtgctggtgggcgacgccagcgtgggcaagacctgcgtggtgcagagattcaagaccggcgccttcagcgagagacagggcagcaccatcggcgtggacttcaccatgaagaccctggagatccagggcaagagagtgaagctgcagatctgggacaccgccggccaggagagattcagaaccatcacccagagctag

SEQ ID NO: 21376 - DNA, 624 bp, Artificial Sequence
  Description of Artificial Sequence: Synthetic coding sequence
atggccaagacctacgactacctgttcaagctgctgctgatcggcgacagcggcgtgggcaagacctgcctgctgttcagattcagcgaggacgccttcaacaccaccttcatcagcaccatcggcatcgacttcaagatcagaaccatcgagctggacggcaagaagatcaagctgcagatctgggacaccgccggccaggagagattcagaaccatcaccaccgcctactacagaggcgccatgggcatcatgctggtgtacgacatcaccaacgagaagagcttcgacaacatcaagaactggatcagaaacatcgaggagcacgccagcagcgacgtggagagaatgatcctgggcaacaagtgcgacatgaacgacaagagacaggtgagcaaggagagaggcgagaagctggccatcgactacggcatcaagttcctggagaccagcgccaagagcagcgccaacgtggaggaggccttcttcaccctggccagagacatcatgaccaagctgaacagaaagatgaacgacagcaacagcgccggcgccggcggccccgtgaagatcaccgagaacagaagcaagaagaccagcttcttcagatgcagcctgctgtag

SEQ ID NO: 21377 - DNA, 573 bp, Artificial Sequence
  Description of Artificial Sequence: Synthetic coding sequence
atggccaagacctacgactacctgttcaagctgctgctgatcggcgacagcggcgtgggcaagacctgcctgctgttcagattcagcgaggacgccttcaacaccaccttcatcagcaccatcggcatcgacttcaagatcagaaccatcgagctggacggcaagaagatcaagctgcagatctgggacaccgccggccaggagagattcagaaccatcaccaccgcctactacagaggcgccatgggcatcatgctggtgtacgacatcaccaacgagaagagcttcgacaacatcaagaactggatcagaaacatcgaggagcacgccagcagcgacgtggagagaatgatcctgggcaacaagtgcgacatgaacgacaagagacaggtgagcaaggagagaggcgagaagctggccatcgactacggcatcaagttcctggagaccagcgccaagagcagcgccaacgtggaggagaacgacagcaacagcgccggcgccggcggccccgtgaagatcaccgagaacagaagcaagaagaccagcttcttcagatgcagcctgctgtag

SEQ ID NO: 21378 - DNA, 966 bp, Artificial Sequence
  Description of Artificial Sequence: Synthetic coding sequence
atgaagcagctgcccgtgctggagcccggcgacaagcccagaaaggccacctggtacaccctgaccgtgcccggcgacagcccctgcgccagagtgggccacagctgcagctacctgccccccgtgggcaacgccaagagaggcaaggtgttcatcgtgggcggcgccaaccccaacagaagcttcagcgacgtgcacaccatggacctggagaccagaacctggaccacccccgaggtgaccagccccccccccagccccagaaccttccacaccagcagcgccgccatcggcaaccagctgtacgtgttcggcggcggcgagagaggcgcccagcccgtgcaggacaccaagctgcacgtgttcgacgccaacaccctgacctggagccagcccgagaccctgggcaacccccccagccccagacacggccacgtgatggtggccgccggcaccaagctgttcatccacggcggcctggccggcgacagattctacgacgacctgcactgcatcgacatcagcgacatgaagtggcagaagctgaaccccaccggcgccgcccccgccggctgcgccgcccacagcgccgtggccatgggcaagcacgtgtacatcttcggcggcatgacccccgccggcgccctggacaccatgtaccagtaccacaccgaggagcagcactggaccctgctgaagttcgacaccctgctgccccccggcagactggaccacagcatgtgcatcatcccctggcccgtgacctgcgccagcgagaaggaggacagcaacagcctgaccctgaaccacgaggccgagaaggaggacagcgccgacaaggtgatgagccacagcggcgacagccacgaggagagccagaccgccaccctgctgtgcctggtgttcggcggcatgaacaccgagggcgagatctacgacgactgcatcgtgaccgtggtggactag

SEQ ID NO: 21379 - DNA, 1119 bp, Artificial Sequence
  Description of Artificial Sequence: Synthetic coding sequence
atgaagcagctgcccgtgctggagcccggcgacaagcccagaaaggccacctggtacaccctgaccgtgcccggcgacagcccctgcgccagagtgggccacagctgcagctacctgccccccgtgggcaacgccaagagaggcaaggtgttcatcgtgggcggcgccaaccccaacagaagcttcagcgacgtgcacaccatggacctgggcaagcaccagtgggacctggacacctgcaagggcctgctgcccagatacgagcacgccagcttcatccccagctgcacccccgacagaatctgggtgttcggcggcgccaaccagagcggcaacagaaactgcctgcaggtgctgaaccccgagaccagaacctggaccacccccgaggtgaccagccccccccccagccccagaaccttccacaccagcagcgccgccatcggcaaccagctgtacgtgttcggcggcggcgagagaggcgcccagcccgtgcaggacaccaagctgcacgtgttcgacgccaacaccctgacctggagccagcccgagaccctgggcaacccccccagccccagacacggccacgtgatggtggccgccggcaccaagctgttcatccacggcggcctggccggcgacagattctacgacgacctgcactgcatcgacatcagcgacatgaagtggcagaagctgaaccccaccggcgccgcccccgccggctgcgccgcccacagcgccgtggccatgggcaagcacgtgtacatcttcggcggcatgacccccgccggcgccctggacaccatgtaccagtaccacaccgaggagcagcactggaccctgctgaagttcgacaccctgctgccccccggcagactggaccacagcatgtgcatcatcccctggcccgtgacctgcgccagcgagaaggaggacagcaacagcctgaccctgaaccacgaggccgagaaggaggacagcgccgacaaggtgatgagccacagcggcgacagccacgaggagagccagaccgccaccctgctgtgcctggtgttcggcggcatgaacaccgagggcgagatctacgacgactgcatcgtgaccgtggtggactag

SEQ ID NO: 21380 - DNA, 465 bp, Artificial Sequence
  Description of Artificial Sequence: Synthetic coding sequence
atgaagcagctgcccgtgctggagcccggcgacaagcccagaaaggccacctggtacaccctgaccgtgcccggcgacagcccctgcgccagagtgggccacagctgcagctacctgccccccgtgggcaacgccaagagaggcaaggtgttcatcgtgggcggcgccaaccccaacagaagcttcagcgacgtgcacaccatggacctgggcaagcaccagtgggacctggacacctgcaagggcctgctgcccagatacgagcacgccagcttcatccccagctgcacccccgacagaatctgggtgttcggcggcgccaaccagagcggcaacagaaactgcctgcaggtgctgaaccccgccttcaagagctggggcttctggaccgtgctggccaaccccaagtaccacctgcacagcagcctgatgttcaagcccggcagaggccccagacagaagtag

SEQ ID NO: 21381 - DNA, 465 bp, Artificial Sequence; identical to SEQ ID NO: 21380
  Description of Artificial Sequence: Synthetic coding sequence

SEQ ID NO: 21382 - DNA, 1119 bp, Artificial Sequence; identical to SEQ ID NO: 21379
  Description of Artificial Sequence: Synthetic coding sequence

SEQ ID NO: 21383 - DNA, 735 bp, Artificial Sequence
  Description of Artificial Sequence: Synthetic coding sequence
ggcagaggcagccccgacaccggcagcatcaccgtgagcggcagagagagcgagagcttcagaggcgtgggccccagcagagtgcagagaaccggcaagggcctgccctggctgagacccggccacttcgacagaatcagcctgttcttccccgaccccgtgagctaccccctggagctgcccagaggcgacgagatctgctgggccggcagcggcggctgctgcggcagaagcagacccagagaggccagcctgaccgagctgtggaccctgggcaccgccgtgagcggcctgggcagaagatacaccctgaccgtgcccggcgacagcccctgcgccagagtgggccacagctgcagctacctgccccccgtgggcaacgccaagagaggcaaggtgttcatcgtgggcggcgccaaccccaacagaagcttcagcgacgtgcacaccatggacctgggcaagcaccagtgggacctggacacctgcaagggcctgctgcccagatacgagcacgccagcttcatccccagctgcacccccgacagaatctgggtgttcggcggcgccaaccagagcggcaacagaaactgcctgcaggtgctgaaccccgagaccagaacctggaccacccccgaggtgaccagccccccccccagccccagaaccttccacaccagcagcgccgccatcggcaaccagctgtacgtgttcggcggcggcgagagaggctag

SEQ ID NO: 21384 - DNA, 606 bp, Artificial Sequence
  Description of Artificial Sequence: Synthetic coding sequence
atggccggcaagagcagcctgttcaaggtgatcctgctgggcgacggcggcgtgggcaagagcagcctgatgaacagatacgtgaccaacaagttcgacacccagctgttccacaccatcggcgtggagttcctgaacaaggacctggaggtggacggccacttcgtgaccatgcagatctgggacaccgccggccaggagagattcagaagcctgagaacccccttctacagaggcagcgactgctgcctgctgaccttcagcgtggacgacagccagagcttccagaacctgagcaactggaagaaggagttcatctactacgccgacgtgaaggagcccgagagcttccccttcgtgatcctgggcaacaagatcgacatcagcgagagacaggtgagcaccgaggaggcccaggcctggtgcagagacaacggcgactacccctacttcgagaccagcgccaaggacgccaccaacgtggccgccgccttcgaggaggccgtgagaagagtgctggccaccgaggacagaagcgaccacctgatccagaccgacaccgtgaacctgcacagaaagcccaagcccagcagcagctgctgctag

SEQ ID NO: 21385 - DNA, 1506 bp, Artificial Sequence
  Description of Artificial Sequence: Synthetic coding sequence
atgggctgcggcctgagaaagctggaggaccccgacgacagcagccccggcaagatcttcagcaccctgaagagaccccaggtggagaccaagaccgagttcgcctacgagtacgtgctgctggacttcaccctgcaggccagcagcaaccccgaggtgatcaagatcaacagcatcctggacatcgtgaccaaggtggagaactactacctgaagggctacatcgtgggcgccatccaccccgtgatccagcccgtgggccagagaaagcacctgcccgccagctacctgtacagagtggtgctgctgagactgaagctgagccccaagaacagcgccgcccccagcggccagagaagacccagactggtgatcgaggagtgccccctgaccagcgaggcccagaccaacgacgccgccaaggagctgatcgagaagatcaacgtggccgccaagagaggcatgaagttcgtgggcttcatcagccagcactacagccccagcaagttctgcaacggcaccaaccacgacggcgacatcgagagcatgctgcacgtgagacacggcagcgacgagaactgcagaagctggaacgagggcaccctgagcggccagagcagcgagagcggcatcgaggaggagctgcaccacgagagcggccagtaccagatggagcagaacggcagccccaccagcagcaagagcagaaagggcgaggccagcgacaacaagctgtacaccgtgttcaacgccttcgacgacgacagcaccagctgggcctaccaggagggcatcctgagcatgaaggtgaccagaaagggcagcgtgatcagcaccctggacgccgactggctggagctgaccaccttctactacaagcagggcctgagcctgatcgacagcttcgtgttctgggagaccagcaagggcgagcacctgcccaagagcctggagggcttcttcatctacgaggaggagggcagcggcgtgcccggcagcagcagaaagggcaacgacgccatcgtggtggagcagtggaccgtgatcgagggctgcgagatcaagaccgactacggccccctgctgcacaccctggccgagttcggctggctgctgaccagcgtgctgcccacccccgtgctgagacacgacagcgagggcaacctggccaccaagcagatcgtgttcctgcagagacccgtgatgtggaacagcgccgcccagacccccgacaagaaggccagcagacacatcaagggcgaggacaagaacaaggccaccagcagaagcatcggcctggacaccaccagcagccagcccgccgagagcagacacctgcccgaggagtgcagactgagccccagcagagagtgctggaccaaggagggcagactggcccagcacaacagcttcagcggcttcagcagcagcgacaacgtgctgagagagctggacgacggccagttcgaccaggaggacggcgtgacccaggtgacctgcatgtag

SEQ ID NO: 21386 - DNA, 1737 bp, Artificial Sequence
  Description of Artificial Sequence: Synthetic coding sequence
atgggctgcggcctgaacaagctggagaagagagacgagaagagacccggcaacatctacagcaccctgaagagaccccaggtggagaccaagatcgacgtgagctacgagtacagattcctggagttcaccaccctgagcgccgccgagctgcccggcagcagcgccgtgagactggccagcctgagagacctgcccgcccagctgctggagctgtaccagcagggcttcagcctggccgccctgcaccccttcgtgcagcccacccacgagagagagaagacccccctggagcacatcttcagagccatcctgatcaagaagaccgacagaagccagaagaccgacctgcacaacgagggctacatcctggagctggactgctgcagcagcctggaccaccccaccgaccagaagctgatccccgagttcatcaagaagatccaggaggccgccagccagggcctgaagttcgtgggcgtgatcccccagtaccacagcagcgtgaacagcgccggcagcagcgcccccgtgagcaccgccaacagcaccgaggacgccagagacgccaagaacgccagaggcgaccacgccagcctggagaacgagaagcccggcaccggcgacgtgtgcagcgcccccgccggcagaaaccagagccccgagcccagcagcggccccagaggcgaggtgcccctggccaagcagcccagcagccccagcggcgagggcgacggcggcgagctgagcccccagggcgtgagcaagaccctggacggccccgagagcaaccccctggaggtgcacgaggagcccctgagcggcaagatggagatcttcaccctgttcaacaagcccaagagccaccagaagtgcagacagtactaccccgtgaccatccccctgcacgtgagcaagaacggccagaccgtgagcggcctggacgccaactggctggagcacatgagcgaccacttcagaaagggcggcatgctggtgaacgccgtgttctacctgggcatcgtgaacgacagcctgcacggcctgaccgacggcgtgttcatcttcgaggccgtgagcaccgaggacagcaagaccatccagggctacgacgccatcgtggtggagcagtggaccgtgctggagggcgtggaggtgcagaccgactacgtgcccctgctgaacagcctggccgcctacggctggcagctgacctgcgtgctgcccacccccgtggtgaagaccaccagcgagggcagcgtgagcaccaagcagatcgtgttcctgcagagaccctgcctgccccagaagatcaagaagaaggagagcaagttccagtggagattcagcagagaggagatgcacaacagacagatgagaaagagcaagggcaagctgagcgccagagacaagcagcaggccgaggagaacgagaagaacctggaggaccagagcagcaaggccggcgacatgggcaactgcgtgagcggccagcagcaggagggcggcgtgagcgaggagatgaagggccccgtgcaggaggacaagggcgagcagctgagccccggcggcctgctgtgcggcgtgggcgtggagggcgaggccgtgcagaacggccccgccagccacagcagagccctggtgggcatctgcaccggccacagcaaccccggcgaggacgccagagacggcgacgccgaggaggtgagagagctgggcaccgtggaggagaactag

SEQ ID NO: 21387 - DNA, 345 bp, Artificial Sequence
  Description of Artificial Sequence: Synthetic coding sequence
atgggctgcggcctgaacaagctggagaagagagacgagaagagacccggcaacatctacagcaccctgaagagaccccaggtggagaccaagatcgacgtgagctacgagtacagattcctggagttcaccaccctgagcgccgccgagctgcccggcagcagcgccgtgagactggccagcctgagagacctgcccgcccagctgctggagctgtaccagcagggcttcagcctggccgccctgcaccccttcgtgcagcccacccacgagagagagaagacccccctggagcacatcttcagagccatcctgatcaagaagaccgacagaagccagaagtag

SEQ ID NO: 21388 - DNA, 450 bp, Artificial Sequence
  Description of Artificial Sequence: Synthetic coding sequence
atgggctgcggcctgaacaagctggagaagagagacgagaagagacccggcaacatctacagcaccctgaagagaccccaggtggagaccaagatcgacgtgagctacgagtacagattcctggagttcaccaccctgagcgccgccgagctgcccggcagcagcgccgtgagactggccagcctgagagacctgcccgcccagctgctggagctgtaccagcagggcttcagcctggccgccctgcaccccttcgtgcagcccacccacgagagagagaagacccccctggagcacatcttcagagccatcctgatcaagaagaccgacagaagccagaagaccgacctgcacaacgagggctacatcctggagctggactgctgcagcagcctggaccaccccaccgaccagaagctgatccccgagttcatcaagaagatccagtag

SEQ ID NO: 21389 - DNA, 450 bp, Artificial Sequence; identical to SEQ ID NO: 21388
  Description of Artificial Sequence: Synthetic coding sequence

SEQ ID NO: 21390 - DNA, 828 bp, Artificial Sequence
  Description of Artificial Sequence: Synthetic coding sequence
atgggctgcggcctgaacaagctggagaagagagacgagaagagacccggcaacatctacagcaccctgaagagaccccaggtggagaccaagatcgacgtgagctacgagtacagattcctggagttcaccaccctgagcgccgccgagctgcccggcagcagcgccgtgagactggccagcctgagagacctgcccgcccagctgctggagctgtaccagcagggcttcagcctggccgccctgcaccccttcgtgcagcccacccacgagagagagaagacccccctggagcacatcttcagagccatcctgatcaagaagaccgacagaagccagaagaccgacctgcacaacgagggctacatcctggagctggactgctgcagcagcctggaccaccccaccgaccagaagctgatccccgagttcatcaagaagatccaggaggccgccagccagggcctgaagttcgtgggcgtgatcccccagtaccacagcagcgtgaacagcgccggcagcagcgcccccgtgagcaccgccaacagcaccgaggacgccagagacgccaagaacgccagaggcgaccacgccagcctggagaacgagaagcccggcaccggcgacgtgtgcagcgcccccgccggcagaaaccagagccccgagcccagcagcggccccagaggcgaggtgcccctggccaagcagcccagcagccccagcggcgagggcgacggcggcgagctgagcccccagggcgtgagcaagaccctggacggccccgagagcaaccccctggaggtgcacgaggagcccctgagcggctag

SEQ ID NO: 21391 - DNA, 1647 bp, Artificial Sequence
  Description of Artificial Sequence: Synthetic coding sequence
atggacctgatgaacggccaggccagcagcgtgaacatcgccgccaccgccagcgagggccagatcaccctgatggacgtgcccgtgttcaaggccatccagcccgacgagctgagcagctgcggctggaacaagaaggagaagtacagcagcgcccccaacgccgtggccttcaccagaagattcaaccacgtgagcttctgggtggtgagagagatcctgcacgcccagaccctgaagatcagagccgaggtgctgagccactacatcaagaccgccaagaagctgtacgagctgaacaacctgcacgccctgatggccgtggtgagcggcctgcagagcgcccccatcttcagactgaccaagacctgggccctgctgagcagaaaggacaagaccaccttcgagaagctggagtacgtgatgagcaaggaggacaactacaagagactgagagactacatcagcagcctgaagatgaccccctgcatcccctacctgggcatctacctgagcgacctgacctacatcgacagcgcctaccccagcaccggcagcatcctggagaacgagcagagaagcaacctgatgaacaacatcctgagaatcatcagcgacctgcagcagagctgcgagtacgacatccccatgctgccccacgtgcagaagtacctgaacagcgtgcagtacatcgaggagctgcagaagttcgtggaggacgacaactacaagctgagcctgaagatcgagcccggcaccagcacccccagaagcgccgccagcagagaggacctggtgggccccgaggtgggcgccagcccccagagcggcagaaagagcgtggccgccgagggcgccctgctgccccagaccccccccagccccagaaacctgatcccccacggccacagaaagtgccacagcctgggctacaacttcatccacaagatgaacaccgccgagttcaagagcgccaccttccccaacgccggccccagacacctgctggacgacagcgtgatggagccccacgcccccagcagaggccaggccgagagcagcaccctgagcagcggcatcagcatcggcagcagcgacggcagcgagctgagcgaggagaccagctggcccgccttcgagagaaacagactgtaccacagcctgggccccgtgaccagagtggccagaaacggctacagaagccacatgaaggccagcagcagcgccgagagcgaggacctggccgtgcacctgtaccccggcgccgtgaccatccagggcgtgctgagaagaaagaccctgctgaaggagggcaagaagcccaccgtggccagctggaccaagtactgggccgccctgtgcggcacccagctgttctactacgccgccaagagcctgaaggccaccgagagaaagcacttcaagagcaccagcaacaagaacgtgagcgtgatcggctggatggtgatgatggccgacgaccccgagcaccccgacctgttcctgctgaccgacagcgagaagggcaacagctacaagttccaggccggcaacagaatgaacgccatgctgtggttcaagcacctgagcgccgcctgccagagcaacaagcagcaggtgcccaccaacctgatgaccttcgagtag

SEQ ID NO: 21392 - DNA, 1674 bp, Artificial Sequence
  Description of Artificial Sequence: Synthetic coding sequence
atggacctgatgaacggccaggccagcagcgtgaacatcgccgccaccgccagcgagaagagcagcagcagcgagagcctgagcgacaagggcagcgagctgaagaagagcttcgacgccgtggtgttcgacgtgctgaaggtgacccccgaggagtacgccggccagatcaccctgatggacgtgcccgtgttcaaggccatccagcccgacgagctgagcagctgcggctggaacaagaaggagaagtacagcagcgcccccaacgccgtggccttcaccagaagattcaaccacgtgagcttctgggtggtgagagagatcctgcacgcccagaccctgaagatcagagccgaggtgctgagccactacatcaagaccgccaagaagctgtacgagctgaacaacctgcacgccctgatggccgtggtgagcggcctgcagagcgcccccatcttcagactgaccaagacctgggccctgctgagcagaaaggacaagaccaccttcgagaagctggagtacgtgatgagcaaggaggacaactacaagagactgagagactacatcagcagcctgaagatgaccccctgcatcccctacctgggcatctacctgagcgacctgacctacatcgacagcgcctaccccagcaccggcagcatcctggagaacgagcagagaagcaacctgatgaacaacatcctgagaatcatcagcgacctgcagcagagctgcgagtacgacatccccatgctgccccacgtgcagaagtacctgaacagcgtgcagtacatcgaggagctgcagaagttcgtggaggacgacaactacaagctgagcctgaagatcgagcccggcaccagcacccccagaagcgccgccagcagagaggacctggtgggccccgaggtgggcgccagcccccagagcggcagaaagagcgtggccgccgagggcgccctgctgccccagaccccccccagccccagaaacctgatcccccacggccacagaaagtgccacagcctgggctacaacttcatccacaagatgaacaccgccgagttcaagagcgccaccttccccaacgccggccccagacacctgctggacgacagcgtgatggagccccacgcccccagcagaggccaggccgagagcagcaccctgagcagcggcatcagcatcggcagcagcgacggcagcgagctgagcgaggagaccagctggcccgccttcgagagcagcgccgagagcgaggacctggccgtgcacctgtaccccggcgccgtgaccatccagggcgtgctgagaagaaagaccctgctgaaggagggcaagaagcccaccgtggccagctggaccaagtactgggccgccctgtgcggcacccagctgttctactacgccgccaagagcctgaaggccaccgagagaaagcacttcaagagcaccagcaacaagaacgtgagcgtgatcggctggatggtgatgatggccgacgaccccgagcaccccgacctgttcctgctgaccgacagcgagaagggcaacagctacaagttccaggccggcaacagaatgaacgccatgctgtggttcaagcacctgagcgccgcctgccagagcaacaagcagcaggtgcccaccaacctgatgaccttcgagtag

SEQ ID NO: 21393 - DNA, 1752 bp, Artificial Sequence
  Description of Artificial Sequence: Synthetic coding sequence
atggacctgatgaacggccaggccagcagcgtgaacatcgccgccaccgccagcgagaagagcagcagcagcgagagcctgagcgacaagggcagcgagctgaagaagagcttcgacgccgtggtgttcgacgtgctgaaggtgacccccgaggagtacgccggccagatcaccctgatggacgtgcccgtgttcaaggccatccagcccgacgagctgagcagctgcggctggaacaagaaggagaagtacagcagcgcccccaacgccgtggccttcaccagaagattcaaccacgtgagcttctgggtggtgagagagatcctgcacgcccagaccctgaagatcagagccgaggtgctgagccactacatcaagaccgccaagaagctgtacgagctgaacaacctgcacgccctgatggccgtggtgagcggcctgcagagcgcccccatcttcagactgaccaagacctgggccctgctgagcagaaaggacaagaccaccttcgagaagctggagtacgtgatgagcaaggaggacaactacaagagactgagagactacatcagcagcctgaagatgaccccctgcatcccctacctgggcatctacctgagcgacctgacctacatcgacagcgcctaccccagcaccggcagcatcctggagaacgagcagagaagcaacctgatgaacaacatcctgagaatcatcagcgacctgcagcagagctgcgagtacgacatccccatgctgccccacgtgcagaagtacctgaacagcgtgcagtacatcgaggagctgcagaagttcgtggaggacgacaactacaagctgagcctgaagatcgagcccggcaccagcacccccagaagcgccgccagcagagaggacctggtgggccccgaggtgggcgccagcccccagagcggcagaaagagcgtggccgccgagggcgccctgctgccccagaccccccccagccccagaaacctgatcccccacggccacagaaagtgccacagcctgggctacaacttcatccacaagatgaacaccgccgagttcaagagcgccaccttccccaacgccggccccagacacctgctggacgacagcgtgatggagccccacgcccccagcagaggccaggccgagagcagcaccctgagcagcggcatcagcatcggcagcagcgacggcagcgagctgagcgaggagaccagctggcccgccttcgagagaaacagactgtaccacagcctgggccccgtgaccagagtggccagaaacggctacagaagccacatgaaggccagcagcagcgccgagagcgaggacctggccgtgcacctgtaccccggcgccgtgaccatccagggcgtgctgagaagaaagaccctgctgaaggagggcaagaagcccaccgtggccagctggaccaagtactgggccgccctgtgcggcacccagctgttctactacgccgccaagagcctgaaggccaccgagagaaagcacttcaagagcaccagcaacaagaacgtgagcgtgatcggctggatggtgatgatggccgacgaccccgagcaccccgacctgttcctgctgaccgacagcgagaagggcaacagctacaagttccaggccggcaacagaatgaacgccatgctgtggttcaagcacctgagcgccgcctgccagagcaacaagcagcaggtgcccaccaacctgatgaccttcgagtag

SEQ ID NO: 21394 - DNA, 699 bp, Artificial Sequence
  Description of Artificial Sequence: Synthetic coding sequence
atgaacaccgccgagttcaagagcgccaccttccccaacgccggccccagacacctgctggacgacagcgtgatggagccccacgcccccagcagaggccaggccgagagcagcaccctgagcagcggcatcagcatcggcagcagcgacggcagcgagctgagcgaggagaccagctggcccgccttcgagagaaacagactgtaccacagcctgggccccgtgaccagagtggccagaaacggctacagaagccacatgaaggccagcagcagcgccgagagcgaggacctggccgtgcacctgtaccccggcgccgtgaccatccagggcgtgctgagaagaaagaccctgctgaaggagggcaagaagcccaccgtggccagctggaccaagtactgggccgccctgtgcggcacccagctgttctactacgccgccaagagcctgaaggccaccgagagaaagcacttcaagagcaccagcaacaagaacgtgagcgtgatcggctggatggtgatgatggccgacgaccccgagcaccccgacctgttcctgctgaccgacagcgagaagggcaacagctacaagttccaggccggcaacagaatgaacgccatgctgtggttcaagcacctgagcgccgcctgccagagcaacaagcagcaggtgcccaccaacctgatgaccttcgagtag

SEQ ID NO: 21395 - DNA, 2388 bp, Artificial Sequence
  Description of Artificial Sequence: Synthetic coding sequence
atggagggcctgaccctgagcgacgccgagcagaagtactacagcgacctgttcagctactgcgacatcgagagcaccaagaaggtggtggtgaacggcagagtgctggagctgttcagagccgcccagctgcccaacgacgtggtgctgcagatcatggagctgtgcggcgccaccagactgggctacttcggcagaagccagttctacatcgccctgaagctggtggccgtggcccagagcggcttccccctgagagtggagagcatcaacaccgtgaaggacctgcccctgcccagattcgtggccagcaagaacgagcaggagagcagacacgccgccagctacagcagcgacagcgagaaccagggcagctacagcggcgtgatcccccccccccccggcagaggccaggtgaagaagggcagcgtgagccacgacaccgtgcagcccagaaccagcgccgacgcccaggagcccgccagccccgtggtgagcccccagcagagcccccccaccagcccccacacctggagaaagcacagcagacaccccagcggcggcaacagcgagagacccctggccggccccggccccttctggagccccttcggcgaggcccagagcggcagcagcgccggcgacgccgtgtggagcggccacagccccccccccccccaggagaactgggtgagcttcgccgacaccccccccaccagcaccctgctgaccatgcaccccgccagcgtgcaggaccagaccaccgtgagaaccgtggccagcgccaccaccgccatcgagatcagaagacagagcagcagctacgacgacccctggaagatcaccgacgagcagagacagtactacgtgaaccagttcaagaccatccagcccgacctgaacggcttcatccccggcagcgccgccaaggagttcttcaccaagagcaagctgcccatcctggagctgagccacatctgggagctgagcgacttcgacaaggacggcgccctgaccctggacgagttctgcgccgccttccacctggtggtggccagaaagaacggctacgacctgcccgagaagctgcccgagagcctgatgcccaagctgatcgacctggaggacagcgccgacgtgggcgaccagcccggcgaggtgggctacagcggcagccccgccgaggccccccccagcaagagccccagcatgcccagcctgaaccagacctggcccgagctgaaccagagcagcgagcagtgggagaccttcagcgagagaagcagcagcagccagaccctgacccagttcgacagcaacatcgcccccgccgaccccgacaccgccatcgtgcaccccgtgcccatcagaatgacccccagcaagatccacatgcaggagatggagctgaagagaaccggcagcgaccacaccaaccccaccagccccctgctggtgaagcccagcgacctgctggaggagaacaagatcaacagcagcgtgaagttcgccagcggcaacaccgtggacggctacagcagcagcgacagcttcaccagcgaccccgagcagatcggcagcaacgtgaccagacagagaagccacagcggcaccagccccgacaacaccgccccccccccccccccccccagaccccagcccagccacagcagaagcagcagcctggacatgaacagaaccttcaccgtgaccaccggccagcagcaggccggcgtggtggcccacccccccgccgtgccccccagaccccagcccagccaggcccccggccccgccgtgcacagacccgtggacgccgacggcctgatcacccacaccagcaccagcccccagcagatccccgagcagcccaacttcgccgacttcagccagttcgaggtgttcgccgccagcaacgtgaacgacgagcaggacgacgaggccgagaagcaccccgaggtgctgcccgccgagaaggccagcgaccccgccagcagcctgagagtggccaagaccgacagcaagaccgaggagaagaccgccgccagcgcccccgccaacgtgagcaagggcaccacccccctggcccccccccccaagcccgtgagaagaagactgaagagcgaggacgagctgagacccgaggtggacgagcacacccagaagaccggcgtgctggccgccgtgctggccagccagcccagcatccccagaagcgtgggcaaggacaagaaggccatccaggccagcatcagaagaaacaaggagaccaacaccgtgctggccagactgaacagcgagctgcagcagcagctgaaggacgtgctggaggagagaatcagcctggaggtgcagctggagcagctgagacccttcagccacctgtag

SEQ ID NO: 21396 - DNA, 2310 bp, Artificial Sequence
  Description of Artificial Sequence: Synthetic coding sequence
atggagggcctgaccctgagcgacgccgagcagaagtactacagcgacctgttcagctactgcgacatcgagagcaccaagaaggtggtggtgaacggcagagtgctggagctgttcagagccgcccagctgcccaacgacgtggtgctgcagatcatggagctgtgcggcgccaccagactgggctacttcggcagaagccagttctacatcgccctgaagctggtggccgtggcccagagcggcttccccctgagagtggagagcatcaacaccgtgaaggacctgcccctgcccagattcgtggccagcaagaacgagcaggagagcagacacgccgccagctacagcagcgacagcgagaaccagggcagctacagcggcgtgatcccccccccccccggcagaggccaggtgaagaagggcagcgtgagccacgacaccgtgcagcccagaaccagcgccgacgcccaggagcccgccagccccgtggtgagcccccagcagagcccccccaccagcccccacacctggagaaagcacagcagacaccccagcggcggcaacagcgagagacccctggccggccccggccccttctggagccccttcggcgaggcccagagcggcagcagcgccggcgacgccgtgtggagcggccacagccccccccccccccaggagaactgggtgagcttcgccgacaccccccccaccagcaccctgctgaccatgcaccccgccagcgtgcaggaccagaccaccgtgagaaccgtggccagcgccaccaccgccatcgagatcagaagacagagcagcagctacgacgacccctggaagatcaccgacgagcagagacagtactacgtgaaccagttcaagaccatccagcccgacctgaacggcttcatccccggcagcgccgccaaggagttcttcaccaagagcaagctgcccatcctggagctgagccacatctgggagctgagcgacttcgacaaggacggcgccctgaccctggacgagttctgcgccgccttccacctggtggtggccagaaagaacggctacgacctgcccgagaagctgcccgagagcctgatgcccaagctgatcgacctggaggacagcgccgacgtgggcgaccagcccggcgaggtgggctacagcggcagccccgccgaggccccccccagcaagagccccagcatgcccagcctgaaccagacctggcccgagctgaaccagagcagcgaggacaccgccatcgtgcaccccgtgcccatcagaatgacccccagcaagatccacatgcaggagatggagctgaagagaaccggcagcgaccacaccaaccccaccagccccctgctggtgaagcccagcgacctgctggaggagaacaagatcaacagcagcgtgaagttcgccagcggcaacaccgtggccgacggctacagcagcagcgacagcttcaccagcgaccccgagcagatcggcagcaacgtgaccagacagagaagccacagcggcaccagccccgacaacaccgccccccccccccccccccccagaccccagcccagccacagcagaagcagcagcctggacatgaacagaaccttcaccgtgaccaccggccagcagcaggccggcgtggtggcccacccccccgccgtgccccccagaccccagcccagccaggcccccggccccgccgtgcacagacccgtggacgccgacggcctgatcacccacaccagcaccagcccccagcagatccccgagcagcccaacttcgccgacttcagccagttcgaggtgttcgccgccagcaacgtgaacgacgagcaggacgacgaggccgagaagcaccccgaggtgctgcccgccgagaaggccagcgaccccgccagcagcctgagagtggccaagaccgacagcaagaccgaggagaagaccgccgccagcgcccccgccaacgtgagcaagggcaccacccccctggcccccccccccaagcccgtgagaagaagactgaagagcgaggacgagctgagacccgaggtggacgagcacacccagaagaccggcgtgctggccgccgtgctggccagccagcccagcatccccagaagcgtgggcaaggacaagaaggccatccaggccagcatcagaagaaacaaggagaccaacaccgtgctggccagactgaacagcgagctgcagcagcagctgaaggacgtgctggaggagagaatcagcctggaggtgcagctggagcagctgagacccttcagccacctgtag

SEQ ID NO: 21397 - DNA, 2235 bp, Artificial Sequence
  Description of Artificial Sequence: Synthetic coding sequence
atggagctgtgcggcgccaccagactgggctacttcggcagaagccagttctacatcgccctgaagctggtggccgtggcccagagcggcttccccctgagagtggagagcatcaacaccgtgaaggacctgcccctgcccagattcgtggccagcaagaacgagcaggagagcagacacgccgccagctacagcagcgacagcgagaaccagggcagctacagcggcgtgatcccccccccccccggcagaggccaggtgaagaagggcagcgtgagccacgacaccgtgcagcccagaaccagcgccgacgcccaggagcccgccagccccgtggtgagcccccagcagagcccccccaccagcccccacacctggagaaagcacagcagacaccccagcggcggcaacagcgagagacccctggccggccccggccccttctggagccccttcggcgaggcccagagcggcagcagcgccggcgacgccgtgtggagcggccacagccccccccccccccaggagaactgggtgagcttcgccgacaccccccccaccagcaccctgctgaccatgcaccccgccagcgtgcaggaccagaccaccgtgagaaccgtggccagcgccaccaccgccatcgagatcagaagacagagcagcagctacgacgacccctggaagatcaccgacgagcagagacagtactacgtgaaccagttcaagaccatccagcccgacctgaacggcttcatccccggcagcgccgccaaggagttcttcaccaagagcaagctgcccatcctggagctgagccacatctgggagctgagcgacttcgacaaggacggcgccctgaccctggacgagttctgcgccgccttccacctggtggtggccagaaagaacggctacgacctgcccgagaagctgcccgagagcctgatgcccaagctgatcgacctggaggacagcgccgacgtgggcgaccagcccggcgaggtgggctacagcggcagccccgccgaggccccccccagcaagagccccagcatgcccagcctgaaccagacctggcccgagctgaaccagagcagcgagcagtgggagaccttcagcgagagaagcagcagcagccagaccctgacccagttcgacagcaacatcgcccccgccgaccccgacaccgccatcgtgcaccccgtgcccatcagaatgacccccagcaagatccacatgcaggagatggagctgaagagaaccggcagcgaccacaccaaccccaccagccccctgctggtgaagcccagcgacctgctggaggagaacaagatcaacagcagcgtgaagttcgccagcggcaacaccgtggccgacggctacagcagcagcgacagcttcaccagcgaccccgagcagatcggcagcaacgtgaccagacagagaagccacagcggcaccagccccgacaacaccgccccccccccccccccccccagaccccagcccagccacagcagaagcagcagcctggacatgaacagaaccttcaccgtgaccaccggccagcagcaggccggcgtggtggcccacccccccgccgtgccccccagaccccagcccagccaggcccccggccccgccgtgcacagacccgtggacgccgacggcctgatcacccacaccagcaccagcccccagcagatccccgagcagcccaacttcgccgacttcagccagttcgaggtgttcgccgccagcaacgtgaacgacgagcaggacgacgaggccgagaagcaccccgaggtgctgcccgccgagaaggccagcgaccccgccagcagcctgagagtggccaagaccgacagcaagaccgaggagaagaccgccgccagcgcccccgccaacgtgagcaagggcaccacccccctggcccccccccccaagcccgtgagaagaagactgaagagcgaggacgagctgagacccgaggtggacgagcacacccagaagaccggcgtgctggccgccgtgctggccagccagcccagcatccccagaagcgtgggcaaggacaagaaggccatccaggccagcatcagaagaaacaaggagaccaacaccgtgctggccagactgaacagcgagctgcagcagcagctgaaggacgtgctggaggagagaatcagcctggaggtgcagctggagcagctgagacccttcagccacctgtag

SEQ ID NO: 21398 - DNA, 2118 bp, Artificial Sequence
  Description of Artificial Sequence: Synthetic coding sequence
atggagggcctgaccctgagcgacgccgagcagaagtactacagcgacctgttcagctactgcgacatcgagagcaccaagaaggtggtggtgaacggcagagtgctggagctgttcagagccgcccagctgcccaacgacgtggtgctgcagatcatggagctgtgcggcgccaccagactgggctacttcggcagaagccagttctacatcgccctgaagctggtggccgtggcccagagcggcttccccctgagagtggagagcatcaacaccgtgaaggacctgcccctgcccagattcgtggccagcaagaacgagcaggagagcagacacgccgccagctacagcagcgacagcgagaaccagggcagctacagcggcgtgatcccccccccccccggcagaggccaggtgaagaagggcagcgtgagccacgacaccgtgcagcccagaaccagcgccgacgcccaggagcccgccagccccgtggtgagcccccagcagagcccccccaccagcccccacacctggagaaagcacagcagacaccccagcggcggcaacagcgagagacccctggccggccccggccccttctggagccccttcggcgaggcccagagcggcagcagcgccggcgacgccgtgtggagcggccacagccccccccccccccaggagaactgggtgagcttcgccgacaccccccccaccagcaccctgctgaccatgcaccccgccagcgtgcaggaccagaccaccgtgagaaccgtggccagcgccaccaccgccatcgagatcagaagacagagcagcagctacgacgacccctggaagatcaccgacgagcagagacagtactacgtgaaccagttcaagaccatccagcccgacctgaacggcttcatccccggcagcgccgccaaggagttcttcaccaagagcaagctgcccatcctggagctgagccacatctgggagctgagcgacttcgacaaggacggcgccctgaccctggacgagttctgcgccgccttccacctggtggtggccagaaagaacggctacgacctgcccgagaagctgcccgagagcctgatgcccaagctgatcgacctggaggacagcgccgacgtgggcgaccagcccggcgaggtgggctacagcggcagccccgccgaggccccccccagcaagagccccagcatgcccagcctgaaccagacctggcccgagctgaaccagagcagcgaggacaccgccatcgtgcaccccgtgcccatcagaatgacccccagcaagatccacatgcaggagatggagctgaagagaaccggcagcgaccacaccaaccccaccagccccctgctggtgaagcccagcgacctgctggaggagaacaagatcaacagcagcgtgaagttcgccagcggcaacaccgtgggccagcagcaggccggcgtggtggcccacccccccgccgtgccccccagaccccagcccagccaggcccccggccccgccgtgcacagacccgtggacgccgacggcctgatcacccacaccagcaccagcccccagcagatccccgagcagcccaacttcgccgacttcagccagttcgaggtgttcgccgccagcaacgtgaacgacgagcaggacgacgaggccgagaagcaccccgaggtgctgcccgccgagaaggccagcgaccccgccagcagcctgagagtggccaagaccgacagcaagaccgaggagaagaccgccgccagcgcccccgccaacgtgagcaagggcaccacccccctggcccccccccccaagcccgtgagaagaagactgaagagcgaggacgagctgagacccgaggtggacgagcacacccagaagaccggcgtgctggccgccgtgctggccagccagcccagcatccccagaagcgtgggcaaggacaagaaggccatccaggccagcatcagaagaaacaaggagaccaacaccgtgctggccagactgaacagcgagctgcagcagcagctgaaggacgtgctggaggagagaatcagcctggaggtgcagctggagcagctgagacccttcagccacctgtag

SEQ ID NO: 21399 - DNA, 2391 bp, Artificial Sequence
  Description of Artificial Sequence: Synthetic coding sequence
atggagggcctgaccctgagcgacgccgagcagaagtactacagcgacctgttcagctactgcgacatcgagagcaccaagaaggtggtggtgaacggcagagtgctggagctgttcagagccgcccagctgcccaacgacgtggtgctgcagatcatggagctgtgcggcgccaccagactgggctacttcggcagaagccagttctacatcgccctgaagctggtggccgtggcccagagcggcttccccctgagagtggagagcatcaacaccgtgaaggacctgcccctgcccagattcgtggccagcaagaacgagcaggagagcagacacgccgccagctacagcagcgacagcgagaaccagggcagctacagcggcgtgatcccccccccccccggcagaggccaggtgaagaagggcagcgtgagccacgacaccgtgcagcccagaaccagcgccgacgcccaggagcccgccagccccgtggtgagcccccagcagagcccccccaccagcccccacacctggagaaagcacagcagacaccccagcggcggcaacagcgagagacccctggccggccccggccccttctggagccccttcggcgaggcccagagcggcagcagcgccggcgacgccgtgtggagcggccacagccccccccccccccaggagaactgggtgagcttcgccgacaccccccccaccagcaccctgctgaccatgcaccccgccagcgtgcaggaccagaccaccgtgagaaccgtggccagcgccaccaccgccatcgagatcagaagacagagcagcagctacgacgacccctggaagatcaccgacgagcagagacagtactacgtgaaccagttcaagaccatccagcccgacctgaacggcttcatccccggcagcgccgccaaggagttcttcaccaagagcaagctgcccatcctggagctgagccacatctgggagctgagcgacttcgacaaggacggcgccctgaccctggacgagttctgcgccgccttccacctggtggtggccagaaagaacggctacgacctgcccgagaagctgcccgagagcctgatgcccaagctgatcgacctggaggacagcgccgacgtgggcgaccagcccggcgaggtgggctacagcggcagccccgccgaggccccccccagcaagagccccagcatgcccagcctgaaccagacctggcccgagctgaaccagagcagcgagcagtgggagaccttcagcgagagaagcagcagcagccagaccctgacccagttcgacagcaacatcgcccccgccgaccccgacaccgccatcgtgcaccccgtgcccatcagaatgacccccagcaagatccacatgcaggagatggagctgaagagaaccggcagcgaccacaccaaccccaccagccccctgctggtgaagcccagcgacctgctggaggagaacaagatcaacagcagcgtgaagttcgccagcggcaacaccgtggccgacggctacagcagcagcgacagcttcaccagcgaccccgagcagatcggcagcaacgtgaccagacagagaagccacagcggcaccagccccgacaacaccgccccccccccccccccccccagaccccagcccagccacagcagaagcagcagcctggacatgaacagaaccttcaccgtgaccaccggccagcagcaggccggcgtggtggcccacccccccgccgtgccccccagaccccagcccagccaggcccccggccccgccgtgcacagacccgtggacgccgacggcctgatcacccacaccagcaccagcccccagcagatccccgagcagcccaacttcgccgacttcagccagttcgaggtgttcgccgccagcaacgtgaacgacgagcaggacgacgaggccgagaagcaccccgaggtgctgcccgccgagaaggccagcgaccccgccagcagcctgagagtggccaagaccgacagcaagaccgaggagaagaccgccgccagcgcccccgccaacgtgagcaagggcaccacccccctggcccccccccccaagcccgtgagaagaagactgaagagcgaggacgagctgagacccgaggtggacgagcacacccagaagaccggcgtgctggccgccgtgctggccagccagcccagcatccccagaagcgtgggcaaggacaagaaggccatccaggccagcatcagaagaaacaaggagaccaacaccgtgctggccagactgaacagcgagctgcagcagcagctgaaggacgtgctggaggagagaatcagcctggaggtgcagctggagcagctgagacccttcagccacctgtag

SEQ ID NO: 21400 - DNA, 441 bp, Artificial Sequence
  Description of Artificial Sequence: Synthetic coding sequence
gagctgaaccagagcagcgagtgggagaccttcagcgagagaagcagcagcagccagaccctgacccagttcgacagcaacatcgcccccgccgaccccgacaccgccatcgtgcaccccgtgcccatcagaatgacccccagcaagatccacatgcaggagatggagctgaagagaaccggcagcgaccacaccaaccccaccagccccctgctggtgaagcccagcgacctgctggaggagaacaagatcaacagcagcgtgaagttcgccagcggcaacaccgtgggccagcagcaggccggcgtggtggcccacccccccgccgtgccccccagaccccagcccagccaggcccccggccccgccgtgcacagacccgtggacgccgacggcctgatcacccacaccagcaccagcccccagcagatccccgagtag

SEQ ID NO: 21401 - DNA, 1398 bp, Artificial Sequence
  Description of Artificial Sequence: Synthetic coding sequence
atgaccaccatccccagaaagggcagcagccacctgcccggcagcctgcacacctgcaagctgaagctgcaggaggacagaagacagcaggagaagagcgtgatcgcccagcccatcttcgtgttcgagaagggcgagcagaccttcaagagacccgccgaggacaccctgtacgaggccgccgagcccgagtgcaacggcttccccaccaagagagtgagaagcagcagcttcaccttccacatcaccgacagccagagccagggcgtgagaaagaacaacgtgttcatgaccagcgccctggtgcagagcagcgtggacatcaagagcgccgagcagggccccgtgaagcacagcaagcacgtgatcagacccgccatcctgcagctgccccaggccagaagctgcgccaaggtgagaaagaccttcggccacaaggccctggagagctgcaagaccaaggagaagaccaacaacaagatcagcgagggcaacagctacctgctgagcgagaacctgagcagagccagaatcagcgtgcagctgagcaccaaccaggacttcctgggcgccaccagcgtgggctgccagcccaacgaggacaagtgcagcttcaagagctgcagcagcaacttcgtgttcggcgagaacatggtggagagagtgctgggcacccagaagctgacccagccccagctggagaacgacagctacgccaaggagaagcccttcaagagcatccccaagttccccgtgaacttcctgagcagcagaaccgacagcatcaagaacaccagcctgatcgagagcgccgccgccttcagcagccagcccagcagaaagtgcctgctggagaagatcgacgtgatcaccggcgaggagaccgagcacaacgtgctgaagatcaactgcaagctgttcatcttcaacaagaccacccagagctggatcgagagaggcagaggcaccctgagactgaacgacaccgccagcaccgactgcggcaccctgcagagcagactgatcatgagaaaccagggcagcctgagactgatcctgaacagcaagctgtgggcccagatgaagatccagagagccaaccacaagaacgtgagaatcaccgccaccgacctggaggactacagcatcaagatcttcctgatccaggccagcgcccaggacaccgcctacctgtacgccgccatccaccacagactggtggccctgcagagcttcaacaagcagagagacgtgaaccaggccgagagcctgagcgagaccgcccagcagctgaactgcgagagctgcgacgagaacgaggacgacttcatccaggtgaccaagaacggcagcgaccccagcagctggacccacagacagagcgtggcctgcagctag

SEQ ID NO: 21402 - DNA, 327 bp, Artificial Sequence
  Description of Artificial Sequence: Synthetic coding sequence
atgaccaccatccccagaaagggcagcagccacctgcccggcagcctgcacacctgcaagctgaagctgcaggaggacagaagacagcaggagaagagcgtgatcgcccagcccatcttcgtgttcgagaagggcgagcagaccttcaagagacccgccgaggacaccctgtacgaggccgccgagcccgagtgcaacggcttccccaccaagagagtgagaagcagcagcttcaccttccacatcaccgacagccagagccagggcgtgagaaagaacaacgtgttcatgaccagcgccctggtgcagagcagcgtggacatctag

SEQ ID NO: 21403 - DNA, 1473 bp, Artificial Sequence
  Description of Artificial Sequence: Synthetic coding sequence
atgaccaccatccccagaaagggcagcagccacctgcccggcagcctgcacacctgcaagctgaagctgcaggaggacagaagacagcaggagaagagcgtgatcgcccagcccatcttcgtgttcgagaagggcgagcagaccttcaagagacccgccgaggacaccctgtacgaggccgccgagcccgagtgcaacggcttccccaccaagagagtgagaagcagcagcttcaccttccacatcaccgacagccagagccagggcgtgagcaccctgagccagaagcagatgagatgcagcagcgtgaccaacctgcccaccttcccccacagcggccccgtgagaaagaacaacgtgttcatgaccagcgccctggtgcagagcagcgtggacatcaagagcgccgagcagggccccgtgaagcacagcaagcacgtgatcagacccgccatcctgcagctgccccaggccagaagctgcgccaaggtgagaaagaccttcggccacaaggccctggagagctgcaagaccaaggagaagaccaacaacaagatcagcgagggcaacagctacctgctgagcgagaacctgagcagagccagaatcagcgtgcagctgagcaccaaccaggacttcctgggcgccaccagcgtgggctgccagcccaacgaggacaagtgcagcttcaagagctgcagcagcaacttcgtgttcggcgagaacatggtggagagagtgctgggcacccagaagctgacccagccccagctggagaacgacagctacgccaaggagaagcccttcaagagcatccccaagttccccgtgaacttcctgagcagcagaaccgacagcatcaagaacaccagcctgatcgagagcgccgccgccttcagcagccagcccagcagaaagtgcctgctggagaagatcgacgtgatcaccggcgaggagaccgagcacaacgtgctgaagatcaactgcaagctgttcatcttcaacaagaccacccagagctggatcgagagaggcagaggcaccctgagactgaacgacaccgccagcaccgactgcggcaccctgcagagcagactgatcatgagaaaccagggcagcctgagactgatcctgaacagcaagctgtgggcccagatgaagatccagagagccaaccacaagaacgtgagaatcaccgccaccgacctggaggactacagcatcaagatcttcctgatccaggccagcgcccaggacaccgcctacctgtacgccgccatccaccacagactggtggccctgcagagcttcaacaagcagagagacgtgaaccaggccgagagcctgagcgagaccgcccagcagctgaactgcgagagctgcgacgagaacgaggacgacttcatccaggtgaccaagaacggcagcgaccccagcagctggacccacagacagagcgtggcctgcagctag

SEQ ID NO: 21404 - DNA, 4500 bp, Artificial Sequence
  Description of Artificial Sequence: Synthetic coding sequence
atgaagcccctggccatccccgccaaccacggcgtgatgggccagcaggagaagcacagcctgcccgccgacttcaccaagctgcacctgaccgacagcctgcacccccaggtgacccacgtgagcagcagccacagcggctgcagcatcaccagcgacagcggcagcagcagcctgagcgacatctaccaggccaccgagagcgaggccggcgacatggacctgagcggcctgcccgagaccgccgtggacagcgaggacgacgacgacgaggaggacatcgagagagccagcgaccccctgatgagcagagacatcgtgagagactgcctggagaaggaccccatcgacagaaccgacgacgacatcgagcagctgctggagttcatgcaccagctgcccgccttcgccaacatgaccatgagcgtgagaagagagctgtgcgccgtgatggtgttcgccgtggtggagagagccggcaccatcgtgctgaacgacggcgaggagctggacagctggagcgtgatcctgaacggcagcgtggaggtgacctaccccgacggcaaggccgagatcctgtgcatgggcaacagcttcggcgtgagccccaccatggacaaggagtacatgaagggcgtgatgagaaccaaggtggacgactgccagttcgtgtgcatcgcccagcaggactactgcagaatcctgaaccaggtggagaagaacatgcagaaggtggaggaggagggcgagatcgtgatggtgaaggagcacagagagctggacagaaccggcaccagaaagggccacatcgtgatcaagggcaccagcgagagactgaccatgcacctggtggaggagcacagcgtggtggaccccaccttcatcgaggacttcctgctgacctacagaaccttcctgagcagccccatggaggtgggcaagaagctgctggagtggttcaacgaccccagcctgagagacaaggtgaccagagtggtgctgctgtgggtgaacaaccacttcaacgacttcgagggcgaccccgccatgaccagattcctggaggagttcgagaacaacctggagagagagaagatgggcggccacctgagactgctgaacatcgcctgcgccgccaaggccaagagaagactgatgaccctgaccaagcccagcagagaggcccccctgcccttcatcctgctgggcggcagcgagaagggcttcggcatcttcgtggacagcgtggacagcggcagcaaggccaccgaggccggcctgaagagaggcgaccagatcctggaggtgaacggccagaacttcgagaacatccagctgagcaaggccatggagatcctgagaaacaacacccacctgagcatcaccgtgaagaccaacctgttcgtgttcaaggagctgctgaccagactgagcgaggagaagagaaacggcgccccccacctgcccaagatcggcgacatcaagaaggccagcagatacagcatccccgacctggccgtggacgtggagcaggtgatcggcctggagaaggtgaacaagaagagcaaggccaacaccgtgggcggcagaaacaagctgaagaagatcctggacaagaccagaatcagcatcctgccccagaagccctacaacgacatcggcatcggccagagccaggacgacagcatcgtgggcctgagacagaccaagcacatccccaccgccctgcccgtgagcggcaccctgagcagcagcaaccccgacctgctgcagagccaccacagaatcctggacttcagcgccacccccgacctgcccgaccaggtgctgagagtgttcaaggccgaccagcagagcagatacatcatgatcagcaaggacaccaccgccaaggaggtggtgatccaggccatcagagagttcgccgtgaccgccacccccgaccagtacagcctgtgcgaggtgagcgtgacccccgagggcgtgatcaagcagagaagactgcccgaccagctgagcaagctggccgacagaatccagctgagcggcagatactacctgaagaacaacatggagaccgagaccctgtgcagcgacgaggacgcccaggagctgctgagagagagccagatcagcctgctgcagctgagcaccgtggaggtggccacccagctgagcatgagaaacttcgagctgttcagaaacatcgagcccaccgagtacatcgacgacctgttcaagctgagaagcaagaccagctgcgccaacctgaagagattcgaggaggtgatcaaccaggagaccttctgggtggccagcgagatcctgagagagaccaaccagctgaagagaatgaagatcatcaagcacttcatcaagatcgccctgcactgcagagagtgcaagaacttcaacagcatgttcgccatcatcagcggcctgaacctggcccccgtggccagactgagaaccacctgggagaagctgcccaacaagtacgagaagctgttccaggacctgcaggacctgttcgaccccagcagaaacatggccaagtacagaaacgtgctgaacagccagaacctgcagccccccatcatccccctgttccccgtgatcaagaaggacctgaccttcctgcacgagggcaacgacagcaaggtggacggcctggtgaacttcgagaagctgagaatgatcgccaaggagatcagacacgtgggcagaatggccagcgtgaacatggaccccgccctgatgttcagaaccagaaagaagaagtggagaagcctgggcagcctgagccagggcagcaccaacgccaccgtgctggacgtggcccagaccggcggccacaagaagagagtgagaagaagcagcttcctgaacgccaagaagctgtacgaggacgcccagatggccagaaaggtgaagcagtacctgagcaacctggagctggagatggacgaggagagcctgcagaccctgagcctgcagtgcgagcccgccaccaacaccctgcccaagaaccccggcgacaagaagcccgtgaagagcgagaccagccccgtggcccccagagccggcagccagcagaaggcccagagcctgccccagccccagcagcagcccccccccgcccacaagatcaaccagggcctgcaggtgcccgccgtgagcctgtaccccagcagaaagaaggtgcccgtgaaggacctgccccccttcggcatcaacagcccccaggccctgaagaagatcctgagcctgagcgaggagggcagcctggagagacacaagaagcaggccgaggacaccatcagcaacgccagcagccagctgagcagcccccccaccagcccccagagcagccccagaaagggctacaccctggcccccagcggcaccgtggacaacttcagcgacagcggccacagcgagatcagcagcagaagcagcatcgtgagcaacagcagcttcgacagcgtgcccgtgagcctgcacgacgagagaagacagagacacagcgtgagcatcgtggagaccaacctgggcatgggcagaatggagagaagaaccatgatcgagcccgaccagtacagcctgggcagctacgcccccatgagcgagggcagaggcctgtacgccaccgccaccgtgatcagcagccccagcaccgaggagctgagccaggaccagggcgacagagccagcctggacgccgccgacagcggcagaggcagctggaccagctgcagcagcggcagccacgacaacatccagaccatccagcaccagagaagctgggagaccctgcccttcggccacacccacttcgactacagcggcgaccccgccggcctgtgggccagcagcagccacatggaccagatcatgttcagcgaccacagcaccaagtacaacagacagaaccagagcagagagagcctggagcaggcccagagcagagccagctgggccagcagcaccggctactggggcgaggacagcgagggcgacaccggcaccatcaagagaagaggcggcaaggacgtgagcatcgaggccgagagcagcagcctgaccagcgtgaccaccgaggagaccaagcccgtgcccatgcccgcccacatcgccgtggccagcagcaccaccaagggcctgatcgccagaaaggagggcagatacagagagcccccccccaccccccccggctacatcggcatccccatcaccgacttccccgagggccacagccaccccgccagaaagccccccgactacaacgtggccctgcagagaagcagaatggtggccagaagcagcgacaccgccggccccagcagcgtgcagcagccccacggccaccccaccagcagcagacccgtgaacaagccccagtggcacaagcccaacgagagcgaccccagactggccccctaccagagccagggcttcagcaccgaggaggacgaggacgagcaggtgagcgccgtgtag

SEQ ID NO: 21405 - DNA, 2646 bp, Artificial Sequence
  Description of Artificial Sequence: Synthetic coding sequence
atggtgctgagaagaatgcacagacccagaagctgcagctaccagctgctgctggagcaccagagacccagctgcatccagggcctgagatggacccccctgaccaacagcgaggagagcctggacttcagcgagagcctggagcaggccagcaccgagagagtgctgagagccggcagacagctgcacagacacctgctggccacctgccccaacctgatcagagacagaaagtaccacctgagactgtacagacagtgctgcagcggcagagagctggtggacggcatcctggccctgggcctgggcgtgcacagcagaagccaggtggtgggcatctgccaggtgctgctggacgagggcgccctgtgccacgtgaagcacgactgggccttccaggacagagacgcccagttctacagattccccggccccgagcccgagcccgtgagaacccacgagatggaggaggagctggccgaggccgtggccctgctgagccagagaggccccgacgccctgctgaccgtggccctgagaaagccccccggccagagaaccgacgaggagctggacctgatcttcgaggagctgctgcacatcaaggccgtggcccacctgagcaacagcgtgaagagagagctggccgccgtgctgctgttcgagccccacagcaaggccggcaccgtgctgttcagccagggcgacaagggcaccagctggtacatcatctggaagggcagcgtgaacgtggtgacccacggcaagggcctggtgaccaccctgcacgagggcgacgacttcggccagctggccctggtgaacgacgcccccagagccgccaccatcatcctgagagaggacaactgccacttcctgagagtggacaagcaggacttcaacagaatcatcaaggacgtggaggccaagaccatgagactggaggagcacggcaaggtggtgctggtgctggagagagccagccagggcgccggccccagcagaccccccacccccggcagaaacagatacaccgtgatgagcggcacccccgagaagatcctggagctgctgctggaggccatgggccccgacagcagcgcccacgaccccaccgagaccttcctgagcgacttcctgctgacccacagagtgttcatgcccagcgcccagctgtgcgccgccctgctgcaccacttccacgtggagcccgccggcggcagcgagcaggagagaagcacctacgtgtgcaacaagagacagcagatcctgagactggtgagccagtgggtggccctgtacggcagcatgctgcacaccgaccccgtggccaccagcttcctgcagaagctgagcgacctggtgggcagagacaccagactgagcaacctgctgagagagcagtggcccgagagaagaagatgccacagactggagaacggctgcggcaacgccagcccccagatgaaggccagaaacctgcccgtgtggctgcccaaccaggacgagcccctgcccggcagcagctgcgccatccaggtgggcgacaaggtgccctacgacatctgcagacccgaccacagcgtgctgaccctgcagctgcccgtgaccgccagcgtgagagaggtgatggccgccctggcccaggaggacggctggaccaagggccaggtgctggtgaaggtgaacagcgccggcgacgccatcggcctgcagcccgacgccagaggcgtggccaccagcctgggcctgaacgagagactgttcgtggtgaacccccaggaggtgcacgagctgatcccccaccccgaccagctgggccccaccgtgggcagcgccgagggcctggacctggtgagcgccaaggacctggccggccagctgaccgaccacgactggagcctgttcaacagcatccaccaggtggagctgatccactacgtgctgggcccccagcacctgagagacgtgaccaccgccaacctggagagattcatgagaagattcaacgagctgcagtactgggtggccaccgagctgtgcctgtgccccgtgcccggccccagagcccagctgctgagaaagttcatcaagctggccgcccacctgaaggagcagaagaacctgaacagcttcttcgccgtgatgttcggcctgagcaacagcgccatcagcagactggcccacacctgggagagactgccccacaaggtgagaaagctgtacagcgccctggagagactgctggaccccagctggaaccacagagtgtacagactggccctggccaagctgagcccccccgtgatccccttcatgcccctgctgctgaaggacatgaccttcatccacgagggcaaccacaccctggtggagaacctgatcaacttcgagaagatgagaatgatggccagagccgccagaatgctgcaccactgcagaagccacaaccccgtgcccctgagccccctgagaagcagagtgagccacctgcacgaggacagccaggtggccagaatcagcacctgcagcgagcagagcctgagcaccagaagccccgccagcacctgggcctacgtgcagcagctgaaggtgatcgacaaccagagagagctgagcagactgagcagagagctggagccctag

SEQ ID NO: 21406 - DNA, 2646 bp, Artificial Sequence; identical to SEQ ID NO: 21405
  Description of Artificial Sequence: Synthetic coding sequence

SEQ ID NO: 21407 - DNA, 2772 bp, Artificial Sequence
  Description of Artificial Sequence: Synthetic coding sequence
atgaaggtgggctggcccggcgagagctgctggcaggtgggcctggccgtggaggacagccccgccctgggcgcccccagagtgggcgccctgcccgacgtggtgcccgagggcaccctgctgaacatggtgctgagaagaatgcacagacccagaagctgcagctaccagctgctgctggagcaccagagacccagctgcatccagggcctgagatggacccccctgaccaacagcgaggagagcctggacttcagcgagagcctggagcaggccagcaccgagagagtgctgagagccggcagacagctgcacagacacctgctggccacctgccccaacctgatcagagacagaaagtaccacctgagactgtacagacagtgctgcagcggcagagagctggtggacggcatcctggccctgggcctgggcgtgcacagcagaagccaggtggtgggcatctgccaggtgctgctggacgagggcgccctgtgccacgtgaagcacgactgggccttccaggacagagacgcccagttctacagattccccggccccgagcccgagcccgtgagaacccacgagatggaggaggagctggccgaggccgtggccctgctgagccagagaggccccgacgccctgctgaccgtggccctgagaaagccccccggccagagaaccgacgaggagctggacctgatcttcgaggagctgctgcacatcaaggccgtggcccacctgagcaacagcgtgaagagagagctggccgccgtgctgctgttcgagccccacagcaaggccggcaccgtgctgttcagccagggcgacaagggcaccagctggtacatcatctggaagggcagcgtgaacgtggtgacccacggcaagggcctggtgaccaccctgcacgagggcgacgacttcggccagctggccctggtgaacgacgcccccagagccgccaccatcatcctgagagaggacaactgccacttcctgagagtggacaagcaggacttcaacagaatcatcaaggacgtggaggccaagaccatgagactggaggagcacggcaaggtggtgctggtgctggagagagccagccagggcgccggccccagcagaccccccacccccggcagaaacagatacaccgtgatgagcggcacccccgagaagatcctggagctgctgctggaggccatgggccccgacagcagcgcccacgaccccaccgagaccttcctgagcgacttcctgctgacccacagagtgttcatgcccagcgcccagctgtgcgccgccctgctgcaccacttccacgtggagcccgccggcggcagcgagcaggagagaagcacctacgtgtgcaacaagagacagcagatcctgagactggtgagccagtgggtggccctgtacggcagcatgctgcacaccgaccccgtggccaccagcttcctgcagaagctgagcgacctggtgggcagagacaccagactgagcaacctgctgagagagcagtggcccgagagaagaagatgccacagactggagaacggctgcggcaacgccagcccccagatgaaggccagaaacctgcccgtgtggctgcccaaccaggacgagcccctgcccggcagcagctgcgccatccaggtgggcgacaaggtgccctacgacatctgcagacccgaccacagcgtgctgaccctgcagctgcccgtgaccgccagcgtgagagaggtgatggccgccctggcccaggaggacggctggaccaagggccaggtgctggtgaaggtgaacagcgccggcgacgccatcggcctgcagcccgacgccagaggcgtggccaccagcctgggcctgaacgagagactgttcgtggtgaacccccaggaggtgcacgagctgatcccccaccccgaccagctgggccccaccgtgggcagcgccgagggcctggacctggtgagcgccaaggacctggccggccagctgaccgaccacgactggagcctgttcaacagcatccaccaggtggagctgatccactacgtgctgggcccccagcacctgagagacgtgaccaccgccaacctggagagattcatgagaagattcaacgagctgcagtactgggtggccaccgagctgtgcctgtgccccgtgcccggccccagagcccagctgctgagaaagttcatcaagctggccgcccacctgaaggagcagaagaacctgaacagcttcttcgccgtgatgttcggcctgagcaacagcgccatcagcagactggcccacacctgggagagactgccccacaaggtgagaaagctgtacagcgccctggagagactgctggaccccagctggaaccacagagtgtacagactggccctggccaagctgagcccccccgtgatccccttcatgcccctgctgctgaaggacatgaccttcatccacgagggcaaccacaccctggtggagaacctgatcaacttcgagaagatgagaatgatggccagagccgccagaatgctgcaccactgcagaagccacaaccccgtgcccctgagccccctgagaagcagagtgagccacctgcacgaggacagccaggtggccagaatcagcacctgcagcgagcagagcctgagcaccagaagccccgccagcacctgggcctacgtgcagcagctgaaggtgatcgacaaccagagagagctgagcagactgagcagagagctggagccctag

SEQ ID NO: 21408 - DNA, 1797 bp, Artificial Sequence
  Description of Artificial Sequence: Synthetic coding sequence
atgaaggtgggctggcccggcgagagctgctggcaggtgggcctggccgtggaggacagccccgccctgggcgcccccagagtgggcgccctgcccgacgtggtgcccgagggcaccctgctgaacatggtgctgagaagaatgcacagacccagaagctgcagctaccagctgctgctggagcaccagagacccagctgcatccagggcctgagatggacccccctgaccaacagcgaggagagcctggacttcagcgagagcctggagcaggccagcaccgagagagtgctgagagccggcagacagctgcacagacacctgctggccacctgccccaacctgatcagagacagaaagtaccacctgagactgtacagacagtgctgcagcggcagagagctggtggacggcatcctggccctgggcctgggcgtgcacagcagaagccaggtggtgggcatctgccaggtgctgctggacgagggcgccctgtgccacgtgaagcacgactgggccttccaggacagagacgcccagttctacagattccccggccccgagcccgagcccgtgagaacccacgagatggaggaggagctggccgaggccgtggccctgctgagccagagaggccccgacgccctgctgaccgtggccctgagaaagccccccggccagagaaccgacgaggagctggacctgatcttcgaggagctgctgcacatcaaggccgtggcccacctgagcaacagcgtgaagagagagctggccgccgtgctgctgttcgagccccacagcaaggccggcaccgtgctgttcagccagggcgacaagggcaccagctggtacatcatctggaagggcagcgtgaacgtggtgacccacggcaagggcctggtgaccaccctgcacgagggcgacgacttcggccagctggccctggtgaacgacgcccccagagccgccaccatcatcctgagagaggacaactgccacttcctgagagtggacaagcaggacttcaacagaatcatcaaggacgtggaggccaagaccatgagactggaggagcacggcaaggtggtgctggtgctggagagagccagccagggcgccggccccagcagaccccccacccccggcagaaacagatacaccgtgatgagcggcacccccgagaagatcctggagctgctgctggaggccatgggccccgacagcagcgcccacgaccccaccgagaccttcctgagcgacttcctgctgacccacagagtgttcatgcccagcgcccagctgtgcgccgccctgctgcaccacttccacgtggagcccgccggcggcagcgagcaggagagaagcacctacgtgtgcaacaagagacagcagatcctgagactggtgagccagtgggtggccctgtacggcagcatgctgcacaccgaccccgtggccaccagcttcctgcagaagctgagcgacctggtgggcagagacaccagactgagcaacctgctgagagagcagtggcccgagagaagaagatgccacagactggagaacggctgcggcaacgccagcccccagatgaaggtgagcgcctggccccagttcctgagcagcgccccccccggcctgcaggccccccccagcccccccgaccccgagggcctgtgcggcagaggcaagctgagcagccacagacacaccctgggcagcctgatcggcgtgcacggcgccctggccgcctgcggcgccctgggccaggccgtgcccggcggcgccgaggcctag

SEQ ID NO: 21409 - DNA, 2607 bp, Artificial Sequence
  Description of Artificial Sequence: Synthetic coding sequence
atggcccagagagaggagatcaagagacccctgtgggagaccgtgggctggcccggcgagagctgctggcaggtgggcctggccgtggaggacagccccgccctgggcgcccccagagtgggcgccctgcccgacgtggtgcccgagggcaccctgctgaacatggtgctgagaagaatgcacagacccagaagctgcagctaccagctgctgctggagcaccagagacccagctgcatccagggcctgagatggacccccctgaccaacagcgaggagagcctggacttcagcgagagcctggagcaggccagcaccgagagagtgctgagagccggcagacagctgcacagacacctgctggccacctgccccaacctgatcagagacagaaagtaccacctgagactgtacagacagtgctgcagcggcagagagctggtggacggcatcctggccctgggcctgggcgtgcacagcagaagccaggtggtgggcatctgccaggtgctgctggacgagggcgccctgtgccacgtgaagcacgactgggccttccaggacagagacgcccagttctacagattccccggccccgagcccgagcccgtgagaacccacgagatggaggaggagctggccgaggccgtggccctgctgagccagagaggccccgacgccctgctgaccgtggccctgagaaagccccccggccagagaaccgacgaggagctggacctgatcttcgaggagctgctgcacatcaaggccgtggcccacctgagcaacagcgtgaagagagagctggccgccgtgctgctgttcgagccccacagcaaggccggcaccgtgctgttcagccagggcgacaagggcaccagctggtacatcatctggaagggcagcgtgaacgtggtgacccacggcaagggcctggtgaccaccctgcacgagggcgacgacttcggccagctggccctggtgaacgacgcccccagagccgccaccatcatcctgagagaggacaactgccacttcctgagagtggacaagcaggacttcaacagaatcatcaaggacgtggaggccaagaccatgagactggaggagcacggcaaggtggtgctggtgctggagagagccagccagggcgccggccccagcagaccccccacccccggcagaaacagatacaccgtgatgagcggcacccccgagaagatcctggagctgctgctggaggccatgggccccgacagcagcgcccacgaccccaccgagaccttcctgagcgacttcctgctgacccacagagtgttcatgcccagcgcccagctgtgcgccgccctgctgcaccacttccacgtggagcccgccggcggcagcgagcaggagagaagcacctacgtgtgcaacaagagacagcagatcctgagactggtgagccagtgggtggccctgtacggcagcatgctgcacaccgaccccgtggccaccagcttcctgcagaagctgagcgacctggtgggcagagacaccagactgagcaacctgctgagagagcagtggcccgagagaagaagatgccacagactggagaacggctgcggcaacgccagcccccagatgaaggccagaaacctgcccgtgtggctgcccaaccaggacgagcccctgcccggcagcagctgcgccatccaggtgggcgacaaggacgccatcggcctgcagcccgacgccagaggcgtggccaccagcctgggcctgaacgagagactgttcgtggtgaacccccaggaggtgcacgagctgatcccccaccccgaccagctgggccccaccgtgggcagcgccgagggcctggacctggtgagcgccaaggacctggccggccagctgaccgaccacgactggagcctgttcaacagcatccaccaggtggagctgatccactacgtgctgggcccccagcacctgagagacgtgaccaccgccaacctggagagattcatgagaagattcaacgagctgcagtactgggtggccaccgagctgtgcctgtgccccgtgcccggccccagagcccagctgctgagaaagttcatcaagctggccgcccacaacagcgccatcagcagactggcccacacctgggagagactgccccacaaggtgagaaagctgtacagcgccctggagagactgctggaccccagctggaaccacagagtgtacagactggccctggccaagctgagcccccccgtgatccccttcatgcccctgctgctgaaggacatgaccttcatccacgagggcaaccacaccctggtggagaacctgatcaacttcgagaagatgagaatgatggccagagccgccagaatgctgcaccactgcagaagccacaaccccgtgcccctgagccccctgagaagcagagtgagccacctgcacgaggacagccaggtggccagaatcagcacctgcagcgagcagagcctgagcaccagaagccccgccagcacctgggcctacgtgcagcagctgaaggtgatcgacaaccagagagagctgagcagactgagcagagagctggagccctag

SEQ ID NO: 21410 - DNA, 2646 bp, Artificial Sequence; identical to SEQ ID NO: 21405
  Description of Artificial Sequence: Synthetic coding sequence

SEQ ID NO: 21411 - DNA, 2772 bp, Artificial Sequence; identical to SEQ ID NO: 21407
  Description of Artificial Sequence: Synthetic coding sequence

SEQ ID NO: 21412 - DNA, 672 bp, Artificial Sequence
  Description of Artificial Sequence: Synthetic coding sequence
atggtgctgagaagaatgcacagacccagaagctgcagctaccagctgctgctggagcaccagagacccagctgcatccagggcctgagatggacccccctgaccaacagcgaggagagcctggacttcagcgagagcctggagcaggccagcaccgagagagtgctgagagccggcagacagctgcacagacacctgctggccacctgccccaacctgatcagagacagaaagtaccacctgagactgtacagacagtgctgcagcggcagagagctggtggacggcatcctggccctgggcctgggcgtgcacagcagaagccaggtggtgggcatctgccaggtgctgctggacgagggcgccctgtgccacgtgaagcacgactgggccttccaggacagagacgcccagttctacagattccccggccccgagcccgagcccgtgagaacccacgagatggaggaggagctggccgaggccgtggccctgctgagccagagaggccccgacgccctgctgaccgtggccctgagaaagccccccggccagagaaccgacgaggagctggacctgatcttcgaggagctgctgcacatcaaggccgtggcccacctgagcaacagcgtgaagagagagctggccgccgtgctgctgttcgagccctag

SEQ ID NO: 21413 - DNA, 426 bp, Artificial Sequence
  Description of Artificial Sequence: Synthetic coding sequence
atggtgctgagaagaatgcacagacccagaagctgcagctaccagctgctgctggagcaccagagacccagctgcatccagggcctgagatggacccccctgaccaacagcgaggagagcctggacttcagcgagagcctggagcaggccagcaccgagagagtgctgagagccggcagacagctgcacagacacctgctggccacctgccccaacctgatcagagacagaaagtaccacctgagactgtacagacagtgctgcagcggcagagagctggtggacggcatcctggccctgggcctgggcgtgcacagcagaagccaggtggtgggcatctgccaggtgctgctggacgagggcgccctgtgccacgtgaagcacgactgggccttccaggacagagacgcccagttctacagatag

SEQ ID NO: 21414 - DNA, 1713 bp, Artificial Sequence
  Description of Artificial Sequence: Synthetic coding sequence
atgagactggaggagcacggcaaggtggtgctggtgctggagagagccagccagggcgccggccccagcagaccccccacccccggcagaaacagatacaccgtgatgagcggcacccccgagaagatcctggagctgctgctggaggccatgggccccgacagcagcgcccacgaccccaccgagaccttcctgagcgacttcctgctgacccacagagtgttcatgcccagcgcccagctgtgcgccgccctgctgcaccacttccacgtggagcccgccggcggcagcgagcaggagagaagcacctacgtgtgcaacaagagacagcagatcctgagactggtgagccagtgggtggccctgtacggcagcatgctgcacaccgaccccgtggccaccagcttcctgcagaagctgagcgacctggtgggcagagacaccagactgagcaacctgctgagagagcagtggcccgagagaagaagatgccacagactggagaacggctgcggcaacgccagcccccagatgaaggccagaaacctgcccgtgtggctgcccaaccaggacgagcccctgcccggcagcagctgcgccatccaggtgggcgacaaggtgccctacgacatctgcagacccgaccacagcgtgctgaccctgcagctgcccgtgaccgccagcgtgagagaggtgatggccgccctggcccaggaggacggctggaccaagggccaggtgctggtgaaggtgaacagcgccggcgacgccatcggcctgcagcccgacgccagaggcgtggccaccagcctgggcctgaacgagagactgttcgtggtgaacccccaggaggtgcacgagctgatcccccaccccgaccagctgggccccaccgtgggcagcgccgagggcctggacctggtgagcgccaaggacctggccggccagctgaccgaccacgactggagcctgttcaacagcatccaccaggtggagctgatccactacgtgctgggcccccagcacctgagagacgtgaccaccgccaacctggagagattcatgagaagattcaacgagctgcagtactgggtggccaccgagctgtgcctgtgccccgtgcccggccccagagcccagctgctgagaaagttcatcaagctggccgcccacctgaaggagcagaagaacctgaacagcttcttcgccgtgatgttcggcctgagcaacagcgccatcagcagactggcccacacctgggagagactgccccacaaggtgagaaagctgtacagcgccctggagagactgctggaccccagctggaaccacagagtgtacagactggccctggccaagctgagcccccccgtgatccccttcatgcccctgctgctgaaggacatgaccttcatccacgagggcaaccacaccctggtggagaacctgatcaacttcgagaagatgagaatgatggccagagccgccagaatgctgcaccactgcagaagccacaaccccgtgcccctgagccccctgagaagcagagtgagccacctgcacgaggacagccaggtggccagaatcagcacctgcagcgagcagagcctgagcaccagaagccccgccagcacctgggcctacgtgcagcagctgaaggtgatcgacaaccagagagagctgagcagactgagcagagagctggagccctag

SEQ ID NO: 21415 - DNA, 2646 bp, Artificial Sequence; identical to SEQ ID NO: 21405
  Description of Artificial Sequence: Synthetic coding sequence

SEQ ID NO: 21416 - DNA, 3033 bp, Artificial Sequence
  Description of Artificial Sequence: Synthetic coding sequence
atggtggccgcccacgccgcccacagcagcagcagcgccgagtggatcgcctgcctggacaagagacccctggagagaagcagcgaggacgtggacatcatcttcaccagactgaaggaggtgaaggccttcgagaagttccaccccaacctgctgcaccagatctgcctgtgcggctactacgagaacctggagaagggcatcaccctgttcagacagggcgacatcggcaccaactggtacgccgtgctggccggcagcctggacgtgaaggtgagcgagaccagcagccaccaggacgccgtgaccatctgcaccctgggcatcggcaccgccttcggcgagagcatcctggacaacacccccagacacgccaccatcgtgaccagagagagcagcgagctgctgagaatcgagcagaaggacttcaaggccctgtgggagaagtacagacagtacatggccggcctgctggcccccccctacggcgtgatggagaccggcagcaacaacgacaacatcttcaaggagatgacccccctgatcgagccccacgtgcccctgagacccgccaacaccatcaccaaggtgcccagcgagaagatcctgagagccggcaagatcctgagaaacgccatcctgagcagagccccccacatgatcagagacagaaagtaccacctgaagacctacagacagtgctgcgtgggcaccgagctggtggactggatgatgcagcagaccccctgcgtgcacagcagaacccaggccgtgggcatgtggcaggtgctgctggaggacggcgtgctgaaccacgtggaccaggagcaccacttccaggacaagtacctgttctacagattcctggacgacgagcacgaggacgcccccctgcccaccgaggaggagaagaaggagtgcgacgaggagctgcaggacaccatgctgctgctgagccagatgggccccgacgcccacatgagaatgatcctgagaaagccccccggccagagaaccgtggacgacctggagatcatctacgaggagctgctgcacatcaaggccctgagccacctgagcaccaccgtgaagagagagctggccggcgtgctgatcttcgagagccacgccaagggcggcaccgtgctgttcaaccagggcgaggagggcaccagctggtacatcatcctgaagggcagcgtgaacgtggtgatctacggcaagggcgtggtgtgcaccctgcacgagggcgacgacttcggcaagctggccctggtgaacgacgcccccagagccgccagcatcgtgctgagagaggacaactgccacttcctgagagtggacaaggaggacttcaacagaatcctgagagacgtggaggccaacaccgtgagactgaaggagcacgaccaggacgtgctggtgctggagaaggtgcccgccggcaacagagccagcaaccagggcaacagccagccccagcagaagtacaccgtgatgagcggcacccccgagaagatcctggagcacttcctggagaccatcagactggaggccaccctgaacgaggccaccgacagcgtgctgaacgacttcatcatgatgcactgcgtgttcatgcccaacacccagctgtgccccgccctggtggcccactaccacgcccagcccagccagggcaccgagcaggagaagatggactacgccctgaacaacaagagaagagtgatcagactggtgctgcagtgggccgccatgtacggcgacctgctgcaggaggacgacgtgagcatggccttcctggaggagttctacgtgagcgtgagcgacgacgccagaatgatcgccgccctgaaggagcagctgcccgagctggagaagatcgtgaagcagatcagcgaggacgccaaggccccccagaagaagcacaaggtgctgctgcagcagttcaacaccggcgacgagagagcccagaagagacagcccatcagaggcagcgacgaggtgctgttcaaggtgtactgcatggaccacacctacaccaccatcagagtgcccgtggccaccagcgtgaaggaggtgatcagcgccgtggccgacaagctgggcagcggcgagggcctgatcatcgtgaagatgagcagcggcggcgagaaggtggtgctgaagcccaacgacgtgagcgtgttcaccaccctgaccatcaacggcagactgttcgcctgccccagagagcagttcgacagcctgacccccctgcccgagcaggagggccccaccgtgggcaccgtgggcaccttcgagctgatgagcagcaaggacctggcctaccagatgaccatctacgactgggagctgttcaactgcgtgcacgagctggagctgatctaccacaccttcggcagacacaacttcaagaagaccaccgccaacctggacctgttcctgagaagattcaacgagatccagttctgggtggtgaccgagatctgcctgtgcagccagctgagcaagagagtgcagctgctgaagaagttcatcaagatcgccgcccactgcaaggagtacaagaacctgaacagcttcttcgccatcgtgatgggcctgagcaacgtggccgtgagcagactggccctgacctgggagaagctgcccagcaagttcaagaagttctacgccgagttcgagagcctgatggaccccagcagaaaccacagagcctacagactgaccgtggccaagctggagccccccctgatccccttcatgcccctgctgatcaaggacatgaccttcacccacgagggcaacaagaccttcatcgacaacctggtgaacttcgagaagatgagaatgatcgccaacaccgccagaaccgtgagatactacagaagccagcccttcaaccccgacgccgcccaggccaacaagaaccaccaggacgtgagaagctacgtgagacagctgaacgtgatcgacaaccagagaaccctgagccagatgagccacagactggagcccagaagaccctag

SEQ ID NO: 21417 - DNA, 3036 bp, Artificial Sequence
  Description of Artificial Sequence: Synthetic coding sequence
atggtggccgcccacgccgcccacagcagcagcagcgccgagtggatcgcctgcctggacaagagacccctggagagaagcagcgaggacgtggacatcatcttcaccagactgaaggaggtgaaggccttcgagaagttccaccccaacctgctgcaccagatctgcctgtgcggctactacgagaacctggagaagggcatcaccctgttcagacagggcgacatcggcaccaactggtacgccgtgctggccggcagcctggacgtgaaggtgagcgagaccagcagccaccaggacgccgtgaccatctgcaccctgggcatcggcaccgccttcggcgagagcatcctggacaacacccccagacacgccaccatcgtgaccagagagagcagcgagctgctgagaatcgagcagaaggacttcaaggccctgtgggagaagtacagacagtacatggccggcctgctggcccccccctacggcgtgatggagaccggcagcaacaacgacagaatccccgacaaggagaacacccccctgatcgagccccacgtgcccctgagacccgccaacaccatcaccaaggtgcccagcgagaagatcctgagagccggcaagatcctgagaaacgccatcctgagcagagccccccacatgatcagagacagaaagtaccacctgaagacctacagacagtgctgcgtgggcaccgagctggtggactggatgatgcagcagaccccctgcgtgcacagcagaacccaggccgtgggcatgtggcaggtgctgctggaggacggcgtgctgaaccacgtggaccaggagcaccacttccaggacaagtacctgttctacagattcctggacgacgagcacgaggacgcccccctgcccaccgaggaggagaagaaggagtgcgacgaggagctgcaggacaccatgctgctgctgagccagatgggccccgacgcccacatgagaatgatcctgagaaagccccccggccagagaaccgtggacgacctggagatcatctacgaggagctgctgcacatcaaggccctgagccacctgagcaccaccgtgaagagagagctggccggcgtgctgatcttcgagagccacgccaagggcggcaccgtgctgttcaaccagggcgaggagggcaccagctggtacatcatcctgaagggcagcgtgaacgtggtgatctacggcaagggcgtggtgtgcaccctgcacgagggcgacgacttcggcaagctggccctggtgaacgacgcccccagagccgccagcatcgtgctgagagaggacaactgccacttcctgagagtggacaaggaggacttcaacagaatcctgagagacgtggaggccaacaccgtgagactgaaggagcacgaccaggacgtgctggtgctggagaaggtgcccgccggcaacagagccagcaaccagggcaacagccagccccagcagaagtacaccgtgatgagcggcacccccgagaagatcctggagcacttcctggagaccatcagactggaggccaccctgaacgaggccaccgacagcgtgctgaacgacttcatcatgatgcactgcgtgttcatgcccaacacccagctgtgccccgccctggtggcccactaccacgcccagcccagccagggcaccgagcaggagaagatggactacgccctgaacaacaagagaagagtgatcagactggtgctgcagtgggccgccatgtacggcgacctgctgcaggaggacgacgtgagcatggccttcctggaggagttctacgtgagcgtgagcgacgacgccagaatgatcgccgccctgaaggagcagctgcccgagctggagaagatcgtgaagcagatcagcgaggacgccaaggccccccagaagaagcacaaggtgctgctgcagcagttcaacaccggcgacgagagagcccagaagagacagcccatcagaggcagcgacgaggtgctgttcaaggtgtactgcatggaccacacctacaccaccatcagagtgcccgtggccaccagcgtgaaggaggtgatcagcgccgtggccgacaagctgggcagcggcgagggcctgatcatcgtgaagatgagcagcggcggcgagaaggtggtgctgaagcccaacgacgtgagcgtgttcaccaccctgaccatcaacggcagactgttcgcctgccccagagagcagttcgacagcctgacccccctgcccgagcaggagggccccaccgtgggcaccgtgggcaccttcgagctgatgagcagcaaggacctggcctaccagatgaccatctacgactgggagctgttcaactgcgtgcacgagctggagctgatctaccacaccttcggcagacacaacttcaagaagaccaccgccaacctggacctgttcctgagaagattcaacgagatccagttctgggtggtgaccgagatctgcctgtgcagccagctgagcaagagagtgcagctgctgaagaagttcatcaagatcgccgcccactgcaaggagtacaagaacctgaacagcttcttcgccatcgtgatgggcctgagcaacgtggccgtgagcagactggccctgacctgggagaagctgcccagcaagttcaagaagttctacgccgagttcgagagcctgatggaccccagcagaaaccacagagcctacagactgaccgtggccaagctggagccccccctgatccccttcatgcccctgctgatcaaggacatgaccttcacccacgagggcaacaagaccttcatcgacaacctggtgaacttcgagaagatgagaatgatcgccaacaccgccagaaccgtgagatactacagaagccagcccttcaaccccgacgccgcccaggccaacaagaaccaccaggacgtgagaagctacgtgagacagctgaacgtgatcgacaaccagagaaccctgagccagatgagccacagactggagcccagaagaccctag

SEQ ID NO: 21418 - DNA, 2604 bp, Artificial Sequence
  Description of Artificial Sequence: Synthetic coding sequence
atgctgtacaagaagtacagacagtacatggccggcctgctggcccccccctacggcgtgatggagaccggcagcaacaacgacagaatccccgacaaggagaacacccccctgatcgagccccacgtgcccctgagacccgccaacaccatcaccaaggtgcccagcgagaagatcctgagagccggcaagatcctgagaaacgccatcctgagcagagccccccacatgatcagagacagaaagtaccacctgaagacctacagacagtgctgcgtgggcaccgagctggtggactggatgatgcagcagaccccctgcgtgcacagcagaacccaggccgtgggcatgtggcaggtgctgctggaggacggcgtgctgaaccacgtggaccaggagcaccacttccaggacaagtacctgttctacagattcctggacgacgagcacgaggacgcccccctgcccaccgaggaggagaagaaggagtgcgacgaggagctgcaggacaccatgctgctgctgagccagatgggccccgacgcccacatgagaatgatcctgagaaagccccccggccagagaaccgtggacgacctggagatcatctacgaggagctgctgcacatcaaggccctgagccacctgagcaccaccgtgaagagagagctggccggcgtgctgatcttcgagagccacgccaagggcggcaccgtgctgttcaaccagggcgaggagggcaccagctggtacatcatcctgaagggcagcgtgaacgtggtgatctacggcaagggcgtggtgtgcaccctgcacgagggcgacgacttcggcaagctggccctggtgaacgacgcccccagagccgccagcatcgtgctgagagaggacaactgccacttcctgagagtggacaaggaggacttcaacagaatcctgagagacgtggaggccaacaccgtgagactgaaggagcacgaccaggacgtgctggtgctggagaaggtgcccgccggcaacagagccagcaaccagggcaacagccagccccagcagaagtacaccgtgatgagcggcacccccgagaagatcctggagcacttcctggagaccatcagactggaggccaccctgaacgaggccaccgacagcgtgctgaacgacttcatcatgatgcactgcgtgttcatgcccaacacccagctgtgccccgccctggtggcccactaccacgcccagcccagccagggcaccgagcaggagaagatggactacgccctgaacaacaagagaagagtgatcagactggtgctgcagtgggccgccatgtacggcgacctgctgcaggaggacgacgtgagcatggccttcctggaggagttctacgtgagcgtgagcgacgacgccagaatgatcgccgccctgaaggagcagctgcccgagctggagaagatcgtgaagcagatcagcgaggacgccaaggccccccagaagaagcacaaggtgctgctgcagcagttcaacaccggcgacgagagagcccagaagagacagcccatcagaggcagcgacgaggtgctgttcaaggtgtactgcatggaccacacctacaccaccatcagagtgcccgtggccaccagcgtgaaggaggtgatcagcgccgtggccgacaagctgggcagcggcgagggcctgatcatcgtgaagatgagcagcggcggcgagaaggtggtgctgaagcccaacgacgtgagcgtgttcaccaccctgaccatcaacggcagactgttcgcctgccccagagagcagttcgacagcctgacccccctgcccgagcaggagggccccaccgtgggcaccgtgggcaccttcgagctgatgagcagcaaggacctggcctaccagatgaccatctacgactgggagctgttcaactgcgtgcacgagctggagctgatctaccacaccttcggcagacacaacttcaagaagaccaccgccaacctggacctgttcctgagaagattcaacgagatccagttctgggtggtgaccgagatctgcctgtgcagccagctgagcaagagagtgcagctgctgaagaagttcatcaagatcgccgcccactgcaaggagtacaagaacctgaacagcttcttcgccatcgtgatgggcctgagcaacgtggccgtgagcagactggccctgacctgggagaagctgcccagcaagttcaagaagttctacgccgagttcgagagcctgatggaccccagcagaaaccacagagcctacagactgaccgtggccaagctggagccccccctgatccccttcatgcccctgctgatcaaggacatgaccttcacccacgagggcaacaagaccttcatcgacaacctggtgaacttcgagaagatgagaatgatcgccaacaccgccagaaccgtgagatactacagaagccagcccttcaaccccgacgccgcccaggccaacaagaaccaccaggacgtgagaagctacgtgagacagctgaacgtgatcgacaaccagagaaccctgagccagatgagccacagactggagcccagaagaccctag

SEQ ID NO: 21419 - DNA, 2832 bp, Artificial Sequence
  Description of Artificial Sequence: Synthetic coding sequence
atggtggccgcccacgccgcccacagcagcagcagcgccgagtggatcgcctgcctggacaagagacccctggagagaagcagcgaggacgtggacatcatcttcaccagactgaaggaggtgaaggccttcgagaagttccaccccaacctgctgcaccagatctgcctgtgcggctactacgagaacctggagaagggcatcaccctgttcagacagggcgacatcggcaccaactggtacgccgtgctggccggcagcctggacgtgaaggtgagcgagaccagcagccaccaggacgccgtgaccatctgcaccctgggcatcggcaccgccttcggcgagagcatcctggacaacacccccagacacgccaccatcgtgaccagagagagcagcgagctgctgagaatcgagcagaaggacttcaaggccctgtgggagaagtacagacagtacatggccggcctgctggcccccccctacggcgtgatggagaccggcagcaacaacgacagaatccccgacaaggagaacacccccctgatcgagccccacgtgcccctgagacccgccaacaccatcaccaaggtgcccagcgagaagatcctgagagccggcaagatcctgagaaacgccatcctgagcagagccccccacatgatcagagacagaaagtaccacctgaagacctacagacagtgctgcgtgggcaccgagctggtggactggatgatgcagcagaccccctgcgtgcacagcagaacccaggccgtgggcatgtggcaggtgctgctggaggacggcgtgctgaaccacgtggaccaggagcaccacttccaggacaagtacctgttctacagattcctggacgacgagcacgaggacgcccccctgcccaccgaggaggagaagaaggagtgcgacgaggagctgcaggacaccatgctgctgctgagccagatgggccccgacgcccacatgagaatgatcctgagaaagccccccggccagagaaccgtggacgacctggagatcatctacgaggagctgctgcacatcaaggccctgagccacctgagcaccaccgtgaagagagagctggccggcgtgctgatcttcgagagccacgccaagggcggcaccgtgctgttcaaccagggcgaggagggcaccagctggtacatcatcctgaagggcagcgtgaacgtggtgatctacggcaagggcgtggtgtgcaccctgcacgagggcgacgacttcggcaagctggccctggtgaacgacgcccccagagccgccagcatcgtgctgagagaggacaactgccacttcctgagagtggacaaggaggacttcaacagaatcctgagagacgtggaggccaacaccgtgagactgaaggagcacgaccaggacgtgctggtgctggagaaggtgcccgccggcaacagagccagcaaccagggcaacagccagccccagcagaagtacaccgtgatgagcggcacccccgagaagatcctggagcacttcctggagaccatcagactggaggccaccctgaacgaggccaccgacagcgtgctgaacgacttcatcatgatgcactgcgtgttcatgcccaacacccagctgtgccccgccctggtggcccactaccacgcccagcccagccagggcaccgagcaggagaagatggactacgccctgaacaacaagagaagagtgatcagactggtgctgcagtgggccgccatgtacggcgacctgctgcaggaggacgacgtgagcatggccttcctggaggagttctacgtgagcgtgagcgacgacgccagaatgatcgccgccctgaaggagcagctgcccgagctggagaagatcgtgaagcagatcagcgaggacgccaaggccccccagaagaagcacaaggtgctgctgcagcagttcaacaccggcgacgagagagcccagaagagacagcccatcagaggcagcgacgaggtgctgttcaaggtgtactgcatggaccacacctacaccaccatcagagtgcccgtggccaccagcgtgaaggaggtgatcagcgccgtggccgacaagctgggcagcggcgagggcctgatcatcgtgaagatgagcagcggcggcgagaaggtggtgctgaagcccaacgacgtgagcgtgttcaccaccctgaccatcaacggcagactgttcgcctgccccagagagcagttcgacagcctgacccccctgcccgagcaggagggccccaccgtgggcaccgtgggcaccttcgagctgatgagcagcaaggacctggcctaccagatgaccatctacgactgggagctgttcaactgcgtgcacgagctggagctgatctaccacaccttcggcagacacaacttcaagaagaccaccgccaacctggacctgttcctgagaagattcaacgagatccagttctgggtggtgaccgagatctgcctgtgcagccagctgagcaagagagtgcagctgctgaagaagttcatcaagatcgccgcccactgcaaggagtacaagaacctgaacagcttcttcgccatcgtgatgggcctgagcaacgtggccgtgagcagactggccctgacctgggagagaatgatcgccaacaccgccagaaccgtgagatactacagaagccagcccttcaaccccgacgccgcccaggccaacaagaaccaccaggacgtgagaagctacgtgagacagctgaacgtgatcgacaaccagagaaccctgagccagatgagccacagactggagcccagaagaccctag

SEQ ID NO: 21420 - DNA, 2376 bp, Artificial Sequence
  Description of Artificial Sequence: Synthetic coding sequence
atgatcagagacagaaagtaccacctgaagacctacagacagtgctgcgtgggcaccgagctggtggactggatgatgcagcagaccccctgcgtgcacagcagaacccaggccgtgggcatgtggcaggtgctgctggaggacggcgtgctgaaccacgtggaccaggagcaccacttccaggacaagtacctgttctacagattcctggacgacgagcacgaggacgcccccctgcccaccgaggaggagaagaaggagtgcgacgaggagctgcaggacaccatgctgctgctgagccagatgggccccgacgcccacatgagaatgatcctgagaaagccccccggccagagaaccgtggacgacctggagatcatctacgaggagctgctgcacatcaaggccctgagccacctgagcaccaccgtgaagagagagctggccggcgtgctgatcttcgagagccacgccaagggcggcaccgtgctgttcaaccagggcgaggagggcaccagctggtacatcatcctgaagggcagcgtgaacgtggtgatctacggcaagggcgtggtgtgcaccctgcacgagggcgacgacttcggcaagctggccctggtgaacgacgcccccagagccgccagcatcgtgctgagagaggacaactgccacttcctgagagtggacaaggaggacttcaacagaatcctgagagacgtggaggccaacaccgtgagactgaaggagcacgaccaggacgtgctggtgctggagaaggtgcccgccggcaacagagccagcaaccagggcaacagccagccccagcagaagtacaccgtgatgagcggcacccccgagaagatcctggagcacttcctggagaccatcagactggaggccaccctgaacgaggccaccgacagcgtgctgaacgacttcatcatgatgcactgcgtgttcatgcccaacacccagctgtgccccgccctggtggcccactaccacgcccagcccagccagggcaccgagcaggagaagatggactacgccctgaacaacaagagaagagtgatcagactggtgctgcagtgggccgccatgtacggcgacctgctgcaggaggacgacgtgagcatggccttcctggaggagttctacgtgagcgtgagcgacgacgccagaatgatcgccgccctgaaggagcagctgcccgagctggagaagatcgtgaagcagatcagcgaggacgccaaggccccccagaagaagcacaaggtgctgctgcagcagttcaacaccggcgacgagagagcccagaagagacagcccatcagaggcagcgacgaggtgctgttcaaggtgtactgcatggaccacacctacaccaccatcagagtgcccgtggccaccagcgtgaaggaggtgatcagcgccgtggccgacaagctgggcagcggcgagggcctgatcatcgtgaagatgagcagcggcggcgagaaggtggtgctgaagcccaacgacgtgagcgtgttcaccaccctgaccatcaacggcagactgttcgcctgccccagagagcagttcgacagcctgacccccctgcccgagcaggagggccccaccgtgggcaccgtgggcaccttcgagctgatgagcagcaaggacctggcctaccagatgaccatctacgactgggagctgttcaactgcgtgcacgagctggagctgatctaccacaccttcggcagacacaacttcaagaagaccaccgccaacctggacctgttcctgagaagattcaacgagatccagttctgggtggtgaccgagatctgcctgtgcagccagctgagcaagagagtgcagctgctgaagaagttcatcaagatcgccgcccactgcaaggagtacaagaacctgaacagcttcttcgccatcgtgatgggcctgagcaacgtggccgtgagcagactggccctgacctgggagaagctgcccagcaagttcaagaagttctacgccgagttcgagagcctgatggaccccagcagaaaccacagagcctacagactgaccgtggccaagctggagccccccctgatccccttcatgcccctgctgatcaaggacatgaccttcacccacgagggcaacaagaccttcatcgacaacctggtgaacttcgagaagatgagaatgatcgccaacaccgccagaaccgtgagatactacagaagccagcccttcaaccccgacgccgcccaggccaacaagaaccaccaggacgtgagaagctacgtgagacagctgaacgtgatcgacaaccagagaaccctgagccagatgagccacagactggagcccagaagaccctag

SEQ ID NO: 21421 - DNA, 2523 bp, Artificial Sequence
  Description of Artificial Sequence: Synthetic coding sequence
atggccggcctgctggcccccccctacggcgtgatggagaccggcagcaacaacgacagaatccccgacaaggagaacgtgcccagcgagaagatcctgagagccggcaagatcctgagaaacgccatcctgagcagagccccccacatgatcagagacagaaagtaccacctgaagacctacagacagtgctgcgtgggcaccgagctggtggactggatgatgcagcagaccccctgcgtgcacagcagaacccaggccgtgggcatgtggcaggtgctgctggaggacggcgtgctgaaccacgtggaccaggagcaccacttccaggacaagtacctgttctacagattcctggacgacgagcacgaggacgcccccctgcccaccgaggaggagaagaaggagtgcgacgaggagctgcaggacaccatgctgctgctgagccagatgggccccgacgcccacatgagaatgatcctgagaaagccccccggccagagaaccgtggacgacctggagatcatctacgaggagctgctgcacatcaaggccctgagccacctgagcaccaccgtgaagagagagctggccggcgtgctgatcttcgagagccacgccaagggcggcaccgtgctgttcaaccagggcgaggagggcaccagctggtacatcatcctgaagggcagcgtgaacgtggtgatctacggcaagggcgtggtgtgcaccctgcacgagggcgacgacttcggcaagctggccctggtgaacgacgcccccagagccgccagcatcgtgctgagagaggacaactgccacttcctgagagtggacaaggaggacttcaacagaatcctgagagacgtggaggccaacaccgtgagactgaaggagcacgaccaggacgtgctggtgctggagaaggtgcccgccggcaacagagccagcaaccagggcaacagccagccccagcagaagtacaccgtgatgagcggcacccccgagaagatcctggagcacttcctggagaccatcagactggaggccaccctgaacgaggccaccgacagcgtgctgaacgacttcatcatgatgcactgcgtgttcatgcccaacacccagctgtgccccgccctggtggcccactaccacgcccagcccagccagggcaccgagcaggagaagatggactacgccctgaacaacaagagaagagtgatcagactggtgctgcagtgggccgccatgtacggcgacctgctgcaggaggacgacgtgagcatggccttcctggaggagttctacgtgagcgtgagcgacgacgccagaatgatcgccgccctgaaggagcagctgcccgagctggagaagatcgtgaagcagatcagcgaggacgccaaggccccccagaagaagcacaaggtgctgctgcagcagttcaacaccggcgacgagagagcccagaagagacagcccatcagaggcagcgacgaggtgctgttcaaggtgtactgcatggaccacacctacaccaccatcagagtgcccgtggccaccagcgtgaaggaggtgatcagcgccgtggccgacaagctgggcagcggcgagggcctgatcatcgtgaagatgagcagcggcggcgagaaggtggtgctgaagcccaacgacgtgagcgtgttcaccaccctgaccatcaacggcagactgttcgcctgccccagagagcagttcgacagcctgacccccctgcccgagcaggagggccccaccgtgggcaccgtgggcaccttcgagctgatgagcagcaaggacctggcctaccagatgaccatctacgactgggagctgttcaactgcgtgcacgagctggagctgatctaccacaccttcggcagacacaacttcaagaagaccaccgccaacctggacctgttcctgagaagattcaacgagatccagttctgggtggtgaccgagatctgcctgtgcagccagctgagcaagagagtgcagctgctgaagaagttcatcaagatcgccgcccactgcaaggagtacaagaacctgaacagcttcttcgccatcgtgatgggcctgagcaacgtggccgtgagcagactggccctgacctgggagaagctgcccagcaagttcaagaagttctacgccgagttcgagagcctgatggaccccagcagaaaccacagagcctacagactgaccgtggccaagctggagccccccctgatccccttcatgcccctgctgatcaaggacatgaccttcacccacgagggcaacaagaccttcatcgacaacctggtgaacttcgagaagatgagaatgatcgccaacaccgccagaaccgtgagatactacagaagccagcccttcaaccccgacgccgcccaggccaacaagaaccaccaggacgtgagaagctacgtgagacagctgaacgtgatcgacaaccagagaaccctgagccagatgagccacagactggagcccagaagaccctag

SEQ ID NO: 21422 - DNA, 2577 bp, Artificial Sequence
  Description of Artificial Sequence: Synthetic coding sequence
atggccggcctgctggcccccccctacggcgtgatggagaccggcagcaacaacgacagaatccccgacaaggagaacacccccctgatcgagccccacgtgcccctgagacccgccaacaccatcaccaaggtgcccagcgagaagatcctgagagccggcaagatcctgagaaacgccatcctgagcagagccccccacatgatcagagacagaaagtaccacctgaagacctacagacagtgctgcgtgggcaccgagctggtggactggatgatgcagcagaccccctgcgtgcacagcagaacccaggccgtgggcatgtggcaggtgctgctggaggacggcgtgctgaaccacgtggaccaggagcaccacttccaggacaagtacctgttctacagattcctggacgacgagcacgaggacgcccccctgcccaccgaggaggagaagaaggagtgcgacgaggagctgcaggacaccatgctgctgctgagccagatgggccccgacgcccacatgagaatgatcctgagaaagccccccggccagagaaccgtggacgacctggagatcatctacgaggagctgctgcacatcaaggccctgagccacctgagcaccaccgtgaagagagagctggccggcgtgctgatcttcgagagccacgccaagggcggcaccgtgctgttcaaccagggcgaggagggcaccagctggtacatcatcctgaagggcagcgtgaacgtggtgatctacggcaagggcgtggtgtgcaccctgcacgagggcgacgacttcggcaagctggccctggtgaacgacgcccccagagccgccagcatcgtgctgagagaggacaactgccacttcctgagagtggacaaggaggacttcaacagaatcctgagagacgtggaggccaacaccgtgagactgaaggagcacgaccaggacgtgctggtgctggagaaggtgcccgccggcaacagagccagcaaccagggcaacagccagccccagcagaagtacaccgtgatgagcggcacccccgagaagatcctggagcacttcctggagaccatcagactggaggccaccctgaacgaggccaccgacagcgtgctgaacgacttcatcatgatgcactgcgtgttcatgcccaacacccagctgtgccccgccctggtggcccactaccacgcccagcccagccagggcaccgagcaggagaagatggactacgccctgaacaacaagagaagagtgatcagactggtgctgcagtgggccgccatgtacggcgacctgctgcaggaggacgacgtgagcatggccttcctggaggagttctacgtgagcgtgagcgacgacgccagaatgatcgccgccctgaaggagcagctgcccgagctggagaagatcgtgaagcagatcagcgaggacgccaaggccccccagaagaagcacaaggtgctgctgcagcagttcaacaccggcgacgagagagcccagaagagacagcccatcagaggcagcgacgaggtgctgttcaaggtgtactgcatggaccacacctacaccaccatcagagtgcccgtggccaccagcgtgaaggaggtgatcagcgccgtggccgacaagctgggcagcggcgagggcctgatcatcgtgaagatgagcagcggcggcgagaaggtggtgctgaagcccaacgacgtgagcgtgttcaccaccctgaccatcaacggcagactgttcgcctgccccagagagcagttcgacagcctgacccccctgcccgagcaggagggccccaccgtgggcaccgtgggcaccttcgagctgatgagcagcaaggacctggcctaccagatgaccatctacgactgggagctgttcaactgcgtgcacgagctggagctgatctaccacaccttcggcagacacaacttcaagaagaccaccgccaacctggacctgttcctgagaagattcaacgagatccagttctgggtggtgaccgagatctgcctgtgcagccagctgagcaagagagtgcagctgctgaagaagttcatcaagatcgccgcccactgcaaggagtacaagaacctgaacagcttcttcgccatcgtgatgggcctgagcaacgtggccgtgagcagactggccctgacctgggagaagctgcccagcaagttcaagaagttctacgccgagttcgagagcctgatggaccccagcagaaaccacagagcctacagactgaccgtggccaagctggagccccccctgatccccttcatgcccctgctgatcaaggacatgaccttcacccacgagggcaacaagaccttcatcgacaacctggtgaacttcgagaagatgagaatgatcgccaacaccgccagaaccgtgagatactacagaagccagcccttcaaccccgacgccgcccaggccaacaagaaccaccaggacgtgagaagctacgtgagacagctgaacgtgatcgacaaccagagaaccctgagccagatgagccacagactggagcccagaagaccctag

SEQ ID NO: 21423 - DNA, 1200 bp, Artificial Sequence
  Description of Artificial Sequence: Synthetic coding sequence
atgttcgtgttcgtgctgacccccctgatcgagccccacgtgcccctgagacccgccaacaccatcaccaaggtgcccagcgagaagatcctgagagccggcaagatcctgagaaacgccatcctgagcagagccccccacatgatcagagacagaaagtaccacctgaagacctacagacagtgctgcgtgggcaccgagctggtggactggatgatgcagcagaccccctgcgtgcacagcagaacccaggccgtgggcatgtggcaggtgctgctggaggacggcgtgctgaaccacgtggaccaggagcaccacttccaggacaagtacctgttctacagattcctggacgacgagcacgaggacgcccccctgcccaccgaggaggagaagaaggagtgcgacgaggagctgcaggacaccatgctgctgctgagccagatgggccccgacgcccacatgagaatgatcctgagaaagccccccggccagagaaccgtggacgacctggagatcatctacgaggagctgctgcacatcaaggccctgagccacctgagcaccaccgtgaagagagagctggccggcgtgctgatcttcgagagccacgccaagggcggcaccgtgctgttcaaccagggcgaggagggcaccagctggtacatcatcctgaagggcagcgtgaacgtggtgatctacggcaagggcgtggtgtgcaccctgcacgagggcgacgacttcggcaagctggccctggtgaacgacgcccccagagccgccagcatcgtgctgagagaggacaactgccacttcctgagagtggacaaggaggacttcaacagaatcctgagagacgtggaggccaacaccgtgagactgaaggagcacgaccaggacgtgctggtgctggagaaggtgcccgccggcaacagagccagcaaccagggcaacagccagccccagcagaagtacaccgtgatgagcggcacccccgagaagatcctggagcacttcctggagaccatcagactggaggccaccctgaacgaggccaccgacagcgtgctgaacgacttcatcatgatgcactgcgtgttcatgcccaacacccagctgtgccccgccctggtggcccactaccacgcccagcccagcagatacagaaccggcgagaacggcctgtgcccccagcagtag

SEQ ID NO: 21424 - DNA, 2577 bp, Artificial Sequence; identical to SEQ ID NO: 21422
  Description of Artificial Sequence: Synthetic coding sequence

SEQ ID NO: 21425 - DNA, 552 bp, Artificial Sequence
  Description of Artificial Sequence: Synthetic coding sequence
atgagagagtacaaggtggtggtgctgggcagcggcggcgtgggcaagagcgccctgaccgtgcagttcgtgaccggcagcttcatcgagaagtacgaccccaccatcgaggacttctacagaaaggagatcgaggtggacagcagccccagcgtgctggagatcctggacaccgccggcaccgagcagttcgccagcatgagagacctgtacatcaagaacggccagggcttcatcctggtgtacagcctggtgaaccagcagagcttccaggacatcaagcccatgagagaccagatcatcagagtgaagagatacgagagagtgcccatgatcctggtgggcaacaaggtggacctggagggcgagagagaggtgagctacggcgagggcaaggccctggccgaggagtggagctgccccttcatggagaccagcgccaagaacaaggccagcgtggacgagctgttcgccgagatcgtgagacagatgaactacgccgcccagcccaacggcgacgagggctgctgcagcgcctgcgtgatcctgtag

SEQ ID NO: 21426 - DNA, 552 bp, Artificial Sequence
  Description of Artificial Sequence: Synthetic coding sequence
atgagagagtacaaggtggtggtgctgggcagcggcggcgtgggcaagagcgccctgaccgtgcagttcgtgaccggcaccttcatcgagaagtacgaccccaccatcgaggacttctacagaaaggagatcgaggtggacagcagccccagcgtgctggagatcctggacaccgccggcaccgagcagttcgccagcatgagagacctgtacatcaagaacggccagggcttcatcctggtgtacagcctggtgaaccagcagagcttccaggacatcaagcccatgagagaccagatcgtgagagtgaagagatacgagaaggtgcccctgatcctggtgggcaacaaggtggacctggagcccgagagagaggtgatgagcagcgagggcagagccctggcccaggagtggggctgccccttcatggagaccagcgccaagagcaagagcatggtggacgagctgttcgccgagatcgtgagacagatgaactacagcagcctgcccgagaagcaggaccagtgctgcaccacctgcgtggtgcagtag

SEQ ID NO: 21427 - DNA, 552 bp, Artificial Sequence; identical to SEQ ID NO: 21426
  Description of Artificial Sequence: Synthetic coding sequence

SEQ ID NO: 21428 - DNA, 1023 bp, Artificial Sequence
  Description of Artificial Sequence: Synthetic coding sequence
atgcacaccgacctggacaccgacatggacatggacaccgagaccaccgccctgtgccccagcggcagcagaagagccagcccccccggcacccccacccccgaggccgacgccaccctgctgaagaagagcgagaagctgctggccgagctggacagaagcggcctgcccagcgcccccggcgcccccagaagaagaggcagcatgcccgtgccctacaagcaccagctgagaagagcccaggccgtggacgagctggactggcccccccaggccagcagcagcggcagcagcgacagcctgggcagcggcgaggccgcccccgcccagaaggacggcatcttcaaggtgatgctggtgggcgagagcggcgtgggcaagagcaccctggccggcaccttcggcggcctgcagggcgacagcgcccacgagcccgagaaccccgaggacacctacgagagaagaatcatggtggacaaggaggaggtgaccctggtggtgtacgacatctgggagcagggcgacgccggcggctggctgagagaccactgcctgcagaccggcgacgccttcctgatcgtgttcagcgtgaccgacagaagaagcttcagcaaggtgcccgagaccctgctgagactgagagccggcagaccccaccacgacctgcccgtgatcctggtgggcaacaagagcgacctggccagaagcagagaggtgagcctggaggagggcagacacctggccggcaccctgagctgcaagcacatcgagaccagcgccgccctgcaccacaacaccagagagctgttcgagggcgccgtgagacagatcagactgagaagaggcagaaaccacgccggcggccagagacccgaccccggcagccccgagggccccgccccccccgccagaagagagagcctgaccaagaaggccaagagattcctggccaacctggtgcccagaaacgccaagttcttcaagcagagaagcagaagctgccacgacctgagcgtgctgtag

SEQ ID NO: 21429 - DNA, 666 bp, Artificial Sequence
  Description of Artificial Sequence: Synthetic coding sequence
atgcacaccgacctggacaccgacatggacatggacaccgagaccaccgccctgtgccccagcggcagcagaagagccagcccccccggcacccccacccccgaggccgacgccaccctgctgaagaagagcgagaagctgctggccgagctggacagaagcggcctgcccagcgcccccggcgcccccagaagaagaggcagcatgcccgtgccctacaagcaccagctgagaagagcccaggccgtggacgagctggactggcccccccaggccagcagcagcggcagcagcgacagcctgggcagcggcgaggccgcccccgcccagaaggacggcatcttcaaggtgatgctggtgggcgagagcggcgtgggcaagagcaccctggccggcaccttcggcggcctgcagggcgacagcgcccacgagcccgagaaccccggcggctgcagaagagtggccgccggccccctgcccagcgacagaggcagactgagccacagactgctgagccacagacccaccgagttcctgcagagcagcagagaccccaccagcgcccccggctgggaggccgcccccagacccaccagataccccagatggaagcaggagagactgggccccctgcccggcggcatcaccggcggctgcgtgagctag

SEQ ID NO: 21430 - DNA, 897 bp, Artificial Sequence
  Description of Artificial Sequence: Synthetic coding sequence
atgaccctgaacaccgagcaggaggccaagacccccctgcacagaagagccagcacccccctgcccctgagccccagaggccaccagcccggcagactgagcaccgtgcccagcacccagagccagcaccccagactgggccagagcgccagcctgaacccccccacccagaagcccagccccgcccccgacgactggagcagcgagagcagcgacagcgagggcagctgggaggccctgtacagagtggtgctgctgggcgaccccggcgtgggcaagaccagcctggccagcctgttcgccggcaagcaggagagagacctgcacgagcagctgggcgaggacgtgtacgagagaaccctgaccgtggacggcgaggacaccaccctggtggtggtggacacctgggaggccgagaagctggacaagagctggagccaggagagctgcctgcagggcggcagcgcctacgtgatcgtgtacagcatcgccgacagaggcagcttcgagagcgccagcgagctgagaatccagctgagaagaacccaccaggccgaccacgtgcccatcatcctggtgggcaacaaggccgacctggccagatgcagagaggtgagcgtggaggagggcagagcctgcgccgtggtgttcgactgcaagttcatcgagaccagcgccaccctgcagcacaacgtggccgagctgttcgagggcgtggtgagacagctgagactgagaagaagagacagcgccgccaaggagccccccgcccccagaagacccgccagcctggcccagagagccagaagattcctggccagactgaccgccagaagcgccagaagaagagccctgaaggccagaagcaagagctgccacaacctggccgtgctgtag

SEQ ID NO: 21431 - DNA, 2352 bp, Artificial Sequence
  Description of Artificial Sequence: Synthetic coding sequence
atggagagccccggcgagagcggcgccggcagccccggcgcccccagccccagcagcttcaccaccggccacctggccagagagaagcccgcccaggaccccctgtacgacgtgcccaacgccagcggcggccaggccggcggcccccagagacccggcagagtggtgagcctgagagagagactgctgctgaccagacccgtgtggctgcagctgcaggccaacgccgccgccgccctgcacatgctgagaaccgagccccccggcaccttcctggtgagaaagagcaacaccagacagtgccaggccctgtgcatgagactgcccgaggccagcggccccagcttcgtgagcagccactacatcctggagagccccggcggcgtgagcctggagggcagcgagctgatgttccccgacctggtgcagctgatctgcgcctactgccacaccagagacatcctgctgctgcccctgcagctgcccagagccatccaccacgccgccacccacaaggagctggaggccatcagccacctgggcatcgagttctggagcagcagcctgaacatcaaggcccagagaggccccgccggcggccccgtgctgccccagctgaaggccagaagcccccaggagctggaccagggcaccggcgccgccctgtgcttcttcaaccccctgttccccggcgacctgggccccaccaagagagagaagttcaagagaagcttcaaggtgagagtgagcaccgagaccagcagccccctgagcccccccgccgtgccccccccccccgtgcccgtgctgcccggcgccgtgcccagccagaccgagagactgcccccctgccagctgctgagaagagagagcagcgtgggctacagagtgcccgccggcagcggccccagcctgccccccatgcccagcctgcaggaggtggactgcggcagccccagcagcagcgaggaggagggcgtgcccggcagcagaggcagccccgccaccagcccccacctgggcagaagaagacccctgctgagaagcatgagcgccgccttctgcagcctgctggcccccgagagacaggtgggcagagccgccgccgccctgatgcaggacagacacaccgccgccggccagctggtgcaggacctgctgacccaggtgagagccggccccgagccccaggagctgcagggcatcagacaggccctgagcagagccagagccatgctgagcgccgagctgggccccgagaagctgctgagccccaagagactggagcacgtgctggagaagagcctgcactgcagcgtgctgaagcccctgagacccatcctggccgccagactgagaagaagactggccgccgacggcagcctgggcagactggccgagggcctgagactggccagagcccagggccccggcgccttcggcagccacctgagcctgcccagccccgtggagctggagcaggtgagacagaagctgctgcagctgctgagaacctacagccccagcgcccaggtgaagagactgctgcaggcctgcaagctgctgtacatggccctgagaacccaggagggcgagggcgccggcgccgacgagttcctgcccctgctgagcctggtgctggcccactgcgacctgcccgagctgctgctggaggccgagtacatgagcgagctgctggagcccagcctgctgaccggcgagggcggctactacctgaccagcctgagcgccagcctggccctgctgagcggcctgggccaggcccacaccctgcccctgagccccgtgcaggagctgagaagaagcctgagcctgtgggagcagagaagactgcccgccacccactgcttccagcacctgctgagagtggcctaccaggaccccagcagcggctgcaccagcaagaccctggccgtgccccccgaggccagcatcgccaccctgaaccagctgtgcgccaccaagttcagagtgacccagcccaacaccttcggcctgttcctgtacaaggagcagggctaccacagactgccccccggcgccctggcccacagactgcccaccaccggctacctggtgtacagaagagccgagtggcccgagacccagggcgccgtgaccgaggaggagggcagcggccagagcgaggccagaagcagaggcgaggagcagggctgccagggcgacggcgacgccggcgtgaaggccagccccagagacatcagagagcagagcgagaccaccgccgagggcggccagggccaggcccaggagggccccgcccagcccggcgagcccgaggccgagggcagcagagccgccgaggagtag

SEQ ID NO: 21432 - DNA, 1818 bp, Artificial Sequence
  Description of Artificial Sequence: Synthetic coding sequence
atgagactgcccgaggccagcggccccagcttcgtgagcagccactacatcctggagagccccggcggcgtgagcctggagggcagcgagctgatgttccccgacctggtgcagctgatctgcgcctactgccacaccagagacatcctgctgctgcccctgcagctgcccagagccatccaccacgccgccacccacaaggagctggaggccatcagccacctgggcatcgagttctggagcagcagcctgaacatcaaggcccagagaggccccgccggcggccccgtgctgccccagctgaaggccagaagcccccaggagctggaccagggcaccggcgccgccctgtgcttcttcaaccccctgttccccggcgacctgggccccaccaagagagagaagttcaagagaagcttcaaggtgagagtgagcaccgagaccagcagccccctgagcccccccgccgtgccccccccccccgtgcccgtgctgcccggcgccgtgcccagccagaccgagagactgcccccctgccagctgctgagaagagagagcagcgtgggctacagagtgcccgccggcagcggccccagcctgccccccatgcccagcctgcaggaggtggactgcggcagccccagcagcagcgaggaggagggcgtgcccggcagcagaggcagccccgccaccagcccccacctgggcagaagaagacccctgctgagaagcatgagcgccgccttctgcagcctgctggcccccgagagacaggtgggcagagccgccgccgccctgatgcaggacagacacaccgccgccggccagctggtgcaggacctgctgacccaggtgagagccggccccgagccccaggagctgcagggcatcagacaggccctgagcagagccagagccatgctgagcgccgagctgggccccgagaagctgctgagccccaagagactggagcacgtgctggagaagagcctgcactgcagcgtgctgaagcccctgagacccatcctggccgccagactgagaagaagactggccgccgacggcagcctgggcagactggccgagggcctgagactggccagagcccagggccccggcgccttcggcagccacctgagcctgcccagccccgtggagctggagcaggtgagacagaagctgctgcagctgctgagaacctacagccccagcgcccaggtgaagagactgctgcaggcctgcaagctgctgtacatggccctgagaacccaggagggcgagggcgccggcgccgacgagttcctgcccctgctgagcctggtgctggcccactgcgacctgcccgagctgctgctggaggccgagtacatgagcgagctgctggagcccagcctgctgaccggcgagggcggctactacctgaccagcctgagcgccagcctggccctgctgagcggcctgggccaggcccacaccctgcccctgagccccgtgcaggagctgagaagaagcctgagcctgtgggagcagagaagactgcccgccacccactgcttccagcacctgctgagagtggcctaccaggaccccagcagcggctgcaccagcaagaccctggccgtgccccccgaggccagcatcgccaccctgaaccagctgtgcgccaccaagttcagagtgacccagcccaacaccttcggcctgttcctgcagggcaaccagagacagagagaggccggccagcagagaagcagcctgaagtggcccgagggcagcttcggcgccggcgaccccgagcccgccgagaagagcttctag

SEQ ID NO: 21433 - DNA, 1935 bp, Artificial Sequence
  Description of Artificial Sequence: Synthetic coding sequence
atggagcagctgagcgacgaggagatcgaccacggcgccgaggaggacagcgacaaggaggaccaggacctggacaagatgttcggcgcctggctgggcgagctggacaagctgacccagagcctggacagcgacaagcccatggagcccgtgaagagaagccccctgagacaggagaccaacatggccaacttcagctacagattcagcatctacaacctgaacgaggccctgaaccagggcgagaccgtggacctggacgccctgatggccgacctgtgcagcatcgagcaggagctgagcagcatcggcagcggcaacagcaagagacagatcaccgagaccaaggccacccagaagctgcccgtgagcagacacaccctgaagcacggcaccctgaagggcctgagcagcagcagcaacagaatcgccaagcccagccacgccagctacagcctggacgacgtgaccgcccagctggagcaggccagcctgagcatggacgaggccgcccagcagagcgtgctggaggacaccaagcccctggtgaccaaccagcacagaagaaccgccagcgccggcaccgtgagcgacgccgaggtgcacagcatcagcaacagcagccacagcagcatcaccagcgccgccagcagcatggacagcctggacatcgacaaggtgaccagaccccaggagctggacctgacccaccagggccagcccatcaccgagcacgccatcagcctgagatgcagcagcaagcaggccaagagacacatcgacttcaccgaggagcaggccgagctgaccccccacagctacctggacagagagaccagcctgctgctgagaaacatcgccggcaagcccagccacctgctgaccaaggaggagcaggccgccaagctgaaggccgagaagatcagagtggccctggagaagatcaaggaggcccaggtgaagaagctggtgatcagagtgcacatgagcgacgacagcagcaagaccatgatggtggacgagagacagaccgtgagacaggtgctggacaacctgatggacaagagccactgcggctacagcctggactggagcctggtggagaccgtgagcgagctgcagatggagagaatcttcgaggaccacgagaacctggtggagaacctgctgaactggaccagagacagccagaacaagctgatcttcatggagagaatcgagaagtacgccctgttcaagaacccccagaactacctgctgggcaagaaggagaccgccgagatggccgacagaaacaaggaggtgctgctggaggagtgcttctgcggcagcagcgtgaccgtgcccgagatcgagggcgtgctgtggctgaaggacgacggcaagaagagctggaagaagagatacttcctgctgagagccagcggcatctactacgtgcccaagggcaaggccaaggtgagcagagacctggtgtgcttcctgcagctggaccacgtgaacgtgtactacggccaggactacagaaacaagtacaaggcccccaccgactactgcctggtgctgaagcacccccagatccagaagaagagccagtacatcaagtacctgtgctgcgacgacgtgagaaccctgcaccagtgggtgaacggcatcagaatcgccaagtacggcaagcagctgtacatgaactaccaggaggccctgaagagaaccgagagcgcctacgactggaccagcctgagcagcagcagcatcaagagcggcagcagcagcagcagcatccccgagagccagagcaaccacagcaaccagagcgacagcggcgtgagcgacacccagcccgccggccacgtgagaagccagagcatcgtgagcagcgtgttcagcgaggcctggaagagaggcacccagctggaggagagcagcaagtag

SEQ ID NO: 21434 - DNA, 3753 bp, Artificial Sequence
  Description of Artificial Sequence: Synthetic coding sequence
atggagcagctgagcgacgaggagatcgaccacggcgccgaggaggacagcgacaaggaggaccaggacctggacaagatgttcggcgcctggctgggcgagctggacaagctgacccagagcctggacagcgacaagcccatggagcccgtgaagagaagccccctgagacaggagaccaacatggccaacttcagctacagattcagcatctacaacctgaacgaggccctgaaccagggcgagaccgtggacctggacgccctgatggccgacctgtgcagcatcgagcaggagctgagcagcatcggcagcggcaacagcaagagacagatcaccgagaccaaggccacccagaagctgcccgtgagcagacacaccctgaagcacggcaccctgaagggcctgagcagcagcagcaacagaatcgccaagcccagccacgccagctacagcctggacgacgtgaccgcccagctggagcaggccagcctgagcatggacgaggccgcccagcagagcgtgctggaggacaccaagcccctggtgaccaaccagcacagaagaaccgccagcgccggcaccgtgagcgacgccgaggtgcacagcatcagcaacagcagccacagcagcatcaccagcgccgccagcagcatggacagcctggacatcgacaaggtgaccagaccccaggagctggacctgacccaccagggccagcccatcaccgaggaggagcaggccgccaagctgaaggccgagaagatcagagtggccctggagaagatcaaggaggcccaggtgaagaagctggtgatcagagtgcacatgagcgacgacagcagcaagaccatgatggtggacgagagacagaccgtgagacaggtgctggacaacctgatggacaagagccactgcggctacagcctggactggagcctggtggagaccgtgagcgagctgcagatggagagaatcttcgaggaccacgagaacctggtggagaacctgctgaactggaccagagacagccagaacaagctgatcttcatggagagaatcgagaagtacgccctgttcaagaacccccagaactacctgctgggcaagaaggagaccgccgagatggccgacagaaacaaggaggtgctgctggaggagtgcttctgcggcagcagcgtgaccgtgcccgagatcgagggcgtgctgtggctgaaggacgacggcaagaagagctggaagaagagatacttcctgctgagagccagcggcatctactacgtgcccaagggcaaggccaaggtgagcagagacctggtgtgcttcctgcagctggaccacgtgaacgtgtactacggccaggactacagaaacaagtacaaggcccccaccgactactgcctggtgctgaagcacccccagatccagaagaagagccagtacatcaagtacctgtgctgcgacgacgtgagaaccctgcaccagtgggtgaacggcatcagaatcgccaagtacggcaagcagctgtacatgaactaccaggaggccctgaagagaaccgagagcgcctacgactggaccagcctgagcagcagcagcatcaagagcggcagcagcagcagcagcatccccgagagccagagcaaccacagcaaccagagcgacagcggcgtgagcgacacccagcccgccggccacgtgagaagccagagcatcgtgagcagcgtgttcagcgaggcctggaagagaggcacccagctggaggagagcagcaaggccagaatggagagcatgaacagaccctacaccagcctggtgccccccctgagcccccagcccaagatcgtgaccccctacaccgccagccagcccagcccccccctgccccccccccccccccccccccccccccccccccccccccccccccccccccccccccccctgcccagccagagcgcccccagcgccggcagcgccgcccccatgttcgtgaagtacagcaccatcaccagactgcagaacgccagccagcacagcggcgccctgttcaagccccccaccccccccgtgatgcagagccagagcgtgaagccccagatcctggtgccccccaacggcgtggtgccccccccccccccccccccccccccccccacccccggcagcgccatggcccagctgaagcccgccccctgcgcccccagcctgccccagttcagcgccccccccccccccctgaagatccaccaggtgcagcacatcacccaggtggccccccccaccccccccccccccccccccatccccgcccccctgcccccccaggccccccccaagcccctggtgaccatccccgcccccaccagcaccaagaccgtggcccccgtggtgacccaggccgccccccccacccccaccccccccgtgccccccgccaagaagcagcccgccttccccgccagctacatcccccccagcccccccaccccccccgtgcccgtgcccccccccaccctgcccaagcagcagagcttctgcgccaagcccccccccagccccctgagccccgtgcccagcgtggtgaagcagatcgccagccagttcccccccccccccaccccccccgccatggagagccagcccctgaagcccgtgcccgccaacgtggccccccagagcccccccgccgtgaaggccaagcccaagtggcagcccagcagcatccccgtgcccagccccgacttccccccccccccccccgagagcagcctggtgttccccccccccccccccagccccgtgcccgcccccccccccccccccccccccaccgccagccccacccccgacaagagcggcagccccggcaagaagaccagcaagaccagcagccccggcggcaagaagcccccccccaccccccagagaaacagcagcatcaagagcagcagcggcgccgagcaccccgagcccaagagacccagcgtggacagcctggtgagcaagttcaccccccccgccgagagcggcagccccagcaaggagaccctgcccccccccgccgccccccccaagcccggcaagctgaacctgagcggcgtgaacctgcccggcgtgctgcagcagggctgcgtgagcgccaaggcccccgtgctgagcggcagaggcaaggacagcgtggtggagttccccagcccccccagcgacagcgacttccccccccccccccccgagaccgagctgcccctgccccccatcgagatccccgccgtgttcagcggcaacaccagccccaaggtggccgtggtgaacccccagccccagcagtggagcaagatgagcgtgaagaaggcccccccccccaccagacccaagagaaacgacagcaccagactgacccaggccgagatcagcgagcagcccaccatggccaccgtggtgccccaggtgcccaccagccccaagagcagcctgagcgtgcagcccggcttcctggccgacctgaacagaaccctgcagagaaagagcatcaccagacacggcagcctgagcagcagaatgagcagagccgagcccaccgccaccatggacgacatggccctgcccccccccccccccgagctgctgagcgaccagcagaaggccggctacggcggcagccacatcagcggctacgccaccctgagaagaggccccccccccgccccccccaagagagaccagaacaccaagctgagcagagactggtag

SEQ ID NO: 21435 - DNA, 1854 bp, Artificial Sequence
  Description of Artificial Sequence: Synthetic coding sequence
atggagcagctgagcgacgaggagatcgaccacggcgccgaggaggacagcgacaaggaggaccaggacctggacaagatgttcggcgcctggctgggcgagctggacaagctgacccagagcctggacagcgacaagcccatggagcccgtgaagagaagccccctgagacaggagaccaacatggccaacttcagctacagattcagcatctacaacctgaacgaggccctgaaccagggcgagaccgtggacctggacgccctgatggccgacctgtgcagcatcgagcaggagctgagcagcatcggcagcggcaacagcaagagacagatcaccgagaccaaggccacccagaagctgcccgtgagcagacacaccctgaagcacggcaccctgaagggcctgagcagcagcagcaacagaatcgccaagcccagccacgccagctacagcctggacgacgtgaccgcccagctggagcaggccagcctgagcatggacgaggccgcccagcagagcgtgctggaggacaccaagcccctggtgaccaaccagcacagaagaaccgccagcgccggcaccgtgagcgacgccgaggtgcacagcatcagcaacagcagccacagcagcatcaccagcgccgccagcagcatggacagcctggacatcgacaaggtgaccagaccccaggagctggacctgacccaccagggccagcccatcaccgagcacagctacctggacagagagaccagcctgctgctgagaaacatcgccggcaagcccagccacctgctgaccaaggaggagcaggccgccaagctgaaggccgagaagatcagagtggccctggagaagatcaaggaggcccaggtgaagaagctggtgatcagagtgcacatgagcgacgacagcagcaagaccatgatggtggacgagagacagaccgtgagacaggtgctggacaacctgatggacaagagccactgcggctacagcctggactggagcctggtggagaccgtgagcgagctgcagatggagagaatcttcgaggaccacgagaacctggtggagaacctgctgaactggaccagagacagccagaacaagctgatcttcatggagagaatcgagaagtacgccctgttcaagaacccccagaactacctgctgggcaagaaggagaccgccgagatggccgacagaaacaaggaggtgctgctggaggagtgcttctgcggcagcagcgtgaccgtgcccgagatcgagggcgtgctgtggctgaaggacgacggcaagaagagctggaagaagagatacttcctgctgagagccagcggcatctactacgtgcccaagggcaaggccaaggtgagcagagacctggtgtgcttcctgcagctggaccacgtgaacgtgtactacggccaggactacagaaacaagtacaaggcccccaccgactactgcctggtgctgaagcacccccagatccagaagaagagccagtacatcaagtacctgtgctgcgacgacgtgagaaccctgcaccagtgggtgaacggcatcagaatcgccaagtacggcaagcagctgtacatgaactaccaggaggccctgaagagaaccgagagcgcctacgactggaccagcctgagcagcagcagcatcaagagcggcagcagcagcagcagcatccccgagagccagagcaaccacagcaaccagagcgacagcggcgtgagcgacacccagcccgccggccacgtgagaagccagagcatcgtgagcagcgtgttcagcgaggcctggaagagaggcacccagctggaggagagcagcaagtag

SEQ ID NO: 21436 - DNA, 1860 bp, Artificial Sequence
  Description of Artificial Sequence: Synthetic coding sequence
atggagcagctgagcgacgaggagatcgaccacggcgccgaggaggacagcgacaaggaggaccaggacctggacaagatgttcggcgcctggctgggcgagctggacaagctgacccagagcctggacagcgacaagcccatggagcccgtgaagagaagccccctgagacaggagaccaacatggccaacttcagctacagattcagcatctacaacctgaacgaggccctgaaccagggcgagaccgtggacctggacgccctgatggccgacctgtgcagcatcgagcaggagctgagcagcatcggcagcggcaacagcaagagacagatcaccgagaccaaggccacccagaagctgcccgtgagcagacacaccctgaagcacggcaccctgaagggcctgagcagcagcagcaacagaatcgccaagcccagccacgccagctacagcctggacgacgtgaccgcccagctggagcaggccagcctgagcatggacgaggccgcccagcagagcgtgctggaggacaccaagcccctggtgaccaaccagcacagaagaaccgccagcgccggcaccgtgagcgacgccgaggtgcacagcatcagcaacagcagccacagcagcatcaccagcgccgccagcagcatggacagcctggacatcgacaaggtgaccagaccccaggagctggacctgacccaccagggccagcccatcaccgagcacgccatcagcctgagatgcagcagcaagcaggccaagagacacatcgacttcaccgaggagcaggccgagctgacccccgaggagcaggccgccaagctgaaggccgagaagatcagagtggccctggagaagatcaaggaggcccaggtgaagaagctggtgatcagagtgcacatgagcgacgacagcagcaagaccatgatggtggacgagagacagaccgtgagacaggtgctggacaacctgatggacaagagccactgcggctacagcctggactggagcctggtggagaccgtgagcgagctgcagatggagagaatcttcgaggaccacgagaacctggtggagaacctgctgaactggaccagagacagccagaacaagctgatcttcatggagagaatcgagaagtacgccctgttcaagaacccccagaactacctgctgggcaagaaggagaccgccgagatggccgacagaaacaaggaggtgctgctggaggagtgcttctgcggcagcagcgtgaccgtgcccgagatcgagggcgtgctgtggctgaaggacgacggcaagaagagctggaagaagagatacttcctgctgagagccagcggcatctactacgtgcccaagggcaaggccaaggtgagcagagacctggtgtgcttcctgcagctggaccacgtgaacgtgtactacggccaggactacagaaacaagtacaaggcccccaccgactactgcctggtgctgaagcacccccagatccagaagaagagccagtacatcaagtacctgtgctgcgacgacgtgagaaccctgcaccagtgggtgaacggcatcagaatcgccaagtacggcaagcagctgtacatgaactaccaggaggccctgaagagaaccgagagcgcctacgactggaccagcctgagcagcagcagcatcaagagcggcagcagcagcagcagcatccccgagagccagagcaaccacagcaaccagagcgacagcggcgtgagcgacacccagcccgccggccacgtgagaagccagagcatcgtgagcagcgtgttcagcgaggcctggaagagaggcacccagctggaggagagcagcaagtag

SEQ ID NO: 21437 - DNA, 3909 bp, Artificial Sequence
  Description of Artificial Sequence: Synthetic coding sequence
atggagcagctgagcgacgaggagatcgaccacggcgccgaggaggacagcgacaaggaggaccaggacctggacaagatgttcggcgcctggctgggcgagctggacaagctgacccagagcctggacagcgacaagcccatggagcccgtgaagagaagccccctgagacaggagaccaacatggccaacttcagctacagattcagcatctacaacctgaacgaggccctgaaccagggcgagaccgtggacctggacgccctgatggccgacctgtgcagcatcgagcaggagctgagcagcatcggcagcggcaacagcaagagacagatcaccgagaccaaggccacccagaagctgcccgtgagcagacacaccctgaagcacggcaccctgaagggcctgagcagcagcagcaacagaatcgccaagcccagccacgccagctacagcctggacgacgtgaccgcccagctggagcaggccagcctgagcatggacgaggccgcccagcagagcgtgctggaggacaccaagcccctggtgaccaaccagcacagaagaaccgccagcgccggcaccgtgagcgacgccgaggtgcacagcatcagcaacagcagccacagcagcatcaccagcgccgccagcagcatggacagcctggacatcgacaaggtgaccagaccccaggagctggacctgacccaccagggccagcccatcaccgagcacgccatcagcctgagatgcagcagcaagcaggccaagagacacatcgacttcaccgaggagcaggccgagctgaccccccacagctacctggacagagagaccagcctgctgctgagaaacatcgccggcaagcccagccacctgctgaccaaggaggagcaggccgccaagctgaaggccgagaagatcagagtggccctggagaagatcaaggaggcccaggtgaagaagctggtgatcagagtgcacatgagcgacgacagcagcaagaccatgatggtggacgagagacagaccgtgagacaggtgctggacaacctgatggacaagagccactgcggctacagcctggactggagcctggtggagaccgtgagcgagctgcagatggagagaatcttcgaggaccacgagaacctggtggagaacctgctgaactggaccagagacagccagaacaagctgatcttcatggagagaatcgagaagtacgccctgttcaagaacccccagaactacctgctgggcaagaaggagaccgccgagatggccgacagaaacaaggaggtgctgctggaggagtgcttctgcggcagcagcgtgaccgtgcccgagatcgagggcgtgctgtggctgaaggacgacggcaagaagagctggaagaagagatacttcctgctgagagccagcggcatctactacgtgcccaagggcaaggccaaggtgagcagagacctggtgtgcttcctgcagctggaccacgtgaacgtgtactacggccaggactacagaaacaagtacaaggcccccaccgactactgcctggtgctgaagcacccccagatccagaagaagagccagtacatcaagtacctgtgctgcgacgacgtgagaaccctgcaccagtgggtgaacggcatcagaatcgccaagtacggcaagcagctgtacatgaactaccaggaggccctgaagagaaccgagagcgcctacgactggaccagcctgagcagcagcagcatcaagagcggcagcagcagcagcagcatccccgagagccagagcaaccacagcaaccagagcgacagcggcgtgagcgacacccagcccgccggccacgtgagaagccagagcatcgtgagcagcgtgttcagcgaggcctggaagagaggcacccagctggaggagagcagcaaggccagaatggagagcatgaacagaccctacaccagcctggtgccccccctgagcccccagcccaagatcgtgaccccctacaccgccagccagcccagcccccccctgccccccccccccccccccccccccccccccccccccccccccccccccccccccccccccctgcccagccagagcgcccccagcgccggcagcgccgcccccatgttcgtgaagtacagcaccatcaccagactgcagaacgccagccagcacagcggcgccctgttcaagccccccaccccccccgtgatgcagagccagagcgtgaagccccagatcctggtgccccccaacggcgtggtgccccccccccccccccccccccccccccccacccccggcagcgccatggcccagctgaagcccgccccctgcgcccccagcctgccccagttcagcgccccccccccccccctgaagatccaccaggtgcagcacatcacccaggtggccccccccaccccccccccccccccccccatccccgcccccctgcccccccaggccccccccaagcccctggtgaccatccccgcccccaccagcaccaagaccgtggcccccgtggtgacccaggccgccccccccacccccaccccccccgtgccccccgccaagaagcagcccgccttccccgccagctacatcccccccagcccccccaccccccccgtgcccgtgcccccccccaccctgcccaagcagcagagcttctgcgccaagcccccccccagccccctgagccccgtgcccagcgtggtgaagcagatcgccagccagttcccccccccccccaccccccccgccatggagagccagcccctgaagcccgtgcccgccaacgtggccccccagagcccccccgccgtgaaggccaagcccaagtggcagcccagcagcatccccgtgcccagccccgacttccccccccccccccccgagagcagcctggtgttccccccccccccccccagccccgtgcccgcccccccccccccccccccccccaccgccagccccacccccgacaagagcggcagccccggcaagaagaccagcaagaccagcagccccggcggcaagaagcccccccccaccccccagagaaacagcagcatcaagagcagcagcggcgccgagcaccccgagcccaagagacccagcgtggacagcctggtgagcaagttcaccccccccgccgagagcggcagccccagcaaggagaccctgcccccccccgccgccccccccaagcccggcaagctgaacctgagcggcgtgaacctgcccggcgtgctgcagcagggctgcgtgagcgccaaggcccccgtgctgagcggcagaggcaaggacagcgtggtggagttccccagcccccccagcgacagcgacttccccccccccccccccgagaccgagctgcccctgccccccatcgagatccccgccgtgttcagcggcaacaccagccccaaggtggccgtggtgaacccccagccccagcagtggagcaagatgagcgtgaagaaggcccccccccccaccagacccaagagaaacgacagcaccagactgacccaggccgagatcagcgagcagcccaccatggccaccgtggtgccccaggtgcccaccagccccaagagcagcctgagcgtgcagcccggcttcctggccgacctgaacagaaccctgcagagaaagagcatcaccagacacggcagcctgagcagcagaatgagcagagccgagcccaccgccaccatggacgacatggccctgcccccccccccccccgagctgctgagcgaccagcagaaggccggctacggcggcagccacatcagcggctacgccaccctgagaagaggccccccccccgccccccccaagagagaccagaacaccaagctgagcagagactggtag

SEQ ID NO: 21438 - DNA, 1875 bp, Artificial Sequence
  Description of Artificial Sequence: Synthetic coding sequence
atggagcagctgagcgacgaggagatcgaccacggcgccgaggaggacagcgacaaggaggaccaggacctggacaagatgttcggcgcctggctgggcgagctggacaagctgacccagagcctggacagcgacaagcccatggagcccgtgaagagaagccccctgagacaggagaccaacatggccaacttcagctacagattcagcatctacaacctgaacgaggccctgaaccagggcgagaccgtggacctggacgccctgatggccgacctgtgcagcatcgagcaggagctgagcagcatcggcagcggcaacagcaagagacagatcaccgagaccaaggccacccagaagctgcccgtgagcagacacaccctgaagcacggcaccctgaagggcctgagcagcagcagcaacagaatcgccaagcccagccacgccagctacagcctggacgacgtgaccgcccagctggagcaggccagcctgagcatggacgaggccgcccagcagagcgtgctggaggacaccaagcccctggtgaccaaccagcacagaagaaccgccagcgccggcaccgtgagcgacgccgaggtgcacagcatcagcaacagcagccacagcagcatcaccagcgccgccagcagcatggacagcctggacatcgacaaggtgaccagaccccaggagctggacctgacccaccagggccagcccatcaccgagcacgccatcagcctgagatgcagcagcaagcaggccaagagacacatcgacttcaccgaggagcaggccgagctgacccccgaggagcaggccgccaagctgaaggccgagaagatcagagtggccctggagaagatcaaggaggcccaggtgaagaagctggtgatcagagtgcacatgagcgacgacagcagcaagaccatgatggtggacgagagacagaccgtgagacaggtgctggacaacctgatggacaagagccactgcggctacagcctggactggagcctggtggagaccgtgagcgagctgcagatggagagaatcttcgaggaccacgagaacctggtggagaacctgctgaactggaccagagacagccagaacaagctgatcttcatggagagaatcgagaagtacgccctgttcaagaacccccagaactacctgctgggcaagaaggagaccgccgagatggccgacagaaacaaggaggtgctgctggaggagtgcttctgcggcagcagcgtgaccgtgcccgagatcgagggcgtgctgtggctgaaggacgacggcaagaagagctggaagaagagatacttcctgctgagagccagcggcatctactacgtgcccaagggcaaggccaaggtgagcagagacctggtgtgcttcctgcagctggaccacgtgaacgtgtactacggccaggactacagaaacaagtacaaggcccccaccgactactgcctggtgctgaagcacccccagatccagaagaagagccagtacatcaagtacctgtgctgcgacgacgtgagaaccctgcaccagtgggtgaacggcatcagaatcgccaagtacggcaagcagctgtacatgaactaccaggaggccctgaagagaaccgagagcgcctacgactggaccagcctgagcagcagcagcatcaagagcggcagcagcagcagcagcatccccgagagccagagcaaccacagcaaccagagcgacagcggcgtgagcgacacccagcccgccggccacgtgagaagccagagcatcgtgagcagcgtgttcagcgaggcctggaagagaggcacccagctggaggagagcagcaaggtgaccgccagcttctag

SEQ ID NO: 21439 - DNA, 1794 bp, Artificial Sequence
  Description of Artificial Sequence: Synthetic coding sequence
atggagcagctgagcgacgaggagatcgaccacggcgccgaggaggacagcgacaaggaggaccaggacctggacaagatgttcggcgcctggctgggcgagctggacaagctgacccagagcctggacagcgacaagcccatggagcccgtgaagagaagccccctgagacaggagaccaacatggccaacttcagctacagattcagcatctacaacctgaacgaggccctgaaccagggcgagaccgtggacctggacgccctgatggccgacctgtgcagcatcgagcaggagctgagcagcatcggcagcggcaacagcaagagacagatcaccgagaccaaggccacccagaagctgcccgtgagcagacacaccctgaagcacggcaccctgaagggcctgagcagcagcagcaacagaatcgccaagcccagccacgccagctacagcctggacgacgtgaccgcccagctggagcaggccagcctgagcatggacgaggccgcccagcagagcgtgctggaggacaccaagcccctggtgaccaaccagcacagaagaaccgccagcgccggcaccgtgagcgacgccgaggtgcacagcatcagcaacagcagccacagcagcatcaccagcgccgccagcagcatggacagcctggacatcgacaaggtgaccagaccccaggagctggacctgacccaccagggccagcccatcaccgaggaggagcaggccgccaagctgaaggccgagaagatcagagtggccctggagaagatcaaggaggcccaggtgaagaagctggtgatcagagtgcacatgagcgacgacagcagcaagaccatgatggtggacgagagacagaccgtgagacaggtgctggacaacctgatggacaagagccactgcggctacagcctggactggagcctggtggagaccgtgagcgagctgcagatggagagaatcttcgaggaccacgagaacctggtggagaacctgctgaactggaccagagacagccagaacaagctgatcttcatggagagaatcgagaagtacgccctgttcaagaacccccagaactacctgctgggcaagaaggagaccgccgagatggccgacagaaacaaggaggtgctgctggaggagtgcttctgcggcagcagcgtgaccgtgcccgagatcgagggcgtgctgtggctgaaggacgacggcaagaagagctggaagaagagatacttcctgctgagagccagcggcatctactacgtgcccaagggcaaggccaaggtgagcagagacctggtgtgcttcctgcagctggaccacgtgaacgtgtactacggccaggactacagaaacaagtacaaggcccccaccgactactgcctggtgctgaagcacccccagatccagaagaagagccagtacatcaagtacctgtgctgcgacgacgtgagaaccctgcaccagtgggtgaacggcatcagaatcgccaagtacggcaagcagctgtacatgaactaccaggaggccctgaagagaaccgagagcgcctacgactggaccagcctgagcagcagcagcatcaagagcggcagcagcagcagcagcatccccgagagccagagcaaccacagcaaccagagcgacagcggcgtgagcgacacccagcccgccggccacgtgagaagccagagcatcgtgagcagcgtgttcagcgaggcctggaagagaggcacccagctggaggagagcagcaaggtgaccgccagcttctag

SEQ ID NO: 21440 - DNA, 1779 bp, Artificial Sequence
  Description of Artificial Sequence: Synthetic coding sequence
atggagcagctgagcgacgaggagatcgaccacggcgccgaggaggacagcgacaaggaggaccaggacctggacaagatgttcggcgcctggctgggcgagctggacaagctgacccagagcctggacagcgacaagcccatggagcccgtgaagagaagccccctgagacaggagaccaacatggccaacttcagctacagattcagcatctacaacctgaacgaggccctgaaccagggcgagaccgtggacctggacgccctgatggccgacctgtgcagcatcgagcaggagctgagcagcatcggcagcggcaacagcaagagacagatcaccgagaccaaggccacccagaagctgcccgtgagcagacacaccctgaagcacggcaccctgaagggcctgagcagcagcagcaacagaatcgccaagcccagccacgccagctacagcctggacgacgtgaccgcccagctggagcaggccagcctgagcatggacgaggccgcccagcagagcgtgctggaggacaccaagcccctggtgaccaaccagcacagaagaaccgccagcgccggcaccgtgagcgacgccgaggtgcacagcatcagcaacagcagccacagcagcatcaccagcgccgccagcagcatggacagcctggacatcgacaaggtgaccagaccccaggagctggacctgacccaccagggccagcccatcaccgaggaggagcaggccgccaagctgaaggccgagaagatcagagtggccctggagaagatcaaggaggcccaggtgaagaagctggtgatcagagtgcacatgagcgacgacagcagcaagaccatgatggtggacgagagacagaccgtgagacaggtgctggacaacctgatggacaagagccactgcggctacagcctggactggagcctggtggagaccgtgagcgagctgcagatggagagaatcttcgaggaccacgagaacctggtggagaacctgctgaactggaccagagacagccagaacaagctgatcttcatggagagaatcgagaagtacgccctgttcaagaacccccagaactacctgctgggcaagaaggagaccgccgagatggccgacagaaacaaggaggtgctgctggaggagtgcttctgcggcagcagcgtgaccgtgcccgagatcgagggcgtgctgtggctgaaggacgacggcaagaagagctggaagaagagatacttcctgctgagagccagcggcatctactacgtgcccaagggcaaggccaaggtgagcagagacctggtgtgcttcctgcagctggaccacgtgaacgtgtactacggccaggactacagaaacaagtacaaggcccccaccgactactgcctggtgctgaagcacccccagatccagaagaagagccagtacatcaagtacctgtgctgcgacgacgtgagaaccctgcaccagtgggtgaacggcatcagaatcgccaagtacggcaagcagctgtacatgaactaccaggaggccctgaagagaaccgagagcgcctacgactggaccagcctgagcagcagcagcatcaagagcggcagcagcagcagcagcatccccgagagccagagcaaccacagcaaccagagcgacagcggcgtgagcgacacccagcccgccggccacgtgagaagccagagcatcgtgagcagcgtgttcagcgaggcctggaagagaggcacccagctggaggagagcagcaagtag

SEQ ID NO: 21441 - DNA, 270 bp, Artificial Sequence
  Description of Artificial Sequence: Synthetic coding sequence
atggagcagctgagcgacgaggagatcgaccacggcgccgaggaggacagcgacaaggaggaccaggacctggacaagatgttcggcgcctggctgggcgagctggacaagctgacccagagcctggacagcgacaagcccatggagcccgtgaagagaagccccctgagacaggagaccaacatggccaacttcagctacagattcagcatctacaacctgaacgccctgaaccagggcgagaccgtggacctggacgccctgatgtag

SEQ ID NO: 21442 - DNA, 1860 bp, Artificial Sequence; identical to SEQ ID NO: 21436
  Description of Artificial Sequence: Synthetic coding sequence

SEQ ID NO: 21443 - DNA, 519 bp, Artificial Sequence
  Description of Artificial Sequence: Synthetic coding sequence
atggagcagctgagcgacgaggagatcgaccacggcgccgaggaggacagcgacaaggaggaccaggacctggacaagatgttcggcgcctggctgggcgagctggacaagctgacccagagcctggacagcgacaagcccatggagcccgtgaagagaagccccctgagacaggagaccaacatggccaacttcagctacagattcagcatctacaacctgaacgaggccctgaaccagggcgagaccgtggacctggacgccctgatggccgacctgtgcagcatcgagcaggagctgagcagcatcggcagcggcaacagcaagagacagatcaccgagaccaaggccacccagaagctgcccgtgagcagacacaccctgaagcacggcaccctgaagggcctgagcagcagcagcaacagaatcgccaagcccagccacgccagctacagcctggacgacgtgaccgcccagctggagcaggccagcctgagcatggacgaggccgcccagtag

SEQ ID NO: 21444 - DNA, 1869 bp, Artificial Sequence
  Description of Artificial Sequence: Synthetic coding sequence
atggagcagctgagcgacgaggagatcgaccacggcgccgaggaggacagcgacaaggaggaccaggacctggacaagatgttcggcgcctggctgggcgagctggacaagctgacccagagcctggacagcgacaagcccatggagcccgtgaagagaagccccctgagacaggagaccaacatggccaacttcagctacagattcagcatctacaacctgaacgaggccctgaaccagggcgagaccgtggacctggacgccctgatggccgacctgtgcagcatcgagcaggagctgagcagcatcggcagcggcaacagcaagagacagatcaccgagaccaaggccacccagaagctgcccgtgagcagacacaccctgaagcacggcaccctgaagggcctgagcagcagcagcaacagaatcgccaagcccagccacgccagctacagcctggacgacgtgaccgcccagctggagcaggccagcctgagcatggacgaggccgcccagcagagcgtgctggaggacaccaagcccctggtgaccaaccagcacagaagaaccgccagcgccggcaccgtgagcgacgccgaggtgcacagcatcagcaacagcagccacagcagcatcaccagcgccgccagcagcatggacagcctggacatcgacaaggtgaccagaccccaggagctggacctgacccaccagggccagcccatcaccgagcacagctacctggacagagagaccagcctgctgctgagaaacatcgccggcaagcccagccacctgctgaccaaggaggagcaggccgccaagctgaaggccgagaagatcagagtggccctggagaagatcaaggaggcccaggtgaagaagctggtgatcagagtgcacatgagcgacgacagcagcaagaccatgatggtggacgagagacagaccgtgagacaggtgctggacaacctgatggacaagagccactgcggctacagcctggactggagcctggtggagaccgtgagcgagctgcagatggagagaatcttcgaggaccacgagaacctggtggagaacctgctgaactggaccagagacagccagaacaagctgatcttcatggagagaatcgagaagtacgccctgttcaagaacccccagaactacctgctgggcaagaaggagaccgccgagatggccgacagaaacaaggaggtgctgctggaggagtgcttctgcggcagcagcgtgaccgtgcccgagatcgagggcgtgctgtggctgaaggacgacggcaagaagagctggaagaagagatacttcctgctgagagccagcggcatctactacgtgcccaagggcaaggccaaggtgagcagagacctggtgtgcttcctgcagctggaccacgtgaacgtgtactacggccaggactacagaaacaagtacaaggcccccaccgactactgcctggtgctgaagcacccccagatccagaagaagagccagtacatcaagtacctgtgctgcgacgacgtgagaaccctgcaccagtgggtgaacggcatcagaatcgccaagtacggcaagcagctgtacatgaactaccaggaggccctgaagagaaccgagagcgcctacgactggaccagcctgagcagcagcagcatcaagagcggcagcagcagcagcagcatccccgagagccagagcaaccacagcaaccagagcgacagcggcgtgagcgacacccagcccgccggccacgtgagaagccagagcatcgtgagcagcgtgttcagcgaggcctggaagagaggcacccagctggaggagagcagcaaggtgaccgccagcttctag

SEQ ID NO: 21445 - DNA, 1854 bp, Artificial Sequence; identical to SEQ ID NO: 21435
  Description of Artificial Sequence: Synthetic coding sequence

SEQ ID NO: 21446 - DNA, 1950 bp, Artificial Sequence
  Description of Artificial Sequence: Synthetic coding sequence
atggagcagctgagcgacgaggagatcgaccacggcgccgaggaggacagcgacaaggaggaccaggacctggacaagatgttcggcgcctggctgggcgagctggacaagctgacccagagcctggacagcgacaagcccatggagcccgtgaagagaagccccctgagacaggagaccaacatggccaacttcagctacagattcagcatctacaacctgaacgaggccctgaaccagggcgagaccgtggacctggacgccctgatggccgacctgtgcagcatcgagcaggagctgagcagcatcggcagcggcaacagcaagagacagatcaccgagaccaaggccacccagaagctgcccgtgagcagacacaccctgaagcacggcaccctgaagggcctgagcagcagcagcaacagaatcgccaagcccagccacgccagctacagcctggacgacgtgaccgcccagctggagcaggccagcctgagcatggacgaggccgcccagcagagcgtgctggaggacaccaagcccctggtgaccaaccagcacagaagaaccgccagcgccggcaccgtgagcgacgccgaggtgcacagcatcagcaacagcagccacagcagcatcaccagcgccgccagcagcatggacagcctggacatcgacaaggtgaccagaccccaggagctggacctgacccaccagggccagcccatcaccgagcacgccatcagcctgagatgcagcagcaagcaggccaagagacacatcgacttcaccgaggagcaggccgagctgaccccccacagctacctggacagagagaccagcctgctgctgagaaacatcgccggcaagcccagccacctgctgaccaaggaggagcaggccgccaagctgaaggccgagaagatcagagtggccctggagaagatcaaggaggcccaggtgaagaagctggtgatcagagtgcacatgagcgacgacagcagcaagaccatgatggtggacgagagacagaccgtgagacaggtgctggacaacctgatggacaagagccactgcggctacagcctggactggagcctggtggagaccgtgagcgagctgcagatggagagaatcttcgaggaccacgagaacctggtggagaacctgctgaactggaccagagacagccagaacaagctgatcttcatggagagaatcgagaagtacgccctgttcaagaacccccagaactacctgctgggcaagaaggagaccgccgagatggccgacagaaacaaggaggtgctgctggaggagtgcttctgcggcagcagcgtgaccgtgcccgagatcgagggcgtgctgtggctgaaggacgacggcaagaagagctggaagaagagatacttcctgctgagagccagcggcatctactacgtgcccaagggcaaggccaaggtgagcagagacctggtgtgcttcctgcagctggaccacgtgaacgtgtactacggccaggactacagaaacaagtacaaggcccccaccgactactgcctggtgctgaagcacccccagatccagaagaagagccagtacatcaagtacctgtgctgcgacgacgtgagaaccctgcaccagtgggtgaacggcatcagaatcgccaagtacggcaagcagctgtacatgaactaccaggaggccctgaagagaaccgagagcgcctacgactggaccagcctgagcagcagcagcatcaagagcggcagcagcagcagcagcatccccgagagccagagcaaccacagcaaccagagcgacagcggcgtgagcgacacccagcccgccggccacgtgagaagccagagcatcgtgagcagcgtgttcagcgaggcctggaagagaggcacccagctggaggagagcagcaaggtgaccgccagcttctag

SEQ ID NO: 21447 - DNA, 2073 bp, Artificial Sequence
  Description of Artificial Sequence: Synthetic coding sequence
atgggcagcagcggcctgggcaaggccgccaccctggacgagctgctgtgcacctgcatcgagatgttcgacgacaacggcgagctggacaacagctacctgcccagaatcgtgctgctgatgcacagatggtacctgagcagcaccgagctggccgagaagctgctgtgcatgtacagaaacgccaccggcgagagctgcaacgagttcagactgaagatctgctacttcatgagatactggatcctgaagttccccgccgagttcaacctggacctgggcctgatcagaatgaccgaggagttcagagaggtggccagccagctgggctacgagaagcacgtgagcctgatcgacatcagcagcatccccagctacgactggatgagaagagtgacccagagaaagaaggtgagcaagaagggcaaggcctgcctgctgttcgaccacctggagcccatcgagctggccgagcacctgaccttcctggagcacaagagcttcagaagaatcagcttcaccgactaccagagctacgtgatccacggctgcctggagaacaaccccaccctggagagaagcatcgccctgttcaacggcatcagcaagtgggtgcagctgatggtgctgagcaagcccaccccccagcagagagccgaggtgatcaccaagttcatcaacgtggccaagaagctgctgcagctgaagaacttcaacaccctgatggccgtggtgggcggcctgagccacagcagcatcagcagactgaaggagacccacagccacctgagcagcgaggtgaccaagaactggaacgagatgaccgagctggtgagcagcaacggcaactactgcaactacagaaaggccttcgccgactgcgacggcttcaagatccccatcctgggcgtgcacctgaaggacctgatcgccgtgcacgtgatcttccccgactggaccgaggagaacaaggtgaacatcgtgaagatgcaccagctgagcgtgaccctgagcgagctggtgagcctgcagaacgccagccaccacctggagcccaacatggacctgatcaacctgctgaccctgagcctggacctgtaccacaccgaggacgacatctacaagctgagcctggtgctggagcccagaaacagcaagagccagcccaccagccccaccacccccaacaagcccgtggtgcccctggagtgggccctgggcgtgatgcccaagcccgaccccaccgtgatcaacaagcacatcagaaagctggtggagagcgtgttcagaaactacgaccacgaccacgacggctacatcagccaggaggacttcgagagcatcgccgccaacttccccttcctggacagcttctgcgtgctggacaaggaccaggacggcctgatcagcaaggacgagatgatggcctacttcctgagagccaagagccagctgcactgcaagatgggccccggcttcatccacaacttccaggagatgacctacctgaagcccaccttctgcgagcactgcgccggcttcctgtggggcatcatcaagcagggctacaagtgcaaggactgcggcgccaactgccacaagcagtgcaaggacctgctggtgctggcctgcagaagattcgccagagcccccagcctgagcagcggccacggcagcctgcccggcagccccagcctgccccccgcccaggacgaggtgttcgagttccccggcgtgaccgccggccacagagacctggacagcagagccatcaccctggtgaccggcagcagcagaaagatcagcgtgagactgcagagagccaccaccagccaggccacccagaccgagcccgtgtggagcgaggccggctggggcgacagcggcagccacaccttccccaagatgaagagcaagttccacgacaaggccgccaaggacaagggcttcgccaagtgggagaacgagaagcccagagtgcacgccggcgtggacgtggtggacagaggcaccgagttcgagctggaccaggacgagggcgaggagaccagacaggacggcgaggacggctag

SEQ ID NO: 21448 - DNA, 2073 bp, Artificial Sequence; identical to SEQ ID NO: 21447
  Description of Artificial Sequence: Synthetic coding sequence

SEQ ID NO: 21449 - DNA, 2070 bp, Artificial Sequence
  Description of Artificial Sequence: Synthetic coding sequence
atgggcagcagcggcctgggcaaggccgccaccctggacgagctgctgtgcacctgcatcgagatgttcgacgacaacggcgagctggacaacagctacctgcccagaatcgtgctgctgatgcacagatggtacctgagcagcaccgagctggccgagaagctgctgtgcatgtacagaaacgccaccggcgagagctgcaacgagttcagactgaagatctgctacttcatgagatactggatcctgaagttccccgccgagttcaacctggacctgggcctgatcagaatgaccgaggagttcagagaggtggccagccagctgggctacgagaagcacgtgagcctgatcgacatcagcagcatccccagctacgactggatgagaagagtgacccagagaaagaaggtgagcaagaagggcaaggcctgcctgctgttcgaccacctggagcccatcgagctggccgagcacctgaccttcctggagcacaagagcttcagaagaatcagcttcaccgactaccagagctacgtgatccacggctgcctggagaacaaccccaccctggagagaagcatcgccctgttcaacggcatcagcaagtgggtgcagctgatggtgctgagcaagcccaccccccagcagagagccgaggtgatcaccaagttcatcaacgtggccaagaagctgctgcagctgaagaacttcaacaccctgatggccgtggtgggcggcctgagccacagcagcatcagcagactgaaggagacccacagccacctgagcagcgaggtgaccaagaactggaacgagatgaccgagctggtgagcagcaacggcaactactgcaactacagaaaggccttcgccgactgcgacggcttcaagatccccatcctgggcgtgcacctgaaggacctgatcgccgtgcacgtgatcttccccgactggaccgaggagaacaaggtgaacatcgtgaagatgcaccagctgagcgtgaccctgagcgagctggtgagcctgcagaacgccagccaccacctggagcccaacatggacctgatcaacctgctgaccctgagcctggacctgtaccacaccgaggacgacatctacaagctgagcctggtgctggagcccagaaacagcaagagccccaccagccccaccacccccaacaagcccgtggtgcccctggagtgggccctgggcgtgatgcccaagcccgaccccaccgtgatcaacaagcacatcagaaagctggtggagagcgtgttcagaaactacgaccacgaccacgacggctacatcagccaggaggacttcgagagcatcgccgccaacttccccttcctggacagcttctgcgtgctggacaaggaccaggacggcctgatcagcaaggacgagatgatggcctacttcctgagagccaagagccagctgcactgcaagatgggccccggcttcatccacaacttccaggagatgacctacctgaagcccaccttctgcgagcactgcgccggcttcctgtggggcatcatcaagcagggctacaagtgcaaggactgcggcgccaactgccacaagcagtgcaaggacctgctggtgctggcctgcagaagattcgccagagcccccagcctgagcagcggccacggcagcctgcccggcagccccagcctgccccccgcccaggacgaggtgttcgagttccccggcgtgaccgccggccacagagacctggacagcagagccatcaccctggtgaccggcagcagcagaaagatcagcgtgagactgcagagagccaccaccagccaggccacccagaccgagcccgtgtggagcgaggccggctggggcgacagcggcagccacaccttccccaagatgaagagcaagttccacgacaaggccgccaaggacaagggcttcgccaagtgggagaacgagaagcccagagtgcacgccggcgtggacgtggtggacagaggcaccgagttcgagctggaccaggacgagggcgaggagaccagacaggacggcgaggacggctag

SEQ ID NO: 21450 - DNA, 342 bp, Artificial Sequence
  Description of Artificial Sequence: Synthetic coding sequence
atgggcagcagcggcctgggcaaggccgccaccctggacgagctgctgtgcacctgcatcgagatgttcgacgacaacggcgagctggacaacagctacctgcccagaatcgtgctgctgatgcacagatggtacctgagcagcaccgagctggccgagaagctgctgtgcatgtacagaaacgccaccggcgagagctgcaacgagttcagactgaagatctgctacttcatgagatactggatcctgaagttccccgccgagttcaacctggacctgggcctgatcagaatgaccgaggagttcagagaggtggccagccagctgggctacgagaagtag

SEQ ID NO: 21451 - DNA, 105 bp, Artificial Sequence
  Description of Artificial Sequence: Synthetic coding sequence
atgggcagcagcggcctgggcaaggccgccaccctggacgagctgctgtgcacctgcatcgagatgttcgacgacaacggcgagctggacaacagctacctgtag

SEQ ID NO: 21452 - DNA, 519 bp, Artificial Sequence
  Description of Artificial Sequence: Synthetic coding sequence
atgggcagcagcggcctgggcaaggccgccaccctggacgagctgctgtgcacctgcatcgagatgttcgacgacaacggcgagctggacaacagctacctgcccagaatcgtgctgctgatgcacagatggtacctgagcagcaccgagctggccgagaagctgctgtgcatgtacagaaacgccaccggcgagagctgcaacgagttcagactgaagatctgctacttcatgagatactggatcctgaagttccccgccgagttcaacctggacctgggcctgatcagaatgaccgaggagttcagagaggtggccagccagctgggctacgagaagcacgtgagcctgatcgacatcagcagcatccccagctacgactggatgagaagagtgacccagagaaagaaggtgagcaagaagggcaaggcctgcctgctgttcgaccacctggagcccatcgagctggccgagcacctgaccttcctggagcacaagagcttcagaagaatcagctag

SEQ ID NO: 21453 - DNA, 234 bp, Artificial Sequence
  Description of Artificial Sequence: Synthetic coding sequence
atgggcagcagcggcctgggcaaggccgccaccctggacgagctgctgtgcacctgcatcgagatgttcgacgacaacggcgagctggacaacagctacctgcccagaatcgtgctgctgatgcacagatggtacctgagcagcaccgagctggccgagaagctgctgtgcatgtacagaaacgccaccggcgagagctgcaacgagttcagactgaagatctgctacttctag

SEQ ID NO: 21454 - DNA, 339 bp, Artificial Sequence
  Description of Artificial Sequence: Synthetic coding sequence
atgggcagcagcggcctgggcaaggccgccaccctggacgagctgctgtgcacctgcatcgagatgttcgacgacaacggcgagctggacaacagctacctgcccagaatcgtgctgctgatgcacagatggtacctgagcagcaccgagctggccgagaagctgctgtgcatgtacagaaacgccaccggcgagagctgcaacgagttcagactgaagatctgctacttcatgagatactggatcctgaagttccccgccgagttcaacctggacctgggcctgatcagaatgaccgaggagttcagagaggtggccagccagctgggctacgagtag

SEQ ID NO: 21455 - DNA, 552 bp, Artificial Sequence
  Description of Artificial Sequence: Synthetic coding sequence
atgcccctggtgagatacagaaaggtggtgatcctgggctacagatgcgtgggcaagaccagcctggcccaccagttcgtggagggcgagttcagcgagggctacgaccccaccgtggagaacacctacagcaagatcgtgaccctgggcaaggacgagttccacctgcacctggtggacaccgccggccaggacgagtacagcatcctgccctacagcttcatcatcggcgtgcacggctacgtgctggtgtacagcgtgaccagcctgcacagcttccaggtgatcgagagcctgtaccagaagctgcacgagggccacggcaagaccagagtgcccgtggtgctggtgggcaacaaggccgacctgagccccgagagagaggtgcaggccgtggagggcaagaagctggccgagagctggggcgccaccttcatggagagcagcgccagagagaaccagctgacccagggcatcttcaccaaggtgatccaggagatcgccagagtggagaacagctacggccaggagagaagatgccacctgatgtag

SEQ ID NO: 21456 - DNA, 633 bp, Artificial Sequence
  Description of Artificial Sequence: Synthetic coding sequence
atgaccgccgcccaggccgccggcgaggaggccccccccggcgtgagaagcgtgaaggtggtgctggtgggcgacggcggctgcggcaagaccagcctgctgatggtgttcgccgacggcgccttccccgagagctacacccccaccgtgttcgagagatacatggtgaacctgcaggtgaagggcaagcccgtgcacctgcacatctgggacaccgccggccaggacgactacgacagactgagacccctgttctaccccgacgccagcgtgctgctgctgtgcttcgacgtgaccagccccaacagcttcgacaacatcttcaacagatggtaccccgaggtgaaccacttctgcaagaaggtgcccatcatcgtggtgggctgcaagaccgacctgtgcaaggacaagagcctggtgaacaagctgagaagaaacggcctggagcccgtgacctaccacagaggccaggagatggccagaagcgtgggcgccgtggcctacctggagtgcagcgccagactgcacgacaacgtgcacgccgtgttccaggaggccgccgaggtggccctgagcagcagaggcagaaacttctggagaagaatcacccagggcttctgcgtggtgacctag

SEQ ID NO: 21457 - DNA, 636 bp, Artificial Sequence
  Description of Artificial Sequence: Synthetic coding sequence
atggacgcccccggcgccctggcccagaccgccgcccccggccccggcagaaaggagctgaagatcgtgatcgtgggcgacggcggctgcggcaagaccagcctgctgatggtgtacagccagggcagcttccccgagcactacgcccccagcgtgttcgagaagtacaccgccagcgtgaccgtgggcagcaaggaggtgaccctgaacctgtacgacaccgccggccaggaggactacgacagactgagacccctgagctaccagaacacccacctggtgctgatctgctacgacgtgatgaaccccaccagctacgacaacgtgctgatcaagtggttccccgaggtgacccacttctgcagaggcatccccatggtgctgatcggctgcaagaccgacctgagaaaggacaaggagcagctgagaaagctgagagccgcccagctggagcccatcacctacatgcagggcctgagcgcctgcgagcagatcagagccgccctgtacctggagtgcagcgccaagttcagagagaacgtggaggacgtgttcagagaggccgccaaggtggccctgagcgccctgaagaaggcccagagacagaagaagagaagactgtgcctgctgctgtag

SEQ ID NO: 21458 - DNA, 342 bp, Artificial Sequence
  Description of Artificial Sequence: Synthetic coding sequence
atggacgcccccggcgccctggcccagaccgccgcccccggccccggcagaaaggagctgaagatcgtgatcgtgggcgacggcggctgcggcaagaccagcctgctgatggtgtacagccagggcagcttccccgagcactacgcccccagcgtgttcgagaagtacaccgccagcgtgaccgtgggcagcaaggaggtgaccctgaacctgtacgacaccgccggccaggaggactacgacagactgagacccctgagctaccagaacacccacctggtgctgatctgctacgacgtgatgaaccccaccagctacgacaacgtgctgatcaaggtgtag

SEQ ID NO: 21459 - DNA, 576 bp, Artificial Sequence
  Description of Artificial Sequence: Synthetic coding sequence
atgcagagcatcaagtgcgtggtggtgggcgacggcgccgtgggcaagacctgcctgctgatctgctacaccaccaacgccttccccaaggagtacatccccaccgtgttcgacaactacagcgcccagagcgccgtggacggcagaaccgtgaacctgaacctgtgggacaccgccggccaggaggagtacgacagactgagaaccctgagctacccccagaccaacgtgttcgtgatctgcttcagcatcgccagcccccccagctacgagaacgtgagacacaagtggcaccccgaggtgtgccaccactgccccgacgtgcccatcctgctggtgggcaccaagaaggacctgagagcccagcccgacaccctgagaagactgaaggagcagggccaggcccccatcaccccccagcagggccaggccctggccaagcagatccacgccgtgagatacctggagtgcagcgccctgcagcaggacggcgtgaaggaggtgttcgccgaggccgtgagagccgtgctgaaccccacccccatcaagagaggcagaagctgcatcctgctgtag

SEQ ID NO: 21460 - DNA, 576 bp, Artificial Sequence; identical to SEQ ID NO: 21459
  Description of Artificial Sequence: Synthetic coding sequence

SEQ ID NO: 21461 - DNA, 576 bp, Artificial Sequence; identical to SEQ ID NO: 21459
  Description of Artificial Sequence: Synthetic coding sequence

SEQ ID NO: 21462 - DNA, 576 bp, Artificial Sequence; identical to SEQ ID NO: 21459
  Description of Artificial Sequence: Synthetic coding sequence

SEQ ID NO: 21463 - DNA, 576 bp, Artificial Sequence
  Description of Artificial Sequence: Synthetic coding sequence
atgctgagcagcatcaagtgcgtgctggtgggcgacagcgccgtgggcaagaccagcctgctggtgagattcaccagcgagaccttccccgaggcctacaagcccaccgtgtacgagaacaccggcgtggacgtgttcatggacggcatccagatcagcctgggcctgtgggacaccgccggcaacgacgccttcagaagcatcagacccctgagctaccagcaggccgacgtggtgctgatgtgctacagcgtggccaaccacaacagcttcctgaacctgaagaacaagtggatcggcgagatcagaagcaacctgccctgcacccccgtgctggtggtggccacccagaccgaccagagagagatgggcccccacagagccagctgcgtgaacgccatggagggcaagaagctggcccaggacgtgagagccaagggctacctggagtgcagcgccctgagcaacagaggcgtgcagcaggtgttcgagtgcgccgtgagaaccgccgtgaaccaggccagaagaagaaacagaagaagactgttcagcatcaacgagtgcaagatcttctag

SEQ ID NO: 21464 - DNA, 312 bp, Artificial Sequence
  Description of Artificial Sequence: Synthetic coding sequence
atgctgagcagcatcaagtgcgtgctggtgggcgacagcgccgtgggcaagaccagcctgctggtgagattcaccagcgagaccttccccgaggcctacaagcccaccgtgtacgagaacaccggcgtggacgtgttcatggacggcatccagatcagcctgggcctgtgggacaccgccggcaacgacgccttcagaagcatcagacccctgagctaccagcaggccgacgtggtgctgatgtgctacagcgtggccaaccacaacagcttcctgaacctgaagaacaagtggatcggcgagatcagatag

SEQ ID NO: 21465 - DNA, 576 bp, Artificial Sequence; identical to SEQ ID NO: 21463
  Description of Artificial Sequence: Synthetic coding sequence

SEQ ID NO: 21466 - DNA, 330 bp, Artificial Sequence
  Description of Artificial Sequence: Synthetic coding sequence
atgctgagcagcatcaagtgcgtgctggtgggcgacagcgccgtgggcaagaccagcctgctggtgagattcaccagcgagaccttccccgaggcctacaagcccaccgtgtacgagaacaccggcgtggacgtgttcatggacggcatccagatcagcctgggcctgtgggacaccgccggcaacgacgccttcagaagcatcagacccctgagctaccagcaggccgacgtggtgctgatgtgctacagcgtggccaaccacaacagcttcctgaacctgaagaacaagtggatcggcgagatcagaagcaacctgccctgcacctag

SEQ ID NO: 21467 - DNA, 51 bp, Artificial Sequence
  Description of Artificial Sequence: Synthetic coding sequence
atgctgagcagcatcaagtgcgtgctggtgggcgacagcgccgtgggctag

SEQ ID NO: 21468 - DNA, 21 bp, Artificial Sequence
  Description of Artificial Sequence: Synthetic coding sequence
atgctgagcagcatcaagtag

SEQ ID NO: 21469 - DNA, 645 bp, Artificial Sequence
  Description of Artificial Sequence: Synthetic coding sequence
atgaactgcaaggagggcaccgacagcagctgcggctgcagaggcaacgacgagaagaagatgctgaagtgcgtggtggtgggcgacggcgccgtgggcaagacctgcctgctgatgagctacgccaacgacgccttccccgaggagtacgtgcccaccgtgttcgaccactacgccgtgaccgtgaccgtgggcggcaagcagcacctgctgggcctgtacgacaccgccggccaggaggactacaaccagctgagacccctgagctaccccaacaccgacgtgttcctgatctgcttcagcgtggtgaaccccgccagctaccacaacgtgcaggaggagtgggtgcccgagctgaaggactgcatgccccacgtgccctacgtgctgatcggcacccagatcgacctgagagacgaccccaagaccctggccagactgctgtacatgaaggagaagcccctgacctacgagcacggcgtgaagctggccaaggccatcggcgcccagtgctacctggagtgcagcgccctgacccagaagggcctgaaggccgtgttcgacgaggccatcctgaccatcttccaccccaagaagaagaagaagagatgcagcgagggccacagctgctgcagcatcatctag

SEQ ID NO: 21470 - DNA, 618 bp, Artificial Sequence
  Description of Artificial Sequence: Synthetic coding sequence
atggcccacggccccggcgccctgatgctgaagtgcgtggtggtgggcgacggcgccgtgggcaagacctgcctgctgatgagctacgccaacgacgccttccccgaggagtacgtgcccaccgtgttcgaccactacgccgtgagcgtgaccgtgggcggcaagcagtacctgctgggcctgtacgacaccgccggccaggaggactacgacagactgagacccctgagctaccccatgaccgacgtgttcctgatctgcttcagcgtggtgaaccccgccagcttccagaacgtgaaggaggagtgggtgcccgagctgaaggagtacgcccccaacgtgcccttcctgctgatcggcacccagatcgacctgagagacgaccccaagaccctggccagactgaacgacatgaaggagaagcccatctgcgtggagcagggccagaagctggccaaggagatcggcgcctgctgctacgtggagtgcagcgccctgacccagaagggcctgaagaccgtgttcgacgaggccatcatcgccatcctgacccccaagaagcacaccgtgaagaagagaatcggcagcagatgcatcaactgctgcctgatcacctag

SEQ ID NO: 21471 - DNA, 915 bp, Artificial Sequence
  Description of Artificial Sequence: Synthetic coding sequence
atggccgtgaccaaggagctgctgcagatggacctgtacgccctgctgggcatcgaggagaaggccgccgacaaggaggtgaagaaggcctacagacagaaggccctgagctgccaccccgacaagaaccccgacaaccccagagccgccgagctgttccaccagctgagccaggccctggaggtgctgaccgacgccgccgccagagccgcctacgacaaggtgagaaaggccaagaagcaggccgccgagagaacccagaagctggacgagaagagaaagaaggtgaagctggacctggaggccagagagagacaggcccaggcccaggagagcgaggaggaggaggagagcagaagcaccagaaccctggagcaggagatcgagagactgagagaggagggcagcagacagctggaggagcagcagagactgatcagagagcagatcagacaggagagagaccagagactgagaggcaaggccgagaacaccgagggccagggcacccccaagctgaagctgaagtggaagtgcaagaaggaggacgagagcaagggcggctacagcaaggacgtgctgctgagactgctgcagaagtacggcgaggtgctgaacctggtgctgagcagcaagaagcccggcaccgccgtggtggagttcgccaccgtgaaggccgccgagctggccgtgcagaacgaggtgggcctggtggacaaccccctgaagatcagctggctggagggccagccccaggacgccgtgggcagaagccacagcggcctgagcaagggcagcgtgctgagcgagagagactacgagagcctggtgatgatgagaatgagacaggccgccgagagacagcagctgatcgccagaatgcagcaggaggaccaggagggcccccccacctag

SEQ ID NO: 21472 - DNA, 258 bp, Artificial Sequence
  Description of Artificial Sequence: Synthetic coding sequence
atggccgtggaggaggagctgaagaaggaccacgccgagatgcaggccgtgatcgacgccaagcagaagatcatcgacgcccaggtgatcaacggcgacgagatcatccagaccggcaagaccgacagagtgcccggcttcagccagcaccagaccgacgagagagccgaccccagcgagggcgccgtgcagcacgccggcccccagtggcacctgccccaccagccccaccaggccttccaccacggcgagtggtag

SEQ ID NO: 21473 - DNA, 3843 bp, Artificial Sequence
  Description of Artificial Sequence: Synthetic coding sequence
atggagctgagccccagcagcggcggcgccgccgaggccctgagctggcccgagatgttccccgccctggagagcgacagccccctgccccccgaggacctggacgccgtggtgcccgtgagcggcgccgtggccggcggcatgctggacagaatcctgctggagagcgtgtgccagcagcagagctgggtgagagtgtacgacgtgaagggcccccccacccacagactgagctgcggccagagcccctacaccgagaccaccacctgggagagaaagtactgcatcctgaccgacagccagctggtgctgctgaacaaggagaaggagatccccgtggagggcggccaggagcagcagaccgacagcaccaagggcagatgcctgagaagaaccgtgagcgtgcccagcgagggccagttccccgagtacccccccgagggcgccaccaagctggaggtgcccgccgagagaagccccagaagaagaagcatcagcggcaccagcaccagcgagaagcccaacagcatggacaccgccaacaccagccccttcaaggtgcccggcttcttcagcaagagactgaagggcagcatcaagagaaccaagagccagagcaagctggacagaaacaccagcttcagactgcccagcctgagaagcaccgacgacagaagcagaggcctgcccaagctgaaggagagcagaagccacgagagcctgctgagcccctgcagcaccgtggagtgcctggacctgggcagaggcgagcccgtgagcgtgaagcccctgcacagcagcatcctgggccaggacttctgcttcgaggtgacctacctgagcggcagcaagtgcttcagctgcaacagcgccagcgagagagacaagtggatggagaacctgagaagaaccgtgcagcccaacaaggacaactgcagaagagccgagaacgtgctgagactgtggatcatcgaggccaaggacctggcccccaagaagaagtacttctgcgagctgtgcctggacgacaccctgttcgccagaaccaccagcaagaccaaggccgacaacatcttctggggcgagcacttcgagttcttcagcctgccccccctgcacagcatcaccgtgcacatctacaaggacgtggagaagaagaagaagaaggacaagaacaactacgtgggcctggtgaacatccccaccgccagcgtgaccggcagacagttcgtggagaagtggtaccccgtgagcacccccacccccaacaagggcaagaccggcggccccagcatcagaatcaagagcagattccagaccatcaccatcctgcccatggagcagtacaaggagttcgccgagttcgtgaccagcaactacaccatgctgtgcagcgtgctggagcccgtgatcagcgtgagaaacaaggaggagctggcctgcgccctggtgcacatcctgcagagcaccggcagagccaaggacttcctgaccgacctggtgatgagcgaggtggacagatgcggcgagcacgacgtgctgatcttcagagagaacaccatcgccaccaagagcatcgaggagtacctgaagctggtgggccagcagtacctgcacgacgccctgggcgagttcatcaaggccctgtacgagagcgacgagaactgcgaggtggaccccagcaagtgcagcagcagcgagctgatcgaccaccagagcaacctgaagatgtgctgcgagctggccttctgcaagatcatcaacagctactgcgtgttccccagagagctgaaggaggtgttcgccagctggaagcagcagtgcctgaacagaggcaagcaggacatcagcgagagactgatcagcgccagcctgttcctgagattcctgtgccccgccatcatgagccccagcctgttcaacctgatgcaggagtaccccgacgacagaaccagcagaaccctgaccctgatcgccaaggtgatccagaacctggccaacttcgccaagttcggcaacaaggaggagtacatggccttcatgaacgacttcctggagcacgagtggggcggcatgaagagattcctgctggagatcagcaaccccgacaccatcagcaacacccccggcttcgacggctacatcgacctgggcagagagctgagcgtgctgcacagcctgctgtgggaggtggtgagccagctggacaaggccaccgtggccaagctgggccccctgcccagagtgctggccgacatcaccaagagcctgaccaaccccacccccatccagcagcagctgagaagattcaccgagcacaacagcagccccaacgtgagcggcagcctgagcagcggcctgcagaagatcttcgaggaccccaccgacagcgacctgcacaagctgaagagccccagccaggacaacaccgacagctacttcagaggcaagaccctgctgctggtgcagcaggccagcagccagagcatgacctacagcgagaaggacgagagagagagcagcctgcccaacggcagaagcgtgagcctgatggacctgcaggacacccacgccgcccaggtggagcacgccagcgtgatgctggacgtgcccatcagactgaccggcagccagctgagcatcacccaggtggccagcatcaagcagctgagagagacccagagcaccccccagagcgccccccaggtgagaagacccctgcaccccgccctgaaccagcccggcggcctgcagcccctgagcttccagaaccccgtgtaccacctgaacaaccccatccccgccatgcccaaggccagcatcgacagcagcctggagaacctgagcaccgccagcagcagaagccagagcaacagcgaggacttcaagctgagcggccccagcaacagcagcatggaggacttcaccaagagaagcacccagagcgaggacttcagcagaagacacaccgtgcccgacagacacatccccctggccctgcccagacagaacagcaccggccaggcccagatcagaaaggtggaccagggcggcctgggcgccagagccaaggccccccccagcctgccccacagcgccagcctgagaagcaccggcagcatgagcgtggtgagcgccgccctggtggccgagcccgtgcagaacggcagcagaagcagacagcagagcagcagcagcagagagagccccgtgcccaaggtgagagccatccagagacagcagacccagcaggtgcagagccccgtggacagcgccaccatgagccccgtggagagaaccgccgcctgggtgctgaacaacggccagtacgaggaggacgtggaggagaccgagcagaacctggacgaggccaagcacgccgagaagtacgagcaggagatcaccaagctgaaggagagactgagagtgagcagcagaagactggaggagtacgagagaagactgctggtgcaggagcagcagatgcagaagctgctgctggagtacaaggccagactggaggacagcgaggagagactgagaagacagcaggaggagaaggacagccagatgaagagcatcatcagcagactgatggccgtggaggaggagctgaagaaggaccacgccgagatgcaggccgtgatcgacgccaagcagaagatcatcgacgcccaggagaagagaatcgtgagcctggacagcgccaacaccagactgatgagcgccctgacccaggtgaaggagagatacagcatgcaggtgagaaacggcatcagccccaccaaccccaccaagctgagcatcaccgagaacggcgagttcaagaacagcagctgctag

SEQ ID NO: 21474 - DNA, 2082 bp, Artificial Sequence
  Description of Artificial Sequence: Synthetic coding sequence
tgagaggtgttcgccagctggaagcagcagtgcctgaacagaggcaagcaggacatcagcgagagactgatcagcgccagcctgttcctgagattcctgtgccccgccatcatgagccccagcctgttcaacctgatgcaggagtaccccgacgacagaaccagcagaaccctgaccctgatcgccaaggtgatccagaacctggccaacttcgccaagttcggcaacaaggaggagtacatggccttcatgaacgacttcctggagcacgagtggggcggcatgaagagattcctgctggagatcagcaaccccgacaccatcagcaacacccccggcttcgacggctacatcgacctgggcagagagctgagcgtgctgcacagcctgctgtgggaggtggtgagccagctggacaagggcgagaacagcttcctgcaggccaccgtggccaagctgggccccctgcccagagtgctggccgacatcaccaagagcctgaccaaccccacccccatccagcagcagctgagaagattcaccgagcacaacagcagccccaacgtgagcggcagcctgagcagcggcctgcagaagatcttcgaggaccccaccgacagcgacctgcacaagctgaagagccccagccaggacaacaccgacagctacttcagaggcaagaccctgctgctggtgcagcaggccagcagccagagcatgacctacagcgagaaggacgagagagagagcagcctgcccaacggcagaagcgtgagcctgatggacctgcaggacacccacgccgcccaggtggagcacgccagcgtgatgctggacgtgcccatcagactgaccggcagccagctgagcatcacccaggtggccagcatcaagcagctgagagagacccagagcaccccccagagcgccccccaggtgagaagacccctgcaccccgccctgaaccagcccggcggcctgcagcccctgagcttccagaaccccgtgtaccacctgaacaaccccatccccgccatgcccaaggccagcatcgacagcagcctggagaacctgagcaccgccagcagcagaagccagagcaacagcgaggacttcaagctgagcggccccagcaacagcagcatggaggacttcaccaagagaagcacccagagcgaggacttcagcagaagacacaccgtgcccgacagacacatccccctggccctgcccagacagaacagcaccggccaggcccagatcagaaaggtggaccagggcggcctgggcgccagagccaaggccccccccagcctgccccacagcgccagcctgagaagcaccggcagcatgagcgtggtgagcgccgccctggtggccgagcccgtgcagaacggcagcagaagcagacagcagagcagcagcagcagagagagccccgtgcccaaggtgagagccatccagagacagcagacccagcaggtgcagagccccgtggacagcgccaccatgagccccgtggagagaaccgccgcctgggtgctgaacaacggccagtacgaggaggacgtggaggagaccgagcagaacctggacgaggccaagcacgccgagaagtacgagcaggagatcaccaagctgaaggagagactgagagtgagcagcagaagactggaggagtacgagagaagactgctggtgcaggagcagcagatgcagaagctgctgctggagtacaaggccagactggaggacagcgaggagagactgagaagacagcaggaggagaaggacagccagatgaagagcatcatcagcagactgatggccgtggaggaggagctgaagaaggaccacgccgagatgcaggccgtgatcgacgccaagcagaagatcatcgacgcccaggtgatcaacggcgacgagatcatccagaccggcaagaccgacagagtgcccggcttcagccagcaccagaccgacgagagagccgaccccagcgagggcgccgtgcagcacgccggcccccagtggcacctgccccaccagccccaccaggccttccaccacggcgagtggtag

SEQ ID NO: 21475 - DNA, 3810 bp, Artificial Sequence
  Description of Artificial Sequence: Synthetic coding sequence
atgttccccgccctggagagcgacagccccctgccccccgaggacctggacgccgtggtgcccgtgagcggcgccgtggccggcggcatgctggacagaatcctgctggagagcgtgtgccagcagcagagctgggtgagagtgtacgacgtgaagggcccccccacccacagactgagctgcggccagagcccctacaccgagaccaccacctgggagagaaagtactgcatcctgaccgacagccagctggtgctgctgaacaaggagaaggagatccccgtggagggcggccaggagcagcagaccgacagcaccaagggcagatgcctgagaagaaccgtgagcgtgcccagcgagggccagttccccgagtacccccccgagggcgccaccaagctggaggtgcccgccgagagaagccccagaagaagaagcatcagcggcaccagcaccagcgagaagcccaacagcatggacaccgccaacaccagccccttcaaggtgcccggcttcttcagcaagagactgaagggcagcatcaagagaaccaagagccagagcaagctggacagaaacaccagcttcagactgcccagcctgagaagcaccgacgacagaagcagaggcctgcccaagctgaaggagagcagaagccacgagagcctgctgagcccctgcagcaccgtggagtgcctggacctgggcagaggcgagcccgtgagcgtgaagcccctgcacagcagcatcctgggccaggacttctgcttcgaggtgacctacctgagcggcagcaagtgcttcagctgcaacagcgccagcgagagagacaagtggatggagaacctgagaagaaccgtgcagcccaacaaggacaactgcagaagagccgagaacgtgctgagactgtggatcatcgaggccaaggacctggcccccaagaagaagtacttctgcgagctgtgcctggacgacaccctgttcgccagaaccaccagcaagaccaaggccgacaacatcttctggggcgagcacttcgagttcttcagcctgccccccctgcacagcatcaccgtgcacatctacaaggacgtggagaagaagaagaagaaggacaagaacaactacgtgggcctggtgaacatccccaccgccagcgtgaccggcagacagttcgtggagaagtggtaccccgtgagcacccccacccccaacaagggcaagaccggcggccccagcatcagaatcaagagcagattccagaccatcaccatcctgcccatggagcagtacaaggagttcgccgagttcgtgaccagcaactacaccatgctgtgcagcgtgctggagcccgtgatcagcgtgagaaacaaggaggagctggcctgcgccctggtgcacatcctgcagagcaccggcagagccaaggacttcctgaccgacctggtgatgagcgaggtggacagatgcggcgagcacgacgtgctgatcttcagagagaacaccatcgccaccaagagcatcgaggagtacctgaagctggtgggccagcagtacctgcacgacgccctgggcgagttcatcaaggccctgtacgagagcgacgagaactgcgaggtggaccccagcaagtgcagcagcagcgagctgatcgaccaccagagcaacctgaagatgtgctgcgagctggccttctgcaagatcatcaacagctactgcgtgttccccagagagctgaaggaggtgttcgccagctggaagcagcagtgcctgaacagaggcaagcaggacatcagcgagagactgatcagcgccagcctgttcctgagattcctgtgccccgccatcatgagccccagcctgttcaacctgatgcaggagtaccccgacgacagaaccagcagaaccctgaccctgatcgccaaggtgatccagaacctggccaacttcgccaagttcggcaacaaggaggagtacatggccttcatgaacgacttcctggagcacgagtggggcggcatgaagagattcctgctggagatcagcaaccccgacaccatcagcaacacccccggcttcgacggctacatcgacctgggcagagagctgagcgtgctgcacagcctgctgtgggaggtggtgagccagctggacaagggcgagaacagcttcctgcaggccaccgtggccaagctgggccccctgcccagagtgctggccgacatcaccaagagcctgaccaaccccacccccatccagcagcagctgagaagattcaccgagcacaacagcagccccaacgtgagcggcagcctgagcagcggcctgcagaagatcttcgaggaccccaccgacagcgacctgcacaagctgaagagccccagccaggacaacaccgacagctacttcagaggcaagaccctgctgctggtgcagcaggccagcagccagagcatgacctacagcgagaaggacgagagagagagcagcctgcccaacggcagaagcgtgagcctgatggacctgcaggacacccacgccgcccaggtggagcacgccagcgtgatgctggacgtgcccatcagactgaccggcagccagctgagcatcacccaggtggccagcatcaagcagctgagagagacccagagcaccccccagagcgccccccaggtgagaagacccctgcaccccgccctgaaccagcccggcggcctgcagcccctgagcttccagaaccccgtgtaccacctgaacaaccccatccccgccatgcccaaggccagcatcgacagcagcctggagaacctgagcaccgccagcagcagaagccagagcaacagcgaggacttcaagctgagcggccccagcaacagcagcatggaggacttcaccaagagaagcacccagagcgaggacttcagcagaagacacaccgtgcccgacagacacatccccctggccctgcccagacagaacagcaccggccaggcccagatcagaaaggtggaccagggcggcctgggcgccagagccaaggccccccccagcctgccccacagcgccagcctgagaagcaccggcagcatgagcgtggtgagcgccgccctggtggccgagcccgtgcagaacggcagcagaagcagacagcagagcagcagcagcagagagagccccgtgcccaaggtgagagccatccagagacagcagacccagcaggtgcagagccccgtggacagcgccaccatgagccccgtggagagaaccgccgcctgggtgctgaacaacggccagtacgaggaggacgtggaggagaccgagcagaacctggacgaggccaagcacgccgagaagtacgagcaggagatcaccaagctgaaggagagactgagagtgagcagcagaagactggaggagtacgagagaagactgctggtgcaggagcagcagatgcagaagctgctgctggagtacaaggccagactggaggacagcgaggagagactgagaagacagcaggaggagaaggacagccagatgaagagcatcatcagcagactgatggccgtggaggaggagctgaagaaggaccacgccgagatgcaggccgtgatcgacgccaagcagaagatcatcgacgcccaggagaagagaatcgtgagcctggacagcgccaacaccagactgatgagcgccctgacccaggtgaaggagagatacagcatgcaggtgagaaacggcatcagccccaccaaccccaccaagctgagcatcaccgagaacggcgagttcaagaacagcagctgctag

SEQ ID NO: 21476 - DNA, 3420 bp, Artificial Sequence
  Description of Artificial Sequence: Synthetic coding sequence
atgcagacccccgaggtgcccgccgagagaagccccagaagaagaagcatcagcggcaccagcaccagcgagaagcccaacagcatggacaccgccaacaccagccccttcaaggtgcccggcttcttcagcaagagactgaagggcagcatcaagagaaccaagagccagagcaagctggacagaaacaccagcttcagactgcccagcctgagaagcaccgacgacagaagcagaggcctgcccaagctgaaggagagcagaagccacgagagcctgctgagcccctgcagcaccgtggagtgcctggacctgggcagaggcgagcccgtgagcgtgaagcccctgcacagcagcatcctgggccaggacttctgcttcgaggtgacctacctgagcggcagcaagtgcttcagctgcaacagcgccagcgagagagacaagtggatggagaacctgagaagaaccgtgcagcccaacaaggacaactgcagaagagccgagaacgtgctgagactgtggatcatcgaggccaaggacctggcccccaagaagaagtacttctgcgagctgtgcctggacgacaccctgttcgccagaaccaccagcaagaccaaggccgacaacatcttctggggcgagcacttcgagttcttcagcctgccccccctgcacagcatcaccgtgcacatctacaaggacgtggagaagaagaagaagaaggacaagaacaactacgtgggcctggtgaacatccccaccgccagcgtgaccggcagacagttcgtggagaagtggtaccccgtgagcacccccacccccaacaagggcaagaccggcggccccagcatcagaatcaagagcagattccagaccatcaccatcctgcccatggagcagtacaaggagttcgccgagttcgtgaccagcaactacaccatgctgtgcagcgtgctggagcccgtgatcagcgtgagaaacaaggaggagctggcctgcgccctggtgcacatcctgcagagcaccggcagagccaaggacttcctgaccgacctggtgatgagcgaggtggacagatgcggcgagcacgacgtgctgatcttcagagagaacaccatcgccaccaagagcatcgaggagtacctgaagctggtgggccagcagtacctgcacgacgccctgggcgagttcatcaaggccctgtacgagagcgacgagaactgcgaggtggaccccagcaagtgcagcagcagcgagctgatcgaccaccagagcaacctgaagatgtgctgcgagctggccttctgcaagatcatcaacagctactgcgtgttccccagagagctgaaggaggtgttcgccagctggaagcagcagtgcctgaacagaggcaagcaggacatcagcgagagactgatcagcgccagcctgttcctgagattcctgtgccccgccatcatgagccccagcctgttcaacctgatgcaggagtaccccgacgacagaaccagcagaaccctgaccctgatcgccaaggtgatccagaacctggccaacttcgccaagttcggcaacaaggaggagtacatggccttcatgaacgacttcctggagcacgagtggggcggcatgaagagattcctgctggagatcagcaaccccgacaccatcagcaacacccccggcttcgacggctacatcgacctgggcagagagctgagcgtgctgcacagcctgctgtgggaggtggtgagccagctggacaagggcgagaacagcttcctgcaggccaccgtggccaagctgggccccctgcccagagtgctggccgacatcaccaagagcctgaccaaccccacccccatccagcagcagctgagaagattcaccgagcacaacagcagccccaacgtgagcggcagcctgagcagcggcctgcagaagatcttcgaggaccccaccgacagcgacctgcacaagctgaagagccccagccaggacaacaccgacagctacttcagaggcaagaccctgctgctggtgcagcaggccagcagccagagcatgacctacagcgagaaggacgagagagagagcagcctgcccaacggcagaagcgtgagcctgatggacctgcaggacacccacgccgcccaggtggagcacgccagcgtgatgctggacgtgcccatcagactgaccggcagccagctgagcatcacccaggtggccagcatcaagcagctgagagagacccagagcaccccccagagcgccccccaggtgagaagacccctgcaccccgccctgaaccagcccggcggcctgcagcccctgagcttccagaaccccgtgtaccacctgaacaaccccatccccgccatgcccaaggccagcatcgacagcagcctggagaacctgagcaccgccagcagcagaagccagagcaacagcgaggacttcaagctgagcggccccagcaacagcagcatggaggacttcaccaagagaagcacccagagcgaggacttcagcagaagacacaccgtgcccgacagacacatccccctggccctgcccagacagaacagcaccggccaggcccagatcagaaaggtggaccagggcggcctgggcgccagagccaaggccccccccagcctgccccacagcgccagcctgagaagcaccggcagcatgagcgtggtgagcgccgccctggtggccgagcccgtgcagaacggcagcagaagcagacagcagagcagcagcagcagagagagccccgtgcccaaggtgagagccatccagagacagcagacccagcaggtgcagagccccgtggacagcgccaccatgagccccgtggagagaaccgccgcctgggtgctgaacaacggccagtacgaggaggacgtggaggagaccgagcagaacctggacgaggccaagcacgccgagaagtacgagcaggagatcaccaagctgaaggagagactgagagtgagcagcagaagactggaggagtacgagagaagactgctggtgcaggagcagcagatgcagaagctgctgctggagtacaaggccagactggaggacagcgaggagagactgagaagacagcaggaggagaaggacagccagatgaagagcatcatcagcagactgatggccgtggaggaggagctgaagaaggaccacgccgagatgcaggccgtgatcgacgccaagcagaagatcatcgacgcccaggagaagagaatcgtgagcctggacagcgccaacaccagactgatgagcgccctgacccaggtgaaggagagatacagcatgcaggtgagaaacggcatcagccccaccaaccccaccaagctgagcatcaccgagaacggcgagttcaagaacagcagctgctag

SEQ ID NO: 21477 - DNA, 3036 bp, Artificial Sequence
  Description of Artificial Sequence: Synthetic coding sequence
atggacccccccagccccagcagaaccagccagacccagcccaccgccaccagccccctgaccagctacagatggcacaccggcggcggcggcgagaaggccgccggcggcttcagatggggcagattcgccggctggggcagagccctgagccaccaggagcccatggtgagcacccagcccgcccccagaagcatcttcagaagagtgctgagcgccccccccaaggagagcagaaccagcagactgagactgagcaaggccctgtggggcagacacaagaaccccccccccgagcccgaccccgagcccgagcaggaggcccccgagctggagcccgagcccgagctggagccccccaccccccagatccccgaggcccccacccccaacgtgcccgtgtgggacatcggcggcttcaccctgctggacggcaagctggtgctgctgggcggcgaggaggagggccccagaagacccagagtgggcagcgccagcagcgagggcagcatccacgtggccatgggcaacttcagagaccccgacagaatgcccggcaagaccgagcccgagaccgccggccccaaccaggtgcacaacgtgagaggcctgctgaagagactgaaggagaagaagaaggccagactggagcccagagacggcccccccagcgccctgggcagcagagagagcctggccaccctgagcgagctggacctgggcgccgagagagacgtgagaatctggcccctgcaccccagcctgctgggcgagccccactgcttccaggtgacctggaccggcggcagcagatgcttcagctgcagaagcgccgccgagagagacagatggatcgaggacctgagaagacagttccagcccacccaggacaacgtggagagagaggagacctggctgagcgtgtgggtgcacgaggccaagggcctgcccagagccgccgccggcgcccccggcgtgagagccgagctgtggctggacggcgccctgctggccagaaccgcccccagagccggccccggccagctgttctgggccgagagattccacttcgaggccctgccccccgccagaagactgagcctgagactgagaggcctgggccccggcagcgccgtgctgggcagagtggccctggccctggaggagctggacgcccccagagcccccgccgccggcctggagagatggttccccctgctgggcgcccccgccggcgccgccctgagagccagaatcagagccagaagactgagagtgctgcccagcgagagatacaaggagctggccgagttcctgaccttccactacgccagactgtgcggcgccctggagcccgccctgcccgcccaggccaaggaggagctggccgccgccatggtgagagtgctgagagccaccggcagagcccaggccctggtgaccgacctgggcaccgccgagctggccagatgcggcggcagagaggccctgctgttcagagagaacaccctggccaccaaggccatcgacgagtacatgaagctggtggcccaggactacctgcaggagaccctgggccaggtggtgagaagactgtgcgccagcaccgaggactgcgaggtggaccccagcaagtgccccgccagcgagctgcccgagcaccaggccagactgagaaacagctgcgaggaggtgttcgagaccatcatccacagctacgactggttccccgccgagctgggcatcgtgttcagcagctggagagaggcctgcaaggagagaggcagcgaggtgctgggccccagactggtgtgcgccagcctgttcctgagactgctgtgccccgccatcctggcccccagcctgttcggcctggcccccgaccaccccgcccccggccccgccagaaccctgaccctgatcgccaaggtgatccagaacctggccaacagagcccccttcggcgagaaggaggcctacatgggcttcatgaacagcttcctggaggagcacggccccgccatgcagtgcttcctggaccaggtggccatggtggacgtggacgccgcccccagcggctaccagggcagcggcgacctggccctgcagctggccgtgctgcacgcccagctgtgcaccatcttcgccgagctggaccagaccaccagagacaccctggagcccctgcccaccatcctgagagccatcgaggagggccagcccgtgctggtgagcgtgcccatgagactgcccctgccccccgcccaggtgcacagcagcctgagcgccggcgagaagcccggcttcctggcccccagagacctgcccaagcacacccccctgatcagcaagagccagagcctgagaagcgtgagaagaagcgagagctgggccagacccagacccgacgaggagagacccctgagaagacccagacccgtgcagagaacccagagcgtgcccgtgagaagacccgccagaagaagacagagcgccggcccctggcccagacccaagggcagcctgagcatgggccccgcccccagagccagaccctggaccagagacagcgccagcctgcccagaaagcccagcgtgccctggcagagacagatggaccagccccaggacagaaaccaggccctgggcacccacagacccgtgaacaagctggccgagctgcagtgcgaggtggccgccctgagagaggagcagaaggtgctgagcagactggtggagagcctgagcacccagatcagagccctgaccgagcagcaggagcagctgagaggccagctgcaggacctggacagcagactgagagccggcagcagcgagttcgacagcgagcacaacctgaccagcaacgagggccacagcctgaagaacctggagcacagactgaacgagatggagagaacccaggcccagctgagagacgccgtgcagagcctgcagctgagccccagaaccagaggcagctggagccagccccagcccctgaaggccccctgcctgaacggcgacaccacctag

SEQ ID NO: 21478 - DNA, 711 bp, Artificial Sequence
  Description of Artificial Sequence: Synthetic coding sequence
atggagagatggctgttcctgggcgccaccgaggagggccccaagagaaccatggacagcggcaccagacccgtgggcagctgctgcagcagccccgccggcctgagcagagagtacaagctggtgatgctgggcgccggcggcgtgggcaagagcgccatgaccatgcagttcatcagccacagattccccgaggaccacgaccccaccatcgaggacgcctacaagatcagaatcagaatcgacgacgagcccgccaacctggacatcctggacaccgccggccaggccgagttcaccgccatgagagaccagtacatgagagccggcgagggcttcatcatctgctacagcatcaccgacagaagaagcttccacgaggtgagagagttcaagcagctgatctacagagtgagaagaaccgacgacacccccgtggtgctggtgggcaacaagagcgacctgaagcagctgagacaggtgaccaaggaggagggcctggccctggccagagagttcagctgccccttcttcgagaccagcgccgcctacagatactacatcgacgacgtgttccacgccctggtgagagagatcagaagaaaggagaaggaggccgtgctggccatggagaagaagagcaagcccaagaacagcgtgtggaagagactgaagagccccttcagaaagaagaaggacagcgtgacctag

SEQ ID NO: 21479 - DNA, 660 bp, Artificial Sequence
  Description of Artificial Sequence: Synthetic coding sequence
atggacagcggcaccagacccgtgggcagctgctgcagcagccccgccggcctgagcagagagtacaagctggtgatgctgggcgccggcggcgtgggcaagagcgccatgaccatgcagttcatcagccacagattccccgaggaccacgaccccaccatcgaggacgcctacaagatcagaatcagaatcgacgacgagcccgccaacctggacatcctggacaccgccggccaggccgagttcaccgccatgagagaccagtacatgagagccggcgagggcttcatcatctgctacagcatcaccgacagaagaagcttccacgaggtgagagagttcaagcagctgatctacagagtgagaagaaccgacgacacccccgtggtgctggtgggcaacaagagcgacctgaagcagctgagacaggtgaccaaggaggagggcctggccctggccagagagttcagctgccccttcttcgagaccagcgccgcctacagatactacatcgacgacgtgttccacgccctggtgagagagatcagaagaaaggagaaggaggccgtgctggccatggagaagaagagcaagcccaagaacagcgtgtggaagagactgaagagccccttcagaaagaagaaggacagcgtgacctag

SEQ ID NO: 21480 - DNA, 552 bp, Artificial Sequence
  Description of Artificial Sequence: Synthetic coding sequence
atgaccatgcagttcatcagccacagattccccgaggaccacgaccccaccatcgaggacgcctacaagatcagaatcagaatcgacgacgagcccgccaacctggacatcctggacaccgccggccaggccgagttcaccgccatgagagaccagtacatgagagccggcgagggcttcatcatctgctacagcatcaccgacagaagaagcttccacgaggtgagagagttcaagcagctgatctacagagtgagaagaaccgacgacacccccgtggtgctggtgggcaacaagagcgacctgaagcagctgagacaggtgaccaaggaggagggcctggccctggccagagagttcagctgccccttcttcgagaccagcgccgcctacagatactacatcgacgacgtgttccacgccctggtgagagagatcagaagaaaggagaaggaggccgtgctggccatggagaagaagagcaagcccaagaacagcgtgtggaagagactgaagagccccttcagaaagaagaaggacagcgtgacctag

SEQ ID NO: 21481 - DNA, 462 bp, Artificial Sequence
  Description of Artificial Sequence: Synthetic coding sequence
atggaggtggagaacgaggccagctgcagccccggcagcgccagcggcggcagcagagagtacaaggtggtgatgctgggcgccggcggcgtgggcaagagcgccatgaccatgcagttcatcagccaccagttccccgactaccacgaccccaccatcgaggacgcctacaagacccaggtgagaatcgacaacgagcccgcctacctggacatcctggacaccgccggccaggccgagttcaccgccatgagagagcagtacatgagaggcggcgagggcttcatcatctgctacagcgtgaccgacagacagagcttccaggaggccgccaagttcaaggagctgatcttccaggtgagacacacctacgagatccccctggtgctggtgggcaacaagatcgacctggagcagttcagacagcccaccctgaaggagttcggcagagaggagttctag

SEQ ID NO: 21482 - DNA, 654 bp, Artificial Sequence
  Description of Artificial Sequence: Synthetic coding sequence
atggaggtggagaacgaggccagctgcagccccggcagcgccagcggcggcagcagagagtacaaggtggtgatgctgggcgccggcggcgtgggcaagagcgccatgaccatgcagttcatcagccaccagttccccgactaccacgaccccaccatcgaggacgcctacaagacccaggtgagaatcgacaacgagcccgcctacctggacatcctggacaccgccggccaggccgagttcaccgccatgagagagcagtacatgagaggcggcgagggcttcatcatctgctacagcgtgaccgacagacagagcttccaggaggccgccaagttcaaggagctgatcttccaggtgagacacacctacgagatccccctggtgctggtgggcaacaagatcgacctggagcagttcagacaggtgagcaccgaggagggcctgagcctggcccaggagtacaactgcggcttcttcgagaccagcgccgccctgagattctgcatcgacgacgccttccacggcctggtgagagagatcagaaagaaggagagcatgcccagcctgatggagaagaagctgaagagaaaggacagcctgtggaagaagctgaagggcagcctgaagaagaagagagagaacatgacctag

SEQ ID NO: 21483 - DNA, 240 bp, Artificial Sequence
  Description of Artificial Sequence: Synthetic coding sequence
atgcccgtggccgtgggcccctacggccagagccagcccagctgcttcgacagagtgaagatgggcttcgtgatgggctgcgccgtgggcatggccgccggcgccctgttcggcaccttcagctgcctgagaatcggcatgagaggcagagagctgatgggcggcatcggcaagaccatgatgcagagcggcggcaccttcggcaccttcatggccatcggcatgggcatcagatgctag

SEQ ID NO: 21484 - DNA, 240 bp, Artificial Sequence; identical to SEQ ID NO: 21483
  Description of Artificial Sequence: Synthetic coding sequence

SEQ ID NO: 21485 - DNA, 240 bp, Artificial Sequence; identical to SEQ ID NO: 21483
  Description of Artificial Sequence: Synthetic coding sequence

SEQ ID NO: 21486 - DNA, 240 bp, Artificial Sequence; identical to SEQ ID NO: 21483
  Description of Artificial Sequence: Synthetic coding sequence

SEQ ID NO: 21487 - DNA, 792 bp, Artificial Sequence
  Description of Artificial Sequence: Synthetic coding sequence
atgagaatcttcagaccctggagactgagatgccccgccctgcacctgcccagcctgagcgtgttcagcctgagatggaagctgcccagcctgaccaccgacgagaccatgtgcaagagcgtgaccaccgacgagtggaagaaggtgttctacgagaagatggaggaggccaagcccgccgacagctgggacctgatcatcgaccccaacctgaagcacaacgtgctgagccccggctggaagcagtacctggagctgcacgccagcggcagattccactgcagctggtgctggcacacctggcagagcccctacgtggtgatcctgttccacatgttcctggacagagcccagagagccggcagcgtgagaatgagagtgttcaagcagctgtgctacgagtgcggcaccgccagactggacgagagcagcatgctggaggagaacatcgagggcctggtggacaacctgatcaccagcctgagagagcagtgctacggcgagagaggcggccagtacagaatccacgtggccagcagacaggacaacagaagacacagaggcgagttctgcgaggcctgccaggagggcatcgtgcactggaagcccagcgagaagctgctggaggaggaggccaccacctacaccttcagcagagcccccagccccaccaagagccaggaccagaccggcagcggctggaacttctgcagcatcccctggtgcctgttctgggccaccgtgctgctgctgatcatctacctgcagttcagcttcagaagcagcgtgtag

SEQ ID NO: 21488 - DNA, 678 bp, Artificial Sequence
  Description of Artificial Sequence: Synthetic coding sequence
atgtgcaccagcctgaccacctgcgagtggaagaaggtgttctacgagaagatggaggtggccaagcccgccgacagctgggagctgatcatcgaccccaacctgaagcccagcgagctggcccccggctggaagcagtacctggagcagcacgccagcggcagattccactgcagctggtgctggcacacctggcagagcgcccacgtggtgatcctgttccacatgttcctggacagagcccagagagccggcagcgtgagaatgagagtgttcaagcagctgtgctacgagtgcggcaccgccagactggacgagagcagcatgctggaggagaacatcgagggcctggtggacaacctgatcaccagcctgagagagcagtgctacgaggaggacggcggccagtacagaatccacgtggccagcagacccgacagcggcccccacagagccgagttctgcgaggcctgccaggagggcatcgtgcactggaagcccagcgagaagctgctggaggaggaggtgaccacctacaccagcgaggccagcaagcccagagcccaggccggcagcggctacaacttcctgagcctgagatggtgcctgttctgggccagcctgtgcctgctggtggtgtacctgcagttcagcttcctgagccccgccttcttctag

SEQ ID NO: 21489 - DNA, 2016 bp, Artificial Sequence
  Description of Artificial Sequence: Synthetic coding sequence
atgcagcccgacatgagcctgaacgtgatcaagatgaagagcagcgacttcctggagagcgccgagctggacagcggcggcttcggcaaggtgagcctgtgcttccacagaacccagggcctgatgatcatgaagaccgtgtacaagggccccaactgcatcgagcacaacgaggccctgctggaggaggccaagatgatgaacagactgagacacagcagagtggtgaagctgctgggcgtgatcatcgaggagggcaagtacagcctggtgatggagtacatggagaagggcaacctgatgcacgtgctgaaggccgagatgagcacccccctgagcgtgaagggcagaatcatcctggagatcatcgagggcatgtgctacctgcacggcaagggcgtgatccacaaggacctgaagcccgagaacatcctggtggacaacgacttccacatcaagatcgccgacctgggcctggccagcttcaagatgtggagcaagctgaacaacgaggagcacaacgagctgagagaggtggacggcaccgccaagaagaacggcggcaccctgtactacatggcccccgagcacctgaacgacgtgaacgccaagcccaccgagaagagcgacgtgtacagcttcgccgtggtgctgtgggccatcttcgccaacaaggagccctacgagaacgccatctgcgagcagcagctgatcatgtgcatcaagagcggcaacagacccgacgtggacgacatcaccgagtactgccccagagagatcatcagcctgatgaagctgtgctgggaggccaaccccgaggccagacccaccttccccggcatcgaggagaagttcagacccttctacctgagccagctggaggagagcgtggaggaggacgtgaagagcctgaagaaggagtacagcaacgagaacgccgtggtgaagagaatgcagagcctgcagctggactgcgtggccgtgcccagcagcagaagcaacagcgccaccgagcagcccggcagcctgcacagcagccagggcctgggcatgggccccgtggaggagagctggttcgcccccagcctggagcacccccaggaggagaacgagcccagcctgcagagcaagctgcaggacgaggccaactaccacctgtacggcagcagaatggacagacagaccaagcagcagcccagacagaacgtggcctacaacagagaggaggagagaagaagaagagtgagccacgaccccttcgcccagcagagaccctacgagaacttccagaacaccgagggcaagggcaccgcctacagcagcgccgccagccacggcaacgccgtgcaccagcccagcggcctgaccagccagccccaggtgctgtaccagaacaacggcctgtacagcagccacggcttcggcaccagacccctggaccccggcaccgccggccccagagtgtggtacagacccatccccagccacatgcccagcctgcacaacatccccgtgcccgagaccaactacctgggcaacacccccaccatgcccttcagcagcctgccccccaccgacgagagcatcaagtacaccatctacaacagcaccggcatccagatcggcgcctacaactacatggagatcggcggcaccagcagcagcctgctggacagcaccaacaccaacttcaaggaggagcccgccgccaagtaccaggccatcttcgacaacaccaccagcctgaccgacaagcacctggaccccatcagagagaacctgggcaagcactggaagaactgcgccagaaagctgggcttcacccagagccagatcgacgagatcgaccacgactacgagagagacggcctgaaggagaaggtgtaccagatgctgcagaagtgggtgatgagagagggcatcaagggcgccaccgtgggcaagctggcccaggccctgcaccagtgcagcagaatcgacctgctgagcagcctgatctacgtgagccagaactag

SEQ ID NO: 21490 - DNA, 2016 bp, Artificial Sequence; identical to SEQ ID NO: 21489
  Description of Artificial Sequence: Synthetic coding sequence

SEQ ID NO: 21491 - DNA, 822 bp, Artificial Sequence
  Description of Artificial Sequence: Synthetic coding sequence
atgagccccgcctgcagagtgaacagcaagaccaagcccaccaccatcttcatggccgccgcctggaccggcagaagaaacagcagccccgacagaatgtggctgaccaccgagagaagaaagggcgacgccggcagccccatgaccctgctgcacagacccagcggcctgaccagccagccccaggtgctgtaccagaacaacggcctgtacagcagccacggcttcggcaccagacccctggaccccggcaccgccggccccagagtgtggtacagacccatccccagccacatgcccagcctgcacaacatccccgtgcccgagaccaactacctgggcaacacccccaccatgcccttcagcagcctgccccccaccgacgagagcatcaagtacaccatctacaacagcaccggcatccagatcggcgcctacaactacatggagatcggcggcaccagcagcagcctgctggacagcaccaacaccaacttcaaggaggagcccgccgccaagtaccaggccatcttcgacaacaccaccagcctgaccgacaagcacctggaccccatcagagagaacctgggcaagcactggaagaactgcgccagaaagctgggcttcacccagagccagatcgacgagatcgaccacgactacgagagagacggcctgaaggagaaggtgtaccagatgctgcagaagtgggtgatgagagagggcatcaagggcgccaccgtgggcaagctggcccaggccctgcaccagtgcagcagaatcgacctgctgagcagcctgatctacgtgagccagaactag

SEQ ID NO: 21492 - DNA, 1878 bp, Artificial Sequence
  Description of Artificial Sequence: Synthetic coding sequence
atgcagcccgacatgagcctgaacgtgatcaagatgaagagcagcgacttcctggagagcgccgagctggacagcggcggcttcggcaaggtgagcctgtgcttccacagaacccagggcctgatgatcatgaagaccgtgtacaagggccccaactgcatcgagcacaacgaggccctgctggaggaggccaagatgatgaacagactgagacacagcagagtggtgaagctgctgggcgtgatcatcgaggagggcaagtacagcctggtgatggagtacatggagaagggcaacctgatgcacgtgctgaaggccgagatcgccgacctgggcctggccagcttcaagatgtggagcaagctgaacaacgaggagcacaacgagctgagagaggtggacggcaccgccaagaagaacggcggcaccctgtactacatggcccccgagcacctgaacgacgtgaacgccaagcccaccgagaagagcgacgtgtacagcttcgccgtggtgctgtgggccatcttcgccaacaaggagccctacgagaacgccatctgcgagcagcagctgatcatgtgcatcaagagcggcaacagacccgacgtggacgacatcaccgagtactgccccagagagatcatcagcctgatgaagctgtgctgggaggccaaccccgaggccagacccaccttccccggcatcgaggagaagttcagacccttctacctgagccagctggaggagagcgtggaggaggacgtgaagagcctgaagaaggagtacagcaacgagaacgccgtggtgaagagaatgcagagcctgcagctggactgcgtggccgtgcccagcagcagaagcaacagcgccaccgagcagcccggcagcctgcacagcagccagggcctgggcatgggccccgtggaggagagctggttcgcccccagcctggagcacccccaggaggagaacgagcccagcctgcagagcaagctgcaggacgaggccaactaccacctgtacggcagcagaatggacagacagaccaagcagcagcccagacagaacgtggcctacaacagagaggaggagagaagaagaagagtgagccacgaccccttcgcccagcagagaccctacgagaacttccagaacaccgagggcaagggcaccgcctacagcagcgccgccagccacggcaacgccgtgcaccagcccagcggcctgaccagccagccccaggtgctgtaccagaacaacggcctgtacagcagccacggcttcggcaccagacccctggaccccggcaccgccggccccagagtgtggtacagacccatccccagccacatgcccagcctgcacaacatccccgtgcccgagaccaactacctgggcaacacccccaccatgcccttcagcagcctgccccccaccgacgagagcatcaagtacaccatctacaacagcaccggcatccagatcggcgcctacaactacatggagatcggcggcaccagcagcagcctgctggacagcaccaacaccaacttcaaggaggagcccgccgccaagtaccaggccatcttcgacaacaccaccagcctgaccgacaagcacctggaccccatcagagagaacctgggcaagcactggaagaactgcgccagaaagctgggcttcacccagagccagatcgacgagatcgaccacgactacgagagagacggcctgaaggagaaggtgtaccagatgctgcagaagtgggtgatgagagagggcatcaagggcgccaccgtgggcaagctggcccaggccctgcaccagtgcagcagaatcgacctgctgagcagcctgatctacgtgagccagaactag

SEQ ID NO: 21493 - DNA, 522 bp, Artificial Sequence
  Description of Artificial Sequence: Synthetic coding sequence
atgcagagcgagctgtgcttcgccgacatccacgacagcgacggcagcagcagcagcagccaccagagcctgaagagcaccgccaagtgggccgccagcctggagaacctgctggaggaccccgagggcgtgaagagattcagagagttcctgaagaaggagttcagcgaggagaacgtgctgttctggctggcctgcgaggacttcaagaagatgcaggacaagacccagatgcaggagaaggccaaggagatctacatgaccttcctgagcagcaaggccagcagccaggtgaacgtggagggccagagcagactgaacgagaagatcctggaggagccccaccccctgatgttccagaagctgcaggaccagatcttcaacctgatgaagtacgacagctacagcagattcctgaagagcgacctgttcctgaagcacaagagaaccgaggaggaggaggaggacctgcccgacgcccagaccgccgccaagagagccagcagaatctacaacacctag

SEQ ID NO: 21494 - DNA, 546 bp, Artificial Sequence
  Description of Artificial Sequence: Synthetic coding sequence
atgttcaacagagccgtgagcagactgagcagaaagagaccccccagcgacatccacgacagcgacggcagcagcagcagcagccaccagagcctgaagagcaccgccaagtgggccgccagcctggagaacctgctggaggaccccgagggcgtgaagagattcagagagttcctgaagaaggagttcagcgaggagaacgtgctgttctggctggcctgcgaggacttcaagaagatgcaggacaagacccagatgcaggagaaggccaaggagatctacatgaccttcctgagcagcaaggccagcagccaggtgaacgtggagggccagagcagactgaacgagaagatcctggaggagccccaccccctgatgttccagaagctgcaggaccagatcttcaacctgatgaagtacgacagctacagcagattcctgaagagcgacctgttcctgaagcacaagagaaccgaggaggaggaggaggacctgcccgacgcccagaccgccgccaagagagccagcagaatctacaacacctag

SEQ ID NO: 21495 - DNA, 504 bp, Artificial Sequence
  Description of Artificial Sequence: Synthetic coding sequence
atggagcacatccacgacagcgacggcagcagcagcagcagccaccagagcctgaagagcaccgccaagtgggccgccagcctggagaacctgctggaggaccccgagggcgtgaagagattcagagagttcctgaagaaggagttcagcgaggagaacgtgctgttctggctggcctgcgaggacttcaagaagatgcaggacaagacccagatgcaggagaaggccaaggagatctacatgaccttcctgagcagcaaggccagcagccaggtgaacgtggagggccagagcagactgaacgagaagatcctggaggagccccaccccctgatgttccagaagctgcaggaccagatcttcaacctgatgaagtacgacagctacagcagattcctgaagagcgacctgttcctgaagcacaagagaaccgaggaggaggaggaggacctgcccgacgcccagaccgccgccaagagagccagcagaatctacaacacctag

SEQ ID NO: 21496 - DNA, 1341 bp, Artificial Sequence
  Description of Artificial Sequence: Synthetic coding sequence
atggagagagtggtggtgagcatgcaggaccccgaccagggcgtgaagatgagaagccagagactgctggtgaccgtgatcccccacgccgtgaccggcagcgacgtggtgcagtggctggcccagaagttctgcgtgagcgaggaggaggccctgcacctgggcgccgtgctggtgcagcacggctacatctaccccctgagagaccccagaagcctgatgctgagacccgacgagaccccctacagattccagaccccctacttctggaccagcaccctgagacccgccgccgagctggactacgccatctacctggccaagaagaacatcagaaagagaggcaccctggtggactacgagaaggactgctacgacagactgcacaagaagatcaaccacgcctgggacctggtgctgatgcaggccagagagcagctgagagccgccaagcagagaagcaagggcgacagactggtgatcgcctgccaggagcagacctactggctggtgaacagacccccccccggcgcccccgacgtgctggagcagggccccggcagaggcagctgcgccgccagcagagtgctgatgaccaagagcgccgacttccacaagagagagatcgagtacttcagaaaggccctgggcagaaccagagtgaagagcagcgtgtgcctggaggcctacctgagcttctgcggccagagaggcccccacgaccccctggtgagcggctgcctgcccagcaacccctggatcagcgacaacgacgcctactgggtgatgaacgcccccaccgtggccgcccccaccaagctgagagtggagagatggggcttcagcttcagagagctgctggaggaccccgtgggcagagcccacttcatggacttcctgggcaaggagttcagcggcgagaacctgagcttctgggaggcctgcgaggagctgagatacggcgcccaggcccaggtgcccaccctggtggacgccgtgtacgagcagttcctggcccccggcgccgcccactgggtgaacatcgacagcagaaccatggagcagaccctggagggcctgagacagccccacagatacgtgctggacgacgcccagctgcacatctacatgctgatgaagaaggacagctaccccagattcctgaagagcgacatgtacaaggccctgctggccgaggccggcatccccctggagatgaagagaagagtgttccccttcacctggagacccagacacagcagccccagccccgccctgctgcccacccccgtggagcccaccgccgcctgcggccccggcggcggcgacggcgtggcctag

SEQ ID NO: 21497 - DNA, 786 bp, Artificial Sequence
  Description of Artificial Sequence: Synthetic coding sequence
atggccgccggccccgcccccccccccggcagacccagagcccagatgccccacctgagaaagatggagagagtggtggtgagcatgcaggaccccgaccagggcgtgaagatgagaagccagagactgctggtgaccgtgatcccccacgccgtgaccggcagcgacgtggtgcagtggctggcccagaagttctgcgtgagcgaggaggaggccctgcacctgggcgccgtgctggtgcagcacggctacatctaccccctgagagaccccagaagcctgatgctgagacccgacgagaccccctacagattccagaccccctacttctggaccagcaccctgagacccgccgccgagctggactacgccatctacctggccaagaagaacatcagaaagagaggcaccctggtggactacgagaaggactgctacgacagactgcacaagaagatcaaccacgcctgggacctggtgctgatgcaggccagagagcagctgagagccgccaagcagagaagcaagggcgacagactggtgatcgcctgccaggagcagacctactggctggtgaacagacccccccccggcgcccccgacgtgctggagcagggccccggcagaggcagctgcgccgccagcagagtgctgatggtggaggccagcagaaccagaggcaccagacccgagggcgccagcgagcccagaagcagcaagaccctgtgcagcaaccagagccaccccgaccccaccagcggcaagatgcacctggagccccactag

SEQ ID NO: 21498 - DNA, 1404 bp, Artificial Sequence
  Description of Artificial Sequence: Synthetic coding sequence
atggccgccggccccgcccccccccccggcagacccagagcccagatgccccacctgagaaagatggagagagtggtggtgagcatgcaggaccccgaccagggcgtgaagatgagaagccagagactgctggtgaccgtgatcccccacgccgtgaccggcagcgacgtggtgcagtggctggcccagaagttctgcgtgagcgaggaggaggccctgcacctgggcgccgtgctggtgcagcacggctacatctaccccctgagagaccccagaagcctgatgctgagacccgacgagaccccctacagattccagaccccctacttctggaccagcaccctgagacccgccgccgagctggactacgccatctacctggccaagaagaacatcagaaagagaggcaccctggtggactacgagaaggactgctacgacagactgcacaagaagatcaaccacgcctgggacctggtgctgatgcaggccagagagcagctgagagccgccaagcagagaagcaagggcgacagactggtgatcgcctgccaggagcagacctactggctggtgaacagacccccccccggcgcccccgacgtgctggagcagggccccggcagaggcagctgcgccgccagcagagtgctgatgaccaagagcgccgacttccacaagagagagatcgagtacttcagaaaggccctgggcagaaccagagtgaagagcagcgtgtgcctggaggcctacctgagcttctgcggccagagaggcccccacgaccccctggtgagcggctgcctgcccagcaacccctggatcagcgacaacgacgcctactgggtgatgaacgcccccaccgtggccgcccccaccaagctgagagtggagagatggggcttcagcttcagagagctgctggaggaccccgtgggcagagcccacttcatggacttcctgggcaaggagttcagcggcgagaacctgagcttctgggaggcctgcgaggagctgagatacggcgcccaggcccaggtgcccaccctggtggacgccgtgtacgagcagttcctggcccccggcgccgcccactgggtgaacatcgacagcagaaccatggagcagaccctggagggcctgagacagccccacagatacgtgctggacgacgcccagctgcacatctacatgctgatgaagaaggacagctaccccagattcctgaagagcgacatgtacaaggccctgctggccgaggccggcatccccctggagatgaagagaagagtgttccccttcacctggagacccagacacagcagccccagccccgccctgctgcccacccccgtggagcccaccgccgcctgcggccccggcggcggcgacggcgtggcctag

SEQ ID NO: 21499 - DNA, 405 bp, Artificial Sequence
  Description of Artificial Sequence: Synthetic coding sequence
atggccaccagcaccagatgcgccacccccgtggccagctgcagcggccagaccagaagacccaccggcagcagaagcggcagcggcgtgcaggtgggcgccggcggcacccccacccccacccaccccgcctaccagctgggcgagaccggcggcgcccccagcctgctgggcctggagtgggacagcgccatgagcccctgggccggcggccccagcccccccccccagaagagctggaccgccagcaccgacgtggtgagaagaaccagactgagagacggcgccagcgtgttcctgggcaccaccgccggcccccacaagggcagctacgtgcagagaatcctgcccagcagctggggcagcctgggccccggccccgagggcggcgccgtgaaggcctag

SEQ ID NO: 21500 - DNA, 480 bp, Artificial Sequence
  Description of Artificial Sequence: Synthetic coding sequence
atgagcagaagaaactgctggatctgcaagatgtgcagagacgagagcaagagaccccccagcaacctgaccctggaggaggtgctgcagtgggcccagagcttcgagaacctgatggccaccaagtacggccccgtggtgtacgccgcctacctgaagatggagcacagcgacgagaacatccagttctggatggcctgcgagacctacaagaagatcgccagcagatggagcagaatcagcagagccaagaagctgtacaagatctacatccagccccagagccccagagagatcaacatcgacagcagcaccagagagaccatcatcagaaacatccaggagcccaccgagacctgcttcgaggaggcccagaagatcgtgtacatgcacatggagagagacagctaccccagattcctgaagagcgagatgtaccagaagctgctgaagaccatgcagagcaacaacagcttctag

SEQ ID NO: 21501 - DNA, 480 bp, Artificial Sequence; identical to SEQ ID NO: 21500
  Description of Artificial Sequence: Synthetic coding sequence

SEQ ID NO: 21502 - DNA, 1788 bp, Artificial Sequence
  Description of Artificial Sequence: Synthetic coding sequence
atgaccatgaccctgcacaccaaggccagcggcatggccctgctgcaccagatccagggcaacgagctggagcccctgaacagaccccagctgaagatccccctggagagacccctgggcgaggtgtacctggacagcagcaagcccgccgtgtacaactaccccgagggcgccgcctacgagttcaacgccgccgccgccgccaacgcccaggtgtacggccagaccggcctgccctacggccccggcagcgaggccgccgccttcggcagcaacggcctgggcggcttcccccccctgaacagcgtgagccccagccccctgatgctgctgcacccccccccccagctgagccccttcctgcagccccacggccagcaggtgccctactacctggagaacgagcccagcggctacaccgtgagagaggccggcccccccgccttctacagacccaacagcgacaacagaagacagggcggcagagagagactggccagcaccaacgacaagggcagcatggccatggagagcgccaaggagaccagatactgcgccgtgtgcaacgactacgccagcggctaccactacggcgtgtggagctgcgagggctgcaaggccttcttcaagagaagcatccagggccacaacgactacatgtgccccgccaccaaccagtgcaccatcgacaagaacagaagaaagagctgccaggcctgcagactgagaaagtgctacgaggtgggcatgatgaagggcggcatcagaaaggacagaagaggcggcagaatgctgaagcacaagagacagagagacgacggcgagggcagaggcgaggtgggcagcgccggcgacatgagagccgccaacctgtggcccagccccctgatgatcaagagaagcaagaagaacagcctggccctgagcctgaccgccgaccagatggtgagcgccctgctggacgccgagccccccatcctgtacagcgagtacgaccccaccagacccttcagcgaggccagcatgatgggcctgctgaccaacctggccgacagagagctggtgcacatgatcaactgggccaagagagtgcccggcttcgtggacctgaccctgcacgaccaggtgcacctgctggagtgcgcctggctggagatcctgatgatcggcctggtgtggagaagcatggagcaccccggcaagctgctgttcgcccccaacctgctgctggacagaaaccagggcaagtgcgtggagggcatggtggagatcttcgacatgctgctggccaccagcagcagattcagaatgatgaacctgcagggcgaggagttcgtgtgcctgaagagcatcatcctgctgaacagcggcgtgtacaccttcctgagcagcaccctgaagagcctggaggagaaggaccacatccacagagtgctggacaagatcaccgacaccctgatccacctgatggccaaggccggcctgaccctgcagcagcagcaccagagactggcccagctgctgctgatcctgagccacatcagacacatgagcaacaagggcatggagcacctgtacagcatgaagtgcaagaacgtggtgcccctgtacgacctgctgctggagatgctggacgcccacagactgcacgcccccaccagcagaggcggcgccagcgtggaggagaccgaccagagccacctggccaccgccggcagcaccagcagccacagcctgcagaagtactacatcaccggcgaggccgagggcttccccgccaccgtgtag

SEQ ID NO: 21503 - DNA, 633 bp, Artificial Sequence
  Description of Artificial Sequence: Synthetic coding sequence
atgagaaagagacagcagagccagaacgagggcacccccgccgtgagccaggcccccggcaaccagagacccaacaacacctgctgcttctgctggtgctgctgctgcagctgcagctgcctgaccgtgagaaacgaggagagaggcgagaacgccggcagacccacccacaccaccaagatggagagcatccaggtgctggaggagtgccagaaccccaccgccgaggaggtgctgagctggagccagaacttcgacaagatgatgaaggcccccgccggcagaaacctgttcagagagttcctgagaaccgagtacagcgaggagaacctgctgttctggctggcctgcgaggacctgaagaaggagcagaacaagaaggtgatcgaggagaaggccagaatgatctacgaggactacatcagcatcctgagccccaaggaggtgagcctggacagcagagtgagagaggtgatcaacagaaacctgctggaccccaacccccacatgtacgaggacgcccagctgcagatctacaccctgatgcacagagacagcttccccagattcctgaacagccagatctacaagagcttcgtggagagcaccgccggcagcagcagcgagagctag

SEQ ID NO: 21504 - DNA, 708 bp, Artificial Sequence
  Description of Artificial Sequence: Synthetic coding sequence
atggagaccaccctgctgttcttcagccagatcaacatgtgcgagagcaaggagaagaccttcttcaagctgatccacggcagcggcaaggaggagaccagcaaggaggccaagatcagagccaaggagaagagaaacagactgagcctgctggtgcagaagcccgagttccacgaggacaccagaagcagcagaagcggccacctggccaaggagaccagagtgagccccgaggaggccgtgaagtggggcgagagcttcgacaagctgctgagccacagagacggcctggaggccttcaccagattcctgaagaccgagttcagcgaggagaacatcgagttctggatcgcctgcgaggacttcaagaagagcaagggcccccagcagatccacctgaaggccaaggccatctacgagaagttcatccagaccgacgcccccaaggaggtgaacctggacttccacaccaaggaggtgatcaccaacagcatcacccagcccaccctgcacagcttcgacgccgcccagagcagagtgtaccagctgatggagcaggacagctacaccagattcctgaagagcgacatctacctggacctgatggagggcagaccccagagacccaccaacctgagaagaagaagcagaagcttcacctgcaacgagttccaggacgtgcagagcgacgtggccatctggctgtag

SEQ ID NO: 21505 - DNA, 654 bp, Artificial Sequence
  Description of Artificial Sequence: Synthetic coding sequence
atgcccaccccccacgaggccgagaagcagatcaccggccccgaggaggccgacagaccccccagcatgagcagccacgacaccgccagccccgccgcccccagcagaaacccctgctgcctgtgctggtgctgctgctgcagctgcagctggaaccaggagagaagaagagcctggcaggccagcagagagagcaagctgcagcccctgcccagctgcgaggtgtgcgccacccccagccccgaggaggtgcagagctgggcccagagcttcgacaagctgatgcacagccccgccggcagaagcgtgttcagagccttcctgagaaccgagtacagcgaggagaacatgctgttctggctggcctgcgaggagctgaaggccgaggccaaccagcacgtggtggacgagaaggccagactgatctacgaggactacgtgagcatcctgagccccaaggaggtgagcctggacagcagagtgagagagggcatcaacaagaagatgcaggagcccagcgcccacaccttcgacgacgcccagctgcagatctacaccctgatgcacagagacagctaccccagattcctgagcagccccacctacagagccctgctgctgcagggccccagccagagcagcagcgaggcctag

SEQ ID NO: 21506 - DNA, 654 bp, Artificial Sequence; identical to SEQ ID NO: 21505
  Description of Artificial Sequence: Synthetic coding sequence

SEQ ID NO: 21507 - DNA, 726 bp, Artificial Sequence
  Description of Artificial Sequence: Synthetic coding sequence
atgagaaccgccgacggcggcgagcccgccggcgccagcagccccgccggcagagtggacggcggcctgcagatgggcagcgagagaatggagatgagaaagagacagatgcccgccgcccaggacacccccggcgccgcccccggccagcccggcgccggcagcagaggcagcaacgcctgctgcttctgctggtgctgctgctgcagctgcagctgcctgaccgtgagaaaccaggaggaccagagacccaccatcgccagccacgagctgagagccgacctgcccacctgggaggagagccccgcccccaccctggaggaggtgaacgcctgggcccagagcttcgacaagctgatggtgacccccgccggcagaaacgccttcagagagttcctgagaaccgagttcagcgaggagaacatgctgttctggatggcctgcgaggagctgaagaaggaggccaacaagaacatcatcgaggagaaggccagaatcatctacgaggactacatcagcatcctgagccccaaggaggtgagcctggacagcagagtgagagaggtgatcaacagaaacatggtggagcccagccagcacatcttcgacgacgcccagctgcagatctacaccctgatgcacagagacagctaccccagattcatgaacagcgccgtgtacaaggacctgctgcagagcctgagcgagaagagcatcgaggcctag

SEQ ID NO: 21508 - DNA, 1167 bp, Artificial Sequence
  Description of Artificial Sequence: Synthetic coding sequence
atgccccagctgagccaggacaaccaggagtgcctgcagaagcacttcagcagacccagcatctggacccagttcctgcccctgttcagagcccagagatacaacaccgacatccaccagatcaccgagaacgagggcgacctgagagccgtgcccgacatcaagagcttcccccccgcccagctgcccgacagccccgccgcccccaagctgttcggcctgctgagcagccccctgagcagcctggccagattcttcagccacctgctgagaagacccccccccgaggcccccagaagaagactggacttcagccccctgctgcccgccctgcccgccgccagactgagcagaggccacgaggagctgcccggcagactgagcctgctgctgggcgccgccctggccctgcccggcagacccagcggcggcagacccctgagacccccccaccccgtggccaagcccagagaggaggacgccaccgccggccagagcagccccatgccccagatgggcagcgagagaatggagatgagaaagagacagatgcccgccgcccaggacacccccggcgccgcccccggccagcccggcgccggcagcagaggcagcaacgcctgctgcttctgctggtgctgctgctgcagctgcagctgcctgaccgtgagaaaccaggaggaccagagacccaccatcgccagccacgagctgagagccgacctgcccacctgggaggagagccccgcccccaccctggaggaggtgaacgcctgggcccagagcttcgacaagctgatggtgacccccgccggcagaaacgccttcagagagttcctgagaaccgagttcagcgaggagaacatgctgttctggatggcctgcgaggagctgaagaaggaggccaacaagaacatcatcgaggagaaggccagaatcatctacgaggactacatcagcatcctgagccccaaggaggtgagcctggacagcagagtgagagaggtgatcaacagaaacatggtggagcccagccagcacatcttcgacgacgcccagctgcagatctacaccctgatgcacagagacagctaccccagattcatgaacagcgccgtgtacaaggacctgctgcagagcctgagcgagaagagcatcgaggcctag

SEQ ID NO: 21509 - DNA, 3795 bp, Artificial Sequence
  Description of Artificial Sequence: Synthetic coding sequence
atgcccgagaagagactgaccgccgagccccccaccatcaccgaggaggagttcgaggacagcctggccaccgacgacttcctggtggactacttcaacgagttcctgagcctgcccaccttcagcgaggccatcagattcaacgccgactacggcgtgttcgaggtggccaacgacgccccccagttcctggagaagcagctgaagaagatcctgcagaaccagcagcccagaaaccccatctacgacgtggtgagaaagggcaagaacgaggtgaagcccgtgcagatgaacgcccccgacgaggacgagaccatcaacgtgaactacaacatcatgtgcctgagcagagaggagggcatcaagtggatcaagaaggagagactgcccgccttcctggagagcgactgctacttcgagtacagactggccaagctggtgagccaggtgagatggagcaagagcggcatgaacttcaccgtgggcagcaacttcagcccctggatcgtgaagaagccccccagcctgcccccccccgccaccgaggaggacaacctggtgatcatgaagaagttctacgtgagcctgggcgaggccagctacacccagaccaaggactggttcgccctggccaagcagagccagcagaccgtgagcaccttcagcctgccctgctgcgtgccctacaacaagctgaagagccccgccatcagcagcgtgagcgagaacttcatcttcgacgacggcgtgcaccccagaaccaagaaggaccccagcaagaccaacaagctgatcagcgagttcgaggaggaggagggcgaggaggaggaggtgagcgtgagcctgcaggacacccccagccaggccctgctgagagtgtacctggagaagaagcaggacgtggacgagagcctgaccatgcacttcagcacctgcgaggagttcctgagcagctacatctacttcatcctgagaggcgccatccagcagatcgtgggcaagcccgtgggcgagacccccgactacatcaacttcaacaacatcaccaaggtgagcttcgacgactgcttcgagagcatccacggcaagaacttcctgagcgagctggtgcagaccaccaaggagagaagcgaggagatcgagcagaccagcctgagcagcaagaacgagagcgccggccccgagagcagagccgactggtgcatcagccacagaacctacgacatcggcaacagaaaggagttcgagagattcaagaagttcatcaagggcaccctgggcgagagatactggtggctgtggatggacatcgagagactgaaggtgctgaaggaccccggcagacaccagagacacctggagaagatgaagaagtgctacctggtgagcaacggcgactactacctgagcgccgagatcctgagcaagttcaagctgctggacggcagccagtggaacgaggagcacctgagaaacatccagagcgaggtgctgaagcccctgctgctgtactgggcccccagattctgcgtgacccacagcgccagcaccaagtacgccagcgccgagctgaagttctggcacctgagacaggccaagcccagaaaggacatcgaccccttcccccagatggccaccctgctgcccctgagacccaagagctgcatcccccagatccccgagatccagaaggaggagttcagcctgagccagccccccaagagccccaacaagagccccgaggtgaagaccgccacccagaagccctggaagagagagctgctgtaccccggcagcagcaaggacgacgtgatcgagaagggcagcaagtacatgagcgagagcagcaaggtgatccacctgaccagcttcaccgacatcagcgagtgcctgaagccccagctggacagaagatacgcctacaccgaggagcccagagtgaagaccgtgagcgacgtgggcgccctgggcggcagcgacatggagaacctgctgcagagcctgtacgtggagaacagagccggcttcttcttcaccaagttctgcgagcacagcggcaacaagctgtggaagaacagcgtgtacttctggttcgacctgcaggcctaccaccagctgttctaccaggagaccctgcagcccttcaaggtgtgcaagcaggcccagtacctgttcgccacctacgtggcccccagcgccaccctggacatcggcctgcagcaggagaagaagaaggagatctacatgaagatccagccccccttcgaggacctgttcgacaccgccgaggagtacatcctgctgctgctgctggagccctggaccaagatggtgaagagcgaccagatcgcctacaagaaggtggagctggtggaggagaccagacagctggacagcacctacttcagaaagctgcaggccctgcacaaggagaccttcagcaagaaggccgaggacaccacctgcgagatcggcaccggcatcctgagcctgagcaacgtgagcaagagaaccgagtactgggacaacgtgcccgccgagtacaagcacttcaagttcagcgacctgctgaacaacaagctggagttcgagcacttcagacagttcctggagacccacagcagcagcatggacctgatgtgctggaccgacatcgagcagttcagaagaatcacctacagagacagaaaccagagaaaggccaagagcatctacatcaagaacaagtacctgaacaagaagtacttcttcggccccaacagccccgccagcctgtaccagcagaaccaggtgatgcacctgagcggcggctggggcaagatcctgcacgagcagctggacgcccccgtgctggtggagatccagaagcacgtgcagaacagactggagaacgtgtggctgcccctgttcctggccagcgagcagttcgccgccagacagaagatcaaggtgcagatgaaggacatcgccgaggagctgctgctgcagaaggccgagaagaagatcggcgtgtggaagcccgtggagagcaagtggatcagcagcagctgcaagatcatcgccttcagaaaggccctgctgaaccccgtgaccagcagacagttccagagattcgtggccctgaagggcgacctgctggagaacggcctgctgttctggcaggaggtgcagaagtacaaggacctgtgccacagccactgcgacgagagcgtgatccagaagaagatcaccaccatcatcaactgcttcatcaacagcagcatcccccccgccctgcagatcgacatccccgtggagcaggcccagaagatcatcgagcacagaaaggagctgggcccctacgtgttcagagaggcccagatgaccatcttcggcgtgctgttcaagttctggccccagttctgcgagttcagaaagaacctgaccgacgagaacatcatgagcgtgctggagagaagacaggagtacaacaagcagaagaagaagctggccgtgctggaggacgagaagagcggcaaggacggcatcaagcagtacgccaacaccagcgtgcccgccatcaagaccgccctgctgagcgacagcttcctgggcctgcagccctacggcagacagcccacctggtgctacagcaagtacatcgaggccctggagcaggagagaatcctgctgaagatccaggaggagctggagaagaagctgttcgccggcctgcagcccctgaccaacttcaaggccagcagcagcaccatgagcctgaagaagaacatgagcgcccacagcagccagaagtag

SEQ ID NO: 21510 - DNA, 3756 bp, Artificial Sequence
  Description of Artificial Sequence: Synthetic coding sequence
atgcccgagaagagactgaccgccgagccccccaccatcaccgaggaggagttcgaggacagcctggccaccgacgacttcctggtggactacttcaacgagttcctgagcctgcccaccttcagcgaggccatcagattcaacgccgactacggcgtgttcgaggtggccaacgacgccccccagttcctggagaagcagctgaagaagatcctgcagaaccagcagcccagaaaccccatctacgacgtggtgagaaagggcaagaacgaggtgaagcccgtgcagatgaacgcccccgacgaggacgagaccatcaacgtgaactacaacatcatgtgcctgagcagagaggagggcatcaagtggatcaagaaggagagactgcccgccttcctggagagcgactgctacttcgagtacagactggccaagctggtgagccaggtgagatggagcaagagcggcatgaacttcaccgtgggcagcaacttcagcccctggatcgtgaagaagccccccagcctgcccccccccgccaccgaggaggacaacctggccagctacacccagaccaaggactggttcgccctggccaagcagagccagcagaccgtgagcaccttcagcctgccctgctgcgtgccctacaacaagctgaagagccccgccatcagcagcgtgagcgagaacttcatcttcgacgacggcgtgcaccccagaaccaagaaggaccccagcaagaccaacaagctgatcagcgagttcgaggaggaggagggcgaggaggaggaggtgagcgtgagcctgcaggacacccccagccaggccctgctgagagtgtacctggagaagaagcaggacgtggacgagagcctgaccatgcacttcagcacctgcgaggagttcctgagcagctacatctacttcatcctgagaggcgccatccagcagatcgtgggcaagcccgtgggcgagacccccgactacatcaacttcaacaacatcaccaaggtgagcttcgacgactgcttcgagagcatccacggcaagaacttcctgagcgagctggtgcagaccaccaaggagagaagcgaggagatcgagcagaccagcctgagcagcaagaacgagagcgccggccccgagagcagagccgactggtgcatcagccacagaacctacgacatcggcaacagaaaggagttcgagagattcaagaagttcatcaagggcaccctgggcgagagatactggtggctgtggatggacatcgagagactgaaggtgctgaaggaccccggcagacaccagagacacctggagaagatgaagaagtgctacctggtgagcaacggcgactactacctgagcgccgagatcctgagcaagttcaagctgctggacggcagccagtggaacgaggagcacctgagaaacatccagagcgaggtgctgaagcccctgctgctgtactgggcccccagattctgcgtgacccacagcgccagcaccaagtacgccagcgccgagctgaagttctggcacctgagacaggccaagcccagaaaggacatcgaccccttcccccagatggccaccctgctgcccctgagacccaagagctgcatcccccagatccccgagatccagaaggaggagttcagcctgagccagccccccaagagccccaacaagagccccgaggtgaagaccgccacccagaagccctggaagagagagctgctgtaccccggcagcagcaaggacgacgtgatcgagaagggcagcaagtacatgagcgagagcagcaaggtgatccacctgaccagcttcaccgacatcagcgagtgcctgaagccccagctggacagaagatacgcctacaccgaggagcccagagtgaagaccgtgagcgacgtgggcgccctgggcggcagcgacatggagaacctgctgcagagcctgtacgtggagaacagagccggcttcttcttcaccaagttctgcgagcacagcggcaacaagctgtggaagaacagcgtgtacttctggttcgacctgcaggcctaccaccagctgttctaccaggagaccctgcagcccttcaaggtgtgcaagcaggcccagtacctgttcgccacctacgtggcccccagcgccaccctggacatcggcctgcagcaggagaagaagaaggagatctacatgaagatccagccccccttcgaggacctgttcgacaccgccgaggagtacatcctgctgctgctgctggagccctggaccaagatggtgaagagcgaccagatcgcctacaagaaggtggagctggtggaggagaccagacagctggacagcacctacttcagaaagctgcaggccctgcacaaggagaccttcagcaagaaggccgaggacaccacctgcgagatcggcaccggcatcctgagcctgagcaacgtgagcaagagaaccgagtactgggacaacgtgcccgccgagtacaagcacttcaagttcagcgacctgctgaacaacaagctggagttcgagcacttcagacagttcctggagacccacagcagcagatggatcctgtgcgccggccagaccctgagcagcagcggcgagacctacagagacagaaaccagagaaaggccaagagcatctacatcaagaacaagtacctgaacaagaagtacttcttcggccccaacagccccgccagcctgtaccagcagaaccaggtgatgcacctgagcggcggctggggcaagatcctgcacgagcagctggacgcccccgtgctggtggagatccagaagcacgtgcagaacagactggagaacgtgtggctgcccctgttcctggccagcgagcagttcgccgccagacagaagatcaaggtgcagatgaaggacatcgccgaggagctgctgctgcagaaggccgagaagaagatcggcgtgtggaagcccgtggagagcaagtggatcagcagcagctgcaagatcatcgccttcagaaaggccctgctgaaccccgtgaccagcagacagttccagagattcgtggccctgaagggcgacctgctggagaacggcctgctgttctggcaggaggtgcagaagtacaaggacctgtgccacagccactgcgacgagagcgtgatccagaagaagatcaccaccatcatcaactgcttcatcaacagcagcatcccccccgccctgcagatcgacatccccgtggagcaggcccagaagatcatcgagcacagaaaggagctgggcccctacgtgttcagagaggcccagatgaccatcttcggcgtgctgttcaagttctggccccagttctgcgagttcagaaagaacctgaccgacgagaacatcatgagcgtgctggagagaagacaggagtacaacaagcagaagaagaagctggccgtgctggaggacgagaagagcggcaaggacggcatcaagcagtacgccaacaccagcgtgcccgccatcaagaccgccctgctgagcgacagcttcctgggcctgcagccctacggcagacagcccacctggtgctacagcaagtacatcgaggccctggagcaggagagaatcctgctgaagatccaggaggagctggagaagaagctgttcgccggcctgcagcccctgaccaacttcaaggccagcagcagcaccatgagcctgaagaagaacatgagcgcccacagcagccagaagtag

SEQ ID NO: 21511 - DNA, 597 bp, Artificial Sequence
  Description of Artificial Sequence: Synthetic coding sequence
atgtggaacaccctgaccagaagcctgagcgaccaccccgtgggcaaggacccccaggccatgagaaccggccagagacagaacaagggcatgagaaccagactgggctgcctgagccacaagagcgacagctgcagcgacttcaccgccatcctgcccgacaagcccaacagagccctgaagagactgagcaccgaggaggccaccagatgggccgacagcttcgacgtgctgctgagccacaagtacggcgtggccgccttcagagccttcctgaagaccgagttcagcgaggagaacctggagttctggctggcctgcgaggagttcaagaagaccagaagcaccgccaagctggtgagcaaggcccacagaatcttcgaggagttcgtggacgtgcaggcccccagagaggtgaacatcgacttccagaccagagaggccaccagaaagaacctgcaggagcccagcctgacctgcttcgaccaggcccagggcaaggtgcacagcctgatggagaaggacagctaccccagattcctgagaagcaagatgtacctggacctgctgagccagagccagagaagactgagctag

SEQ ID NO: 21512 - DNA, 543 bp, Artificial Sequence
  Description of Artificial Sequence: Synthetic coding sequence
atggccgccctgctgatgcccagaagaaacaagggcatgagaaccagactgggctgcctgagccacaagagcgacagctgcagcgacttcaccgccatcctgcccgacaagcccaacagagccctgaagagactgagcaccgaggaggccaccagatgggccgacagcttcgacgtgctgctgagccacaagtacggcgtggccgccttcagagccttcctgaagaccgagttcagcgaggagaacctggagttctggctggcctgcgaggagttcaagaagaccagaagcaccgccaagctggtgagcaaggcccacagaatcttcgaggagttcgtggacgtgcaggcccccagagaggtgaacatcgacttccagaccagagaggccaccagaaagaacctgcaggagcccagcctgacctgcttcgaccaggcccagggcaaggtgcacagcctgatggagaaggacagctaccccagattcctgagaagcaagatgtacctggacctgctgagccagagccagagaagactgagctag

SEQ ID NO: 21513 - DNA, 543 bp, Artificial Sequence; identical to SEQ ID NO: 21512
  Description of Artificial Sequence: Synthetic coding sequence

SEQ ID NO: 21514 - DNA, 543 bp, Artificial Sequence; identical to SEQ ID NO: 21512
  Description of Artificial Sequence: Synthetic coding sequence

SEQ ID NO: 21515 - DNA, 174 bp, Artificial Sequence
  Description of Artificial Sequence: Synthetic coding sequence
atggccgccctgctgatgcccagaagaaacaagggcatgagaaccagactgggctgcctgagccacaagagcgacagctgcagcgacttcaccgccatcctgcccgacaagcccaacagagccctgaagagactgagcaccgaggaggccaccagatgggccgacagcttctag

SEQ ID NO: 21516 - DNA, 2274 bp, Artificial Sequence
  Description of Artificial Sequence: Synthetic coding sequence
atgaccagcggcagcgtgttcttctacatcctgatcttcggcaagtacttcagccacggcggcggccaggacgtgaagtgcagcctgggctacttcccctgcggcaacatcaccaagtgcctgccccagctgctgcactgcaacggcgtggacgactgcggcaaccaggccgacgaggacaactgcggcgacaacaacggctggagcctgcagttcgacaagtacttcgccagctactacaagatgaccagccagtaccccttcgaggccgagacccccgagtgcctggtgggcagcgtgcccgtgcagtgcctgtgccagggcctggagctggactgcgacgagaccaacctgagagccgtgcccagcgtgagcagcaacgtgaccgccatgagcctgcagtggaacctgatcagaaagctgccccccgactgcttcaagaactaccacgacctgcagaagctgtacctgcagaacaacaagatcaccagcatcagcatctacgccttcagaggcctgaacagcctgaccaagctgtacctgagccacaacagaatcaccttcctgaagcccggcgtgttcgaggacctgcacagactggagtggctgatcatcgaggacaaccacctgagcagaatcagcccccccaccttctacggcctgaacagcctgatcctgctggtgctgatgaacaacgtgctgaccagactgcccgacaagcccctgtgccagcacatgcccagactgcactggctggacctggagggcaaccacatccacaacctgagaaacctgaccttcatcagctgcagcaacctgaccgtgctggtgatgagaaagaacaagatcaaccacctgaacgagaacaccttcgcccccctgcagaagctggacgagctggacctgggcagcaacaagatcgagaacctgccccccctgatcttcaaggacctgaaggagctgagccagctgaacctgagctacaaccccatccagaagatccaggccaaccagttcgactacctggtgaagctgaagagcctgagcctggagggcatcgagatcagcaacatccagcagagaatgttcagacccctgatgaacctgagccacatctacttcaagaagttccagtactgcggctacgccccccacgtgagaagctgcaagcccaacaccgacggcatcagcagcctggagaacctgctggccagcatcatccagagagtgttcgtgtgggtggtgagcgccgtgacctgcttcggcaacatcttcgtgatctgcatgagaccctacatcagaagcgagaacaagctgtacgccatgagcatcatcagcctgtgctgcgccgactgcctgatgggcatctacctgttcgtgatcggcggcttcgacctgaagttcagaggcgagtacaacaagcacgcccagctgtggatggagagcacccactgccagctggtgggcagcctggccatcctgagcaccgaggtgagcgtgctgctgctgaccttcctgaccctggagaagtacatctgcatcgtgtaccccttcagatgcgtgagacccggcaagtgcagaaccatcaccgtgctgatcctgatctggatcaccggcttcatcgtggccttcatccccctgagcaacaaggagttcttcaagaactactacggcaccaacggcgtgtgcttccccctgcacagcgaggacaccgagagcatcggcgcccagatctacagcgtggccatcttcctgggcatcaacctggccgccttcatcatcatcgtgttcagctacggcagcatgttctacagcgtgcaccagagcgccatcaccgccaccgagatcagaaaccaggtgaagaaggagatgatcctggccaagagattcttcttcatcgtgttcaccgacgccctgtgctggatccccatcttcgtggtgaagttcctgagcctgctgcaggtggagatccccggcaccatcaccagctgggtggtgatcttcatcctgcccatcaacagcgccctgaaccccatcctgtacaccctgaccaccagacccttcaaggagatgatccacagattctggtacaactacagacagagaaagagcatggacagcaagggccagaagacctacgcccccagcttcatctgggtggagatgtggcccctgcaggagatgccccccgagctgatgaagcccgacctgttcacctacccctgcgagatgagcctgatcagccagagcaccagactgaacagctacagctag

SEQ ID NO: 21517 - DNA, 570 bp, Artificial Sequence
  Description of Artificial Sequence: Synthetic coding sequence
atgaccagcggcagcgtgttcttctacatcctgatcttcggcaagtacttcagccacggcggcggccaggacgtgaagtgcagcctgggctacttcccctgcggcaacatcaccaagtgcctgccccagctgctgcactgcaacggcgtggacgactgcggcaaccaggccgacgaggacaactgcggcgacaacaacggctggagcctgcagttcgacaagtacttcgccagctactacaagatgaccagccagtaccccttcgaggccgagacccccgagtgcctggtgggcagcgtgcccgtgcagtgcctgtgccagggcctggagctggactgcgacgagaccaacctgagagccgtgcccagcgtgagcagcaacgtgaccgccatgagcctgcagtggaacctgatcagaaagctgccccccgactgcttcaagaactaccacgacctgcagaagctgtacctgcagaacaacaagatcaccagcatcagcatctacgccttcagaggcctgaacagcctgaccaagctgagcagagccgtgaaggacggcagcgagaagtag

SEQ ID NO: 21518 - DNA, 1884 bp, Artificial Sequence
  Description of Artificial Sequence: Synthetic coding sequence
agaaccatggtgacctgcacccagaacatgaaggccgccctgaagagcctgctgtaccacagcagaaacctgggctacctgcagaacaacaagatcaccagcatcagcatctacgccttcagaggcctgaacagcctgaccaagctgtacctgagccacaacagaatcaccttcctgaagcccggcgtgttcgaggacctgcacagactggagtggctgatcatcgaggacaaccacctgagcagaatcagcccccccaccttctacggcctgaacagcctgatcctgctggtgctgatgaacaacgtgctgaccagactgcccgacaagcccctgtgccagcacatgcccagactgcactggctggacctggagggcaaccacatccacaacctgagaaacctgaccttcatcagctgcagcaacctgaccgtgctggtgatgagaaagaacaagatcaaccacctgaacgagaacaccttcgcccccctgcagaagctggacgagctggacctgggcagcaacaagatcgagaacctgccccccctgatcttcaaggacctgaaggagctgagccagctgaacctgagctacaaccccatccagaagatccaggccaaccagttcgactacctggtgaagctgaagagcctgagcctggagggcatcgagatcagcaacatccagcagagaatgttcagacccctgatgaacctgagccacatctacttcaagaagttccagtactgcggctacgccccccacgtgagaagctgcaagcccaacaccgacggcatcagcagcctggagaacctgctggccagcatcatccagagagtgttcgtgtgggtggtgagcgccgtgacctgcttcggcaacatcttcgtgatctgcatgagaccctacatcagaagcgagaacaagctgtacgccatgagcatcatcagcctgtgctgcgccgactgcctgatgggcatctacctgttcgtgatcggcggcttcgacctgaagttcagaggcgagtacaacaagcacgcccagctgtggatggagagcacccactgccagctggtgggcagcctggccatcctgagcaccgaggtgagcgtgctgctgctgaccttcctgaccctggagaagtacatctgcatcgtgtaccccttcagatgcgtgagacccggcaagtgcagaaccatcaccgtgctgatcctgatctggatcaccggcttcatcgtggccttcatccccctgagcaacaaggagttcttcaagaactactacggcaccaacggcgtgtgcttccccctgcacagcgaggacaccgagagcatcggcgcccagatctacagcgtggccatcttcctgggcatcaacctggccgccttcatcatcatcgtgttcagctacggcagcatgttctacagcgtgcaccagagcgccatcaccgccaccgagatcagaaaccaggtgaagaaggagatgatcctggccaagagattcttcttcatcgtgttcaccgacgccctgtgctggatccccatcttcgtggtgaagttcctgagcctgctgcaggtggagatccccggcaccatcaccagctgggtggtgatcttcatcctgcccatcaacagcgccctgaaccccatcctgtacaccctgaccaccagacccttcaaggagatgatccacagattctggtacaactacagacagagaaagagcatggacagcaagggccagaagacctacgcccccagcttcatctgggtggagatgtggcccctgcaggagatgccccccgagctgatgaagcccgacctgttcacctacccctgcgagatgagcctgatcagccagagcaccagactgaacagctacagctag

SEQ ID NO: 21519 - DNA, 1959 bp, Artificial Sequence
  Description of Artificial Sequence: Synthetic coding sequence
atgaccagccagtaccccttcgaggccgagacccccgagtgcctggtgggcagcgtgcccgtgcagtgcctgtgccagggcctggagctggactgcgacgagaccaacctgagagccgtgcccagcgtgagcagcaacgtgaccgccatgagcctgcagtggaacctgatcagaaagctgccccccgactgcttcaagaactaccacgacctgcagaagctgtacctgcagaacaacaagatcaccagcatcagcatctacgccttcagaggcctgaacagcctgaccaagctgtacctgagccacaacagaatcaccttcctgaagcccggcgtgttcgaggacctgcacagactggagtggctgatcatcgaggacaaccacctgagcagaatcagcccccccaccttctacggcctgaacagcctgatcctgctggtgctgatgaacaacgtgctgaccagactgcccgacaagcccctgtgccagcacatgcccagactgcactggctggtgatgagaaagaacaagatcaaccacctgaacgagaacaccttcgcccccctgcagaagctggacgagctggacctgggcagcaacaagatcgagaacctgccccccctgatcttcaaggacctgaaggagctgagccagctgaacctgagctacaaccccatccagaagatccaggccaaccagttcgactacctggtgaagctgaagagcctgagcctggagggcatcgagatcagcaacatccagcagagaatgttcagacccctgatgaacctgagccacatctacttcaagaagttccagtactgcggctacgccccccacgtgagaagctgcaagcccaacaccgacggcatcagcagcctggagaacctgctggccagcatcatccagagagtgttcgtgtgggtggtgagcgccgtgacctgcttcggcaacatcttcgtgatctgcatgagaccctacatcagaagcgagaacaagctgtacgccatgagcatcatcagcctgtgctgcgccgactgcctgatgggcatctacctgttcgtgatcggcggcttcgacctgaagttcagaggcgagtacaacaagcacgcccagctgtggatggagagcacccactgccagctggtgggcagcctggccatcctgagcaccgaggtgagcgtgctgctgctgaccttcctgaccctggagaagtacatctgcatcgtgtaccccttcagatgcgtgagacccggcaagtgcagaaccatcaccgtgctgatcctgatctggatcaccggcttcatcgtggccttcatccccctgagcaacaaggagttcttcaagaactactacggcaccaacggcgtgtgcttccccctgcacagcgaggacaccgagagcatcggcgcccagatctacagcgtggccatcttcctgggcatcaacctggccgccttcatcatcatcgtgttcagctacggcagcatgttctacagcgtgcaccagagcgccatcaccgccaccgagatcagaaaccaggtgaagaaggagatgatcctggccaagagattcttcttcatcgtgttcaccgacgccctgtgctggatccccatcttcgtggtgaagttcctgagcctgctgcaggtggagatccccggcaccatcaccagctgggtggtgatcttcatcctgcccatcaacagcgccctgaaccccatcctgtacaccctgaccaccagacccttcaaggagatgatccacagattctggtacaactacagacagagaaagagcatggacagcaagggccagaagacctacgcccccagcttcatctgggtggagatgtggcccctgcaggagatgccccccgagctgatgaagcccgacctgttcacctacccctgcgagatgagcctgatcagccagagcaccagactgaacagctacagctag

SEQ ID NO: 21520 - DNA, 474 bp, Artificial Sequence
  Description of Artificial Sequence: Synthetic coding sequence
atgaccagcggcagcgtgttcttctacatcctgatcttcggcaagtacttcagccacggcggcggccaggacgtgaagtgcagcctgggctacttcccctgcggcaacatcaccaagtgcctgccccagctgctgcactgcaacggcgtggacgactgcggcaaccaggccgacgaggacaactgcggcgacaacaacggctggagcctgcagttcgacaagtacttcgccagctactacaagatgaccagccagtaccccttcgaggccgagacccccgagtgcctggtgggcagcgtgcccgtgcagtgcctgtgccagggcctggagctggactgcgacgagaccaacctgagagccgtgcccagcgtgagcagcaacgtgaccgccatgagcctgcagtggaacctgatcagaaagctgccccccgactgcttcaagaactaccacgacctgcagaagctgaccctgtag

SEQ ID NO: 21521 - DNA, 2265 bp, Artificial Sequence
  Description of Artificial Sequence: Synthetic coding sequence
atgatcgtgttcctggtgttcaagcacctgttcagcctgagactgatcaccatgttcttcctgctgcacttcatcgtgctgatcaacgtgaaggacttcgccctgacccagggcagcatgatcacccccagctgccagaagggctacttcccctgcggcaacctgaccaagtgcctgcccagagccttccactgcgacggcaaggacgactgcggcaacggcgccgacgaggagaactgcggcgacaccagcggctgggccaccatcttcggcaccgtgcacggcaacgccaacagcgtggccctgacccaggagtgcttcctgaagcagtacccccagtgctgcgactgcaaggagaccgagctggagtgcgtgaacggcgacctgaagagcgtgcccatgatcagcaacaacgtgaccctgctgagcctgaagaagaacaagatccacagcctgcccgacaaggtgttcatcaagtacaccaagctgaagaagatcttcctgcagcacaactgcatcagacacatcagcagaaaggccttcttcggcctgtgcaacctgcagatcctgtacctgaaccacaactgcatcaccaccctgagacccggcatcttcaaggacctgcaccagctgacctggctgatcctggacgacaaccccatcaccagaatcagccagagactgttcaccggcctgaacagcctgttcttcctgagcatggtgaacaactacctggaggccctgcccaagcagatgtgcgcccagatgccccagctgaactgggtggacctggagggcaacagaatcaagtacctgaccaacagcaccttcctgagctgcgacagcctgaccgtgctgttcctgcccagaaaccagatcggcttcgtgcccgagaagaccttcagcagcctgaagaacctgggcgagctggacctgagcagcaacaccatcaccgagctgagcccccacctgttcaaggacctgaagctgctgcagaagctgaacctgagcagcaaccccctgatgtacctgcacaagaaccagttcgagagcctgaagcagctgcagagcctggacctggagagaatcgagatccccaacatcaacaccagaatgttccagcccatgaagaacctgagccacatctacttcaagaacttcagatactgcagctacgccccccacgtgagaatctgcatgcccctgaccgacggcatcagcagcttcgaggacctgctggccaacaacatcctgagaatcttcgtgtgggtgatcgccttcatcacctgcttcggcaacctgttcgtgatcggcatgagaagcttcatcaaggccgagaacaccacccacgccatgagcatcaagatcctgtgctgcgccgactgcctgatgggcgtgtacctgttcttcgtgggcatcttcgacatcaagtacagaggccagtaccagaagtacgccctgctgtggatggagagcgtgcagtgcagactgatgggcttcctggccatgctgagcaccgaggtgagcgtgctgctgctgacctacctgaccctggagaagttcctggtgatcgtgttccccttcagcaacatcagacccggcaagagacagaccagcgtgatcctgatctgcatctggatggccggcttcctgatcgccgtgatccccttctggaacaaggactacttcggcaacttctacggcaagaacggcgtgtgcttccccctgtactacgaccagaccgaggacatcggcagcaagggctacagcctgggcatcttcctgggcgtgaacctgctggccttcctgatcatcgtgttcagctacatcaccatgttctgcagcatccagaagaccgccctgcagaccaccgaggtgagaaactgcttcggcagagaggtggccgtggccaacagattcttcttcatcgtgttcagcgacgccatctgctggatccccgtgttcgtggtgaagatcctgagcctgttcagagtggagatccccgacaccatgaccagctggatcgtgatcttcttcctgcccgtgaacagcgccctgaaccccatcctgtacaccctgaccaccaacttcttcaaggacaagctgaagcagctgctgcacaagcaccagagaaagagcatcttcaagatcaagaagaagagcctgagcaccagcatcgtgtggatcgaggacagcagcagcctgaagctgggcgtgctgaacaagatcaccctgggcgacagcatcatgaagcccgtgagctag

SEQ ID NO: 21522 - DNA, 2193 bp, Artificial Sequence
  Description of Artificial Sequence: Synthetic coding sequence
atgatcgtgttcctggtgttcaagcacctgttcagcctgagactgatcaccatgttcttcctgctgcacttcatcgtgctgatcaacgtgaaggacttcgccctgacccagggcagcatgatcacccccagctgccagaagggctacttcccctgcggcaacctgaccaagtgcctgcccagagccttccactgcgacggcaaggacgactgcggcaacggcgccgacgaggagaactgcggcgacaccagcggctgggccaccatcttcggcaccgtgcacggcaacgccaacagcgtggccctgacccaggagtgcttcctgaagcagtacccccagtgctgcgactgcaaggagaccgagctggagtgcgtgaacggcgacctgaagagcgtgcccatgatcagcaacaacgtgaccctgctgagcctgaagaagaacaagatccacagcctgcccgacaaggtgttcatcaagtacaccaagctgaagaagatcttcctgcagcacaactgcatcagacacatcagcagaaaggccttcttcggcctgtgcaacctgcagatcctgtacctgaaccacaactgcatcaccaccctgagacccggcatcttcaaggacctgcaccagctgacctggctgatcctggacgacaaccccatcaccagaatcagccagagactgttcaccggcctgaacagcctgttcttcctgagcatggtgaacaactacctggaggccctgcccaagcagatgtgcgcccagatgccccagctgaactgggtggacctggagggcaacagaatcaagtacctgaccaacagcaccttcctgagctgcgacagcctgaccgtgctggacctgagcagcaacaccatcaccgagctgagcccccacctgttcaaggacctgaagctgctgcagaagctgaacctgagcagcaaccccctgatgtacctgcacaagaaccagttcgagagcctgaagcagctgcagagcctggacctggagagaatcgagatccccaacatcaacaccagaatgttccagcccatgaagaacctgagccacatctacttcaagaacttcagatactgcagctacgccccccacgtgagaatctgcatgcccctgaccgacggcatcagcagcttcgaggacctgctggccaacaacatcctgagaatcttcgtgtgggtgatcgccttcatcacctgcttcggcaacctgttcgtgatcggcatgagaagcttcatcaaggccgagaacaccacccacgccatgagcatcaagatcctgtgctgcgccgactgcctgatgggcgtgtacctgttcttcgtgggcatcttcgacatcaagtacagaggccagtaccagaagtacgccctgctgtggatggagagcgtgcagtgcagactgatgggcttcctggccatgctgagcaccgaggtgagcgtgctgctgctgacctacctgaccctggagaagttcctggtgatcgtgttccccttcagcaacatcagacccggcaagagacagaccagcgtgatcctgatctgcatctggatggccggcttcctgatcgccgtgatccccttctggaacaaggactacttcggcaacttctacggcaagaacggcgtgtgcttccccctgtactacgaccagaccgaggacatcggcagcaagggctacagcctgggcatcttcctgggcgtgaacctgctggccttcctgatcatcgtgttcagctacatcaccatgttctgcagcatccagaagaccgccctgcagaccaccgaggtgagaaactgcttcggcagagaggtggccgtggccaacagattcttcttcatcgtgttcagcgacgccatctgctggatccccgtgttcgtggtgaagatcctgagcctgttcagagtggagatccccgacaccatgaccagctggatcgtgatcttcttcctgcccgtgaacagcgccctgaaccccatcctgtacaccctgaccaccaacttcttcaaggacaagctgaagcagctgctgcacaagcaccagagaaagagcatcttcaagatcaagaagaagagcctgagcaccagcatcgtgtggatcgaggacagcagcagcctgaagctgggcgtgctgaacaagatcaccctgggcgacagcatcatgaagcccgtgagctag

SEQ ID NO: 21523 - DNA, 1410 bp, Artificial Sequence
  Description of Artificial Sequence: Synthetic coding sequence
atgcagatggccgacgccgccaccatcgccaccatgaacaaggccgccggcggcgacaagctggccgagctgttcagcctggtgcccgacctgctggaggccgccaacaccagcggcaacgccagcctgcagctgcccgacctgtggtgggagctgggcctggagctgcccgacggcgccccccccggccacccccccggcagcggcggcgccgagagcgccgacaccgaggccagagtgagaatcctgatcagcgtggtgtactgggtggtgtgcgccctgggcctggccggcaacctgctggtgctgtacctgatgaagagcatgcagggctggagaaagagcagcatcaacctgttcgtgaccaacctggccctgaccgacttccagttcgtgctgaccctgcccttctgggccgtggagaacgccctggacttcaagtggcccttcggcaaggccatgtgcaagatcgtgagcatggtgaccagcatgaacatgtacgccagcgtgttcttcctgaccgccatgagcgtgaccagataccacagcgtggccagcgccctgaagagccacagaaccagaggccacggcagaggcgactgctgcggcagaagcctgggcgacagctgctgcttcagcgccaaggccctgtgcgtgtggatctgggccctggccgccctggccagcctgcccagcgccatcttcagcaccaccgtgaaggtgatgggcgaggagctgtgcctggtgagattccccgacaagctgctgggcagagacagacagttctggctgggcctgtaccacagccagaaggtgctgctgggcttcgtgctgcccctgggcatcatcatcctgtgctacctgctgctggtgagattcatcgccgacagaagagccgccggcaccaagggcggcgccgccgtggccggcggcagacccaccggcgccagcgccagaagactgagcaaggtgaccaagagcgtgaccatcgtggtgctgagcttcttcctgtgctggctgcccaaccaggccctgaccacctggagcatcctgatcaagttcaacgccgtgcccttcagccaggagtacttcctgtgccaggtgtacgccttccccgtgagcgtgtgcctggcccacagcaacagctgcctgaaccccgtgctgtactgcctggtgagaagagagttcagaaaggccctgaagagcctgctgtggagaatcgccagccccagcatcaccagcatgagacccttcaccgccaccaccaagcccgagcacgaggaccagggcctgcaggcccccgcccccccccacgccgccgccgagcccgacctgctgtactacccccccggcgtggtggtgtacagcggcggcagatacgacctgctgcccagcagcagcgcctactag

SEQ ID NO: 21524 - DNA, 1125 bp, Artificial Sequence
  Description of Artificial Sequence: Synthetic coding sequence
atgcccaccctgaacaccagcgccagcccccccaccttcttctgggccaacgccagcggcggcagcgtgctgagcgccgacgacgcccccatgcccgtgaagttcctggccctgagactgatggtggccctggcctacggcctggtgggcgccatcggcctgctgggcaacctggccgtgctgtgggtgctgagcaactgcgccagaagagcccccggcccccccagcgacaccttcgtgttcaacctggccctggccgacctgggcctggccctgaccctgcccttctgggccgccgagagcgccctggacttccactggcccttcggcggcgccctgtgcaagatggtgctgaccgccaccgtgctgaacgtgtacgccagcatcttcctgatcaccgccctgagcgtggccagatactgggtggtggccatggccgccggccccggcacccacctgagcctgttctgggccagaatcgccaccctggccgtgtgggccgccgccgccctggtgaccgtgcccaccgccgtgttcggcgtggagggcgaggtgtgcggcgtgagactgtgcctgctgagattccccagcagatactggctgggcgcctaccagctgcagagagtggtgctggccttcatggtgcccctgggcgtgatcaccaccagctacctgctgctgctggccttcctgcagagaagacagagaagaagacaggacagcagagtggtggccagaagcgtgagaatcctggtggccagcttcttcctgtgctggttccccaaccacgtggtgaccctgtggggcgtgctggtgaagttcgacctggtgccctggaacagcaccttctacaccatccagacctacgtgttccccgtgaccacctgcctggcccacagcaacagctgcctgaaccccgtgctgtactgcctgctgagaagagagcccagacaggccctggccggcaccttcagagacctgagactgagactgtggccccagggcggcggctgggtgcagcaggtggccctgaagcaggtgggcagaagatgggtggccagcaaccccagagagagcagacccagcaccctgctgaccaacctggacagaggcacccccggctag

SEQ ID NO: 21525 - DNA, 816 bp, Artificial Sequence
  Description of Artificial Sequence: Synthetic coding sequence
atggcccccagagccctgcccggcagcgccgtgctggccgccgccgtgttcgtgggcggcgccgtgagcagccccctggtggcccccgacaacggcagcagcagaaccctgcacagcagaaccgagaccacccccagccccagcaacgacaccggcaacggccaccccgagtacatcgcctacgccctggtgcccgtgttcttcatcatgggcctgttcggcgtgctgatctgccacctgctgaagaagaagggctacagatgcaccaccgaggccgagcaggacatcgaggaggagaaggtggagaagatcgagctgaacgacagcgtgaacgagaacagcgacaccgtgggccagatcgtgcactacatcatgaagaacgaggccaacgccgacgtgctgaaggccatggtggccgacaacagcctgtacgaccccgagagccccgtgacccccagcacccccggcagcccccccgtgagccccggccccctgagccccggcggcacccccggcaagcacgtgtgcggccaccacctgcacaccgtgggcggcgtggtggagagagacgtgtgccacagatgcagacacaagagatggcacttcatcaagcccaccaacaagagcagagagagcagacccagaagacagggcgaggtgaccgtgctgagcgtgggcagattcagagtgaccaaggtggagcacaagagcaaccagaaggagagaagaagcctgatgagcgtgagcggcgccgagaccgtgaacggcgaggtgcccgccacccccgtgaagagagagagaagcggcaccgagtag

SEQ ID NO: 21526 - DNA, 816 bp, Artificial Sequence; identical to SEQ ID NO: 21525
  Description of Artificial Sequence: Synthetic coding sequence

SEQ ID NO: 21527 - DNA, 363 bp, Artificial Sequence
  Description of Artificial Sequence: Synthetic coding sequence
atgaacgccaccttcctgaaccacagcggcctggaggaggtggacggcgtgggcggcggcgccggcgccgccctgggcaacagaacccacggcctgggcacctggctgggctgctgccccggcggcgcccccctggccgccagcgacggcgtgcccgccggcctggcccccgacgagagaagcctgtgggtgagcagagtggcccagatcgccgtgctgtgcgtgctgagcctgaccgtggtgttcggcgtgttcttcctgggctgcaacctgctgatcaagagcgagagcatgatcaacttcctggtgcaggagagaagacccagcaaggacgtgggcgccgccatcctgggcctgtactag

SEQ ID NO: 21528 - DNA, 717 bp, Artificial Sequence
  Description of Artificial Sequence: Synthetic coding sequence
atgggcgtggagaacagcgccaaggagggcgaccccggcaccatcttcttcttcagagagggcgccgccgtgttctggaacgtgaaggacaagaccatgaagcacgtgatgaaggtgctggagaagcacgagatccagccctacgagatcgccctggtgcactgggagaacgaggagctgaactacatcaagatcgagggccagagcaagctgcacagaggcgagatcaagctgaacagcgagctggacctggacgacgccatcctggagaagttcgccttcagcaacgccctgtgcctgagcgtgaagctggccatctgggaggccagcctggacaagttcatcgagagcatccagagcatccccgaggccctgaaggccggcaagaaggtgaagctgagccacgaggaggtgatgcagaagatcggcgagctgttcgccctgagacacagaatcaacctgagcagcgacttcctgatcacccccgacttctactgggacagagagaacctggagggcctgtacgacaagacctgccagttcctgagcatcggcagaagagtgaaggtgatgaacgagaagctgcagcactgcatggagctgaccgacctgatgagaaaccacctgaacgagaagagagccctgagactggagtggatgatcgtgatcctgatcaccatcgaggtgatgttcgagctgggcagagtgttcttctag

SEQ ID NO: 21529 - DNA, 423 bp, Artificial Sequence
  Description of Artificial Sequence: Synthetic coding sequence
atgcccttctgcaagaccggcaacctgggcagcatcctggacaagttcatcgagagcatccagagcatccccgaggccctgaaggccggcaagaaggtgaagctgagccacgaggaggtgatgcagaagatcggcgagctgttcgccctgagacacagaatcaacctgagcagcgacttcctgatcacccccgacttctactgggacagagagaacctggagggcctgtacgacaagacctgccagttcctgagcatcggcagaagagtgaaggtgatgaacgagaagctgcagcactgcatggagctgaccgacctgatgagaaaccacctgaacgagaagagagccctgagactggagtggatgatcgtgatcctgatcaccatcgaggtgatgttcgagctgggcagagtgttcttctag

SEQ ID NO: 21530 - DNA, 1350 bp, Artificial Sequence
  Description of Artificial Sequence: Synthetic coding sequence
atgcccgccaccctgctgagagccgtggccagaagccaccacatcctgagcaaggcccaccagtgcagaagaatcggccacctgatgctgaagcccctgaaggagttcgagaacaccacctgcagcaccctgaccatcagacagagcctggacctgttcctgcccgacaagaccgccagcggcctgaacaagagccagatcctggagatgaaccagaagaagagcgacaccagcatgctgagccccctgaacgccgccagatgccaggacgagaaggcccacctgcccaccatgaagagcttcggcacccacagaagagtgacccacaagcccaacctgctgggcagcaagtggttcatcaagatcctgaagagacacttcagcagcgtgagcaccgagaccttcgtgcccaagcaggacttcccccaggtgaagagacccctgaaggccagcagaaccagacagcccagcagaaccaacctgcccgtgctgagcgtgaacgaggacctgatgcactgcaccgccttcgccaccgccgacgagtaccacctgggcaacctgagccaggacctggccagccacggctacgtggaggtgaccagcctgcccagagacgccgccaacatcctggtgatgggcgtggagaacagcgccaaggagggcgaccccggcaccatcttcttcttcagagagggcgccgccgtgttctggaacgtgaaggacaagaccatgaagcacgtgatgaaggtgctggagaagcacgagatccagccctacgagatcgccctggtgcactgggagaacgaggagctgaactacatcaagatcgagggccagagcaagctgcacagaggcgagatcaagctgaacagcgagctggacctggacgacgccatcctggagaagttcgccttcagcaacgccctgtgcctgagcgtgaagctggccatctgggaggccagcctggacaagttcatcgagagcatccagagcatccccgaggccctgaaggccggcaagaaggtgaagctgagccacgaggaggtgatgcagaagatcggcgagctgttcgccctgagacacagaatcaacctgagcagcgacttcctgatcacccccgacttctactgggacagagagaacctggagggcctgtacgacaagacctgccagttcctgagcatcggcagaagagtgaaggtgatgaacgagaagctgcagcactgcatggagctgaccgacctgatgagaaaccacctgaacgagaagagagccctgagactggagtggatgatcgtgatcctgatcaccatcgaggtgatgttcgagctgggcagagtgttcttctag

SEQ ID NO: 21531 - DNA, 636 bp, Artificial Sequence
  Description of Artificial Sequence: Synthetic coding sequence
atgcactgcaccgccttcgccaccgccgacgagtaccacctgggcaacctgagccaggacctggccagccacggctacgtggaggtgaccagcctgcccagagacgccgccaacatcctggtgatgggcgtggagaacagcgccaaggagggcgaccccggcaccatcttcttcttcagagagggcgccgccgtgttctggaacgtgaaggacaagaccatgaagcacgtgatgaaggtgctggagaagcacgagatccagccctacgagatcgccctggtgcactgggagaacgaggagctgaactacatcaagatcgagggccagagcaagctgcacagaggcgagatcaagctgaacagcgagctggacctggacgacgccatcctggagaagttcgccttcagcaacgccctgtgcctgagcgtgaagctggccatctgggaggccagcctggacaagttcatcgagagcatccagagcatccccgaggccctgaaggccggcaagaaggtgaagctgagccacgaggaggtgatgcagaagatcggcgagctgttcgccctgagacacagaatcaacctgagcagcgacttcctgatcacccccgacttctactgggacagagagaactag

SEQ ID NO: 21532 - DNA, 591 bp, Artificial Sequence
  Description of Artificial Sequence: Synthetic coding sequence
atgagcgagggcgacagcgtgggcgagagcgtgcacggcaagcccagcgtggtgtacagattcttcaccagactgggccagatctaccagagctggctggacaagagcaccccctacaccgccgtgagatgggtggtgaccctgggcctgagcttcgtgtacatgatcagagtgtacctgctgcagggctggtacatcgtgacctacgccctgggcatctaccacctgaacctgttcatcgccttcctgagccccaaggtggaccccagcctgatggaggacagcgacgacggccccagcctgcccaccaagcagaacgaggagttcagacccttcatcagaagactgcccgagttcaagttctggcacgccgccaccaagggcatcctggtggccatggtgtgcaccttcttcgacgccttcaacgtgcccgtgttctggcccatcctggtgatgtacttcatcatgctgttctgcatcaccatgaagagacagatcaagcacatgatcaagtacagatacatccccttcacccacggcaagagaagatacagaggcaaggaggacgccggcaaggccttcgccagctag

SEQ ID NO: 21533 - DNA, 564 bp, Artificial Sequence
  Description of Artificial Sequence: Synthetic coding sequence
atgagcgagggcgacagcgtgggcgagagcgtgcacggcaagcccagcgtggtgtacagattcttcaccagactgggccagatctaccagagctggctggacaagagcaccccctacaccgccgtgagatgggtggtgaccctgggcctgagcttcgtgtacatgatcagagtgtacctgctgcagggctggtacatcgtgacctacgccctgggcatctaccacctgaacctgttcatcgccttcctgagccccaaggtggaccccagcctgatggaggacagcgacgacggccccagcctgcccaccaagcagaacgaggagttcagacccttcatcagaagactgcccgagttcaagttctgggacgccagcgtgtgcggcgacggcagatgcagctgcaaggccggcggcggcagacaggtgcccggcgccggctgcagatgcggcgccaacctgctgagccccctggagggcatgagactgcccagagccagcctgtggctgtggagcgtgctgagcagcaccctgagcaccagcagatgcagcggcagattctggtag

SEQ ID NO: 21534 - DNA, 354 bp, Artificial Sequence
  Description of Artificial Sequence: Synthetic coding sequence
atgagcgagggcgacagcgtgggcgagagcgtgcacggcaagcccagcgtggtgtacagattcttcaccagactgggccagatctaccagagctggctggacaagagcaccccctacaccgccgtgagatgggtggtgaccctgggcctgagcttcgtgtacatgatcagagtgtacctgctgcagatgaccgtgctgagatacccccccaacagaaccagaaacagcgcccccagcttcgagggcagccagagcctgaacttcggcatgagactgcccagagccagcctgtggctgtggagcgtgctgagcagcaccctgagcaccagcagatgcagcggcagattctggtag

SEQ ID NO: 21535 - DNA, 354 bp, Artificial Sequence; identical to SEQ ID NO: 21534
  Description of Artificial Sequence: Synthetic coding sequence

SEQ ID NO: 21536 - DNA, 645 bp, Artificial Sequence
  Description of Artificial Sequence: Synthetic coding sequence
atgagcgagggcgacagcgtgggcgagagcgtgcacggcaagcccagcgtggtgtacagattcttcaccagactgggccagatctaccagagctggctggacaagagcaccccctacaccgccgtgagatgggtggtgaccctgggcctgagcttcgtgtacatgatcagagtgtacctgctgcagggctggtacatcgtgacctacgccctgggcatctaccacctgaacctgttcatcgccttcctgagccccaaggtggaccccagcctgatggaggacagcgacgacggccccagcctgcccaccaagcagaacgaggagttcagacccttcatcagaagactgcccgagttcaagttctggcacgccgccaccaagggcatcctggtggccatggtgtgcaccttcttcgacgccttcaacgtgcccgtgttctggcccatcctggtgatgtacttcatcatgctgttctgcatcaccatgaagagacagatcaagcacatgatcaagtacagatacatccccttcacccacggcaagagaagatacagaggcaaggaggacgccggcaagcccagccccgccagaagcggcaccgaggccgccagcagagtggccagaaccgtgctgagccactgctag

SEQ ID NO: 21537 - DNA, 477 bp, Artificial Sequence
  Description of Artificial Sequence: Synthetic coding sequence
atgagcgagggcgacagcgtgggcgagagcgtgcacggcaagcccagcgtggtgtacagattcttcaccagactgggccagatctaccagagctggctggacaagagcaccccctacaccgccgtgagatgggtggtgaccctgggcctgagcttcgtgtacatgatcagagtgtacctgctgcagggctggtacatcgtgacctacgccctgggcatctaccacctgaacctgttcatcgccttcctgagccccaaggtggaccccagcctgatggaggacagcgacgacggccccagcctgcccaccaagcagaacgaggagttcagacccttcatcagaagactgcccgagttcaagttctggcacgccgccaccaagggcatcctggtggccatggtgtgcaccttcttcgacgccttcaacgtgcccgtgttctggcccatcctggtgatgtacttcatcatgctgttctag

SEQ ID NO: 21538 - DNA, 1110 bp, Artificial Sequence
  Description of Artificial Sequence: Synthetic coding sequence
atggcctacagcaccgtgcagagagtggccctggccagcggcctggtgctggccctgagcctgctgctgcccaaggccttcctgagcagaggcaagagacaggagcccccccccacccccgagggcaagctgggcagattcccccccatgatgcaccaccaccaggcccccagcgacggccagacccccggcgccagattccagagaagccacctggccgaggccttcgccaaggccaagggcagcggcggcggcgccggcggcggcggcagcggcagaggcctgatgggccagatcatccccatctacggcttcggcatcttcctgtacatcctgtacatcctgttcaagctgagcaagggcaagaccaccgccgaggacggcaagtgctacaccgccatgcccggcaacacccacagaaagatcaccagcttcgagctggcccagctgcaggagaagctgaaggagaccgaggccgccatggagaagctgatcaacagagtgggccccaacggcgagagcagagcccagaccgtgaccagcgaccaggagaagagactgctgcaccagctgagagagatcaccagagtgatgaaggagggcaagttcatcgacagattcagccccgagaaggaggccgaggaggccccctacatggaggactgggagggctaccccgaggagacctaccccatctacgacctgagcgactgcatcaagagaagacaggagaccatcctggtggactaccccgaccccaaggagctgagcgccgaggagatcgccgagagaatgggcatgatcgaggaggaggagagcgaccacctgggctgggagagcctgcccaccgaccccagagcccaggaggacaacagcgtgaccagctgcgaccccaagcccgagacctgcagctgctgcttccacgaggacgaggaccccgccgtgctggccgagaacgccggcttcagcgccgacagctaccccgagcaggaggagaccaccaaggaggagtggagccaggacttcaaggacgagggcctgggcatcagcaccgacaaggcctacaccggcagcatgctgagaaagagaaacccccagggcctggagtag

SEQ ID NO: 21539 - DNA, 564 bp, Artificial Sequence
  Description of Artificial Sequence: Synthetic coding sequence
atggcctacagcaccgtgcagagagtggccctggccagcggcctggtgctggccctgagcctgctgctgcccaaggccttcctgagcagaggcaagagacaggagcccccccccacccccgagggctaccccgaggagacctaccccatctacgacctgagcgactgcatcaagagaagacaggagaccatcctggtggactaccccgaccccaaggagctgagcgccgaggagatcgccgagagaatgggcatgatcgaggaggaggagagcgaccacctgggctgggagagcctgcccaccgaccccagagcccaggaggacaacagcgtgaccagctgcgaccccaagcccgagacctgcagctgctgcttccacgaggacgaggaccccgccgtgctggccgagaacgccggcttcagcgccgacagctaccccgagcaggaggagaccaccaaggaggagtggagccaggacttcaaggacgagggcctgggcatcagcaccgacaaggcctacaccggcagcatgctgagaaagagaaacccccagggcctggagtag

SEQ ID NO: 21540 - DNA, 1107 bp, Artificial Sequence
  Description of Artificial Sequence: Synthetic coding sequence
atggcctacagcaccgtgcagagagtggccctggccagcggcctggtgctggccctgagcctgctgctgcccaaggccttcctgagcagaggcaagagacaggagcccccccccacccccgagggcaagctgggcagattcccccccatgatgcaccaccaccaggcccccagcgacggccagacccccggcgccagattccagagaagccacctggccgaggccttcgccaaggccaagggcagcggcggcggcgccggcggcggcggcagcggcagaggcctgatgggccagatcatccccatctacggcttcggcatcttcctgtacatcctgtacatcctgttcaagctgagcaagggcaagaccaccgccgaggacggcaagtgctacaccgccatgcccggcaacacccacagaaagatcaccagcttcgagctggcccagctgcaggagaagctgaaggagaccgaggccgccatggagaagctgatcaacagagtgggccccaacggcgagagagcccagaccgtgaccagcgaccaggagaagagactgctgcaccagctgagagagatcaccagagtgatgaaggagggcaagttcatcgacagattcagccccgagaaggaggccgaggaggccccctacatggaggactgggagggctaccccgaggagacctaccccatctacgacctgagcgactgcatcaagagaagacaggagaccatcctggtggactaccccgaccccaaggagctgagcgccgaggagatcgccgagagaatgggcatgatcgaggaggaggagagcgaccacctgggctgggagagcctgcccaccgaccccagagcccaggaggacaacagcgtgaccagctgcgaccccaagcccgagacctgcagctgctgcttccacgaggacgaggaccccgccgtgctggccgagaacgccggcttcagcgccgacagctaccccgagcaggaggagaccaccaaggaggagtggagccaggacttcaaggacgagggcctgggcatcagcaccgacaaggcctacaccggcagcatgctgagaaagagaaacccccagggcctggagtag

SEQ ID NO: 21541 - DNA, 624 bp, Artificial Sequence
  Description of Artificial Sequence: Synthetic coding sequence
atgtgcagactgaagagacaggagttcgtgatcagcagagcccagaccgtgaccagcgaccaggagaagagactgctgcaccagctgagagagatcaccagagtgatgaaggagggcaagttcatcgacagattcagccccgagaaggaggccgaggaggccccctacatggaggactgggagggctaccccgaggagacctaccccatctacgacctgagcgactgcatcaagagaagacaggagaccatcctggtggactaccccgaccccaaggagctgagcgccgaggagatcgccgagagaatgggcatgatcgaggaggaggagagcgaccacctgggctgggagagcctgcccaccgaccccagagcccaggaggacaacagcgtgaccagctgcgaccccaagcccgagacctgcagctgctgcttccacgaggacgaggaccccgccgtgctggccgagaacgccggcttcagcgccgacagctaccccgagcaggaggagaccaccaaggaggagtggagccaggacttcaaggacgagggcctgggcatcagcaccgacaaggcctacaccggcagcatgctgagaaagagaaacccccagggcctggagtag

SEQ ID NO: 21542 - DNA, 387 bp, Artificial Sequence
  Description of Artificial Sequence: Synthetic coding sequence
atggcctacagcaccgtgcagagagtggccctggccagcggcctggtgctggccctgagcctgctgctgcccaaggccttcctgagcagaggcaagagacaggagcccccccccacccccgagggcaagctgggcagattcccccccatgatgcaccaccaccaggcccccagcgacggccagacccccggcgccagattccagagaagccacctggccgaggccttcgccaaggccaagggcagcggcggcggcgccggcggcggcggcagcggcagaggcctgatgggccagatcatccccatctacggcttcggcatcttcctgtacatcctgtacatcctgttcaaggtgagcagaatcatcctgatcatcctgcaccagtag

SEQ ID NO: 21543 - DNA, 963 bp, Artificial Sequence
  Description of Artificial Sequence: Synthetic coding sequence
atgatgcaccaccaccaggcccccagcgacggccagacccccggcgccagattccagagaagccacctggccgaggccttcgccaaggccaagggcagcggcggcggcgccggcggcggcggcagcggcagaggcctgatgggccagatcatccccatctacggcttcggcatcttcctgtacatcctgtacatcctgttcaagctgagcaagggcaagaccaccgccgaggacggcaagtgctacaccgccatgcccggcaacacccacagaaagatcaccagcttcgagctggcccagctgcaggagaagctgaaggagaccgaggccgccatggagaagctgatcaacagagtgggccccaacggcgagagcagagcccagaccgtgaccagcgaccaggagaagagactgctgcaccagctgagagagatcaccagagtgatgaaggagggcaagttcatcgacagattcagccccgagaaggaggccgaggaggccccctacatggaggactgggagggctaccccgaggagacctaccccatctacgacctgagcgactgcatcaagagaagacaggagaccatcctggtggactaccccgaccccaaggagctgagcgccgaggagatcgccgagagaatgggcatgatcgaggaggaggagagcgaccacctgggctgggagagcctgcccaccgaccccagagcccaggaggacaacagcgtgaccagctgcgaccccaagcccgagacctgcagctgctgcttccacgaggacgaggaccccgccgtgctggccgagaacgccggcttcagcgccgacagctaccccgagcaggaggagaccaccaaggaggagtggagccaggacttcaaggacgagggcctgggcatcagcaccgacaaggcctacaccggcagcatgctgagaaagagaaacccccagggcctggagtag

SEQ ID NO: 21544 - DNA, 990 bp, Artificial Sequence
  Description of Artificial Sequence: Synthetic coding sequence
atggcctacagcaccgtgcagagagtggccctggccagcggcctggtgctggccctgagcctgctgctgcccaaggccttcctgagcagaggcaagagacaggagcccccccccacccccgagggcaagctgggcagattcccccccatgatgcaccaccaccaggcccccagcgacggccagacccccggcgccagattccagagaagccacctggccgaggccttcgccaaggccaagggcagcggcggcggcgccggcggcggcggcagcggcagaggcctgatgggccagatcatccccatctacggcttcggcatcttcctgtacatcctgtacatcctgttcaagctgagcaagggcaagaccaccgccgaggacggcaagtgctacaccgccatgcccggcaacacccacagaaagatcaccagcttcgagctggcccagctgcaggagaagctgaaggagaccgaggccgccatggagaagctgatcaacagagtgggccccaacggcgagagcacccagaccgaccacagcgacgtgtacgtgcactgcctgggcgtgttcaccaccaagtggctggactgcctgatcttcctgagcagagcccagaccgtgaccagcgaccaggagaagagactgctgcaccagctgagagagatcaccagagtgatgaaggagggcaagttcatcgacagattcagccccgagaaggaggccgaggaggccccctacatggaggactgggagggctaccccgaggagacctaccccatctacgacctgagcgactgcatcaagagaagacaggagaccatcctggtggactaccccgaccccaaggagctgagcgccgaggagatcgccgagagaatgggcatgatcgaggaggaggagagcgaccacctgggctgggagagcctgcccaccgaccccagagcccaggaggacaacagcgtgaccagctgcgaccccaagcccgtgtag

SEQ ID NO: 21545 - DNA, 867 bp, Artificial Sequence
  Description of Artificial Sequence: Synthetic coding sequence
atggcctacagcaccgtgcagagagtggccctggccagcggcctggtgctggccctgagcctgctgctgcccaaggccttcctgagcagaggcaagagacaggagcccccccccacccccgagggcaagctgggcagattcccccccatgatgcaccaccaccaggcccccagcgacggccagacccccggcgccagattccagagaagccacctggccgaggccttcgccaaggccaagggcagcggcggcggcgccggcggcggcggcagcggcagaggcctgatgggccagatcatccccatctacggcttcggcatcttcctgtacatcctgtacatcctgttcaagctgagcaagggcaagaccaccgccgaggacggcaagtgctacaccgccatgcccggcaacacccacagaaagatcagctaccccgaggagacctaccccatctacgacctgagcgactgcatcaagagaagacaggagaccatcctggtggactaccccgaccccaaggagctgagcgccgaggagatcgccgagagaatgggcatgatcgaggaggaggagagcgaccacctgggctgggagagcctgcccaccgaccccagagcccaggaggacaacagcgtgaccagctgcgaccccaagcccgagacctgcagctgctgcttccacgaggacgaggaccccgccgtgctggccgagaacgccggcttcagcgccgacagctaccccgagcaggaggagaccaccaaggaggagtggagccaggacttcaaggacgagggcctgggcatcagcaccgacaaggcctacaccggcagcatgctgagaaagagaaacccccagggcctggagtag

SEQ ID NO: 21546 - DNA, 1614 bp, Artificial Sequence
  Description of Artificial Sequence: Synthetic coding sequence
atggagcccagagccgtggccgaggccgtggagaccggcgaggaggacgtgatcatggaggccctgagaagctacaaccaggagcacagccagagcttcaccttcgacgacgcccagcaggaggacagaaagagactggccgagctgctggtgagcgtgctggagcagggcctgccccccagccacagagtgatctggctgcagagcgtgagaatcctgagcagagacagaaactgcctggaccccttcaccagcagacagagcctgcaggccctggcctgctacgccgacatcagcgtgagcgagggcagcgtgcccgagagcgccgacatggacgtggtgctggagagcctgaagtgcctgtgcaacctggtgctgagcagccccgtggcccagatgctggccgccgaggccagactggtggtgaagctgaccgagagagtgggcctgtacagagagagaagcttcccccacgacgtgcagttcttcgacctgagactgctgttcctgctgaccgccctgagaaccgacgtgagacagcagctgttccaggagctgaagggcgtgagactgctgaccgacaccctggagctgaccctgggcgtgacccccgagggcaaccccccccccaccctgctgcccagccaggagaccgagagagccatggagatcctgaaggtgctgttcaacatcaccctggacagcatcaagggcgaggtggacgaggaggacgccgccctgtacagacacctgggcaccctgctgagacactgcgtgatgatcgccaccgccggcgacagaaccgaggagttccacggccacgccgtgaacctgctgggcaacctgcccctgaagtgcctggacgtgctgctgaccctggagccccacggcgacagcaccgagttcatgggcgtgaacatggacgtgatcagagccctgctgatcttcctggagaagagactgcacaagacccacagactgaaggagagcgtggcccccgtgctgagcgtgctgaccgagtgcgccagaatgcacagacccgccagaaagttcctgaaggcccagggctggccccccccccaggtgctgccccccctgagagacgtgagaaccagacccgaggtgggcgagatgctgagaaacaagctggtgagactgatgacccacctggacaccgacgtgaagagagtggccgccgagttcctgttcgtgctgtgcagcgagagcgtgcccagattcatcaagtacaccggctacggcaacgccgccggcctgctggccgccagaggcctgatggccggcggcagacccgagggccagtacagcgaggacgaggacaccgacaccgacgagtacaaggaggccaaggccagcatcaaccccgtgaccggcagagtggaggagaagccccccaaccccatggagggcatgaccgaggagcagaaggagcacgaggccatgaagctggtgaccatgttcgacaagctgagcagaaacagagtgatccagcccatgggcatgagccccagaggccacctgaccagcctgcaggacgccatgtgcgagaccatggagcagcagctgagcagcgaccccgacagcgaccccgactag

SEQ ID NO: 21547 - DNA, 1596 bp, Artificial Sequence
  Description of Artificial Sequence: Synthetic coding sequence
atggagcccagagccgtggccgaggccgtggagaccggcgaggaggacgtgatcatggaggccctgagaagctacaaccaggagcacagccagagcttcaccttcgacgacgcccagcaggaggacagaaagagactggccgagctgctggtgagcgtgctggagcagggcctgccccccagccacagagtgatctggctgcagagcgtgagaatcctgagcagagacagaaactgcctggaccccttcaccagcagacagagcctgcaggccctggcctgctacgccgacatcagcgtgagcgagggcagcgtgcccgagagcgccgacatggacgtggtgctggagagcctgaagtgcctgtgcaacctggtgctgagcagccccgtggcccagatgctggccgccgaggccagactggtggtgaagctgaccgagagagtgggcctgtacagagagagaagcttcccccacgacgtgcagttcttcgacctgagactgctgttcctgctgaccgccctgagaaccgacgtgagacagcagctgttccaggagctgaagggcgtgagactgctgaccgacaccctggagctgaccctgggcgtgacccccgagggcaaccccccccccaccctgctgcccagccaggagaccgagagagccatggagatcctgaaggtgctgttcaacatcaccctggacagcatcaagggcgaggtggacgaggaggacgccgccctgtacagacacctgggcaccctgctgagacactgcgtgatgatcgccaccgccggcgacagaaccgaggagttccacggccacgccgtgaacctgctgggcaacctgcccctgaagtgcctggacgtgctgctgaccctggagccccacggcgacagcaccgagttcatgggcgtgaacatggacgtgatcagagccctgctgatcttcctggagaagagactgcacaagacccacagactgaaggagagcgtggcccccgtgctgagcgtgctgaccgagtgcgccagaatgcacagacccgccagaaagttcctgaaggcccaggtgctgccccccctgagagacgtgagaaccagacccgaggtgggcgagatgctgagaaacaagctggtgagactgatgacccacctggacaccgacgtgaagagagtggccgccgagttcctgttcgtgctgtgcagcgagagcgtgcccagattcatcaagtacaccggctacggcaacgccgccggcctgctggccgccagaggcctgatggccggcggcagacccgagggccagtacagcgaggacgaggacaccgacaccgacgagtacaaggaggccaaggccagcatcaaccccgtgaccggcagagtggaggagaagccccccaaccccatggagggcatgaccgaggagcagaaggagcacgaggccatgaagctggtgaccatgttcgacaagctgagcagaaacagagtgatccagcccatgggcatgagccccagaggccacctgaccagcctgcaggacgccatgtgcgagaccatggagcagcagctgagcagcgaccccgacagcgaccccgactag

SEQ ID NO: 21548 - DNA, 1491 bp, Artificial Sequence
  Description of Artificial Sequence: Synthetic coding sequence
atgctggccagcaagctgtgcgagggcatcttcaaggtgctgatcaaggacatccccaccacctgccaggtgagctgcctggaggtgctgagaatcctgagcagagacaagaaggtgctggtgcccgtgaccaccaaggagaacatgcagatcctgctgagactggccaagctgaacgagctggacgacagcctggagaaggtgagcgagttccccgtgatcgtggagagcctgaagtgcctgtgcaacatcgtgttcaacagccagatggcccagcagctgagcctggagctgaacctggccgccaagctgtgcaacctgctgagaaagtgcaaggacagaaagttcatcaacgacatcaagtgcttcgacctgagactgctgttcctgctgagcctgctgcacaccgacatcagaagccagctgagatacgagctgcagggcctgcccctgctgacccagatcctggagagcgccttcagcatcaagtggaccgacgagtacgagagcgccatcgaccacaacggcccccccctgagcccccaggagaccgactgcgccatcgaggccctgaaggccctgttcaacgtgaccgtggacagctggaaggtgcacaaggagagcgacagccaccagttcagagtgatggccgccgtgctgagacactgcctgctgatcgtgggccccaccgaggacaagaccgaggagctgcacagcaacgccgtgaacctgctgagcaacgtgcccgtgagctgcctggacgtgctgatctgccccctgacccacgaggagaccgcccaggaggccaccaccctggacgagctgcccagcaacaagaccgccgagaaggagaccgtgctgaagaacaacaccatggtgtacaacggcatgaacatggaggccatccacgtgctgctgaacttcatggagaagagaatcgacaagggcagcagctacagagagggcctgacccccgtgctgagcctgctgaccgagtgcagcagagcccacagaaacatcagaaagttcctgaaggaccaggtgctgccccccctgagagacgtgaccaacagacccgaggtgggcagcaccgtgagaaacaagctggtgagactgatgacccacgtggacctgggcgtgaagcagatcgccgccgagttcctgttcgtgctgtgcaaggagagagtggacagcctgctgaagtacaccggctacggcaacgccgccggcctgctggccgccagaggcctgctggccggcggcagaggcgacaactggtacagcgaggacgaggacaccgacaccgaggagtacaagaacgccaagcccaacatcaacctgatcaccggccacctggaggagcccatgcccaaccccatcgacgagatgaccgaggagcagaaggagtacgaggccatgaagctggtgaacatgctggacaagctgagcagaagagccgacgtgaaggacctgcaccaggacggcggctag

SEQ ID NO: 21549 - DNA, 1683 bp, Artificial Sequence
  Description of Artificial Sequence: Synthetic coding sequence
atggacgaggagagagccctgtacatcgtgagagccggcgaggccggcgccatcgagagagtgctgagagactacagcgacaagcacagagccaccttcaagttcgagagcaccgacgaggacaagagaaagaagctgtgcgagggcatcttcaaggtgctgatcaaggacatccccaccacctgccaggtgagctgcctggaggtgctgagaatcctgagcagagacaagaaggtgctggtgcccgtgaccaccaaggagaacatgcagatcctgctgagactggccaagctgaacgagctggacgacagcctggagaaggtgagcgagttccccgtgatcgtggagagcctgaagtgcctgtgcaacatcgtgttcaacagccagatggcccagcagctgagcctggagctgaacctggccgccaagctgtgcaacctgctgagaaagtgcaaggacagaaagttcatcaacgacatcaagtgcttcgacctgagactgctgttcctgctgagcctgctgcacaccgacatcagaagccagctgagatacgagctgcagggcctgcccctgctgacccagatcctggagagcgccttcagcatcaagtggaccgacgagtacgagagcgccatcgaccacaacggcccccccctgagcccccaggagaccgactgcgccatcgaggccctgaaggccctgttcaacgtgaccgtggacagctggaaggtgcacaaggagagcgacagccaccagttcagagtgatggccgccgtgctgagacactgcctgctgatcgtgggccccaccgaggacaagaccgaggagctgcacagcaacgccgtgaacctgctgagcaacgtgcccgtgagctgcctggacgtgctgatctgccccctgacccacgaggagaccgcccaggaggccaccaccctggacgagctgcccagcaacaagaccgccgagaaggagaccgtgctgaagaacaacaccatggtgtacaacggcatgaacatggaggccatccacgtgctgctgaacttcatggagaagagaatcgacaagggcagcagctacagagagggcctgacccccgtgctgagcctgctgaccgagtgcagcagagcccacagaaacatcagaaagttcctgaaggaccaggtgctgccccccctgagagacgtgaccaacagacccgaggtgggcagcaccgtgagaaacaagctggtgagactgatgacccacgtggacctgggcgtgaagcagatcgccgccgagttcctgttcgtgctgtgcaaggagagagtggacagcctgctgaagtacaccggctacggcaacgccgccggcctgctggccgccagaggcctgctggccggcggcagaggcgacaactggtacagcgaggacgaggacaccgacaccgaggagtacaagaacgccaagcccaacatcaacctgatcaccggccacctggaggagcccatgcccaaccccatcgacgagatgaccgaggagcagaaggagtacgaggccatgaagctggtgaacatgctggacaagctgagcagagaggagctgctgaagcccatgggcctgaagcccgacggcaccatcacccccctggaggaggccctgaaccagtacagcgtgatcgaggagaccagcagcgacaccgactag

SEQ ID NO: 21550 - DNA, 1563 bp, Artificial Sequence
  Description of Artificial Sequence: Synthetic coding sequence
atggacgaggagagagccctgtacatcgtgagagccggcgaggccggcgccatcgagagagtgctgagagactacagcgacaagcacagagccaccttcaagttcgagagcaccgacgaggacaagagaaagaagctgtgcgagggcatcttcaaggtgctgatcaaggacatccccaccacctgccaggtgagctgcctggaggtgctgagaatcctgagcagagacaagaaggtgctggtgcccgtgaccaccaaggagaacatgcagatcctgctgagactggccaagctgaacgagctggacgacagcctggagaaggtgagcgagttccccgtgatcgtggagagcctgaagtgcctgtgcaacatcgtgttcaacagccagatggcccagcagctgagcctggagctgaacctggccgccaagctgtgcaacctgctgagaaagtgcaaggacagaaagttcatcaacgacatcaagtgcttcgacctgagactgctgttcctgctgagcctgctgcacaccgacatcagaagccagctgagatacgagctgcagggcctgcccctgctgacccagatcctggagagcgccttcagcatcaagtggaccgacgagtacgagagcgccatcgaccacaacggcccccccctgagcccccaggagaccgactgcgccatcgaggccctgaaggccctgttcaacgtgaccgtggacagctggaaggtgcacaaggagagcgacagccaccagttcagagtgatggccgccgtgctgagacactgcctgctgatcgtgggccccaccgaggacaagaccgaggagctgcacagcaacgccgtgaacctgctgagcaacgtgcccgtgagctgcctggacgtgctgatctgccccctgacccacgaggagaccgcccaggaggccaccaccctggacgagctgcccagcaacaagaccgccgagaaggagaccgtgctgaagaacaacaccatggtgtacaacggcatgaacatggaggccatccacgtgctgctgaacttcatggagaagagaatcgacaagggcagcagctacagagagggcctgacccccgtgctgagcctgctgaccgagtgcagcagagcccacagaaacatcagaaagttcctgaaggaccaggtgctgccccccctgagagacgtgaccaacagacccgaggtgggcagcaccgtgagaaacaagctggtgagactgatgacccacgtggacctgggcgtgaagcagatcgccgccgagttcctgttcgtgctgtgcaaggagagagtggacagcctgctgaagtacaccggctacggcaacgccgccggcctgctggccgccagaggcctgctggccggcggcagaggcgacaactggtacagcgaggacgaggacaccgacaccgaggagtacaagaacgccaagcccaaggaggagctgctgaagcccatgggcctgaagcccgacggcaccatcacccccctggaggaggccctgaaccagtacagcgtgatcgaggagaccagcagcgacaccgactag

SEQ ID NO: 21551 - DNA, 987 bp, Artificial Sequence
  Description of Artificial Sequence: Synthetic coding sequence
atgatgtggagacccagcgtgctgctgctgctgctgctgctgagacacggcgcccagggcaagcccagccccgacgccggcccccacggccagggcagagtgcaccaggccgcccccctgagcgacgccccccacgacgacgcccacggcaacttccagtacgaccacgaggccttcctgggcagagaggtggccaaggagttcgaccagctgacccccgaggagagccaggccagactgggcagaatcgtggacagaatggacagagccggcgacggcgacggctgggtgagcctggccgagctgagagcctggatcgcccacacccagcagagacacatcagagacagcgtgagcgccgcctgggacacctacgacaccgacagagacggcagagtgggctgggaggagctgagaaacgccacctacggccactacgcccccggcgaggagttccacgacgtggaggacgccgagacctacaagaagatgctggccagagacgagagaagattcagagtggccgaccaggacggcgacagcatggccaccagagaggagctgaccgccttcctgcaccccgaggagttcccccacatgagagacatcgtgatcgccgagaccctggaggacctggacagaaacaaggacggctacgtgcaggtggaggagtacatcgccgacctgtacagcgccgagcccggcgaggaggagcccgcctgggtgcagaccgagagacagcagttcagagacttcagagacctgaacaaggacggccacctggacggcagcgaggtgggccactgggtgctgccccccgcccaggaccagcccctggtggaggccaaccacctgctgcacgagagcgacaccgacaaggacggcagactgagcaaggccgagatcctgggcaactggaacatgttcgtgggcagccaggccaccaactacggcgaggacctgaccagacaccacgacgagctgtag

SEQ ID NO: 21552 - DNA, 1326 bp, Artificial Sequence
  Description of Artificial Sequence: Synthetic coding sequence
atgctgagaaagggctgctgcgtggagctgctgctgctgctggtggccgccgagctgcccctgggcggcggctgccccagagactgcgtgtgctaccccgcccccatgaccgtgagctgccaggcccacaacttcgccgccatccccgagggcatccccgtggacagcgagagagtgttcctgcagaacaacagaatcggcctgctgcagcccggccacttcagccccgccatggtgaccctgtggatctacagcaacaacatcacctacatccaccccagcaccttcgagggcttcgtgcacctggaggagctggacctgggcgacaacagacagctgagaaccctggcccccgagaccttccagggcctggtgaagctgcacgccctgtacctgtacaagtgcggcctgagcgccctgcccgccggcgtgttcggcggcctgcacagcctgcagtacctgtacctgcaggacaaccacatcgagtacctgcaggacgacatcttcgtggacctggtgaacctgagccacctgttcctgcacggcaacaagctgtggagcctgggccccggcaccttcagaggcctggtgaacctggacagactgctgctgcacgagaaccagctgcagtgggtgcaccacaaggccttccacgacctgagaagactgaccaccctgttcctgttcaacaacagcctgagcgagctgcagggcgagtgcctggcccccctgggcgccctggagttcctgagactgaacggcaacccctgggactgcggctgcagagccagaagcctgtgggagtggctgcagagattcagaggcagcagcagcgccgtgccctgcgtgagccccggcctgagacacggccaggacctgaagctgctgagagccgaggacttcagaaactgcaccggccccgccagcccccaccagatcaagagccacaccctgaccaccaccgacagagccgccagaaaggagcaccacagcccccacggccccaccagaagcaagggccacccccacggccccagacccggccacagaaagcccggcaagaactgcaccaaccccagaaacagaaaccagatcagcaaggccggcgccggcaagcaggcccccgagctgcccgactacgcccccgactaccagcacaagttcagcttcgacatcatgcccaccgccagacccaagagaaagggcaagtgcgccagaagaacccccatcagagcccccagcggcgtgcagcaggccagcagcgccagcagcctgggcgccagcctgctggcctggaccctgggcctggccgtgaccctgagatag

SEQ ID NO: 21553 - DNA, 1263 bp, Artificial Sequence
  Description of Artificial Sequence: Synthetic coding sequence
atgctgcccggcctgagaagactgctgcaggcccccgccagcgcctgcctgctgctgatgctgctggccctgcccctggccgcccccagctgccccatgctgtgcacctgctacagcagcccccccaccgtgagctgccaggccaacaacttcagcagcgtgcccctgagcctgccccccagcacccagagactgttcctgcagaacaacctgatcagaaccctgagacccggcaccttcggcagcaacctgctgaccctgtggctgttcagcaacaacctgagcaccatctaccccggcaccttcagacacctgcaggccctggaggagctggacctgggcgacaacagacacctgagaagcctggagcccgacaccttccagggcctggagagactgcagagcctgcacctgtacagatgccagctgagcagcctgcccggcaacatcttcagaggcctggtgagcctgcagtacctgtacctgcaggagaacagcctgctgcacctgcaggacgacctgttcgccgacctggccaacctgagccacctgttcctgcacggcaacagactgagactgctgaccgagcacgtgttcagaggcctgggcagcctggacagactgctgctgcacggcaacagactgcagggcgtgcacagagccgccttcagaggcctgagcagactgaccatcctgtacctgttcaacaacagcctggccagcctgcccggcgaggccctggccgacctgcccagcctggagttcctgagactgaacgccaacccctgggcctgcgactgcagagccagacccctgtgggcctggttccagagagccagagtgagcagcagcgacgtgacctgcgccaccccccccgagagacagggcagagacctgagagccctgagagaggccgacttccaggcctgcccccccgccgcccccaccagacccggcagcagagccagaggcaacagcagcagcaaccacctgtacggcgtggccgaggccggcgccccccccgccgaccccagcaccctgtacagagacctgcccgccgaggacagcagaggcagacagggcggcgacgcccccaccgaggacgactactggggcggctacggcggcgaggaccagagaggcgagcagatgtgccccggcgccgcctgccaggccccccccgacagcagaggccccgccctgagcgccggcctgcccagccccctgctgtgcctgctgctgctggtgccccaccacctgtag

SEQ ID NO: 21554 - DNA, 1014 bp, Artificial Sequence
  Description of Artificial Sequence: Synthetic coding sequence
atgctgagaaacaacctgggcaacagcagcgacagcaagaacgaggacggcagcgtgttcagccagaccgagcacaacatcgtggccacctacctgatcatggccggcatgatcagcatcatcagcaacatcatcgtgctgggcatcttcatcaagtacaaggagctgagaacccccaccaacgccatcatcatcaacctggccgtgaccgacatcggcgtgagcagcatcggctaccccatgagcgccgccagcgacctgtacggcagctggaagttcggctacgccggctgccaggtgtacgccggcctgaacatcttcttcggcatggccagcatcggcctgctgaccgtggtggccgtggacagatacctgaccatctgcctgcccgacgtgggcagaagaatgaccaccaacacctacatcggcctgatcctgggcgcctggatcaacggcctgttctgggccctgatgcccatcatcggctgggccagctacgcccccgaccccaccggcgccacctgcaccatcaactggagaaagaacgacagaagcttcgtgagctacaccatgaccgtgatcgccatcaacttcatcgtgcccctgaccgtgatgttctactgctactaccacgtgaccctgagcatcaagcaccacaccaccagcgactgcaccgagagcctgaacagagactggagcgaccagatcgacgtgaccaagatgagcgtgatcatgatctgcatgttcctggtggcctggagcccctacagcatcgtgtgcctgtgggccagcttcggcgaccccaagaagatccccccccccatggccatcatcgcccccctgttcgccaagagcagcaccttctacaacccctgcatctacgtggtggccaacaagaagttcagaagagccatgctggccatgttcaagtgccagacccaccagaccatgcccgtgaccagcatcctgcccatggacgtgagccagaaccccctggccagcggcagaatctag

SEQ ID NO: 21555 - DNA, 792 bp, Artificial Sequence
  Description of Artificial Sequence: Synthetic coding sequence
atgagaagaatcagcctgaccagcagccccgtgagactgctgctgttcctgctgctgctgctgatcgccctggagatcatggtgggcggccacagcctgtgcttcaacttcaccatcaagagcctgagcagacccggccagccctggtgcgaggcccaggtgttcctgaacaagaacctgttcctgcagtacaacagcgacaacaacatggtgaagcccctgggcctgctgggcaagaaggtgtacgccaccagcacctggggcgagctgacccagaccctgggcgaggtgggcagagacctgagaatgctgctgtgcgacatcaagccccagatcaagaccagcgaccccagcaccctgcaggtggagatgttctgccagagagaggccgagagatgcaccggcgccagctggcagttcgccaccaacggcgagaagagcctgctgttcgacgccatgaacatgacctggaccgtgatcaaccacgaggccagcaagatcaaggagacctggaagaaggacagaggcctggagaagtacttcagaaagctgagcaagggcgactgcgaccactggctgagagagttcctgggccactgggaggccatgcccgagcccaccgtgagccccgtgaacgccagcgacatccactggagcagcagcagcctgcccgacagatggatcatcctgggcgccttcatcctgctggtgctgatgggcatcgtgctgatctgcgtgtggtggcagaacggcgagtggcaggccggcctgtggcccctgagaaccagctag

SEQ ID NO: 21556 - DNA, 684 bp, Artificial Sequence
  Description of Artificial Sequence: Synthetic coding sequence
atgagaagaatcagcctgaccagcagccccgtgagactgctgctgttcctgctgctgctgctgatcgccctggagatcatgtacaacagcgacaacaacatggtgaagcccctgggcctgctgggcaagaaggtgtacgccaccagcacctggggcgagctgacccagaccctgggcgaggtgggcagagacctgagaatgctgctgtgcgacatcaagccccagatcaagaccagcgaccccagcaccctgcaggtggagatgttctgccagagagaggccgagagatgcaccggcgccagctggcagttcgccaccaacggcgagaagagcctgctgttcgacgccatgaacatgacctggaccgtgatcaaccacgaggccagcaagatcaaggagacctggaagaaggacagaggcctggagaagtacttcagaaagctgagcaagggcgactgcgaccactggctgagagagttcctgggccactgggaggccatgcccgagcccaccgtgagccccgtgaacgccagcgacatccactggagcagcagcagcctgcccgacagatggatcatcctgggcgccttcatcctgctggtgctgatgggcatcgtgctgatctgcgtgtggtggcagaacggcgagtggcaggccggcctgtggcccctgagaaccagctag

SEQ ID NO: 21557 - DNA, 354 bp, Artificial Sequence
  Description of Artificial Sequence: Synthetic coding sequence
atgagaagaatcagcctgaccagcagccccgtgagactgctgctgttcctgctgctgctgctgatcgccctggagatcatggtgggcggccacagcctgtgcttcaacttcaccatcaagagcctgagcagacccggccagccctggtgcgaggcccaggtgttcctgaacaagaacctgttcctgcagtacaacagcgacaacaacatggtgaagcccctgggcctgctgggcaagaagatcctgcccctgtgcaagagcagatgcttcgtgaacgtgaagcagaacggcgccctggtgcaccccggcagcagcccccccatggagagaaaccccagcagcctgacccagtag

SEQ ID NO: 21558 - DNA, 630 bp, Artificial Sequence
  Description of Artificial Sequence: Synthetic coding sequence
atgagaagaatcagcctgaccagcagccccgtgagactgctgctgttcctgctgctgctgctgatcgccctggagatcatggtgggcggccacagcctgtgcttcaacttcaccatcaagagcctgagcagacccggccagccctggtgcgaggcccaggtgttcctgaacaagaacctgttcctgcagtacaacagcgacaacaacatggtgaagcccctgggcctgctgggcaagaaggtgtacgccaccagcacctggggcgagctgacccagaccctgggcgaggtgggcagagacctgagaatgctgctgtgcgacatcaagccccagatcaagaccagcgaccccagcaccctgcaggtggagatgttctgccagagagaggccgagagatgcaccggcgccagctggcagttcgccaccaacggcgagaagagcctgctgttcgacgccatgaacatgacctggaccgtgatcaaccacgaggccagcaagatcaaggagacctggaagaaggacagaggcctggagaagtacttcagaaagctgagcaagggcgactgcgaccactggctgagagagttcctgggccactgggaggccatgcccgagcccaccggcaactag

SEQ ID NO: 21559 - DNA, 243 bp, Artificial Sequence
  Description of Artificial Sequence: Synthetic coding sequence
atgagaagaatcagcctgaccagcagccccgtgagactgctgctgttcctgctgctgctgctgatcgccctggagatcatggtgggcggccacagcctgtgcttcaacttcaccatcaagagcctgagcagacccggccagccctggtgcgaggcccaggtgttcctgaacaagaacctgttcctgcagtacaacagcgacaacaacatggtgaagcccctgggcctgctgggcaagaagtag

SEQ ID NO: 21560 - DNA, 639 bp, Artificial Sequence
  Description of Artificial Sequence: Synthetic coding sequence
atgagaagaatcagcctgaccagcagccccgtgagactgctgctgttcctgctgctgctgctgatcgccctggagatcatggtgggcggccacagcctgtgcttcaacttcaccatcaagagcctgagcagacccggccagccctggtgcgaggcccaggtgttcctgaacaagaacctgttcctgcagtacaacagcgacaacaacatggtgaagcccctgggcctgctgggcaagaaggtgtacgccaccagcacctggggcgagctgacccagaccctgggcgaggtgggcagagacctgagaatgctgctgtgcgacatcaagccccagatcaagaccagcgaccccagcaccctgcaggtggagatgttctgccagagagaggccgagagatgcaccggcgccagctggcagttcgccaccaacggcgagaagagcctgctgttcgacgccatgaacatgacctggaccgtgatcaaccacgaggccagcaagatcaaggagacctggaagaaggacagaggcctggagaagtacttcagaaagctgagcaagggcgactgcgaccactggctgagagagttcctgggccactgggaggccatgcccgagcccaccggcagaagaagcacctag

SEQ ID NO: 21561 - DNA, 1005 bp, Artificial Sequence
  Description of Artificial Sequence: Synthetic coding sequence
atggccgccgccgccagccccgccttcctgctgagactgcccctgctgctgctgctgagcagctggtgcagaaccggcctggccgacccccacagcctgtgctacgacatcaccgtgatccccaagttcagacccggccccagatggtgcgccgtgcagggccaggtggacgagaagaccttcctgcactacgactgcggcagcaagaccgtgacccccgtgagccccctgggcaagaagctgaacgtgaccaccgcctggaaggcccagaaccccgtgctgagagaggtggtggacatcctgaccgagcagctgctggacatccagctggagaactacatccccaaggagcccctgaccctgcaggccagaatgagctgcgagcagaaggccgagggccacggcagcggcagctggcagctgagcttcgacggccagatcttcctgctgttcgacagcgagaacagaatgtggaccaccgtgcaccccggcgccagaaagatgaaggagaagtgggagaacgacaaggacatgaccatgagcttccactacatcagcatgggcgactgcaccggctggctggaggacttcctgatgggcatggacagcaccctggagcccagcgccggcgccccccccaccatgagcagcggcaccgcccagcccagagccaccgccaccaccctgatcctgtgctgcctgctgatcatgtgcctgctgatctgcagcagacacagcctgacccagagccacggccaccacccccagagcctgcagccccccccccacccccccctgctgcaccccacctggctgctgagaagagtgctgtggagcgacagctaccagatcgccaagagacccctgagcggcggccacgtgaccagagtgaccctgcccatcatcggcgacgacagccacagcctgccctgccccctggccctgtacaccatcaacaacggcgccgccagatacagcgagcccctgcaggtgagcatcagctag

SEQ ID NO: 21562 - DNA, 663 bp, Artificial Sequence
  Description of Artificial Sequence: Synthetic coding sequence
atgagcagatacctgctgcccctgagcgccctgggcaccgtggccggcgccgccgtgctgctgaaggactacgtgaccggcggcgcctgccccagcaaggccaccatccccggcaagaccgtgatcgtgaccggcgccaacaccggcatcggcaagcagaccgccctggagctggccagaagaggcggcaacatcatcctggcctgcagagacatggagaagtgcgaggccgccgccaaggacatcagaggcgagaccctgaaccaccacgtgaacgccagacacctggacctggccagcctgaagagcatcagagagttcgccgccaagatcatcgaggaggaggagagagtggacatcctgatcaacaacgccggcgtgatgagatgcccccactggaccaccgaggacggcttcgagatgcagttcggcgtgaaccacctgggccacttcctgctgaccaacctgctgctggacaagctgaaggccagcgcccccagcagaatcatcaacctgagcagcctggcccacgtggccggccacatcgacttcgacgacctgaactggcagaccagaaagtacaacaccaaggccgcctactgccagagcaagctggccatcgtgctgttcaccaaggagctgagcagaagactgcagggctag

SEQ ID NO: 21563 - DNA, 783 bp, Artificial Sequence
  Description of Artificial Sequence: Synthetic coding sequence
atggagaagtgcgaggccgccgccaaggacatcagaggcgagaccctgaaccaccacgtgaacgccagacacctggacctggccagcctgaagagcatcagagagttcgccgccaagatcatcgaggaggaggagagagtggacatcctgatcaacaacgccggcgtgatgagatgcccccactggaccaccgaggacggcttcgagatgcagttcggcgtgaaccacctgggccacttcctgctgaccaacctgctgctggacaagctgaaggccagcgcccccagcagaatcatcaacctgagcagcctggcccacgtggccggccacatcgacttcgacgacctgaactggcagaccagaaagtacaacaccaaggccgcctactgccagagcaagctggccatcgtgctgttcaccaaggagctgagcagaagactgcagggcagcggcgtgaccgtgaacgccctgcaccccggcgtggccagaaccgagctgggcagacacaccggcatccacggcagcaccttcagcagcaccaccctgggccccatcttctggctgctggtgaagagccccgagctggccgcccagcccagcacctacctggccgtggccgaggagctggccgacgtgagcggcaagtacttcgacggcctgaagcagaaggcccccgcccccgaggccgaggacgaggaggtggccagaagactgtgggccgagagcgccagactggtgggcctggaggcccccagcgtgagagagcagcccctgcccagatag

SEQ ID NO: 21564 - DNA, 996 bp, Artificial Sequence
  Description of Artificial Sequence: Synthetic coding sequence
atgagcagatacctgctgcccctgagcgccctgggcaccgtggccggcgccgccgtgctgctgaaggactacgtgaccggcggcgcctgccccagcaaggccaccatccccggcaagaccgtgatcgtgaccggcgccaacaccggcatcggcaagcagaccgccctggagctggccagaagaggcggcaacatcatcctggcctgcagagacatggagaagtgcgaggccgccgccaaggacatcagaggcgagaccctgaaccaccacgtgaacgccagacacctggacctggccagcctgaagagcatcagagagttcgccgccaagatcatcgaggaggaggagagagtggacatcctgatcaacaacgccggcgtgatgagatgcccccactggaccaccgaggacggcttcgagatgcagttcggcgtgaaccacctgggccacttcctgctgaccaacctgctgctggacaagctgaaggccagcgcccccagcagaatcatcaacctgagcagcctggcccacgtggccggccacatcgacttcgacgacctgaactggcagaccagaaagtacaacaccaaggccgcctactgccagagcaagctggccatcgtgctgttcaccaaggagctgagcagaagactgcagggcagcggcgtgaccgtgaacgccctgcaccccggcgtggccagaaccgagctgggcagacacaccggcatccacggcagcaccttcagcagcaccaccctgggccccatcttctggctgctggtgaagagccccgagctggccgcccagcccagcacctacctggccgtggccgaggagctggccgacgtgagcggcaagtacttcgacggcctgaagcagaaggcccccgcccccgaggccgaggacgaggaggtggccagaagactgtgggccgagagcgccagactggtgggcctggaggcccccagcgtgagagagcagcccctgcccagatag

SEQ ID NO: 21565 - DNA, 1011 bp, Artificial Sequence
  Description of Artificial Sequence: Synthetic coding sequence
atggccgtggccaccgccgccgccgtgctggccgccctgggcggcgccctgtggctggccgccagaagattcgtgggccccagagtgcagagactgagaagaggcggcgaccccggcctgatgcacggcaagaccgtgctgatcaccggcgccaacagcggcctgggcagagccaccgccgccgagctgctgagactgggcgccagagtgatcatgggctgcagagacagagccagagccgaggaggccgccggccagctgagaagagagctgagacaggccgccgagtgcggccccgagcccggcgtgagcggcgtgggcgagctgatcgtgagagagctggacctggccagcctgagaagcgtgagagccttctgccaggagatgctgcaggaggagcccagactggacgtgctgatcaacaacgccggcatcttccagtgcccctacatgaagaccgaggacggcttcgagatgcagttcggcgtgaaccacctgggccacttcctgctgaccaacctgctgctgggcctgctgaagagcagcgcccccagcagaatcgtggtggtgagcagcaagctgtacaagtacggcgacatcaacttcgacgacctgaacagcgagcagagctacaacaagagcttctgctacagcagaagcaagctggccaacatcctgttcaccagagagctggccagaagactggagggcaccaacgtgaccgtgaacgtgctgcaccccggcatcgtgagaaccaacctgggcagacacatccacatccccctgctggtgaagcccctgttcaacctggtgagctgggccttcttcaagacccccgtggagggcgcccagaccagcatctacctggccagcagccccgaggtggagggcgtgagcggcagatacttcggcgactgcaaggaggaggagctgctgcccaaggccatggacgagagcgtggccagaaagctgtgggacatcagcgaggtgatggtgggcctgctgaagtag

SEQ ID NO: 21566 - DNA, 954 bp, Artificial Sequence
  Description of Artificial Sequence: Synthetic coding sequence
atgtggctgtacctggccgtgttcgtgggcctgtactacctgctgcactggtacagagagagacaggtgctgagccacctgagagacaagtacgtgttcatcaccggctgcgacagcggcttcggcaagctgctggccagacagctggacgccagaggcctgagagtgctggccgcctgcctgaccgagaagggcgccgagcagctgagaggccagaccagcgacagactggagaccgtgaccctggacgtgaccaagaccgagagcgtggccgccgccgcccagtgggtgaaggagtgcgtgagagacaagggcctgtggggcctggtgaacaacgccggcatcagcctgcccaccgcccccaacgagctgctgaccaagcaggacttcgtgaccatcctggacgtgaacctgctgggcgtgatcgacgtgaccctgagcctgctgcccctggtgagaagagccagaggcagagtggtgaacgtgagcagcgtgatgggcagagtgagcctgttcggcggcggctactgcatcagcaagtacggcgtggaggccttcagcgacagcctgagaagagagctgagctacttcggcgtgaaggtggccatgatcgagcccggctacttcaagaccgccgtgaccagcaaggagagattcctgaagagcttcctggagatctgggacagaagcagccccgaggtgaaggaggcctacggcgagaagttcgtggccgactacaagaagagcgccgagcagatggagcagaagtgcacccaggacctgagcctggtgaccaactgcatggagcacgccctgatcgcctgccaccccagaaccagatacagcgccggctgggacgccaagctgctgtacctgcccatgagctacatgcccaccttcctggtggacgccatcatgtactgggtgagccccagccccgccaaggccctgtag

SEQ ID NO: 21567 - DNA, 1446 bp, Artificial Sequence
  Description of Artificial Sequence: Synthetic coding sequence
atgtggctgcccctggtgctgctgctggccgtgctgctgctggccgtgctgtgcaaggtgtacctgggcctgttcagcggcagcagccccaaccccttcagcgaggacgtgaagagaccccccgcccccctggtgaccgacaaggaggccagaaagaaggtgctgaagcaggccttcagcgccaaccaggtgcccgagaagctggacgtggtggtgatcggcagcggcttcggcggcctggccgccgccgccatcctggccaaggccggcaagagagtgctggtgctggagcagcacaccaaggccggcggctgctgccacaccttcggcaagaacggcctggagttcgacaccggcatccactacatcggcagaatggaggagggcagcatcggcagattcatcctggaccagatcaccgagggccagctggactgggcccccctgagcagccccttcgacatcatggtgctggagggccccaacggcagaaaggagtaccccatgtacagcggcgagaaggcctacatccagggcctgaaggagaagttcccccaggaggaggccatcatcgacaagtacatcaagctggtgaaggtggtgagcagcggcgccccccacgccatcctgctgaagttcctgcccctgcccgtggtgcagctgctggacagatgcggcctgctgaccagattcagccccttcctgcaggccagcacccagagcctggccgaggtgctgcagcagctgggcgccagcagcgagctgcaggccgtgctgagctacatcttccccacctacggcgtgacccccaaccacagcgccttcagcatgcacgccctgctggtgaaccactacatgaagggcggcttctaccccagaggcggcagcagcgagatcgccttccacaccatccccgtgatccagagagccggcggcgccgtgctgaccaaggccaccgtgcagagcgtgctgctggacagcgccggcaaggcctgcggcgtgagcgtgaagaagggccacgagctggtgaacatctactgccccatcgtggtgagcaacgccggcctgttcaacacctacgagcacctgctgcccggcaacgccagatgcctgcccggcgtgaagcagcagctgggcaccgtgagacccggcctgggcatgaccagcgtgttcatctgcctgagaggcaccaaggaggacctgcacctgcccagcaccaactactacgtgtactacgacaccgacatggaccaggccatggagagatacgtgagcatgcccagagaggaggccgccgagcacatccccctgctgttcttcgccttccccagcgccaaggaccccacctgggaggacagattccccggcggcgagtgcgactgcagaatccccacccaccagcccgtgctgagcggctgcagccccagatgcctgctgagaggctag

SEQ ID NO: 21568 - DNA, 1833 bp, Artificial Sequence
  Description of Artificial Sequence: Synthetic coding sequence
atgtggctgcccctggtgctgctgctggccgtgctgctgctggccgtgctgtgcaaggtgtacctgggcctgttcagcggcagcagccccaaccccttcagcgaggacgtgaagagaccccccgcccccctggtgaccgacaaggaggccagaaagaaggtgctgaagcaggccttcagcgccaaccaggtgcccgagaagctggacgtggtggtgatcggcagcggcttcggcggcctggccgccgccgccatcctggccaaggccggcaagagagtgctggtgctggagcagcacaccaaggccggcggctgctgccacaccttcggcaagaacggcctggagttcgacaccggcatccactacatcggcagaatggaggagggcagcatcggcagattcatcctggaccagatcaccgagggccagctggactgggcccccctgagcagccccttcgacatcatggtgctggagggccccaacggcagaaaggagtaccccatgtacagcggcgagaaggcctacatccagggcctgaaggagaagttcccccaggaggaggccatcatcgacaagtacatcaagctggtgaaggtggtgagcagcggcgccccccacgccatcctgctgaagttcctgcccctgcccgtggtgcagctgctggacagatgcggcctgctgaccagattcagccccttcctgcaggccagcacccagagcctggccgaggtgctgcagcagctgggcgccagcagcgagctgcaggccgtgctgagctacatcttccccacctacggcgtgacccccaaccacagcgccttcagcatgcacgccctgctggtgaaccactacatgaagggcggcttctaccccagaggcggcagcagcgagatcgccttccacaccatccccgtgatccagagagccggcggcgccgtgctgaccaaggccaccgtgcagagcgtgctgctggacagcgccggcaaggcctgcggcgtgagcgtgaagaagggccacgagctggtgaacatctactgccccatcgtggtgagcaacgccggcctgttcaacacctacgagcacctgctgcccggcaacgccagatgcctgcccggcgtgaagcagcagctgggcaccgtgagacccggcctgggcatgaccagcgtgttcatctgcctgagaggcaccaaggaggacctgcacctgcccagcaccaactactacgtgtactacgacaccgacatggaccaggccatggagagatacgtgagcatgcccagagaggaggccgccgagcacatccccctgctgttcttcgccttccccagcgccaaggaccccacctgggaggacagattccccggcagaagcaccatgatcatgctgatccccaccgcctacgagtggttcgaggagtggcaggccgagctgaagggcaagagaggcagcgactacgagaccttcaagaacagcttcgtggaggccagcatgagcgtggtgctgaagctgttcccccagctggagggcaaggtggagagcgtgaccgccggcagccccctgaccaaccagttctacctggccgcccccagaggcgcctgctacggcgccgaccacgacctgggcagactgcacccctgcgtgatggccagcctgagagcccagagccccatccccaacctgtacctgaccggccaggacatcttcacctgcggcctggtgggcgccctgcagggcgccctgctgtgcagcagcgccatcctgaagagaaacctgtacagcgacctgaagaacctggacagcagaatcagagcccagaagaagaagaactag

SEQ ID NO: 21569 - DNA, 1650 bp, Artificial Sequence
  Description of Artificial Sequence: Synthetic coding sequence
atgtggctgcccctggtgctgctgctggccgtgctgctgctggccgtgctgtgcaaggtgtacctgggcctgttcagcggcagcagccccaaccccttcagcgaggacgtgaagagaccccccgcccccctggtgaccgacaaggaggccagaaagaaggtgctgaagcagggcatccactacatcggcagaatggaggagggcagcatcggcagattcatcctggaccagatcaccgagggccagctggactgggcccccctgagcagccccttcgacatcatggtgctggagggccccaacggcagaaaggagtaccccatgtacagcggcgagaaggcctacatccagggcctgaaggagaagttcccccaggaggaggccatcatcgacaagtacatcaagctggtgaaggtggtgagcagcggcgccccccacgccatcctgctgaagttcctgcccctgcccgtggtgcagctgctggacagatgcggcctgctgaccagattcagccccttcctgcaggccagcacccagagcctggccgaggtgctgcagcagctgggcgccagcagcgagctgcaggccgtgctgagctacatcttccccacctacggcgtgacccccaaccacagcgccttcagcatgcacgccctgctggtgaaccactacatgaagggcggcttctaccccagaggcggcagcagcgagatcgccttccacaccatccccgtgatccagagagccggcggcgccgtgctgaccaaggccaccgtgcagagcgtgctgctggacagcgccggcaaggcctgcggcgtgagcgtgaagaagggccacgagctggtgaacatctactgccccatcgtggtgagcaacgccggcctgttcaacacctacgagcacctgctgcccggcaacgccagatgcctgcccggcgtgaagcagcagctgggcaccgtgagacccggcctgggcatgaccagcgtgttcatctgcctgagaggcaccaaggaggacctgcacctgcccagcaccaactactacgtgtactacgacaccgacatggaccaggccatggagagatacgtgagcatgcccagagaggaggccgccgagcacatccccctgctgttcttcgccttccccagcgccaaggaccccacctgggaggacagattccccggcagaagcaccatgatcatgctgatccccaccgcctacgagtggttcgaggagtggcaggccgagctgaagggcaagagaggcagcgactacgagaccttcaagaacagcttcgtggaggccagcatgagcgtggtgctgaagctgttcccccagctggagggcaaggtggagagcgtgaccgccggcagccccctgaccaaccagttctacctggccgcccccagaggcgcctgctacggcgccgaccacgacctgggcagactgcacccctgcgtgatggccagcctgagagcccagagccccatccccaacctgtacctgaccggccaggacatcttcacctgcggcctggtgggcgccctgcagggcgccctgctgtgcagcagcgccatcctgaagagaaacctgtacagcgacctgaagaacctggacagcagaatcagagcccagaagaagaagaactag

SEQ ID NO: 21570 - DNA, 699 bp, Artificial Sequence
  Description of Artificial Sequence: Synthetic coding sequence
atgaaggagagaagagccccccagcccgtggtggccagatgcaagctggtgctggtgggcgacgtgcagtgcggcaagaccgccatgctgcaggtgctggccaaggactgctaccccgagacctacgtgcccaccgtgttcgagaactacaccgcctgcctggagaccgaggagcagagagtggagctgagcctgtgggacaccagcggcagcccctactacgacaacgtgagacccctgtgctacagcgacagcgacgccgtgctgctgtgcttcgacatcagcagacccgagaccgtggacagcgccctgaagaagtggagaaccgagatcctggactactgccccagcaccagagtgctgctgatcggctgcaagaccgacctgagaaccgacctgagcaccctgatggagctgagccaccagaagcaggcccccatcagctacgagcagggctgcgccatcgccaagcagctgggcgccgagatctacctggagggcagcgccttcaccagcgagaagagcatccacagcatcttcagaaccgccagcatgctgtgcctgaacaagcccagccccctgccccagaagagccccgtgagaagcctgagcaagagactgctgcacctgcccagcagaagcgagctgatcagcagcaccttcaagaaggagaaggccaagagctgcagcatcatgtag

SEQ ID NO: 21571 - DNA, 381 bp, Artificial Sequence
  Description of Artificial Sequence: Synthetic coding sequence
tggagaaccgagatcctggactactgccccagcaccagagtgctgctgatcggctgcaagaccgacctgagaaccgacctgagcaccctgatggagctgagccaccagaagcaggcccccatcagctacgagcagggctgcgccatcgccaagcagctgggcgccgagatctacctggagggcagcgccttcaccagcgagaagagcatccacagcatcttcagaaccgccagcatgctgtgcctgaacaagcccagccccctgccccagaagagccccgtgagaagcctgagcaagagactgctgcacctgcccagcagaagcgagctgatcagcagcaccttcaagaaggagaaggccaagagctgcagcatcatgtag

SEQ ID NO: 21572 - DNA, 924 bp, Artificial Sequence
  Description of Artificial Sequence: Synthetic coding sequence
atgaccaaggccggcagcaagggcggcaacctgagagacaagctggacggcaacgagctggacctgagcctgagcgacctgaacgaggtgcccgtgaaggagctggccgccctgcccaaggccaccatcctggacctgagctgcaacaagctgaccaccctgcccagcgacttctgcggcctgacccacctggtgaagctggacctgagcaagaacaagctgcagcagctgcccgccgacttcggcagactggtgaacctgcagcacctggacctgctgaacaacaagctggtgaccctgcccgtgagcttcgcccagctgaagaacctgaagtggctggacctgaaggacaaccccctggaccccgtgctggccaaggtggccggcgactgcctggacgagaagcagtgcaagcagtgcgccaacaaggtgctgcagcacatgaaggccgtgcaggccgaccaggagagagagagacagagaagactggaggtggagagagaggccgagaagaagagagaggccaagcagagagccaaggaggcccaggagagagagctgagaaagagagagaaggccgaggagaaggagagaagaagaaaggagtacgacgccctgaaggccgccaagagagagcaggagaagaagcccaagaaggaggccaaccaggcccccaagagcaagagcggcagcagacccagaaagcccccccccagaaagcacaccagaagctgggccgtgctgaagctgctgctgctgctgctgctgttcggcgtggccggcggcctggtggcctgcagagtgaccgagctgcagcagcagcccctgtgcaccagcgtgaacaccatctacgacaacgccgtgcagggcctgagaagacacgagatcctgcagtgggtgctgcagaccgacagccagcagtag

SEQ ID NO: 21573 - DNA, 687 bp, Artificial Sequence
  Description of Artificial Sequence: Synthetic coding sequence
atggagggccagagcggcagatgcaagatcgtggtggtgggcgacgccgagtgcggcaagaccgccctgctgcaggtgttcgccaaggacgcctaccccggcagctacgtgcccaccgtgttcgagaactacaccgccagcttcgagatcgacaagagaagaatcgagctgaacatgtgggacaccagcggcagcagctactacgacaacgtgagacccctggcctaccccgacagcgacgccgtgctgatctgcttcgacatcagcagacccgagaccctggacagcgtgctgaagaagtggcagggcgagacccaggagttctgccccaacgccaaggtggtgctggtgggctgcaagctggacatgagaaccgacctggccaccctgagagagctgagcaagcagagactgatccccgtgacccacgagcaggtgggcaccgtgctggccaagcaggtgggcgccgtgagctacgtggagtgcagcagcagaagcagcgagagaagcgtgagagacgtgttccacgtggccaccgtggccagcctgggcagaggccacagacagctgagaagaaccgacagcagaagaggcatgcagagaagcgcccagctgagcggcagacccgacagaggcaacgagggcgagatccacaaggacagagccaagagctgcaacctgatgtag

SEQ ID NO: 21574 - DNA, 684 bp, Artificial Sequence
  Description of Artificial Sequence: Synthetic coding sequence
atggagggccagagcggcagatgcaagatcgtggtggtgggcgacgccgagtgcggcaagaccgccctgctgcaggtgttcgccaaggacgcctaccccggcagctacgtgcccaccgtgttcgagaactacaccgccagcttcgagatcgacaagagaagaatcgagctgaacatgtgggacaccagcggcagcagctactacgacaacgtgagacccctggcctaccccgacagcgacgccgtgctgatctgcttcgacatcagcagacccgagaccctggacagcgtgctgaagaagtggcagggcgagacccaggagttctgccccaacgccaaggtggtgctggtgggctgcaagctggacatgagaaccgacctggccaccctgagagagctgagcaagcagagactgatccccgtgacccacgagcagggcaccgtgctggccaagcaggtgggcgccgtgagctacgtggagtgcagcagcagaagcagcgagagaagcgtgagagacgtgttccacgtggccaccgtggccagcctgggcagaggccacagacagctgagaagaaccgacagcagaagaggcatgcagagaagcgcccagctgagcggcagacccgacagaggcaacgagggcgagatccacaaggacagagccaagagctgcaacctgatgtag

SEQ ID NO: 21575 - DNA, 6264 bp, Artificial Sequence
  Description of Artificial Sequence: Synthetic coding sequence
atggagaccgagagcgagagcagcaccctgggcgacgacagcgtgttctggctggagagcgaggtgatcatccaggtgaccgactgcgaggaggaggagagagaggagaagttcagaaagatgaagagcagcgtgcacagcgaggaggacgacttcgtgcccgagctgcacagaaacgtgcaccccagagagagacccgactgggaggagaccctgagcgccatggccagaggcgccgacgtgcccgagatccccggcgacctgaccctgaagacctgcggcagcaccgccagcatgaaggtgaagcacgtgaagaagctgcccttcaccaagggccacttccccaagatggccgagtgcgcccacttccactacgagaacgtggagttcggcagcatccagctgagcctgagcgaggagcagaacgaggtgatgaagaacggctgcgagagcaaggagctggtgtacctggtgcagatcgcctgccagggcaagagctggatcgtgaagagaagctacgaggacttcagagtgctggacaagcacctgcacctgtgcatctacgacagaagattcagccagctgagcgagctgcccagaagcgacaccctgaaggacagccccgagagcgtgacccagatgctgatggcctacctgagcagactgagcgccatcgccggcaacaagatcaactgcggccccgccctgacctggatggagatcgacaacaagggcaaccacctgctggtgcacgaggagagcagcatcaacacccccgccgtgggcgccgcccacgtgatcaagagatacaccgccagagcccccgacgagctgaccctggaggtgggcgacatcgtgagcgtgatcgacatgccccccaaggtgctgagcacctggtggagaggcaagcacggcttccaggtgggcctgttccccggccactgcgtggagctgatcaaccagaaggtgccccagagcgtgaccaacagcgtgcccaagcccgtgagcaagaagcacggcaagctgatcaccttcctgagaaccttcatgaagagcagacccaccaagcagaagctgaagcagagaggcatcctgaaggagagagtgttcggctgcgacctgggcgagcacctgctgaacagcggcttcgaggtgccccaggtgctgcagagctgcaccgccttcatcgagagatacggcatcgtggacggcatctacagactgagcggcgtggccagcaacatccagagactgagacacgagttcgacagcgagcacgtgcccgacctgaccaaggagccctacgtgcaggacatccacagcgtgggcagcctgtgcaagctgtacttcagagagctgcccaaccccctgctgacctaccagctgtacgagaagttcagcgacgccgtgagcgccgccaccgacgaggagagactgatcaagatccacgacgtgatccagcagctgccccccccccactacagaaccctggagttcctgatgagacacctgagcctgctggccgactactgcagcatcaccaacatgcacgccaagaacctggccatcgtgtgggcccccaacctgctgagaagcaagcagatcgagagcgcctgcttcagcggcaccgccgccttcatggaggtgagaatccagagcgtggtggtggagttcatcctgaaccacgtggacgtgctgttcagcggcagaatcagcatggccatgcaggagggcgccgccagcctgagcagacccaagagcctgctggtgagcagccccagcaccaagctgctgaccctggaggaggcccaggccagaacccaggcccaggtgaacagccccatcgtgaccgagaacaagtacatcgaggtgggcgagggccccgccgccctgcagggcaagttccacaccatcatcgagttccccctggagagaaagagaccccagaacaagatgaagaagagccccgtgggcagctggagaagcttcttcaacctgggcaagagcagcagcgtgagcaagagaaagctgcagagaaacgagagcgagcccagcgagatgaaggccatggccctgaagggcggcagagccgagggcaccctgagaagcgccaagagcgaggagagcctgaccagcctgcacgccgtggacggcgacagcaagctgttcagacccagaagacccagaagcagcagcgacgccctgagcgccagcttcaacggcgagatgctgggcaacagatgcaacagctacgacaacctgccccacgacaacgagagcgaggaggagggcggcctgctgcacatccccgccctgatgagcccccacagcgccgaggacgtggacctgagcccccccgacatcggcgtggccagcctggacttcgaccccatgagcttccagtgcagcccccccaaggccgagagcgagtgcctggagagcggcgccagcttcctggacagccccggctacagcaaggacaagcccagcgccaacaagaaggacgccgagaccggcagcagccagtgccagacccccggcagcaccgccagcagcgagcccgtgagccccctgcaggagaagctgagccccttcttcaccctggacctgagccccaccgaggacaagagcagcaagcccagcagcttcaccgagaaggtggtgtacgccttcagccccaagatcggcagaaagctgagcaagagccccagcatgagcatcagcgagcccatcagcgtgaccctgccccccagagtgagcgaggtgatcggcaccgtgagcaacaccaccgcccagaacgccagcagcagcacctgggacaagtgcgtggaggagagagacgccaccaacagaagccccacccagatcgtgaagatgaagaccaacgagaccgtggcccaggaggcctacgagagcgaggtgcagcccctggaccaggtggccgccgaggaggtggagctgcccggcaaggaggaccagagcgtgagcagcagccagagcaaggccgtggccagcggccagacccagaccggcgccgtgacccacgaccccccccaggacagcgtgcccgtgagcagcgtgagcctgatcccccccccccccccccccaagaacgtggccagaatgctggccctggccctggccgagagcgcccagcaggccagcacccagagcctgaagagacccggcaccagccaggccggctacaccaactacggcgacatcgccgtggccaccaccgaggacaacctgagcagcagctacagcgccgtggccctggacaaggcctacttccagaccgacagacccgccgagcagttccacctgcagaacaacgcccccggcaactgcgaccaccccctgcccgagaccaccgccaccggcgaccccacccacagcaacaccaccgagagcggcgagcagcaccaccaggtggacctgaccggcaaccagccccaccaggcctacctgagcggcgaccccgagaaggccagaatcaccagcgtgcccctggacagcgagaagagcgacgaccacgtgagcttccccgaggaccagagcggcaagaacagcatgcccaccgtgagcttcctggaccaggaccagagcccccccagattctacagcggcgaccagccccccagctacctgggcgccagcgtggacaagctgcaccaccccctggagttcgccgacaagagccccaccccccccaacctgcccagcgacaagatctacccccccagcggcagccccgaggagaacaccagcaccgccaccatgacctacatgaccaccacccccgccaccgcccagatgagcaccaaggaggccagctgggacgtggccgagcagcccaccaccgccgacttcgccgccgccaccctgcagagaacccacagaaccaacagacccctgccccccccccccagccagagaagcgccgagcagccccccgtggtgggccaggtgcaggccgccaccaacatcggcctgaacaacagccacaaggtgcagggcgtggtgcccgtgcccgagagaccccccgagcccagagccatggacgaccccgccagcgccttcatcagcgacagcggcgccgccgccgcccagtgccccatggccaccgccgtgcagcccggcctgcccgagaaggtgagagacggcgccagagtgcccctgctgcacctgagagccgagagcgtgcccgcccacccctgcggcttccccgcccccctgccccccaccagaatgatggagagcaagatgatcgccgccatccacagcagcagcgccgacgccaccagcagcagcaactaccacagcttcgtgaccgccagcagcaccagcgtggacgacgccctgcccctgcccctgcccgtgccccagcccaagcacgccagccagaagaccgtgtacagcagcttcgccagacccgacgtgaccaccgagcccttcggccccgacaactgcctgcacttcaacatgacccccaactgccagtacagaccccagagcgtgcccccccaccacaacaagctggagcagcaccaggtgtacggcgccagaagcgagccccccgccagcatgggcctgagatacaacacctacgtggcccccggcagaaacgccagcggccaccacagcaagccctgcagcagagtggagtacgtgagcagcctgagcagcagcgtgagaaacacctgctaccccgaggacatccccccctaccccaccatcagaagagtgcagagcctgcacgccccccccagcagcatgatcagaagcgtgcccatcagcagaaccgaggtgccccccgacgacgagcccgcctactgccccagacccctgtaccagtacaagccctaccagagcagccaggccagaagcgactaccacgtgacccagctgcagccctacttcgagaacggcagagtgcactacagatacagcccctacagcagcagcagcagcagctactacagccccgacggcgccctgtgcgacgtggacgcctacggcaccgtgcagctgagacccctgcacagactgcccaacagagacttcgccttctacaaccccagactgcagggcaagagcctgtacagctacgccggcctggcccccagacccagagccaacgtgaccggctacttcagccccaacgaccacaacgtggtgagcatgccccccgccgccgacgtgaagcacacctacaccagctgggacctggaggacatggagaagtacagaatgcagagcatcagaagagagagcagagccagacagaaggtgaagggccccgtgatgagccagtacgacaacatgacccccgccgtgcaggacgacctgggcggcatctacgtgatccacctgagaagcaagagcgaccccggcaagaccggcctgctgagcgtggccgagggcaaggagagcagacacgccgccaaggccatcagccccgagggcgaggacagattctacagaagacaccccgaggccgagatggacagagcccaccaccacggcggccacggcagcacccagcccgagaagcccagcctgccccagaagcagagcagcctgagaagcagaaagctgcccgacatgggctgcagcctgcccgagcacagagcccaccaggaggccagccacagacagttctgcgagagcaagaacggccccccctacccccagggcgccggccagctggactacggcagcaagggcatccccgacaccagcgagcccgtgagctaccacaacagcggcgtgaagtacgccgccagcggccaggagagcctgagactgaaccacaaggaggtgagactgagcaaggagatggagagaccctgggtgagacagcccagcgcccccgagaagcacagcagagactgctacaaggaggaggagcacctgacccagagcatcgtgcccccccccaagcccgagagaagccacagcctgaagctgcaccacacccagaacgtggagagagaccccagcgtgctgtaccagtaccagccccacggcaagagacagagcagcgtgaccgtggtgagccagtacgacaacctggaggactaccacagcctgccccagcaccagagaggcgtgttcggcggcggcggcatgggcacctacgtgccccccggcttcccccacccccagagcagaacctacgccaccgccctgggccagggcgccttcctgcccgccgagctgagcctgcagcaccccgagacccagatccacgccgagtag

SEQ ID NO: 21576 - DNA, 969 bp, Artificial Sequence
  Description of Artificial Sequence: Synthetic coding sequence
atgccccccaaggtgctgagcacctggtggagaggcaagcacggcttccaggtgggcctgttccccggccactgcgtggagctgatcaaccagaaggtgccccagagcgtgaccaacagcgtgcccaagcccgtgagcaagaagcacggcaagctgatcaccttcctgagaaccttcatgaagagcagacccaccaagcagaagctgaagcagagaggcatcctgaaggagagagtgttcggctgcgacctgggcgagcacctgctgaacagcggcttcgaggtgccccaggtgctgcagagctgcaccgccttcatcgagagatacggcatcgtggacggcatctacagactgagcggcgtggccagcaacatccagagactgagacacgagttcgacagcgagcacgtgcccgacctgaccaaggagccctacgtgcaggacatccacagcgtgggcagcctgtgcaagctgtacttcagagagctgcccaaccccctgctgacctaccagctgtacgagaagttcagcgacgccgtgagcgccgccaccgacgaggagagactgatcaagatccacgacgtgatccagcagctgccccccccccactacagaaccctggagttcctgatgagacacctgagcctgctggccgactactgcagcatcaccaacatgcacgccaagaacctggccatcgtgtgggcccccaacctgctgagaagcaagcagatcgagagcgcctgcttcagcggcaccgccgccttcatggaggtgagaatccagagcgtggtggtggagttcatcctgaaccacgtggacgtgctgctgccccacttcagcgccagaaccgagctgatcgtgcccttccccctgagactgcccagaaagcagttcaccccccccctgctgggccccatgagccccctgaaccccctggtgcagatcaccgtgtgcatcagcatctag

SEQ ID NO: 21577 - DNA, 2865 bp, Artificial Sequence
  Description of Artificial Sequence: Synthetic coding sequence
gactacgaggagaccagcaagaaggaggccagaggcgccgacgtgcccgagatccccggcgacctgaccctgaagacctgcggcagcaccgccagcatgaaggtgaagcacgtgaagaagctgcccttcaccaagggccacttccccaagatggccgagtgcgcccacttccactacgagaacgtggagttcggcagcatccagctgagcctgagcgaggagcagaacgaggtgatgaagaacggctgcgagagcaaggagctggtgtacctggtgcagatcgcctgccagggcaagagctggatcgtgaagagaagctacgaggacttcagagtgctggacaagcacctgcacctgtgcatctacgacagaagattcagccagctgagcgagctgcccagaagcgacaccctgaaggacagccccgagagcgtgacccagatgctgatggcctacctgagcagactgagcgccatcgccggcaacaagatcaactgcggccccgccctgacctggatggagatcgacaacaagggcaaccacctgctggtgcacgaggagagcagcatcaacacccccgccgtgggcgccgcccacgtgatcaagagatacaccgccagagcccccgacgagctgaccctggaggtgggcgacatcgtgagcgtgatcgacatgccccccaaggtgctgagcacctggtggagaggcaagcacggcttccaggtgggcctgttccccggccactgcgtggagctgatcaaccagaaggtgccccagagcgtgaccaacagcgtgcccaagcccgtgagcaagaagcacggcaagctgatcaccttcctgagaaccttcatgaagagcagacccaccaagcagaagctgaagcagagaggcatcctgaaggagagagtgttcggctgcgacctgggcgagcacctgctgaacagcggcttcgaggtgccccaggtgctgcagagctgcaccgccttcatcgagagatacggcatcgtggacggcatctacagactgagcggcgtggccagcaacatccagagactgagacacgagttcgacagcgagcacgtgcccgacctgaccaaggagccctacgtgcaggacatccacagcgtgggcagcctgtgcaagctgtacttcagagagctgcccaaccccctgctgacctaccagctgtacgagaagttcagcgacgccgtgagcgccgccaccgacgaggagagactgatcaagatccacgacgtgatccagcagctgccccccccccactacagaaccctggagttcctgatgagacacctgagcctgctggccgactactgcagcatcaccaacatgcacgccaagaacctggccatcgtgtgggcccccaacctgctgagaagcaagcagatcgagagcgcctgcttcagcggcaccgccgccttcatggaggtgagaatccagagcgtggtggtggagttcatcctgaaccacgtggacgtgctgttcagcggcagaatcagcatggccatgcaggagggcgccgccagcctgagcagacccaagagcctgctggtgagcagccccagcaccaagctgctgaccctggaggaggcccaggccagaacccaggcccaggtgaacagccccatcgtgaccgagaacaagtacatcgaggtgggcgagggccccgccgccctgcagggcaagttccacaccatcatcgagttccccctggagagaaagagaccccagaacaagatgaagaagagccccgtgggcagctggagaagcttcttcaacctgggcaagagcagcagcgtgagcaagagaaagctgcagagaaacgagagcgagcccagcgagatgaaggccatggccctgaagggcggcagagccgagggcaccctgagaagcgccaagagcgaggagagcctgaccagcctgcacgccgtggacggcgacagcaagctgttcagacccagaagacccagaagcagcagcgacgccctgagcgccagcttcaacggcgagatgctgggcaacagatgcaacagctacgacaacctgccccacgacaacgagagcgaggaggagggcggcctgctgcacatccccgccctgatgagcccccacagcgccgaggacgtggacctgagcccccccgacatcggcgtggccagcctggacttcgaccccatgagcttccagtgcagcccccccaaggccgagagcgagtgcctggagagcggcgccagcttcctggacagccccggctacagcaaggacaagcccagcgccaacaagaaggacgccgagaccggcagcagccagtgccagacccccggcagcaccgccagcagcgagcccgtgagccccctgcaggagaagctgagccccttcttcaccctggacctgagccccaccgaggacaagagcagcaagcccagcagcttcaccgagaaggtggtgtacgccttcagccccaagatcggcagaaagctgagcaagagccccagcatgagcatcagcgagcccatcagcgtgaccctgccccccagagtgagcgaggtgatcggcaccgtgagcaacaccaccgcccagaacgccagcagcagcacctgggacaagtgcgtggaggagagagacgccaccaacagaagccccacccagatcgtgaagatgaagaccaacgagaccgtggcccaggaggcctacgagagcgaggtgcagcccctggaccaggtggccgccgaggaggtggagctgcccggcaaggaggaccagagcgtgagcagcagccagagcaaggccgtggccagcggccagacccagaccggcaccgtgtgcttcccccccttcttcctgtag

SEQ ID NO: 21578 - DNA, 5217 bp, Artificial Sequence
  Description of Artificial Sequence: Synthetic coding sequence
atgaagagcagacccaccaagcagaagctgaagcagagaggcatcctgaaggagagagtgttcggctgcgacctgggcgagcacctgctgaacagcggcttcgaggtgccccaggtgctgcagagctgcaccgccttcatcgagagatacggcatcgtggacggcatctacagactgagcggcgtggccagcaacatccagagactgagacacgagttcgacagcgagcacgtgcccgacctgaccaaggagccctacgtgcaggacatccacagcgtgggcagcctgtgcaagctgtacttcagagagctgcccaaccccctgctgacctaccagctgtacgagaagttcagcgacgccgtgagcgccgccaccgacgaggagagactgatcaagatccacgacgtgatccagcagctgccccccccccactacagaaccctggagttcctgatgagacacctgagcctgctggccgactactgcagcatcaccaacatgcacgccaagaacctggccatcgtgtgggcccccaacctgctgagaagcaagcagatcgagagcgcctgcttcagcggcaccgccgccttcatggaggtgagaatccagagcgtggtggtggagttcatcctgaaccacgtggacgtgctgttcagcggcagaatcagcatggccatgcaggagggcgccgccagcctgagcagacccaagagcctgctggtgagcagccccagcaccaagctgctgaccctggaggaggcccaggccagaacccaggcccaggtgaacagccccatcgtgaccgagaacaagtacatcgaggtgggcgagggccccgccgccctgcagggcaagttccacaccatcatcgagttccccctggagagaaagagaccccagaacaagatgaagaagagccccgtgggcagctggagaagcttcttcaacctgggcaagagcagcagcgtgagcaagagaaagctgcagagaaacgagagcgagcccagcgagatgaaggccatggccctgaagggcggcagagccgagggcaccctgagaagcgccaagagcgaggagagcctgaccagcctgcacgccgtggacggcgacagcaagctgttcagacccagaagacccagaagcagcagcgacgccctgagcgccagcttcaacggcgagatgctgggcaacagatgcaacagctacgacaacctgccccacgacaacgagagcgaggaggagggcggcctgctgcacatccccgccctgatgagcccccacagcgccgaggacgtggacctgagcccccccgacatcggcgtggccagcctggacttcgaccccatgagcttccagtgcagcccccccaaggccgagagcgagtgcctggagagcggcgccagcttcctggacagccccggctacagcaaggacaagcccagcgccaacaagaaggacgccgagaccggcagcagccagtgccagacccccggcagcaccgccagcagcgagcccgtgagccccctgcaggagaagctgagccccttcttcaccctggacctgagccccaccgaggacaagagcagcaagcccagcagcttcaccgagaaggtggtgtacgccttcagccccaagatcggcagaaagctgagcaagagccccagcatgagcatcagcgagcccatcagcgtgaccctgccccccagagtgagcgaggtgatcggcaccgtgagcaacaccaccgcccagaacgccagcagcagcacctgggacaagtgcgtggaggagagagacgccaccaacagaagccccacccagatcgtgaagatgaagaccaacgagaccgtggcccaggaggcctacgagagcgaggtgcagcccctggaccaggtggccgccgaggaggtggagctgcccggcaaggaggaccagagcgtgagcagcagccagagcaaggccgtggccagcggccagacccagaccggcgccgtgacccacgaccccccccaggacagcgtgcccgtgagcagcgtgagcctgatcccccccccccccccccccaagaacgtggccagaatgctggccctggccctggccgagagcgcccagcaggccagcacccagagcctgaagagacccggcaccagccaggccggctacaccaactacggcgacatcgccgtggccaccaccgaggacaacctgagcagcagctacagcgccgtggccctggacaaggcctacttccagaccgacagacccgccgagcagttccacctgcagaacaacgcccccggcaactgcgaccaccccctgcccgagaccaccgccaccggcgaccccacccacagcaacaccaccgagagcggcgagcagcaccaccaggtggacctgaccggcaaccagccccaccaggcctacctgagcggcgaccccgagaaggccagaatcaccagcgtgcccctggacagcgagaagagcgacgaccacgtgagcttccccgaggaccagagcggcaagaacagcatgcccaccgtgagcttcctggaccaggaccagagcccccccagattctacagcggcgaccagccccccagctacctgggcgccagcgtggacaagctgcaccaccccctggagttcgccgacaagagccccaccccccccaacctgcccagcgacaagatctacccccccagcggcagccccgaggagaacaccagcaccgccaccatgacctacatgaccaccacccccgccaccgcccagatgagcaccaaggaggccagctgggacgtggccgagcagcccaccaccgccgacttcgccgccgccaccctgcagagaacccacagaaccaacagacccctgccccccccccccagccagagaagcgccgagcagccccccgtggtgggccaggtgcaggccgccaccaacatcggcctgaacaacagccacaaggtgcagggcgtggtgcccgtgcccgagagaccccccgagcccagagccatggacgaccccgccagcgccttcatcagcgacagcggcgccgccgccgcccagtgccccatggccaccgccgtgcagcccggcctgcccgagaaggtgagagacggcgccagagtgcccctgctgcacctgagagccgagagcgtgcccgcccacccctgcggcttccccgcccccctgccccccaccagaatgatggagagcaagatgatcgccgccatccacagcagcagcgccgacgccaccagcagcagcaactaccacagcttcgtgaccgccagcagcaccagcgtggacgacgccctgcccctgcccctgcccgtgccccagcccaagcacgccagccagaagaccgtgtacagcagcttcgccagacccgacgtgaccaccgagcccttcggccccgacaactgcctgcacttcaacatgacccccaactgccagtacagaccccagagcgtgcccccccaccacaacaagctggagcagcaccaggtgtacggcgccagaagcgagccccccgccagcatgggcctgagatacaacacctacgtggcccccggcagaaacgccagcggccaccacagcaagccctgcagcagagtggagtacgtgagcagcctgagcagcagcgtgagaaacacctgctaccccgaggacatccccccctaccccaccatcagaagagtgcagagcctgcacgccccccccagcagcatgatcagaagcgtgcccatcagcagaaccgaggtgccccccgacgacgagcccgcctactgccccagacccctgtaccagtacaagccctaccagagcagccaggccagaagcgactaccacgtgacccagctgcagccctacttcgagaacggcagagtgcactacagatacagcccctacagcagcagcagcagcagctactacagccccgacggcgccctgtgcgacgtggacgcctacggcaccgtgcagctgagacccctgcacagactgcccaacagagacttcgccttctacaaccccagactgcagggcaagagcctgtacagctacgccggcctggcccccagacccagagccaacgtgaccggctacttcagccccaacgaccacaacgtggtgagcatgccccccgccgccgacgtgaagcacacctacaccagctgggacctggaggacatggagaagtacagaatgcagagcatcagaagagagagcagagccagacagaaggtgaagggccccgtgatgagccagtacgacaacatgacccccgccgtgcaggacgacctgggcggcatctacgtgatccacctgagaagcaagagcgaccccggcaagaccggcctgctgagcgtggccgagggcaaggagagcagacacgccgccaaggccatcagccccgagggcgaggacagattctacagaagacaccccgaggccgagatggacagagcccaccaccacggcggccacggcagcacccagcccgagaagcccagcctgccccagaagcagagcagcctgagaagcagaaagctgcccgacatgggctgcagcctgcccgagcacagagcccaccaggaggccagccacagacagttctgcgagagcaagaacggccccccctacccccagggcgccggccagctggactacggcagcaagggcatccccgacaccagcgagcccgtgagctaccacaacagcggcgtgaagtacgccgccagcggccaggagagcctgagactgaaccacaaggaggtgagactgagcaaggagatggagagaccctgggtgagacagcccagcgcccccgagaagcacagcagagactgctacaaggaggaggagcacctgacccagagcatcgtgcccccccccaagcccgagagaagccacagcctgaagctgcaccacacccagaacgtggagagagaccccagcgtgctgtaccagtaccagccccacggcaagagacagagcagcgtgaccgtggtgagccagtacgacaacctggaggactaccacagcctgccccagcaccagagaggcgtgttcggcggcggcggcatgggcacctacgtgccccccggcttcccccacccccagagcagaacctacgccaccgccctgggccagggcgccttcctgcccgccgagctgagcctgcagcaccccgagacccagatccacgccgagtag

SEQ ID NO: 21579 - DNA, 2841 bp, Artificial Sequence
  Description of Artificial Sequence: Synthetic coding sequence
atggccgcccacggcaagctgagaagagagagaggcctgcaggccgagtacgagacccaggtgaaggagatgagatggcagctgagcgagcagctgagatgcctggagctgcagggcgagctgagaagagagctgctgcaggagctggccgagttcatgagaagaagagccgaggtggagctggagtacagcagaggcctggagaagctggccgagagattcagcagcagaggcggcagactgggcagcagcagagagcaccagagcttcagaaaggagcccagcctgctgagccccctgcactgctgggccgtgctgctgcagcacaccagacagcagagcagagagagcgccgccctgagcgaggtgctggccggccccctggcccagagactgagccacatcgccgaggacgtgggcagactggtgaagaagagcagagacctggagcagcagctgcaggacgagctgctggaggtggtgagcgagctgcagaccgccaagaagacctaccaggcctaccacatggagagcgtgaacgccgaggccaagctgagagaggccgagagacaggaggagaagagagccggcagaagcgtgcccaccaccaccgccggcgccaccgaggccggccccctgagaaagagcagcctgaagaagggcggcagactggtggagaagagacaggccaagttcatggagcacaagctgaagtgcaccaaggccagaaacgagtacctgctgagcctggccagcgtgaacgccgccgtgagcaactactacctgcacgacgtgctggacctgatggactgctgcgacaccggcttccacctggccctgggccaggtgctgagaagctacaccgccgccgagagcagaacccaggccagccaggtgcagggcctgggcagcctggaggaggccgtggaggccctggacccccccggcgacaaggccaaggtgctggaggtgcacgccaccgtgttctgcccccccctgagattcgactaccacccccacgacggcgacgaggtggccgagatctgcgtggagatggagctgagagacgagatcctgcccagagcccagaacatccagagcagactggacagacagaccatcgagaccgaggaggtgaacaagaccctgaaggccaccctgcaggccctgctggaggtggtggccagcgacgacggcgacgtgctggacagcttccagaccagccccagcaccgagagcctgaagagcaccagcagcgaccccggcagcagacaggccggcagaagaagaggccagcagcaggagaccgagaccttctacctgaccaagctgcaggagtacctgagcggcagaagcatcctggccaagctgcaggccaagcacgagaagctgcaggaggccctgcagagaggcgacaaggaggagcaggaggtgagctggacccagtacacccagagaaagttccagaagagcagacagcccagacccagcagccagtacaaccagagactgttcggcggcgacatggagaagttcatccagagcagcggccagcccgtgcccctggtggtggagagctgcatcagattcatcaacctgaacggcctgcagcacgagggcatcttcagagtgagcggcgcccagctgagagtgagcgagatcagagacgccttcgagagaggcgaggaccccctggtggagggctgcaccgcccacgacctggacagcgtggccggcgtgctgaagctgtacttcagaagcctggagccccccctgttcccccccgacctgttcggcgagctgctggccagcagcgagctggaggccaccgccgagagagtggagcacgtgagcagactgctgtggagactgcccgcccccgtgctggtggtgctgagatacctgttcaccttcctgaaccacctggcccagtacagcgacgagaacatgatggacccctacaacctggccgtgtgcttcggccccaccctgctgcccgtgcccgccggccaggaccccgtggccctgcagggcagagtgaaccagctggtgcagaccctgatcgtgcagcccgacagagtgttcccccccctgaccagcctgcccggccccgtgtacgagaagtgcatggccccccccagcgccagctgcctgggcgacgcccagctggagagcctgggcgccgacaacgagcccgagctggaggccgagatgcccgcccaggaggacgacctggagggcgtggtggaggccgtggcctgcttcgcctacaccggcagaaccgcccaggagctgagcttcagaagaggcgacgtgctgagactgcacgagagagccagcagcgactggtggagaggcgagcacaacggcatgagaggcctgatcccccacaagtacatcaccctgcccgccggcaccgagaagcaggtggtgggcgccggcctgcagaccgccggcgagagcggcagcagccccgagggcctgctggccagcgagctggtgcacagacccgagccctgcaccagccccgaggccatgggccccagcggccacagaagaagatgcctggtgcccgccagccccgagcagcacgtggaggtggacaaggccgtggcccagaacatggacagcgtgttcaaggagctgctgggcaagaccagcgtgagacagggcctgggccccgccagcaccaccagccccagccccggccccagaagccccaaggccccccccagcagcagactgggcagaaacaagggcttcagcagaggccccggcgcccccgccagccccagcgccagccacccccagggcctggacaccacccccaagccccactag

SEQ ID NO: 21580 - DNA, 2778 bp, Artificial Sequence
  Description of Artificial Sequence: Synthetic coding sequence
atggccgcccacggcaagctgagaagagagagaggcctgcaggccgagtacgagacccaggtgaaggagatgagatggcagctgagcgagcagctgagatgcctggagctgcagggcgagctgagaagagagctgctgcaggagctggccgagttcatgagaagaagagccgaggtggagctggagtacagcagaggcctggagaagctggccgagagattcagcagcagaggcggcagactgggcagcagcagagagcaccagagcttcagaaaggagcccagcctgctgagccccctgcactgctgggccgtgctgctgcagcacaccagacagcagagcagagagagcgccgccctgagcgaggtgctggccggccccctggcccagagactgagccacatcgccgaggacgtgggcagactggtgaagaaggccaagaagacctaccaggcctaccacatggagagcgtgaacgccgaggccaagctgagagaggccgagagacaggaggagaagagagccggcagaagcgtgcccaccaccaccgccggcgccaccgaggccggccccctgagaaagagcagcctgaagaagggcggcagactggtggagaagagacaggccaagttcatggagcacaagctgaagtgcaccaaggccagaaacgagtacctgctgagcctggccagcgtgaacgccgccgtgagcaactactacctgcacgacgtgctggacctgatggactgctgcgacaccggcttccacctggccctgggccaggtgctgagaagctacaccgccgccgagagcagaacccaggccagccaggtgcagggcctgggcagcctggaggaggccgtggaggccctggacccccccggcgacaaggccaaggtgctggaggtgcacgccaccgtgttctgcccccccctgagattcgactaccacccccacgacggcgacgaggtggccgagatctgcgtggagatggagctgagagacgagatcctgcccagagcccagaacatccagagcagactggacagacagaccatcgagaccgaggaggtgaacaagaccctgaaggccaccctgcaggccctgctggaggtggtggccagcgacgacggcgacgtgctggacagcttccagaccagccccagcaccgagagcctgaagagcaccagcagcgaccccggcagcagacaggccggcagaagaagaggccagcagcaggagaccgagaccttctacctgaccaagctgcaggagtacctgagcggcagaagcatcctggccaagctgcaggccaagcacgagaagctgcaggaggccctgcagagaggcgacaaggaggagcaggaggtgagctggacccagtacacccagagaaagttccagaagagcagacagcccagacccagcagccagtacaaccagagactgttcggcggcgacatggagaagttcatccagagcagcggccagcccgtgcccctggtggtggagagctgcatcagattcatcaacctgaacggcctgcagcacgagggcatcttcagagtgagcggcgcccagctgagagtgagcgagatcagagacgccttcgagagaggcgaggaccccctggtggagggctgcaccgcccacgacctggacagcgtggccggcgtgctgaagctgtacttcagaagcctggagccccccctgttcccccccgacctgttcggcgagctgctggccagcagcgagctggaggccaccgccgagagagtggagcacgtgagcagactgctgtggagactgcccgcccccgtgctggtggtgctgagatacctgttcaccttcctgaaccacctggcccagtacagcgacgagaacatgatggacccctacaacctggccgtgtgcttcggccccaccctgctgcccgtgcccgccggccaggaccccgtggccctgcagggcagagtgaaccagctggtgcagaccctgatcgtgcagcccgacagagtgttcccccccctgaccagcctgcccggccccgtgtacgagaagtgcatggccccccccagcgccagctgcctgggcgacgcccagctggagagcctgggcgccgacaacgagcccgagctggaggccgagatgcccgcccaggaggacgacctggagggcgtggtggaggccgtggcctgcttcgcctacaccggcagaaccgcccaggagctgagcttcagaagaggcgacgtgctgagactgcacgagagagccagcagcgactggtggagaggcgagcacaacggcatgagaggcctgatcccccacaagtacatcaccctgcccgccggcaccgagaagcaggtggtgggcgccggcctgcagaccgccggcgagagcggcagcagccccgagggcctgctggccagcgagctggtgcacagacccgagccctgcaccagccccgaggccatgggccccagcggccacagaagaagatgcctggtgcccgccagccccgagcagcacgtggaggtggacaaggccgtggcccagaacatggacagcgtgttcaaggagctgctgggcaagaccagcgtgagacagggcctgggccccgccagcaccaccagccccagccccggccccagaagccccaaggccccccccagcagcagactgggcagaaacaagggcttcagcagaggccccggcgcccccgccagccccagcgccagccacccccagggcctggacaccacccccaagccccactag

SEQ ID NO: 21581 - DNA, 2961 bp, Artificial Sequence
  Description of Artificial Sequence: Synthetic coding sequence
atggccgcccacggcaagctgagaagagagagaggcctgcaggccgagtacgagacccaggtgaaggagatgagatggcagctgagcgagcagctgagatgcctggagctgcagggcgagctgagaagagagctgctgcaggagctggccgagttcatgagaagaagagccgaggtggagctggagtacagcagaggcctggagaagctggccgagagattcagcagcagaggcggcagactgggcagcagcagagagcaccagagcttcagaaaggagcccagcctgctgagccccctgcactgctgggccgtgctgctgcagcacaccagacagcagagcagagagagcgccgccctgagcgaggtgctggccggccccctggcccagagactgagccacatcgccgaggacgtgggcagactggtgaagaagagcagagacctggagcagcagctgcaggacgagctgctggaggtggtgagcgagctgcagaccgccaagaagacctaccaggcctaccacatggagagcgtgaacgccgaggccaagctgagagaggccgagagacaggaggagaagagagccggcagaagcgtgcccaccaccaccgccggcgccaccgaggccggccccctgagaaagagcagcctgaagaagggcggcagactggtggagaagctgtggcccccccagagacccgtggccgccagcagctgcgcccccgtgtgctggctgcaggccggcttcctggtgcaccccccctggtggggcgccatgtgcgcccccagcacccaccagagacaggccaagttcatggagcacaagctgaagtgcaccaaggccagaaacgagtacctgctgagcctggccagcgtgaacgccgccgtgagcaactactacctgcacgacgtgctggacctgatggactgctgcgacaccggcttccacctggccctgggccaggtgctgagaagctacaccgccgccgagagcagaacccaggccagccaggtgcagggcctgggcagcctggaggaggccgtggaggccctggacccccccggcgacaaggccaaggtgctggaggtgcacgccaccgtgttctgcccccccctgagattcgactaccacccccacgacggcgacgaggtggccgagatctgcgtggagatggagctgagagacgagatcctgcccagagcccagaacatccagagcagactggacagacagaccatcgagaccgaggaggtgaacaagaccctgaaggccaccctgcaggccctgctggaggtggtggccagcgacgacggcgacgtgctggacagcttccagaccagccccagcaccgagagcctgaagagcaccagcagcgaccccggcagcagacaggccggcagaagaagaggccagcagcaggagaccgagaccttctacctgaccaagctgcaggagtacctgagcggcagaagcatcctggccaagctgcaggccaagcacgagaagctgcaggaggccctgcagagaggcgacaaggaggagcaggaggtgagctggacccagtacacccagagaaagttccagaagagcagacagcccagacccagcagccagtacaaccagagactgttcggcggcgacatggagaagttcatccagagcagcggccagcccgtgcccctggtggtggagagctgcatcagattcatcaacctgaacggcctgcagcacgagggcatcttcagagtgagcggcgcccagctgagagtgagcgagatcagagacgccttcgagagaggcgaggaccccctggtggagggctgcaccgcccacgacctggacagcgtggccggcgtgctgaagctgtacttcagaagcctggagccccccctgttcccccccgacctgttcggcgagctgctggccagcagcgagctggaggccaccgccgagagagtggagcacgtgagcagactgctgtggagactgcccgcccccgtgctggtggtgctgagatacctgttcaccttcctgaaccacctggcccagtacagcgacgagaacatgatggacccctacaacctggccgtgtgcttcggccccaccctgctgcccgtgcccgccggccaggaccccgtggccctgcagggcagagtgaaccagctggtgcagaccctgatcgtgcagcccgacagagtgttcccccccctgaccagcctgcccggccccgtgtacgagaagtgcatggccccccccagcgccagctgcctgggcgacgcccagctggagagcctgggcgccgacaacgagcccgagctggaggccgagatgcccgcccaggaggacgacctggagggcgtggtggaggccgtggcctgcttcgcctacaccggcagaaccgcccaggagctgagcttcagaagaggcgacgtgctgagactgcacgagagagccagcagcgactggtggagaggcgagcacaacggcatgagaggcctgatcccccacaagtacatcaccctgcccgccggcaccgagaagcaggtggtgggcgccggcctgcagaccgccggcgagagcggcagcagccccgagggcctgctggccagcgagctggtgcacagacccgagccctgcaccagccccgaggccatgggccccagcggccacagaagaagatgcctggtgcccgccagccccgagcagcacgtggaggtggacaaggccgtggcccagaacatggacagcgtgttcaaggagctgctgggcaagaccagcgtgagacagggcctgggccccgccagcaccaccagccccagccccggccccagaagccccaaggccccccccagcagcagactgggcagaaacaagggcttcagcagaggccccggcgcccccgccagccccagcgccagccacccccagggcctggacaccacccccaagccccactag

SEQ ID NO: 21582 - DNA, 2307 bp, Artificial Sequence
  Description of Artificial Sequence: Synthetic coding sequence
atggccgcccacggcaagctgagaagagagagaggcctgcaggccgagtacgagacccaggtgaaggagatgagatggcagctgagcgagcagctgagatgcctggagctgcagggcgagctgagaagagagctgctgcaggagctggccgagttcatgagaagaagagccgaggtggagctggagtacagcagaggcctggagaagctggccgagagattcagcagcagaggcggcagactgggcagcagcagagagcaccagagcttcagaaaggagcccagcctgctgagccccctgcactgctgggccgtgctgctgcagcacaccagacagcagagcagagagagcgccgccctgagcgaggtgctggccggccccctggcccagagactgagccacatcgccgaggacgtgggcagactggtgaagaagagcagagacctggagcagcagctgcaggacgagctgctggaggtggtgagcgagctgcagaccgtggccgagatctgcgtggagatggagctgagagacgagatcctgcccagagcccagaacatccagagcagactggacagacagaccatcgagaccgaggaggtgaacaagaccctgaaggccaccctgcaggccctgctggaggtggtggccagcgacgacggcgacgtgctggacagcttccagaccagccccagcaccgagagcctgaagagcaccagcagcgaccccggcagcagacaggccggcagaagaagaggccagcagcaggagaccgagaccttctacctgaccaagctgcaggagtacctgagcggcagaagcatcctggccaagctgcaggccaagcacgagaagctgcaggaggccctgcagagaggcgacaaggaggagcaggaggtgagctggacccagtacacccagagaaagttccagaagagcagacagcccagacccagcagccagtacaaccagagactgttcggcggcgacatggagaagttcatccagagcagcggccagcccgtgcccctggtggtggagagctgcatcagattcatcaacctgaacggcctgcagcacgagggcatcttcagagtgagcggcgcccagctgagagtgagcgagatcagagacgccttcgagagaggcgaggaccccctggtggagggctgcaccgcccacgacctggacagcgtggccggcgtgctgaagctgtacttcagaagcctggagccccccctgttcccccccgacctgttcggcgagctgctggccagcagcgagctggaggccaccgccgagagagtggagcacgtgagcagactgctgtggagactgcccgcccccgtgctggtggtgctgagatacctgttcaccttcctgaaccacctggcccagtacagcgacgagaacatgatggacccctacaacctggccgtgtgcttcggccccaccctgctgcccgtgcccgccggccaggaccccgtggccctgcagggcagagtgaaccagctggtgcagaccctgatcgtgcagcccgacagagtgttcccccccctgaccagcctgcccggccccgtgtacgagaagtgcatggccccccccagcgccagctgcctgggcgacgcccagctggagagcctgggcgccgacaacgagcccgagctggaggccgagatgcccgcccaggaggacgacctggagggcgtggtggaggccgtggcctgcttcgcctacaccggcagaaccgcccaggagctgagcttcagaagaggcgacgtgctgagactgcacgagagagccagcagcgactggtggagaggcgagcacaacggcatgagaggcctgatcccccacaagtacatcaccctgcccgccggcaccgagaagcaggtggtgggcgccggcctgcagaccgccggcgagagcggcagcagccccgagggcctgctggccagcgagctggtgcacagacccgagccctgcaccagccccgaggccatgggccccagcggccacagaagaagatgcctggtgcccgccagccccgagcagcacgtggaggtggacaaggccgtggcccagaacatggacagcgtgttcaaggagctgctgggcaagaccagcgtgagacagggcctgggccccgccagcaccaccagccccagccccggccccagaagccccaaggccccccccagcagcagactgggcagaaacaagggcttcagcagaggccccggcgcccccgccagccccagcgccagccacccccagggcctggacaccacccccaagccccactag

SEQ ID NO: 21583 - DNA, 2772 bp, Artificial Sequence
  Description of Artificial Sequence: Synthetic coding sequence
atgagatggcagctgagcgagcagctgagatgcctggagctgcagggcgagctgagaagagagctgctgcaggagctggccgagttcatgagaagaagagccgaggtggagctggagtacagcagaggcctggagaagctggccgagagattcagcagcagaggcggcagactgggcagcagcagagagcaccagagcttcagaaaggagcccagcctgctgagccccctgcactgctgggccgtgctgctgcagcacaccagacagcagagcagagagagcgccgccctgagcgaggtgctggccggccccctggcccagagactgagccacatcgccgaggacgtgggcagactggtgaagaagagcagagacctggagcagcagctgcaggacgagctgctggaggtggtgagcgagctgcagaccgccaagaagacctaccaggcctaccacatggagagcgtgaacgccgaggccaagctgagagaggccgagagacaggaggagaagagagccggcagaagcgtgcccaccaccaccgccggcgccaccgaggccggccccctgagaaagagcagcctgaagaagggcggcagactggtggagaagagacaggccaagttcatggagcacaagctgaagtgcaccaaggccagaaacgagtacctgctgagcctggccagcgtgaacgccgccgtgagcaactactacctgcacgacgtgctggacctgatggactgctgcgacaccggcttccacctggccctgggccaggtgctgagaagctacaccgccgccgagagcagaacccaggccagccaggtgcagggcctgggcagcctggaggaggccgtggaggccctggacccccccggcgacaaggccaaggtgctggaggtgcacgccaccgtgttctgcccccccctgagattcgactaccacccccacgacggcgacgaggtggccgagatctgcgtggagatggagctgagagacgagatcctgcccagagcccagaacatccagagcagactggacagacagaccatcgagaccgaggaggtgaacaagaccctgaaggccaccctgcaggccctgctggaggtggtggccagcgacgacggcgacgtgctggacagcttccagaccagccccagcaccgagagcctgaagagcaccagcagcgaccccggcagcagacaggccggcagaagaagaggccagcagcaggagaccgagaccttctacctgaccaagctgcaggagtacctgagcggcagaagcatcctggccaagctgcaggccaagcacgagaagctgcaggaggccctgcagagaggcgacaaggaggagcaggaggtgagctggacccagtacacccagagaaagttccagaagagcagacagcccagacccagcagccagtacaaccagagactgttcggcggcgacatggagaagttcatccagagcagcggccagcccgtgcccctggtggtggagagctgcatcagattcatcaacctgaacggcctgcagcacgagggcatcttcagagtgagcggcgcccagctgagagtgagcgagatcagagacgccttcgagagaggcgaggaccccctggtggagggctgcaccgcccacgacctggacagcgtggccggcgtgctgaagctgtacttcagaagcctggagccccccctgttcccccccgacctgttcggcgagctgctggccagcagcgagctggaggccaccgccgagagagtggagcacgtgagcagactgctgtggagactgcccgcccccgtgctggtggtgctgagatacctgttcaccttcctgaaccacctggcccagtacagcgacgagaacatgatggacccctacaacctggccgtgtgcttcggccccaccctgctgcccgtgcccgccggccaggaccccgtggccctgcagggcagagtgaaccagctggtgcagaccctgatcgtgcagcccgacagagtgttcccccccctgaccagcctgcccggccccgtgtacgagaagtgcatggccccccccagcgccagctgcctgggcgacgcccagctggagagcctgggcgccgacaacgagcccgagctggaggccgagatgcccgcccaggaggacgacctggagggcgtggtggaggccgtggcctgcttcgcctacaccggcagaaccgcccaggagctgagcttcagaagaggcgacgtgctgagactgcacgagagagccagcagcgactggtggagaggcgagcacaacggcatgagaggcctgatcccccacaagtacatcaccctgcccgccggcaccgagaagcaggtggtgggcgccggcctgcagaccgccggcgagagcggcagcagccccgagggcctgctggccagcgagctggtgcacagacccgagccctgcaccagccccgaggccatgggccccagcggccacagaagaagatgcctggtgcccgccagccccgagcagcacgtggaggtggacaaggccgtggcccagaacatggacagcgtgttcaaggagctgctgggcaagaccagcgtgagacagggcctgggccccgccagcaccaccagccccagccccggccccagaagccccaaggccccccccagcagcagactgggcagaaacaagggcttcagcagaggccccggcgcccccgccagccccagcgccagccacccccagggcctggacaccacccccaagccccactag

SEQ ID NO: 21584 - DNA, 2817 bp, Artificial Sequence
  Description of Artificial Sequence: Synthetic coding sequence
atgttcagaagaagaacctgcggcaccgaggccagcctgagatggagccacagcagcagaagcgagatcagactgggcagaagcgagagcctgaagggcagagaggagatgaagagaagcagaaaggccgagaacgtgcccagaagcagaagcgacgtggacatggacgccgccgccgaggccaccagactgcaccagagcgccagcagcagcaccagcagcctgagcaccagaagcctggagaaccccaccccccccttcacccccaagatgggcagaagaagcatcgagagccccagcctgggcttctgcaccgacaccctgctgccccacctgctggaggacgacctgggccagctgagcgacctggagcccgagcccgacgcccagaactggcagcacaccgtgggcaaggacgtggtggccggcctgacccagagagagatcgacagacaggaggtgatcaacgagctgttcgtgaccgaggccagccacctgagaaccctgagagtgctggacctgatcttctaccagagaatgaagaaggagaacctgatgcccagagaggagctggccagactgttccccaacctgcccgagctgatcgagatccacaacagctggtgcgaggccatgaagaagctgagagaggagggccccatcatcaaggagatcagcgacctgatgctggccagattcgacggccccgccagagaggagctgcagcaggtggccgcccagttctgcagctaccagagcatcgccctggagctgatcaagaccaagcagagaaaggagagcagattccagctgttcatgcaggaggccgagagccacccccagtgcagaagactgcagctgagagacctgatcatcagcgagatgcagagactgaccaagtaccccctgctgctggagagcatcatcaagcacaccgagggcggcaccagcgagcacgagaagctgtgcagagccagagaccagtgcagagagatcctgaagtacgtgaacgaggccgtgaagcagaccgagaacagacacagactggagggctaccagaagagactggacgccaccgccctggagagagccagcaaccccctggccgccgagttcaagagcctggacctgaccaccagaaagatgatccacgagggccccctgacctggagaatcagcaaggacaagaccctggacctgcacgtgctgctgctggaggacctgctggtgctgctgcagaagcaggacgagaagctgctgctgaagtgccacagcaagaccgccgtgggcagcagcgacagcaagcagaccttcagccccgtgctgaagctgaacgccgtgctgatcagaagcgtggccaccgacaagagagccttcttcatcatctgcaccagcaagctgggccccccccagatctacgagctggtggccctgaccagcagcgacaagaacacctggatggagctgctggaggaggccgtgagaaacgccaccagacaccccggcgccgcccccatgcccgtgcacccccccccccccggccccagagagcccgcccagcagggccccacccccagcagagtggagctggacgacagcgacgtgttccacggcgagcccgagcccgaggagctgcccggcggcaccggcagccagcagagagtgcagggcaagcaccaggtgctgctggaggaccccgagcaggagggcagcgccgaggaggaggagctgggcgtgctgccctgccccagcaccagcctggacggcgagaacagaggcatcagaaccagaaaccccatccacctggccttccccggccccctgttcatggagggcctggccgacagcgccctggaggacgtggagaacctgagacacctgatcctgtggagcctgctgcccggccacaccatggagacccaggccgcccaggagcccgaggacgacctgacccccacccccagcgtgatcagcgtgaccagccacccctgggaccccggcagccccggccaggccccccccggcggcgagggcgacaacacccagctggccggcctggagggcgagagacccgagcaggaggacatgggcctgtgcagcctggagcacctgccccccagaaccagaaacagcggcatctgggagagccccgagctggacagaaacctggccgaggacgccagcagcaccgaggccgccggcggctacaaggtggtgagaaaggccgaggtggccggcagcaaggtggtgcccgccctgcccgagagcggccagagcgagcccggcccccccgaggtggagggcggcaccaaggccaccggcaactgcttctacgtgagcatgcccagcggcccccccgacagcagcaccgaccacagcgaggcccccatgagccccccccagcccgacagcctgcccgccggccagaccgagccccagccccagctgcagggcggcaacgacgaccccagaagacccagcagaagcccccccagcctggccctgagagacgtgggcatgatcttccacaccatcgagcagctgaccctgaagctgaacagactgaaggacatggagctggcccacagagagctgctgaagagcctgggcggcgagagcagcggcggcaccacccccgtgggcagcttccacaccgaggccgccagatggaccgacggcagcctgagcccccccgccaaggagcccctggccagcgacagcagaaacagccacgagctgggcccctgccccgaggacggcagcgacgcccccctggaggacagcaccgccgacgccgccgccagccccggcccctag

SEQ ID NO: 21585 - DNA, 4569 bp, Artificial Sequence
  Description of Artificial Sequence: Synthetic coding sequence
atgagcgtgagactgccccagagcatcgacagactgagcagcctgagcagcctgggcgacagcgcccccgagagaaagagccccagccaccacagacagcccagcgacgccagcgagaccaccggcctggtgcagagatgcgtgatcatccagaaggaccagcacggcttcggcttcaccgtgagcggcgacagaatcgtgctggtgcagagcgtgagacccggcggcgccgccatgaaggccggcgtgaaggagggcgacagaatcatcaaggtgaacggcaccatggtgaccaacagcagccacctggaggtggtgaagctgatcaagagcggcgcctacgtggccctgaccctgctgggcagcagccccagcagcatgggcatcagcggcctgcagcaggaccccagccccgccggcgcccccagaatcaccagcgtgatccccagcccccccccccccccccccctgccccccccccagagaatcaccggccccaagcccctgcaggaccccgaggtgcagaagcacgccacccagatcctgagaaacatgctgagacaggaggagaaggagctgcaggacatcctgcccctgtacggcgacaccagccagagacccagcgagggcagactgagcctggacagccaggagggcgacagcggcctggacagcggcaccgagagattccccagcctgagcgagagcctgatgaacagaaacagcgtgctgagcgaccccggcctggacagccccagaaccagccccgtgatcatggccagagtggcccagcaccacagaagacagggcagcgacgccgccgtgcccagcaccggcgaccagggcgtggaccagagccccaagcccctgatcatcggccccgaggaggactacgaccccggctacttcaacaacgagagcgacatcatcttccaggacctggagaagctgaagagcagacccgcccacctgggcgtgttcctgagatacatcttcagccaggccgaccccagccccctgctgttctacctgtgcgccgaggtgtaccagcaggccagccccaaggacagcagaagcctgggcaaggacatctggaacatcttcctggagaagaacgcccccctgagagtgaagatccccgagatgctgcaggccgagatcgacagcagactgagaaacagcgaggacgccagaggcgtgctgtgcgaggcccaggaggccgccatgcccgagatccaggagcagatccacgactacagaaccaagagaaccctgggcctgggcagcctgtacggcgagaacgacctgctggacctggacggcgaccccctgagagagagacaggtggccgagaagcagctggccgccctgggcgacatcctgagcaagtacgaggaggacagaagcgcccccatggacttcgccctgaacacctacatgagccacgccggcatcagactgagagaggccagacccagcaacaccgccgagaaggcccagagcgcccccgacaaggacaagtggctgcccttcttccccaagaccaagaagagcagcaacagcaagaaggagaaggacgccctggaggacaagaagagaaaccccatcctgaagtacatcggcaagcccaagagcagcagccagagcaccttccacatccccctgagccccgtggaggtgaagcccggcaacgtgagaaacatcatccagcacttcgagaacaaccagcagtacgacgcccccgagcccggcacccagagactgagcaccggcagcttccccgaggacctgctggagagcgacagcagcagaagcgagatcagactgggcagaagcgagagcctgaagggcagagaggagatgaagagaagcagaaaggccgagaacgtgcccagaagcagaagcgacgtggacatggacgccgccgccgaggccaccagactgcaccagagcgccagcagcagcaccagcagcctgagcaccagaagcctggagaaccccaccccccccttcacccccaagatgggcagaagaagcatcgagagccccagcctgggcttctgcaccgacaccctgctgccccacctgctggaggacgacctgggccagctgagcgacctggagcccgagcccgacgcccagaactggcagcacaccgtgggcaaggacgtggtggccggcctgacccagagagagatcgacagacaggaggtgatcaacgagctgttcgtgaccgaggccagccacctgagaaccctgagagtgctggacctgatcttctaccagagaatgaagaaggagaacctgatgcccagagaggagctggccagactgttccccaacctgcccgagctgatcgagatccacaacagctggtgcgaggccatgaagaagctgagagaggagggccccatcatcaaggagatcagcgacctgatgctggccagattcgacggccccgccagagaggagctgcagcaggtggccgcccagttctgcagctaccagagcatcgccctggagctgatcaagaccaagcagagaaaggagagcagattccagctgttcatgcaggaggccgagagccacccccagtgcagaagactgcagctgagagacctgatcatcagcgagatgcagagactgaccaagtaccccctgctgctggagagcatcatcaagcacaccgagggcggcaccagcgagcacgagaagctgtgcagagccagagaccagtgcagagagatcctgaagtacgtgaacgaggccgtgaagcagaccgagaacagacacagactggagggctaccagaagagactggacgccaccgccctggagagagccagcaaccccctggccgccgagttcaagagcctggacctgaccaccagaaagatgatccacgagggccccctgacctggagaatcagcaaggacaagaccctggacctgcacgtgctgctgctggaggacctgctggtgctgctgcagaagcaggacgagaagctgctgctgaagtgccacagcaagaccgccgtgggcagcagcgacagcaagcagaccttcagccccgtgctgaagctgaacgccgtgctgatcagaagcgtggccaccgacaagagagccttcttcatcatctgcaccagcaagctgggccccccccagatctacgagctggtggccctgaccagcagcgacaagaacacctggatggagctgctggaggaggccgtgagaaacgccaccagacaccccggcgccgcccccatgcccgtgcacccccccccccccggccccagagagcccgcccagcagggccccacccccagcagagtggagctggacgacagcgacgtgttccacggcgagcccgagcccgaggagctgcccggcggcaccggcagccagcagagagtgcagggcaagcaccaggtgctgctggaggaccccgagcaggagggcagcgccgaggaggaggagctgggcgtgctgccctgccccagcaccagcctggacggcgagaacagaggcatcagaaccagaaaccccatccacctggccttccccggccccctgttcatggagggcctggccgacagcgccctggaggacgtggagaacctgagacacctgatcctgtggagcctgctgcccggccacaccatggagacccaggccgcccaggagcccgaggacgacctgacccccacccccagcgtgatcagcgtgaccagccacccctgggaccccggcagccccggccaggccccccccggcggcgagggcgacaacacccagctggccggcctggagggcgagagacccgagcaggaggacatgggcctgtgcagcctggagcacctgccccccagaaccagaaacagcggcatctgggagagccccgagctggacagaaacctggccgaggacgccagcagcaccgaggccgccggcggctacaaggtggtgagaaaggccgaggtggccggcagcaaggtggtgcccgccctgcccgagagcggccagagcgagcccggcccccccgaggtggagggcggcaccaaggccaccggcaactgcttctacgtgagcatgcccagcggcccccccgacagcagcaccgaccacagcgaggcccccatgagccccccccagcccgacagcctgcccgccggccagaccgagccccagccccagctgcagggcggcaacgacgaccccagaagacccagcagaagcccccccagcctggccctgagagacgtgggcatgatcttccacaccatcgagcagctgaccctgaagctgaacagactgaaggacatggagctggcccacagagagctgctgaagagcctgggcggcgagagcagcggcggcaccacccccgtgggcagcttccacaccgaggccgccagatggaccgacggcagcctgagcccccccgccaaggagcccctggccagcgacagcagaaacagccacgagctgggcccctgccccgaggacggcagcgacgcccccctggaggacagcaccgccgacgccgccgccagccccggcccctag

SEQ ID NO: 21586 - DNA, 4689 bp, Artificial Sequence
  Description of Artificial Sequence: Synthetic coding sequence
atgagcgtgagactgccccagagcatcgacagactgagcagcctgagcagcctgggcgacagcgcccccgagagaaagagccccagccaccacagacagcccagcgacgccagcgagaccaccggcctggtgcagagatgcgtgatcatccagaaggaccagcacggcttcggcttcaccgtgagcggcgacagaatcgtgctggtgcagagcgtgagacccggcggcgccgccatgaaggccggcgtgaaggagggcgacagaatcatcaaggtgaacggcaccatggtgaccaacagcagccacctggaggtggtgaagctgatcaagagcggcgcctacgtggccctgaccctgctgggcagcagccccagcagcatgggcatcagcggcctgcagcaggaccccagccccgccggcgcccccagaatcaccagcgtgatccccagcccccccccccccccccccctgccccccccccagagaatcaccggccccaagcccctgcaggaccccgaggtgcagaagcacgccacccagatcctgagaaacatgctgagacaggaggagaaggagctgcagagaatctgcgaggtgtacagcagaaaccccgccagcctgctggaggagcagatcgagggcgccagaagaagagtgacccagctgcagctgaagatccagcaggagaccggcggcagcgtggacatcctgcccctgtacggcgacaccagccagagacccagcgagggcagactgagcctggacagccaggagggcgacagcggcctggacagcggcaccgagagattccccagcctgagcgagagcctgatgaacagaaacagcgtgctgagcgaccccggcctggacagccccagaaccagccccgtgatcatggccagagtggcccagcaccacagaagacagggcagcgacgccgccgtgcccagcaccggcgaccagggcgtggaccagagccccaagcccctgatcatcggccccgaggaggactacgaccccggctacttcaacaacgagagcgacatcatcttccaggacctggagaagctgaagagcagacccgcccacctgggcgtgttcctgagatacatcttcagccaggccgaccccagccccctgctgttctacctgtgcgccgaggtgtaccagcaggccagccccaaggacagcagaagcctgggcaaggacatctggaacatcttcctggagaagaacgcccccctgagagtgaagatccccgagatgctgcaggccgagatcgacagcagactgagaaacagcgaggacgccagaggcgtgctgtgcgaggcccaggaggccgccatgcccgagatccaggagcagatccacgactacagaaccaagagaaccctgggcctgggcagcctgtacggcgagaacgacctgctggacctggacggcgaccccctgagagagagacaggtggccgagaagcagctggccgccctgggcgacatcctgagcaagtacgaggaggacagaagcgcccccatggacttcgccctgaacacctacatgagccacgccggcatcagactgagagaggccagacccagcaacaccgccgagaaggcccagagcgcccccgacaaggacaagtggctgcccttcttccccaagaccaagaagagcagcaacagcaagaaggagaaggacgccctggaggacaagaagagaaaccccatcctgaagtacatcggcaagcccaagagcagcagccagagcaccttccacatccccctgagccccgtggaggtgaagcccggcaacgtgagaaacatcatccagcacttcgagaacaaccagcagtacgacgcccccgagcccggcacccagagactgagcaccggcagcttccccgaggacctgctggagagcgacagcagcagaagcgagatcagactgggcagaagcgagagcctgaagggcagagaggagatgaagagaagcagaaaggccgagaacgtgcccagaagcagaagcgacgtggacatggacgccgccgccgaggccaccagactgcaccagagcgccagcagcagcaccagcagcctgagcaccagaagcctggagaaccccaccccccccttcacccccaagatgggcagaagaagcatcgagagccccagcctgggcttctgcaccgacaccctgctgccccacctgctggaggacgacctgggccagctgagcgacctggagcccgagcccgacgcccagaactggcagcacaccgtgggcaaggacgtggtggccggcctgacccagagagagatcgacagacaggaggtgatcaacgagctgttcgtgaccgaggccagccacctgagaaccctgagagtgctggacctgatcttctaccagagaatgaagaaggagaacctgatgcccagagaggagctggccagactgttccccaacctgcccgagctgatcgagatccacaacagctggtgcgaggccatgaagaagctgagagaggagggccccatcatcaaggagatcagcgacctgatgctggccagattcgacggccccgccagagaggagctgcagcaggtggccgcccagttctgcagctaccagagcatcgccctggagctgatcaagaccaagcagagaaaggagagcagattccagctgttcatgcaggaggccgagagccacccccagtgcagaagactgcagctgagagacctgatcatcagcgagatgcagagactgaccaagtaccccctgctgctggagagcatcatcaagcacaccgagggcggcaccagcgagcacgagaagctgtgcagagccagagaccagtgcagagagatcctgaagtacgtgaacgaggccgtgaagcagaccgagaacagacacagactggagggctaccagaagagactggacgccaccgccctggagagagccagcaaccccctggccgccgagttcaagagcctggacctgaccaccagaaagatgatccacgagggccccctgacctggagaatcagcaaggacaagaccctggacctgcacgtgctgctgctggaggacctgctggtgctgctgcagaagcaggacgagaagctgctgctgaagtgccacagcaagaccgccgtgggcagcagcgacagcaagcagaccttcagccccgtgctgaagctgaacgccgtgctgatcagaagcgtggccaccgacaagagagccttcttcatcatctgcaccagcaagctgggccccccccagatctacgagctggtggccctgaccagcagcgacaagaacacctggatggagctgctggaggaggccgtgagaaacgccaccagacaccccggcgccgcccccatgcccgtgcacccccccccccccggccccagagagcccgcccagcagggccccacccccagcagagtggagctggacgacagcgacgtgttccacggcgagcccgagcccgaggagctgcccggcggcaccggcagccagcagagagtgcagggcaagcaccaggtgctgctggaggaccccgagcaggagggcagcgccgaggaggaggagctgggcgtgctgccctgccccagcaccagcctggacggcgagaacagaggcatcagaaccagaaaccccatccacctggccttccccggccccctgttcatggagggcctggccgacagcgccctggaggacgtggagaacctgagacacctgatcctgtggagcctgctgcccggccacaccatggagacccaggccgcccaggagcccgaggacgacctgacccccacccccagcgtgatcagcgtgaccagccacccctgggaccccggcagccccggccaggccccccccggcggcgagggcgacaacacccagctggccggcctggagggcgagagacccgagcaggaggacatgggcctgtgcagcctggagcacctgccccccagaaccagaaacagcggcatctgggagagccccgagctggacagaaacctggccgaggacgccagcagcaccgaggccgccggcggctacaaggtggtgagaaaggccgaggtggccggcagcaaggtggtgcccgccctgcccgagagcggccagagcgagcccggcccccccgaggtggagggcggcaccaaggccaccggcaactgcttctacgtgagcatgcccagcggcccccccgacagcagcaccgaccacagcgaggcccccatgagccccccccagcccgacagcctgcccgccggccagaccgagccccagccccagctgcagggcggcaacgacgaccccagaagacccagcagaagcccccccagcctggccctgagagacgtgggcatgatcttccacaccatcgagcagctgaccctgaagctgaacagactgaaggacatggagctggcccacagagagctgctgaagagcctgggcggcgagagcagcggcggcaccacccccgtgggcagcttccacaccgaggccgccagatggaccgacggcagcctgagcccccccgccaaggagcccctggccagcgacagcagaaacagccacgagctgggcccctgccccgaggacggcagcgacgcccccctggaggacagcaccgccgacgccgccgccagccccggcccctag

SEQ ID NO: 21587 - DNA, 1743 bp, Artificial Sequence
  Description of Artificial Sequence: Synthetic coding sequence
atgagaggcggccacaagggcggcagatgcgcctgccccagagtgatcagaaaggtgctggccaagtgcggctgctgcttcgccagaggcggcagagagagctacagcatcgccggcagcgagggcagcatcagcgccagcgccgccagcggcctggccgcccccagcggccccagcagcggcctgagcagcggcccctgcagccccggcccccccggccccgtgagcggcctgagaagatggctggaccacagcaagcactgcctgagcgtggagaccgaggccgacagcggccaggccggcccctacgagaactggatgctggagcccgccctggccaccggcgaggagctgcccgagctgaccctgctgaccaccctgctggagggccccggcgacaagacccagccccccgaggaggagaccctgagccaggcccccgagagcgaggaggagcagaagaagaaggccctggagagaagcatgtacgtgctgagcgagctggtggagaccgagaagatgtacgtggacgacctgggccagatcgtggagggctacatggccaccatggccgcccagggcgtgcccgagagcctgagaggcagagacagaatcgtgttcggcaacatccagcagatctacgagtggcacagagactacttcctgcaggagctgcagagatgcctgaaggaccccgactggctggcccagctgttcatcaagcacgagagaagactgcacatgtacgtggtgtactgccagaacaagcccaagagcgagcacgtggtgagcgagttcggcgacagctacttcgaggagctgagacagcagctgggccacagactgcagctgaacgacctgctgatcaagcccgtgcagagaatcatgaagtaccagctgctgctgaaggacttcctgaagtactacaacagagccggcatggacaccgccgacctggagcaggccgtggaggtgatgtgcttcgtgcccaagagatgcaacgacatgatgaccctgggcagactgagaggcttcgagggcaagctgaccgcccagggcaagctgctgggccaggacaccttctgggtgaccgagcccgaggccggcggcctgctgagcagcagaggcagagagagaagagtgttcctgttcgagcagatcatcatcttcagcgaggccctgggcggcggcgtgagaggcggcacccagcccggctacgtgtacaagaacagcatcaaggtgagctgcctgggcctggagggcaacctgcagggcgacccctgcagattcgccctgaccagcagaggccccgagggcggcatccagagatacgtgctgcaggccgccgaccccgccatcagccaggcctggatcaagcacgtggcccagatcctggagagccagagagacttcctgaacgccctgcagagccccatcgagtaccagagaagagagagccagaccaacagcctgggcagacccagaggccccggcgtgggcagccccggcagaatccagctgggcgaccaggcccagggcagcacccacacccccatcaacggcagcctgcccagcctgctgctgagccccaagggcgaggtggccagagccctgctgcccctggacaagcaggccctgggcgacatcccccaggccccccacgacagcccccccgtgagccccacccccaagacccccccctgccaggccagactggccaagctggacgaggacgagctgtag

SEQ ID NO: 21588 - DNA, 921 bp, Artificial Sequence
  Description of Artificial Sequence: Synthetic coding sequence
atgagaagcagccccggcctgtgcagccccccccccgaggaggagaccctgagccaggcccccgagagcgaggaggagcagaagaagaaggccctggagagaagcatgtacgtgctgagcgagctggtggagaccgagaagatgtacgtggacgacctgggccagatcgtggagggctacatggccaccatggccgcccagggcgtgcccgagagcctgagaggcagagacagaatcgtgttcggcaacatccagcagatctacgagtggcacagagactacttcctgcaggagctgcagagatgcctgaaggaccccgactggctggcccagctgttcatcaagcacgagagaagactgcacatgtacgtggtgtactgccagaacaagcccaagagcgagcacgtggtgagcgagttcggcgacagctacttcgaggagctgagacagcagctgggccacagactgcagctgaacgacctgctgatcaagcccgtgcagagaatcatgaagtaccagctgctgctgaaggacttcctgaagtactacaacagagccggcatggacaccgccgacctggagggcaagctgaccgcccagggcaagctgctgggccaggacaccttctgggtgaccgagcccgaggccggcggcctgctgagcagcagaggcagagagagaagagtgttcctgttcgagcagatcatcatcttcagcgaggccctgggcggcggcgtgagaggcggcacccagcccggctacgtgtacaagaacagcatgagacaggtgttctgccagatgcaggagctgccccagctgtggcacatcagcagagtggacttcgtgagaaacgccatcacccccagactgccccccctgatcctgctggccagccccgccagcgccctgaaccagacctag

SEQ ID NO: 21589 - DNA, 1860 bp, Artificial Sequence
  Description of Artificial Sequence: Synthetic coding sequence
atgaagccccccgacagacccgcccccggcagaaccgacagaatcctgggcgtgatgggcggcatgctgagagcctgcgccctgcccggccaggagggcccccccagaagaagccccctgggcctggtgggcaccgagcccgagagcgagagaaccgagggcgaccacagaagagacagagagcacgaggtgctggccggcgccctgcagcccgagagctacagcatcgccggcagcgagggcagcatcagcgccagcgccgccagcggcctggccgcccccagcggccccagcagcggcctgagcagcggcccctgcagccccggcccccccggccccgtgagcggcctgagaagatggctggaccacagcaagcactgcctgagcgtggagaccgaggccgacagcggccaggccggcccctacgagaactggatgctggagcccgccctggccaccggcgaggagctgcccgagctgaccctgctgaccaccctgctggagggccccggcgacaagacccagccccccgaggaggagaccctgagccaggcccccgagagcgaggaggagcagaagaagaaggccctggagagaagcatgtacgtgctgagcgagctggtggagaccgagaagatgtacgtggacgacctgggccagatcgtggagggctacatggccaccatggccgcccagggcgtgcccgagagcctgagaggcagagacagaatcgtgttcggcaacatccagcagatctacgagtggcacagagactacttcctgcaggagctgcagagatgcctgaaggaccccgactggctggcccagctgttcatcaagcacgagagaagactgcacatgtacgtggtgtactgccagaacaagcccaagagcgagcacgtggtgagcgagttcggcgacagctacttcgaggagctgagacagcagctgggccacagactgcagctgaacgacctgctgatcaagcccgtgcagagaatcatgaagtaccagctgctgctgaaggacttcctgaagtactacaacagagccggcatggacaccgccgacctggagcaggccgtggaggtgatgtgcttcgtgcccaagagatgcaacgacatgatgaccctgggcagactgagaggcttcgagggcaagctgaccgcccagggcaagctgctgggccaggacaccttctgggtgaccgagcccgaggccggcggcctgctgagcagcagaggcagagagagaagagtgttcctgttcgagcagatcatcatcttcagcgaggccctgggcggcggcgtgagaggcggcacccagcccggctacgtgtacaagaacagcatcaaggtgagctgcctgggcctggagggcaacctgcagggcgacccctgcagattcgccctgaccagcagaggccccgagggcggcatccagagatacgtgctgcaggccgccgaccccgccatcagccaggcctggatcaagcacgtggcccagatcctggagagccagagagacttcctgaacgccctgcagagccccatcgagtaccagagaagagagagccagaccaacagcctgggcagacccagaggccccggcgtgggcagccccggcagaatccagctgggcgaccaggcccagggcagcacccacacccccatcaacggcagcctgcccagcctgctgctgagccccaagggcgaggtggccagagccctgctgcccctggacaagcaggccctgggcgacatcccccaggccccccacgacagcccccccgtgagccccacccccaagacccccccctgccaggccagactggccaagctggacgaggacgagctgtag

SEQ ID NO: 21590 - DNA, 5064 bp, Artificial Sequence
  Description of Artificial Sequence: Synthetic coding sequence
atggagctgagctgcagcgaggcccccctgtacggccagatgatgatctacgccaagttcgacaagaacgtgtacctgcccgaggacgccgagttctacttcacctacgacggcagccaccagagacacgtgatgatcgccgagagaatcgaggacaacgtgctgcagagcagcgtgcccggccacggcctgcaggagaccgtgaccgtgagcgtgtgcctgtgcagcgagggctacagccccgtgaccatgggcagcggcagcgtgacctacgtggacaacatggcctgcagactggccagactgctggtgacccaggccaacagactgaccgcctgcagccaccagaccctgctgacccccttcgccctgaccgccggcgccctgcccgccctggacgaggagctggtgctggccctgacccacctggagctgcccctggagtggaccgtgctgggcagcagcagcctggaggtgagcagccacagagagagcctgctgcacctggccatgagatggggcctggccaagctgagccagttcttcctgtgcctgcccggcggcgtgcaggccctggccctgcccaacgaggagggcgccacccccctggacctggccctgagagagggccacagcaagctggtggaggacgtgaccaacttccagggcagatggagccccagcttcagcagagtgcagctgagcgaggaggccagcctgcactacatccacagcagcgagaccctgaccctgaccctgaaccacaccgccgagcacctgctggaggccgacatcaagctgttcagaaagtacttctgggacagagccttcctggtgaaggccttcgagcccgaggccagacccgaggagagaaccgccatgcccagcagcggcgccgagaccgaggaggagatcaagaacagcgtgagcagcagaagcgccgccgagaaggaggacatcaagagagtgaagagcctggtggtgcagcacaacgagcacgaggaccagcacagcctggacctggacagaagcttcgacatcctgaagaagagcaagccccccagcaccctgctggccgccggcagactgagcgacatgctgaacggcggcgacgaggtgtacgccaactgcatggtgatcgaccaggtgggcgacctggacatcagctacatcaacatcgagggcatcaccgccaccaccagccccgagagcagaggctgcaccctgtggccccagagcagcaagcacaccctgcccaccgagaccagccccagcgtgtaccccctgagcgagaacgtggagggcaccgcccacaccgaggcccagcagagcttcatgagccccagcagcagctgcgccagcaacctgaacctgagcttcggctggcacggcttcgagaaggagcagagccacctgaagaagagaagcagcagcctggacgccctggacgccgacagcgagggcgagggccacagcgagcccagccacatctgctacacccccggcagccagagcagcagcagaaccggcatccccagcggcgacgagctggacagcttcgagaccaacaccgagcccgacttcaacatcagcagagccgagagcctgcccctgagcagcaacctgcagagcaaggagagcctgctgagcggcgtgagaagcagaagctacagctgcagcagccccaagatcagcctgggcaagaccagactggtgagagagctgaccgtgtgcagcagcagcgaggagcagagagcctacagcctgagcgagccccccagagagaacagaatccaggaggaggagtgggacaagtacatcatccccgccaagagcgagagcgagaagtacaaggtgagcagaaccttcagcttcctgatgaacagaatgaccagccccagaaacaagagcaagaccaagagcaaggacgccaaggacaaggagaagctgaacagacaccagttcgcccccggcaccttcagcggcgtgctgcagtgcctggtgtgcgacaagaccctgctgggcaaggagagcctgcagtgcagcaactgcaacgccaacgtgcacaagggctgcaaggacgccgcccccgcctgcaccaagaagttccaggagaagtacaacaagaacaagccccagaccatcctgggcaacagcagcttcagagacatcccccagcccggcctgagcctgcaccccagcagcagcgtgcccgtgggcctgcccaccggcagaagagagaccgtgggccaggtgcaccccctgagcagaagcgtgcccggcaccaccctggagagcttcagaagaagcgccaccagcctggagagcgagagcgaccacaacagctgcagaagcagaagccacagcgacgagctgctgcagagcatgggcagcagccccagcaccgagagcttcatcatggaggacgtggtggacagcagcctgtggagcgacctgagcagcgacgcccaggagttcgaggccgagagctggagcctggtggtggaccccagcttctgcaacagacaggagaaggacgtgatcaagagacaggacgtgatcttcgagctgatgcagaccgagatgcaccacatccagaccctgttcatcatgagcgagatcttcagaaagggcatgaaggaggagctgcagctggaccacagcaccgtggacaagatcttcccctgcctggacgagctgctggagatccacagacacttcttctacagcatgaaggagagaagacaggagagctgcgccggcagcgacagaaacttcgtgatcgacagaatcggcgacatcctggtgcagcagttcagcgaggagaacgccagcaagatgaagaagatctacggcgagttctgctgccaccacaaggaggccgtgaacctgttcaaggagctgcagcagaacaagaagttccagaacttcatcaagctgagaaacagcaacctgctggccagaagaagaggcatccccgagtgcatcctgctggtgacccagagaatcaccaagtaccccgtgctggtggagagaatcctgcagtacaccaaggagagaaccgaggagcacaaggacctgagaaaggccctgtgcctgatcaaggacatgatcgccaccgtggacctgaaggtgaacgagtacgagaagaaccagaagtggctggagatcctgaacaagatcgagaacaagacctacaccaagctgaagaacggccacgtgttcagaaagcaggccctgatgagcgaggagagaaccctgctgtacgacggcctggtgtactggaagaccgccaccggcagattcaaggacatcctggccctgctgctgaccgacgtgctgctgttcctgcaggagaaggaccagaagtacatcttcgccgccgtggaccagaagcccagcgtgatcagcctgcagaagctgatcgccagagaggtggccaacgaggagagaggcatgttcctgatcagcgccagcagcgccggccccgagatgtacgagatccacaccaacagcaaggaggagagaaacaactggatgagaagaatccagcaggccgtggagagctgccccgaggagaagggcggcagaaccagcgagagcgacgaggacaagagaaaggccgaggccagagtggccaagatccagcagtgccaggagatcctgaccaaccaggaccagcagatctgcgcctacctggaggagaagctgcacatctacgccgagctgggcgagctgagcggcttcgaggacgtgcacctggagccccacctgctgatcaagcccgaccccggcgagcccccccaggccgccagcctgctggccgccgccctgaaggaggccctggtgaccggcggcagagagggcagaggctgcagcgacgtggaccccggcatccagggcgtggtgaccgacctggccgtgagcgacgccggcgagaaggtggagtgcagaaacttccccggcagcagccagagcgagatcatccaggccatccagaacctgaccagactgctgtacagcctgcaggccgccctgaccatccaggacagccacatcgagatccacagactggtgctgcagcagcaggagggcctgagcctgggccacagcatcctgagaggcggccccctgcaggaccagaagagcagagacgccgacagacagcacgaggagctggccaacgtgcaccagctgcagcaccagctgcagcaggagcagagaagatggctgagaagatgcgagcagcagcagagagcccaggccaccagagagagctggctgcaggagagagagagagagtgccagagccaggaggagctgctgctgagaagcagaggcgagctggacctgcagctgcaggagtaccagcacagcctggagagactgagagagggccagagactggtggagagagagcaggccagaatgagagcccagcagagcctgctgggccactggaagcacggcagacagagaagcctgcccgccgtgctgctgcccggcggccccgaggtgatggagctgaacagaagcgagagcctgtgccacgagaacagcttcttcatcaacgaggccctggtgcagatgagcttcaacaccttcaacaagctgaaccccagcgtgatccaccaggacgccacctaccccaccacccagagccacagcgacctggtgagaaccagcgagcaccaggtggacctgaaggtggaccccagccagcccagcaacgtgagccacaagctgtggaccgccgccggcagcggccaccagatcctgcccttccacgagagcagcaaggacagctgcaagaacggcagcagcatgaccaagtgcagctgcaccctgaccagcccccccggcctgtggaccggcaccaccagcaccctgaaggacctggacaccagccacaccgagagccccaccccccacgacagcaacagccacagaccccagctgcaggccttcatcaccgaggccaagctgaacctgcccaccagaaccatgaccagacaggacggcgagaccggcgacggcgccaaggagaacatcgtgtacctgtag

SEQ ID NO: 21591 - DNA, 4956 bp, Artificial Sequence
  Description of Artificial Sequence: Synthetic coding sequence
atggagctgagctgcagcgaggcccccctgtacggccagatgatgatctacgccaagttcgacaagaacgtgtacctgcccgaggacgccgagttctacttcacctacgacggcagccaccagagacacgtgatgatcgccgagagaatcgaggacaacgtgctgcagagcagcgtgcccggccacggcctgcaggagaccgtgaccgtgagcgtgtgcctgtgcagcgagggctacagccccgtgaccatgggcagcggcagcgtgacctacgtggacaacatggcctgcagactggccagactgctggtgacccaggccaacagactgaccgcctgcagccaccagaccctgctgacccccttcgccctgaccgccggcgccctgcccgccctggacgaggagctggtgctggccctgacccacctggagctgcccctggagtggaccgtgctgggcagcagcagcctggaggtgagcagccacagagagagcctgctgcacctggccatgagatggggcctggccaagctgagccagttcttcctgtgcctgcccggcggcgtgcaggccctggccctgcccaacgaggagggcgccacccccctggacctggccctgagagagggccacagcaagctggtggaggacgtgaccaacttccagggcagatggagccccagcttcagcagagtgcagctgagcgaggaggccagcctgcactacatccacagcagcgagaccctgaccctgaccctgaaccacaccgccgagcacctgctggaggccgacatcaagctgttcagaaagtacttctgggacagagccttcctggtgaaggccttcgagcccgaggccagacccgaggagagaaccgccatgcccagcagcggcgccgagaccgaggaggagatcaagaacagcgtgagcagcagaagcgccgccgagaaggaggacatcaagagagtgaagagcctggtggtgcagcacaacgagcacgaggaccagcacagcctggacctggacagaagcttcgacatcctgaagaagagcaagccccccagcaccctgctggccgccggcagactgagcgacatgctgaacggcggcgacgaggtgtacgccaactgcatggtgatcgaccaggtgggcgacctggacatcagctacatcaacatcgagggcatcaccgccaccaccagccccgagagcagaggctgcaccctgtggccccagagcagcaagcacaccctgcccaccgagaccagccccagcgtgtaccccctgagcgagaacgtggagggcaccgcccacaccgaggcccagcagagcttcatgagccccagcagcagctgcgccagcaacctgaacctgagcttcggctggcacggcttcgagaaggagcagagccacctgaagaagagaagcagcagcctggacgccctggacgccgacagcgagggcgagggccacagcgagcccagccacatctgctacacccccggcagccagagcagcagcagaaccggcatccccagcggcgacgagctggacagcttcgagaccaacaccgagcccgacttcaacatcagcagagccgagagcctgcccctgagcagcaacctgcagagcaaggagagcctgctgagcggcgtgagaagcagaagctacagctgcagcagccccaagatcagcctgggcaagaccagactggtgagagagctgaccgtgtgcagcagcagcgaggagcagagagcctacagcctgagcgagccccccagagagaacagaatccaggaggaggagtgggacaagtacatcatccccgccaagagcgagagcgagaagtacaaggtgagcagaaccttcagcttcctgatgaacagaatgaccagccccagaaacaagagcaagaccaagagcaaggacgccaaggacaaggagaagctgaacagacaccagttcgcccccggcaccttcagcggcgtgctgcagtgcctggtgtgcgacaagaccctgctgggcaaggagagcctgcagtgcagcaactgcaacgccaacgtgcacaagggctgcaaggacgccgcccccgcctgcaccaagaagttccaggagaagtacaacaagaacaagccccagaccatcctgggcaacagcagcttcagagacatcccccagcccggcctgagcctgcaccccagcagcagcgtgcccgtgggcctgcccaccggcagaagagagaccgtgggccaggtgcaccccctgagcagaagcgtgcccggcaccaccctggagagcttcagaagaagcgccaccagcctggagagcgagagcgaccacaacagctgcagaagcagaagccacagcgacgagctgctgcagagcatgggcagcagccccagcaccgagagcttcatcatggaggacgtggtggacagcagcctgtggagcgacctgagcagcgacgcccaggagttcgaggccgagagctggagcctggtggtggaccccagcttctgcaacagacaggagaaggacgtgatcaagagacaggacgtgatcttcgagctgatgcagaccgagatgcaccacatccagaccctgttcatcatgagcgagatcttcagaaagggcatgaaggaggagctgcagctggaccacagcaccgtggacaagatcttcccctgcctggacgagctgctggagatccacagacacttcttctacagcatgaaggagagaagacaggagagctgcgccggcagcgacagaaacttcgtgatcgacagaatcggcgacatcctggtgcagcagttcagcgaggagaacgccagcaagatgaagaagatctacggcgagttctgctgccaccacaaggaggccgtgaacctgttcaaggagctgcagcagaacaagaagttccagaacttcatcaagctgagaaacagcaacctgctggccagaagaagaggcatccccgagtgcatcctgctggtgacccagagaatcaccaagtaccccgtgctggtggagagaatcctgcagtacaccaaggagagaaccgaggagcacaaggacctgagaaaggccctgtgcctgatcaaggacatgatcgccaccgtggacctgaaggtgaacgagtacgagaagaaccagaagtggctggagatcctgaacaagatcgagaacaagacctacaccaagctgaagaacggccacgtgttcagaaagcaggccctgatgagcgaggagagaaccctgctgtacgacggcctggtgtactggaagaccgccaccggcagattcaaggacatcctggccctgctgctgaccgacgtgctgctgttcctgcaggagaaggaccagaagtacatcttcgccgccgtggaccagaagcccagcgtgatcagcctgcagaagctgatcgccagagaggtggccaacgaggagagaggcatgttcctgatcagcgccagcagcgccggccccgagatgtacgagatccacaccaacagcaaggaggagagaaacaactggatgagaagaatccagcaggccgtggagagctgccccgaggagaagggcggcagaaccagcgagagcgacgaggacaagagaaaggccgaggccagagtggccaagatccagcagtgccaggagatcctgaccaaccaggaccagcagatctgcgcctacctggaggagaagctgcacatctacgccgagctgggcgagctgagcggcttcgaggacgtgcacctggagccccacctgctgatcaagcccgaccccggcgagcccccccaggccgccagcctgctggccgccgccctgaaggaggccgagagcctgcaggtggccgtgaaggccagccagatgggcgccgtgagccagagctgcgaggacagctgcggcgacagcgtgctggccgacaccctgagcagccacgacgtgcccggcagccccaccgccagcctggtgaccggcggcagagagggcagaggctgcagcgacgtggaccccggcatccagggcgtggtgaccgacctggccgtgagcgacgccggcgagaaggtggagtgcagaaacttccccggcagcagccagagcgagatcatccaggccatccagaacctgaccagactgctgtacagcctgcaggccgccctgaccatccaggacagccacatcgagatccacagactggtgctgcagcagcaggagggcctgagcctgggccacagcatcctgagaggcggccccctgcaggaccagaagagcagagacgccgacagacagcacgaggagctggccaacgtgcaccagctgcagcaccagctgcagcaggagcagagaagatggctgagaagatgcgagcagcagcagagagcccaggccaccagagagagctggctgcaggagagagagagagagtgccagagccaggaggagctgctgctgagaagcagaggcgagctggacctgcagctgcaggagtaccagcacagcctggagagactgagagagggccagagactggtggagagagagcaggccagaatgagagcccagcagagcctgctgggccactggaagcacggcagacagagaagcctgcccgccgtgctgctgcccggcggccccgaggtgatggagctgaacagaagcgagagcctgtgccacgagaacagcttcttcatcaacgaggccctggtgcagatgagcttcaacaccttcaacaagctgaaccccagcgtgatccaccaggacgccacctaccccaccacccagagccacagcgacctggtgagaaccagcgagcaccaggtggacctgaaggtggaccccagccagcccagcaacgtgagccacaagctgtggaccgccgccggcagcggccaccagatcctgcccttccacgagagcagcaaggacagctgcaagaacggcaactag

SEQ ID NO: 21592 - DNA, 5118 bp, Artificial Sequence
  Description of Artificial Sequence: Synthetic coding sequence
atggagctgagctgcagcgaggcccccctgtacggccagatgatgatctacgccaagttcgacaagaacgtgtacctgcccgaggacgccgagttctacttcacctacgacggcagccaccagagacacgtgatgatcgccgagagaatcgaggacaacgtgctgcagagcagcgtgcccggccacggcctgcaggagaccgtgaccgtgagcgtgtgcctgtgcagcgagggctacagccccgtgaccatgggcagcggcagcgtgacctacgtggacaacatggcctgcagactggccagactgctggtgacccaggccaacagactgaccgcctgcagccaccagaccctgctgacccccttcgccctgaccgccggcgccctgcccgccctggacgaggagctggtgctggccctgacccacctggagctgcccctggagtggaccgtgctgggcagcagcagcctggaggtgagcagccacagagagagcctgctgcacctggccatgagatggggcctggccaagctgagccagttcttcctgtgcctgcccggcggcgtgcaggccctggccctgcccaacgaggagggcgccacccccctggacctggccctgagagagggccacagcaagctggtggaggacgtgaccaacttccagggcagatggagccccagcttcagcagagtgcagctgagcgaggaggccagcctgcactacatccacagcagcgagaccctgaccctgaccctgaaccacaccgccgagcacctgctggaggccgacatcaagctgttcagaaagtacttctgggacagagccttcctggtgaaggccttcgagcccgaggccagacccgaggagagaaccgccatgcccagcagcggcgccgagaccgaggaggagatcaagaacagcgtgagcagcagaagcgccgccgagaaggaggacatcaagagagtgaagagcctggtggtgcagcacaacgagcacgaggaccagcacagcctggacctggacagaagcttcgacatcctgaagaagagcaagccccccagcaccctgctggccgccggcagactgagcgacatgctgaacggcggcgacgaggtgtacgccaactgcatggtgatcgaccaggtgggcgacctggacatcagctacatcaacatcgagggcatcaccgccaccaccagccccgagagcagaggctgcaccctgtggccccagagcagcaagcacaccctgcccaccgagaccagccccagcgtgtaccccctgagcgagaacgtggagggcaccgcccacaccgaggcccagcagagcttcatgagccccagcagcagctgcgccagcaacctgaacctgagcttcggctggcacggcttcgagaaggagcagagccacctgaagaagagaagcagcagcctggacgccctggacgccgacagcgagggcgagggccacagcgagcccagccacatctgctacacccccggcagccagagcagcagcagaaccggcatccccagcggcgacgagctggacagcttcgagaccaacaccgagcccgacttcaacatcagcagagccgagagcctgcccctgagcagcaacctgcagagcaaggagagcctgctgagcggcgtgagaagcagaagctacagctgcagcagccccaagatcagcctgggcaagaccagactggtgagagagctgaccgtgtgcagcagcagcgaggagcagagagcctacagcctgagcgagccccccagagagaacagaatccaggaggaggagtgggacaagtacatcatccccgccaagagcgagagcgagaagtacaaggtgagcagaaccttcagcttcctgatgaacagaatgaccagccccagaaacaagagcaagaccaagagcaaggacgccaaggacaaggagaagctgaacagacaccagttcgcccccggcaccttcagcggcgtgctgcagtgcctggtgtgcgacaagaccctgctgggcaaggagagcctgcagtgcagcaactgcaacgccaacgtgcacaagggctgcaaggacgccgcccccgcctgcaccaagaagttccaggagaagtacaacaagaacaagccccagaccatcctgggcaacagcagcttcagagacatcccccagcccggcctgagcctgcaccccagcagcagcgtgcccgtgggcctgcccaccggcagaagagagaccgtgggccaggtgcaccccctgagcagaagcgtgcccggcaccaccctggagagcttcagaagaagcgccaccagcctggagagcgagagcgaccacaacagctgcagaagcagaagccacagcgacgagctgctgcagagcatgggcagcagccccagcaccgagagcttcatcatggaggacgtggtggacagcagcctgtggagcgacctgagcagcgacgcccaggagttcgaggccgagagctggagcctggtggtggaccccagcttctgcaacagacaggagaaggacgtgatcaagagacaggacgtgatcttcgagctgatgcagaccgagatgcaccacatccagaccctgttcatcatgagcgagatcttcagaaagggcatgaaggaggagctgcagctggaccacagcaccgtggacaagatcttcccctgcctggacgagctgctggagatccacagacacttcttctacagcatgaaggagagaagacaggagagctgcgccggcagcgacagaaacttcgtgatcgacagaatcggcgacatcctggtgcagcagttcagcgaggagaacgccagcaagatgaagaagatctacggcgagttctgctgccaccacaaggaggccgtgaacctgttcaaggagctgcagcagaacaagaagttccagaacttcatcaagctgagaaacagcaacctgctggccagaagaagaggcatccccgagtgcatcctgctggtgacccagagaatcaccaagtaccccgtgctggtggagagaatcctgcagtacaccaaggagagaaccgaggagcacaaggacctgagaaaggccctgtgcctgatcaaggacatgatcgccaccgtggacctgaaggtgaacgagtacgagaagaaccagaagtggctggagatcctgaacaagatcgagaacaagacctacaccaagctgaagaacggccacgtgttcagaaagcaggccctgatgagcgaggagagaaccctgctgtacgacggcctggtgtactggaagaccgccaccggcagattcaaggacatcctggccctgctgctgaccgacgtgctgctgttcctgcaggagaaggaccagaagtacatcttcgccgccgtggaccagaagcccagcgtgatcagcctgcagaagctgatcgccagagaggtggccaacgaggagagaggcatgttcctgatcagcgccagcagcgccggccccgagatgtacgagatccacaccaacagcaaggaggagagaaacaactggatgagaagaatccagcaggccgtggagagctgccccgaggagaagggcggcagaaccagcgagagcgacgaggacaagagaaaggccgaggccagagtggccaagatccagcagtgccaggagatcctgaccaaccaggaccagcagatctgcgcctacctggaggagaagctgcacatctacgccgagctgggcgagctgagcggcttcgaggacgtgcacctggagccccacctgctgatcaagcccgaccccggcgagcccccccaggccgccagcctgctggccgccgccctgaaggaggccgagagcctgcaggtggccgtgaaggccagccagatgggcgccgtgagccagagctgcgaggacagctgcggcgacagcgtgctggccgacaccctgagcagccacgacgtgcccggcagccccaccgccagcctggtgaccggcggcagagagggcagaggctgcagcgacgtggaccccggcatccagggcgtggtgaccgacctggccgtgagcgacgccggcgagaaggtggagtgcagaaacttccccggcagcagccagagcgagatcatccaggccatccagaacctgaccagactgctgtacagcctgcaggccgccctgaccatccaggacagccacatcgagatccacagactggtgctgcagcagcaggagggcctgagcctgggccacagcatcctgagaggcggccccctgcaggaccagaagagcagagacgccgacagacagcacgaggagctggccaacgtgcaccagctgcagcaccagctgcagcaggagcagagaagatggctgagaagatgcgagcagcagcagagagcccaggccaccagagagagctggctgcaggagagagagagagagtgccagagccaggaggagctgctgctgagaagcagaggcgagctggacctgcagctgcaggagtaccagcacagcctggagagactgagagagggccagagactggtggagagagagcaggccagaatgagagcccagcagagcctgctgggccactggaagcacggcagacagagaagcctgcccgccgtgctgctgcccggcggccccgaggtgatggagctgaacagaagcgagagcctgtgccacgagaacagcttcttcatcaacgaggccctggtgcagatgagcttcaacaccttcaacaagctgaaccccagcgtgatccaccaggacgccacctaccccaccacccagagccacagcgacctggtgagaaccagcgagcaccaggtggacctgaaggtggaccccagccagcccagcaacgtgagccacaagctgtggaccgccgccggcagcggccaccagatcctgcccttccacgagagcagcaaggacagctgcaagaacgacctggacaccagccacaccgagagccccaccccccacgacagcaacagccacagaccccagctgcaggccttcatcaccgaggccaagctgaacctgcccaccagaaccatgaccagacaggacggcgagaccggcgacggcgccaaggagaacatcgtgtacctgtag

SEQ ID NO: 21593 - DNA, 252 bp, Artificial Sequence
  Description of Artificial Sequence: Synthetic coding sequence
atggagctgagctgcagcgaggcccccctgtacggccagatgatgatctacgccaagttcgacaagaacgtgtacctgcccgaggacgccgagttctacttcacctacgacggcagccaccagagacacgtgatgatcgccgagagaatcgaggacaacgtgctgcagagcagcgtgcccggccacggcctgcaggagaccgtgaccgtgagcgtgtgcctgtgcagcgagggctacagccccgtgacctag

SEQ ID NO: 21594 - DNA, 5118 bp, Artificial Sequence; identical to SEQ ID NO: 21592
  Description of Artificial Sequence: Synthetic coding sequence

SEQ ID NO: 21595 - DNA, 5196 bp, Artificial Sequence
  Description of Artificial Sequence: Synthetic coding sequence
atggagctgagctgcagcgaggcccccctgtacggccagatgatgatctacgccaagttcgacaagaacgtgtacctgcccgaggacgccgagttctacttcacctacgacggcagccaccagagacacgtgatgatcgccgagagaatcgaggacaacgtgctgcagagcagcgtgcccggccacggcctgcaggagaccgtgaccgtgagcgtgtgcctgtgcagcgagggctacagccccgtgaccatgggcagcggcagcgtgacctacgtggacaacatggcctgcagactggccagactgctggtgacccaggccaacagactgaccgcctgcagccaccagaccctgctgacccccttcgccctgaccgccggcgccctgcccgccctggacgaggagctggtgctggccctgacccacctggagctgcccctggagtggaccgtgctgggcagcagcagcctggaggtgagcagccacagagagagcctgctgcacctggccatgagatggggcctggccaagctgagccagttcttcctgtgcctgcccggcggcgtgcaggccctggccctgcccaacgaggagggcgccacccccctggacctggccctgagagagggccacagcaagctggtggaggacgtgaccaacttccagggcagatggagccccagcttcagcagagtgcagctgagcgaggaggccagcctgcactacatccacagcagcgagaccctgaccctgaccctgaaccacaccgccgagcacctgctggaggccgacatcaagctgttcagaaagtacttctgggacagagccttcctggtgaaggccttcgagcccgaggccagacccgaggagagaaccgccatgcccagcagcggcgccgagaccgaggaggagatcaagaacagcgtgagcagcagaagcgccgccgagaaggaggacatcaagagagtgaagagcctggtggtgcagcacaacgagcacgaggaccagcacagcctggacctggacagaagcttcgacatcctgaagaagagcaagccccccagcaccctgctggccgccggcagactgagcgacatgctgaacggcggcgacgaggtgtacgccaactgcatggtgatcgaccaggtgggcgacctggacatcagctacatcaacatcgagggcatcaccgccaccaccagccccgagagcagaggctgcaccctgtggccccagagcagcaagcacaccctgcccaccgagaccagccccagcgtgtaccccctgagcgagaacgtggagggcaccgcccacaccgaggcccagcagagcttcatgagccccagcagcagctgcgccagcaacctgaacctgagcttcggctggcacggcttcgagaaggagcagagccacctgaagaagagaagcagcagcctggacgccctggacgccgacagcgagggcgagggccacagcgagcccagccacatctgctacacccccggcagccagagcagcagcagaaccggcatccccagcggcgacgagctggacagcttcgagaccaacaccgagcccgacttcaacatcagcagagccgagagcctgcccctgagcagcaacctgcagagcaaggagagcctgctgagcggcgtgagaagcagaagctacagctgcagcagccccaagatcagcctgggcaagaccagactggtgagagagctgaccgtgtgcagcagcagcgaggagcagagagcctacagcctgagcgagccccccagagagaacagaatccaggaggaggagtgggacaagtacatcatccccgccaagagcgagagcgagaagtacaaggtgagcagaaccttcagcttcctgatgaacagaatgaccagccccagaaacaagagcaagaccaagagcaaggacgccaaggacaaggagaagctgaacagacaccagttcgcccccggcaccttcagcggcgtgctgcagtgcctggtgtgcgacaagaccctgctgggcaaggagagcctgcagtgcagcaactgcaacgccaacgtgcacaagggctgcaaggacgccgcccccgcctgcaccaagaagttccaggagaagtacaacaagaacaagccccagaccatcctgggcaacagcagcttcagagacatcccccagcccggcctgagcctgcaccccagcagcagcgtgcccgtgggcctgcccaccggcagaagagagaccgtgggccaggtgcaccccctgagcagaagcgtgcccggcaccaccctggagagcttcagaagaagcgccaccagcctggagagcgagagcgaccacaacagctgcagaagcagaagccacagcgacgagctgctgcagagcatgggcagcagccccagcaccgagagcttcatcatggaggacgtggtggacagcagcctgtggagcgacctgagcagcgacgcccaggagttcgaggccgagagctggagcctggtggtggaccccagcttctgcaacagacaggagaaggacgtgatcaagagacaggacgtgatcttcgagctgatgcagaccgagatgcaccacatccagaccctgttcatcatgagcgagatcttcagaaagggcatgaaggaggagctgcagctggaccacagcaccgtggacaagatcttcccctgcctggacgagctgctggagatccacagacacttcttctacagcatgaaggagagaagacaggagagctgcgccggcagcgacagaaacttcgtgatcgacagaatcggcgacatcctggtgcagcagttcagcgaggagaacgccagcaagatgaagaagatctacggcgagttctgctgccaccacaaggaggccgtgaacctgttcaaggagctgcagcagaacaagaagttccagaacttcatcaagctgagaaacagcaacctgctggccagaagaagaggcatccccgagtgcatcctgctggtgacccagagaatcaccaagtaccccgtgctggtggagagaatcctgcagtacaccaaggagagaaccgaggagcacaaggacctgagaaaggccctgtgcctgatcaaggacatgatcgccaccgtggacctgaaggtgaacgagtacgagaagaaccagaagtggctggagatcctgaacaagatcgagaacaagacctacaccaagctgaagaacggccacgtgttcagaaagcaggccctgatgagcgaggagagaaccctgctgtacgacggcctggtgtactggaagaccgccaccggcagattcaaggacatcctggccctgctgctgaccgacgtgctgctgttcctgcaggagaaggaccagaagtacatcttcgccgccgtggaccagaagcccagcgtgatcagcctgcagaagctgatcgccagagaggtggccaacgaggagagaggcatgttcctgatcagcgccagcagcgccggccccgagatgtacgagatccacaccaacagcaaggaggagagaaacaactggatgagaagaatccagcaggccgtggagagctgccccgaggagaagggcggcagaaccagcgagagcgacgaggacaagagaaaggccgaggccagagtggccaagatccagcagtgccaggagatcctgaccaaccaggaccagcagatctgcgcctacctggaggagaagctgcacatctacgccgagctgggcgagctgagcggcttcgaggacgtgcacctggagccccacctgctgatcaagcccgaccccggcgagcccccccaggccgccagcctgctggccgccgccctgaaggaggccgagagcctgcaggtggccgtgaaggccagccagatgggcgccgtgagccagagctgcgaggacagctgcggcgacagcgtgctggccgacaccctgagcagccacgacgtgcccggcagccccaccgccagcctggtgaccggcggcagagagggcagaggctgcagcgacgtggaccccggcatccagggcgtggtgaccgacctggccgtgagcgacgccggcgagaaggtggagtgcagaaacttccccggcagcagccagagcgagatcatccaggccatccagaacctgaccagactgctgtacagcctgcaggccgccctgaccatccaggacagccacatcgagatccacagactggtgctgcagcagcaggagggcctgagcctgggccacagcatcctgagaggcggccccctgcaggaccagaagagcagagacgccgacagacagcacgaggagctggccaacgtgcaccagctgcagcaccagctgcagcaggagcagagaagatggctgagaagatgcgagcagcagcagagagcccaggccaccagagagagctggctgcaggagagagagagagagtgccagagccaggaggagctgctgctgagaagcagaggcgagctggacctgcagctgcaggagtaccagcacagcctggagagactgagagagggccagagactggtggagagagagcaggccagaatgagagcccagcagagcctgctgggccactggaagcacggcagacagagaagcctgcccgccgtgctgctgcccggcggccccgaggtgatggagctgaacagaagcgagagcctgtgccacgagaacagcttcttcatcaacgaggccctggtgcagatgagcttcaacaccttcaacaagctgaaccccagcgtgatccaccaggacgccacctaccccaccacccagagccacagcgacctggtgagaaccagcgagcaccaggtggacctgaaggtggaccccagccagcccagcaacgtgagccacaagctgtggaccgccgccggcagcggccaccagatcctgcccttccacgagagcagcaaggacagctgcaagaacggcagcagcatgaccaagtgcagctgcaccctgaccagcccccccggcctgtggaccggcaccaccagcaccctgaaggacctggacaccagccacaccgagagccccaccccccacgacagcaacagccacagaccccagctgcaggccttcatcaccgaggccaagctgaacctgcccaccagaaccatgaccagacaggacggcgagaccggcgacggcgccaaggagaacatcgtgtacctgtag

SEQ ID NO: 21596 - DNA, 948 bp, Artificial Sequence
  Description of Artificial Sequence: Synthetic coding sequence
atgcagagaagaagcagaggcatcaacaccggcctgatcctgctgctgagccagatcttccacgtgggcatcaacaacatcccccccgtgaccctggccaccctggccctgaacatctggttcttcctgaacccccagaagcccctgtacagcagctgcctgagcgtggagaagtgctaccagcagaaggactggcagagactgctgctgagccccctgcaccacgccgacgactggcacctgtacttcaacatggccagcatgctgtggaagggcatcaacctggagagaagactgggcagcagatggttcgcctacgtgatcaccgccttcagcgtgctgaccggcgtggtgtacctgctgctgcagttcgccgtggccgagttcatggacgagcccgacttcaagagaagctgcgccgtgggcttcagcggcgtgctgttcgccctgaaggtgctgaacaaccactactgccccggcggcttcgtgaacatcctgggcttccccgtgcccaacagattcgcctgctgggtggagctggtggccatccacctgttcagccccggcaccagcttcgccggccacctggccggcatcctggtgggcctgatgtacacccagggccccctgaagaagatcatggaggcctgcgccggcggcttcagcagcagcgtgggctaccccggcagacagtactacttcaacagcagcggcagcagcggctaccaggactactacccccacggcagacccgaccactacgaggaggcccccagaaactacgacacctacaccgccggcctgagcgaggaggagcagctggagagagccctgcaggccagcctgtgggacagaggcaacaccagaaacagcccccccccctacggcttccacctgagccccgaggagatgagaagacagagactgcacagattcgacagccagtag

SEQ ID NO: 21597 - DNA, 948 bp, Artificial Sequence; identical to SEQ ID NO: 21596
  Description of Artificial Sequence: Synthetic coding sequence

SEQ ID NO: 21598 - DNA, 456 bp, Artificial Sequence
  Description of Artificial Sequence: Synthetic coding sequence
atgcagagaagaagcagaggcatcaacaccggcctgatcctgctgctgagccagatcttccacgtgggcatcaacaacatcccccccgtgaccctggccaccctggccctgaacatctggttcttcctgaacccccagaagcccctgtacagcagctgcctgagcgtggagaagtgctaccagcagaaggactggcagagactgctgctgagccccctgcaccacgccgacgactggcacctgtacttcaacatggccagcatgctgtggaagggcatcaacctggagagaagactgggcagcagatggttcgcctacgtgatcaccgccttcagcgtgctgaccggcgtggtgtacctgctgctgcagttcgccgtggccgagttcatggacgagcccgacttcaagagaagctgcgccgtgggcttcagcggcgtgctgttcgccctgaagtag

SEQ ID NO: 21599 - DNA, 405 bp, Artificial Sequence
  Description of Artificial Sequence: Synthetic coding sequence
atgcagagaagaagcagaggcatcaacaccggcctgatcctgctgctgagccagatcttccacgtgggcatcaacaacatcccccccgtgaccctggccaccctggccctgaacatctggttcttcctgaacccccagaagcccctgtacagcagctgcctgagcgtggagaagtgctaccagcagaaggactggcagagactgctgctgagccccctgcaccacgccgacgactggcacctgtacttcaacatggccagcatgctgtggaagggcatcaacctggagagaagactgggcagcagatggttcgcctacgtgatcaccgccttcagcgtgctgaccggcgtggtgtacctgctgctgcagttcgccgtggccgagttcatggacgagcccgactag

SEQ ID NO: 21600 - DNA, 165 bp, Artificial Sequence
  Description of Artificial Sequence: Synthetic coding sequence
atgcagagaagaagcagaggcatcaacaccggcctgatcctgctgctgagccagatcttccacgtgggcatcaacaacatcccccccgtgaccctggccaccctggccctgaacatctggttcttcctgaacccccagaagcccctgtacagcagctgcctgtag

SEQ ID NO: 21601 - DNA, 153 bp, Artificial Sequence
  Description of Artificial Sequence: Synthetic coding sequence
atgcagagaagaagcagaggcatcaacaccggcctgatcctgctgctgagccagatcttccacgtgggcatcaacaacatcccccccgtgaccctggccaccctggccctgaacatctggttcttcctgaacccccagaagcccctgtactag

SEQ ID NO: 21602 - DNA, 21 bp, Artificial Sequence
  Description of Artificial Sequence: Synthetic coding sequence
atgcagagaagaagcagatag

SEQ ID NO: 21603 - DNA, 375 bp, Artificial Sequence
  Description of Artificial Sequence: Synthetic coding sequence
atgcagagaagaagcagaggcatcaacaccggcctgatcctgctgctgagccagatcttccacgtgggcatcaacaacatcccccccgtgaccctggccaccctggccctgaacatctggttcttcctgaacccccagaagcccctgtacagcagctgcctgagcgtggagaagtgctaccagcagaaggactggcagagactgctgctgagccccctgcaccacgccgacgactggcacctgtacttcaacatggccagcatgctgtggaagggcatcaacctggagagaagactgggcagcagatggttcgcctacgtgatcaccgccttcagcgtgctgaccggcgtggtgtacctgctgctgcagttctag

SEQ ID NO: 21604 - DNA, 1095 bp, Artificial Sequence
  Description of Artificial Sequence: Synthetic coding sequence
atggccgccagcggccccggctgcagaagctggtgcctgtgccccgaggtgcccagcgccaccttcttcaccgccctgctgagcctgctggtgagcggccccagactgttcctgctgcagcagcccctggcccccagcggcctgaccctgaagagcgaggccctgagaaactggcaggtgtacagactggtgacctacatcttcgtgtacgagaaccccatcagcctgctgtgcggcgccatcatcatctggagattcgccggcaacttcgagagaaccgtgggcaccgtgagacactgcttcttcaccgtgatcttcgccatcttcagcgccatcatcttcctgagcttcgaggccgtgagcagcctgagcaagctgggcgaggtggaggacgccagaggcttcacccccgtggccttcgccatgctgggcgtgaccaccgtgagaagcagaatgagaagagccctggtgttcggcatggtggtgcccagcgtgctggtgccctggctgctgctgggcgccagctggctgatcccccagaccagcttcctgagcaacgtgtgcggcctgagcatcggcctggcctacggcctgacctactgctacagcatcgacctgagcgagagagtggccctgaagctggaccagaccttccccttcagcctgatgagaagaatcagcgtgttcaagtacgtgagcggcagcagcgccgagagaagagccgcccagagcagaaagctgaaccccgtgcccggcagctaccccacccagagctgccacccccacctgagccccagccaccccgtgagccagacccagcacgccagcggccagaagctggccagctggcccagctgcacccccggccacatgcccaccctgcccccctaccagcccgccagcggcctgtgctacgtgcagaaccacttcggccccaaccccaccagcagcagcgtgtaccccgccagcgccggcaccagcctgggcatccagccccccacccccgtgaacagccccggcaccgtgtacagcggcgccctgggcacccccggcgccgccggcagcaaggagagcagcagagtgcccatgccctag

SEQ ID NO: 21605 - DNA, 672 bp, Artificial Sequence
  Description of Artificial Sequence: Synthetic coding sequence
atgctgggcgtgaccaccgtgagaagcagaatgagaagagccctggtgttcggcatggtggtgcccagcgtgctggtgccctggctgctgctgggcgccagctggctgatcccccagaccagcttcctgagcaacgtgtgcggcctgagcatcggcctggcctacggcctgacctactgctacagcatcgacctgagcgagagagtggccctgaagctggaccagaccttccccttcagcctgatgagaagaatcagcgtgttcaagtacgtgagcggcagcagcgccgagagaagagccgcccagagcagaaagctgaaccccgtgcccggcagctaccccacccagagctgccacccccacctgagccccagccaccccgtgagccagacccagcacgccagcggccagaagctggccagctggcccagctgcacccccggccacatgcccaccctgcccccctaccagcccgccagcggcctgtgctacgtgcagaaccacttcggccccaaccccaccagcagcagcgtgtaccccgccagcgccggcaccagcctgggcatccagccccccacccccgtgaacagccccggcaccgtgtacagcggcgccctgggcacccccggcgccgccggcagcaaggagagcagcagagtgcccatgccctag

SEQ ID NO: 21606 - DNA, 1305 bp, Artificial Sequence
  Description of Artificial Sequence: Synthetic coding sequence
atgggcagaggcctgtgggaggcctggccccccgccggcagcagcgccgtggccaagggcaactgcagagaggaggccgagggcgccgaggacagacagcccgccagcagaagaggcgccggcaccaccgccgccatggccgccagcggccccggctgcagaagctggtgcctgtgccccgaggtgcccagcgccaccttcttcaccgccctgctgagcctgctggtgagcggccccagactgttcctgctgcagcagcccctggcccccagcggcctgaccctgaagagcgaggccctgagaaactggcaggtgtacagactggtgacctacatcttcgtgtacgagaaccccatcagcctgctgtgcggcgccatcatcatctggagattcgccggcaacttcgagagaaccgtgggcaccgtgagacactgcttcttcaccgtgatcttcgccatcttcagcgccatcatcttcctgagcttcgaggccgtgagcagcctgagcaagctgggcgaggtggaggacgccagaggcttcacccccgtggccttcgccatgctgggcgtgaccaccgtgagaagcagaatgagaagagccctggtgttcggcatggtggtgcccagcgtgctggtgccctggctgctgctgggcgccagctggctgatcccccagaccagcttcctgagcaacgtgtgcggcctgagcatcggcctggcctacccccacctgctgctgttccacagacccctgagagccagcggcaccgaggccagaagcgacctgcccctgcagcccgacgaggaggacatcagagtgcaggtgagactgagagtgttcagcagagaggagggcagccccgagcccgagaccgagcccggcgcctggctgctgccccacaccgagctgccccccagccccgtgcccaagcccccctgcgtgcccgacgccgccagacagtggagcgaggccggcctgctggccagctgcacccccggccacatgcccaccctgcccccctaccagcccgccagcggcctgtgctacgtgcagaaccacttcggccccaaccccaccagcagcagcgtgtaccccgccagcgccggcaccagcctgggcatccagccccccacccccgtgaacagccccggcaccgtgtacagcggcgccctgggccaccagggcctgcaggcccccagaagcccccccggcagcccctgccccgagagaatcagcagagaggtgatcagcctgggcctgctgaaggtgctgcccaagagcctgctgaccaaggtgacctactag

SEQ ID NO: 21607 - DNA, 672 bp, Artificial Sequence; identical to SEQ ID NO: 21605
  Description of Artificial Sequence: Synthetic coding sequence

SEQ ID NO: 21608 - DNA, 1185 bp, Artificial Sequence
  Description of Artificial Sequence: Synthetic coding sequence
atggagctgagcgccgtgggcgagagagtgttcgccgccgagagcatcatcaagagaagaatcagaaagggcagaatcgagtacctggtgaagtggaagggctgggccatcaagtacagcacctgggagcccgaggagaacatcctggacagcagactgatcgccgccttcgagcagaaggagagagagagagagctgtacggccccaagaagagaggccccaagcccaagaccttcctgctgaagcccagcgccagcgccagcagccccaagctgcacagcagcgccgccgtgcacagactgaagaaggacatcagaagatgccacagaatgagcagaagacccctgcccagacccgacccccagggcggcagccccggcctgagaccccccatcagccccttcagcgagaccgtgagaatcatcaacagaaaggtgaagcccagagagcccaagagaaacagaatcatcctgaacctgaaggtgatcgacaagggcgccggcggcggcggcgccggccagggcgccggcgccctggccagacccaaggtgcccagcagaaacagagtgatcggcaagagcaagaagttcagcgagagcgtgctgagaacccagatcagacacatgaagttcggcgccttcgccctgtacaagcccccccccgcccccctggtggcccccagccccggcaaggccgaggccagcgcccccggccccggcctgctgctggccgcccccgccgccccctacgacgccagaagcagcggcagcagcggctgccccagccccaccccccagagcagcgaccccgacgacaccccccccaagctgctgcccgagaccgtgagccccagcgcccccagctggagagagcccgaggtgctggacctgagcctgccccccgagagcgccgccaccagcaagagagccccccccgaggtgaccgccgccgccggccccgccccccccaccgcccccgagcccgccggcgccagcagcgagcccgaggccggcgactggagacccgagatgagcccctgcagcaacgtggtggtgaccgacgtgaccagcaacctgctgaccgtgaccatcaaggagttctgcaaccccgaggacttcgagaaggtggccgccggcgtggccggcgccgccggcggcggcggcagcatcggcgccagcaagtag

SEQ ID NO: 21609 - DNA, 411 bp, Artificial Sequence
  Description of Artificial Sequence: Synthetic coding sequence
atgcacgccagaggcccccacggccagctgagccccgccctgcccctggccagcagcgtgctgatgctgctgatgagcaccctgtggctggtgggcgccggccccggcctggtgctggcccccgagctgctgctggacccctggcaggtgcacagactgctgacccacgccctgggccacaccgccctgcccggcctgctgctgagcctgctgctgctgcccaccgtgggctggcagcaggagtgccacctgggcaccctgagattcctgcacgccagcgccctgctggccctggccagcggcctgctggccgtgctgctggccggcctgggcctgagcagcgccgccggcagctgcggctacatgcccgtgcacctggccatgctggccggcgagggccacagaccctag

SEQ ID NO: 21610 - DNA, 588 bp, Artificial Sequence
  Description of Artificial Sequence: Synthetic coding sequence
atgcacgccagaggcccccacggccagctgagccccgccctgcccctggccagcagcgtgctgatgctgctgatgagcaccctgtggctggtgggcgccggccccggcctggtgctggcccccgagctgctgctggacccctggcaggtgcacagactgctgacccacgccctgggccacaccgccctgcccggcctgctgctgagcctgctgctgctgcccaccgtgggctggcagcaggagtgccacctgggcaccctgagattcctgcacgccagcgccctgctggccctggccagcggcctgctggccgtgctgctggccggcctgggcctgagcagcgccgccggcagctgcggctacatgcccgtgcacctggccatgctggccggcgagggccacagacccagaagacccagaggcgccctgcccccctggctgagcccctggctgctgctggccctgacccccctgctgagcagcgagccccccttcctgcagctgctgtgcggcctgctggccggcctggcctacgccgccggcgccttcagatggctggagcccagcgagagaagactgcaggtgtag

SEQ ID NO: 21611 - DNA, 912 bp, Artificial Sequence
  Description of Artificial Sequence: Synthetic coding sequence
atgaagggcaaggaggagaaggagggcggcgccagactgggcgccggcggcggcagccccgagaagagccccagcgcccaggagctgaaggagcagggcaacagactgttcgtgggcagaaagtaccccgaggccgccgcctgctacggcagagccatcaccagaaaccccctggtggccgtgtactacaccaacagagccctgtgctacctgaagatgcagcagcacgagcaggccctggccgactgcagaagagccctggagctggacggccagagcgtgaaggcccacttcttcctgggccagtgccagctggagatggagagctacgacgaggccatcgccaacctgcagagagcctacagcctggccaaggagcagagactgaacttcggcgacgacatccccagcgccctgagaatcgccaagaagaagagatggaacagcatcgaggagagaagaatccaccaggagagcgagctgcacagctacctgagcagactgatcgccgccgagagagagagagagctggaggagtgccagagaaaccacgagggcgacgaggacgacagccacgtgagagcccagcaggcctgcatcgaggccaagcacgacaagtacatggccgacatggacgagctgttcagccaggtggacgagaagagaaagaagagagacatccccgactacctgtgcggcaagatcagcttcgagctgatgagagagccctgcatcacccccagcggcatcacctacgacagaaaggacatcgaggagcacctgcagagagtgggccacttcgaccccgtgaccagaagccccctgacccaggagcagctgatccccaacctggccatgaaggaggtgatcgacgccttcatcagcgagaacggctgggtggaggactactag

SEQ ID NO: 21612 - DNA, 1122 bp, Artificial Sequence
  Description of Artificial Sequence: Synthetic coding sequence
atggacagaagcagcctgctgcagctgatccaggagcagcagctggaccccgagaacaccggcttcatcggcgccgacaccttcaccggcctggtgcacagccacgagctgcccctggaccccgccaagctggacatgctggtggccctggcccagagcaacgagcagggccaggtgtgctaccaggagctggtggacctgatcagcagcaagagaagcagcagcttcaagagagccatcgccaacggccagagagccctgcccagagacggccccctggacgagcccggcctgggcgtgtacaagagattcgtgagatacgtggcctacgagatcctgccctgcgaggtggacagaagatggtacttctacagacacagaagctgccccccccccgtgttcatggccagcgtgaccctggcccagatcatcgtgttcctgtgctacggcgccagactgaacaagtgggtgctgcagacctaccaccccgagtacatgaagagccccctggtgtaccaccccggccacagagccagagcctggagattcctgacctacatgttcatgcacgtgggcctggagcagctgggcttcaacgccctgctgcagctgatgatcggcgtgcccctggagatggtgcacggcctgctgagaatcagcctgctgtacctggccggcgtgctggccggcagcctgaccgtgagcatcaccgacatgagagcccccgtggtgggcggcagcggcggcgtgtacgccctgtgcagcgcccacctggccaacgtggtgatgaactgggccggcatgagatgcccctacaagctgctgagaatggtgctggccctggtgtgcatgagcagcgaggtgggcagagccgtgtggctgagattcagcccccccctgcccgccagcggcccccagcccagcttcatggcccacctggccggcgccgtggtgggcgtgagcatgggcctgaccatcctgagaagctacgaggagagactgagagaccagtgcggctggtgggtggtgctgctggcctacggcaccttcctgctgttcgccgtgttctggaacgtgttcgcctacgacctgctgggcgcccacatccccccccccccctag

SEQ ID NO: 21613 - DNA, 933 bp, Artificial Sequence
  Description of Artificial Sequence: Synthetic coding sequence
atggacagaagcagcctgctgcagctgatccaggagcagcagctggaccccgagaacaccggcttcatcggcgccgacaccttcaccggcctggtgcacagccacgagctgcccctggaccccgccaagctggacatgctggtggccctggcccagagcaacgagcagggccaggtgtgctaccaggagctggtggacctgatcagcagcaagagaagcagcagcttcaagagagccatcgccaacggccagagagccctgcccagagacggccccctggacgagcccggcctgggcgtgtacaagagattcgtgagatacgtggcctacgagatcctgccctgcgaggtggacagaagatggtacttctacagacacagaagctgccccccccccgtgttcatggccagcgtgaccctggcccagatcatcgtgttcctgtgctacggcgccagactgaacaagtgggtgctgcagacctaccaccccgagtacatgaagagccccctggtgtaccaccccggccacagagccagagcctggagattcctgacctacatgttcatgcacgtgggcctggagcagctgggcttcaacgccctgctgcagctgatgatcggcgtgcccctggagatggtgcacggcctgctgagaatcagcctgctgtacctggccggcgtgctggccggcagcctgaccgtgagcatcaccgacatgagagcccccgtggtgggcggcagcggcggcgtgtacgccctgtgcagcgcccacctggccaacgtggtgatggtgaccggcctgcccggcggcggcagaggcgagggcccccaggtgagcctgaccaccagcagactgcacacccccatcgagctgggctgggacgagatgagcctgcaggtggccgaggacggcgccggcctgggcgtgcagtag

SEQ ID NO: 21614 - DNA, 912 bp, Artificial Sequence
  Description of Artificial Sequence: Synthetic coding sequence
atggccgccgtgcacgacctggagatggagagcatgaacctgaacatgggcagagagatgaaggaggagctggaggaggaggagaagatgagagaggacggcggcggcaaggacagagccaagagcaagaaggtgcacagaatcgtgagcaagtggatgctgcccgagaagagcagaggcacctacctggagagagccaactgcttccccccccccgtgttcatcatcagcatcagcctggccgagctggccgtgttcatctactacgccgtgtggaagccccagaagcagtggatcaccctggacaccggcatcctggagagccccttcatctacagccccgagaagagagaggaggcctggagattcatcagctacatgctggtgcacgccggcgtgcagcacatcctgggcaacctgtgcatgcagctggtgctgggcatccccctggagatggtgcacaagggcctgagagtgggcctggtgtacctggccggcgtgatcgccggcagcctggccagcagcatcttcgaccccctgagatacctggtgggcgccagcggcggcgtgtacgccctgatgggcggctacttcatgaacgtgctggtgaacttccaggagatgatccccgccttcggcatcttcagactgctgatcatcatcctgatcatcgtgctggacatgggcttcgccctgtacagaagattcttcgtgcccgaggacggcagccccgtgagcttcgccgcccacatcgccggcggcttcgccggcatgagcatcggctacaccgtgttcagctgcttcgacaaggccctgctgaaggaccccagattctggatcgccatcgccgcctacctggcctgcgtgctgttcgccgtgttcttcaacatcttcctgagccccgccaactag

SEQ ID NO: 21615 - DNA, 1152 bp, Artificial Sequence
  Description of Artificial Sequence: Synthetic coding sequence
atgcagctgggcaagagacacaagctgaccaccaagagcgtgtgccacggcaagggcgtggtgatcagagtgctggccctgcccggccccagctgggtgagaagaagaagagagggcaaggccctggagagcagcagatgcgccagacagcccagagaggagagacagcccgaggacctgggcccccccgccgtgccctgggacagctgccccagcggcgaggagggcggccccagaaccatggccgccgtgcacgacctggagatggagagcatgaacctgaacatgggcagagagatgaaggaggagctggaggaggaggagaagatgagagaggacggcggcggcaaggacagagccaagagcaagaaggtgcacagaatcgtgagcaagtggatgctgcccgagaagagcagaggcacctacctggagagagccaactgcttccccccccccgtgttcatcatcagcatcagcctggccgagctggccgtgttcatctactacgccgtgtggaagccccagaagcagtggatcaccctggacaccggcatcctggagagccccttcatctacagccccgagaagagagaggaggcctggagattcatcagctacatgctggtgcacgccggcgtgcagcacatcctgggcaacctgtgcatgcagctggtgctgggcatccccctggagatggtgcacaagggcctgagagtgggcctggtgtacctggccggcgtgatcgccggcagcctggccagcagcatcttcgaccccctgagatacctggtgggcgccagcggcggcgtgtacgccctgatgggcggctacttcatgaacgtgctggtgaacttccaggagatgatccccgccttcggcatcttcagactgctgatcatcatcctgatcatcgtgctggacatgggcttcgccctgtacagaagattcttcgtgcccgaggacggcagccccgtgagcttcgccgcccacatcgccggcggcttcgccggcatgagcatcggctacaccgtgttcagctgcttcgacaaggccctgctgaaggaccccagattctggatcgccatcgccgcctacctggcctgcgtgctgttcgccgtgttcttcaacatcttcctgagccccgccaactag

SEQ ID NO: 21616 - DNA, 912 bp, Artificial Sequence; identical to SEQ ID NO: 21614
  Description of Artificial Sequence: Synthetic coding sequence

SEQ ID NO: 21617 - DNA, 1113 bp, Artificial Sequence
  Description of Artificial Sequence: Synthetic coding sequence
atgaccaccacctacatgctgagcaagaaccccctggaggtgttcgacatctgcagattcaacacctgcaacttcggcaaggccctggagagcagcagatgcgccagacagcccagagaggagagacagcccgaggacctgggcccccccgccgtgccctgggacagctgccccagcggcgaggagggcggccccagaaccatggccgccgtgcacgacctggagatggagagcatgaacctgaacatgggcagagagatgaaggaggagctggaggaggaggagaagatgagagaggacggcggcggcaaggacagagccaagagcaagaaggtgcacagaatcgtgagcaagtggatgctgcccgagaagagcagaggcacctacctggagagagccaactgcttccccccccccgtgttcatcatcagcatcagcctggccgagctggccgtgttcatctactacgccgtgtggaagccccagaagcagtggatcaccctggacaccggcatcctggagagccccttcatctacagccccgagaagagagaggaggcctggagattcatcagctacatgctggtgcacgccggcgtgcagcacatcctgggcaacctgtgcatgcagctggtgctgggcatccccctggagatggtgcacaagggcctgagagtgggcctggtgtacctggccggcgtgatcgccggcagcctggccagcagcatcttcgaccccctgagatacctggtgggcgccagcggcggcgtgtacgccctgatgggcggctacttcatgaacgtgctggtgaacttccaggagatgatccccgccttcggcatcttcagactgctgatcatcatcctgatcatcgtgctggacatgggcttcgccctgtacagaagattcttcgtgcccgaggacggcagccccgtgagcttcgccgcccacatcgccggcggcttcgccggcatgagcatcggctacaccgtgttcagctgcttcgacaaggccctgctgaaggaccccagattctggatcgccatcgccgcctacctggcctgcgtgctgttcgccgtgttcttcaacatcttcctgagccccgccaactag

SEQ ID NO: 21618 - DNA, 1215 bp, Artificial Sequence
  Description of Artificial Sequence: Synthetic coding sequence
atgggcgagcaccccagccccggccccgccgtggccgcctgcgccgaggccgagagaatcgaggagctggagcccgaggccgaggagagactgcccgccgcccccgaggaccactggaaggtgctgttcgaccagttcgaccccggcaacaccggctacatcagcaccggcaagttcagaagcctgctggagagccacagcagcaagctggacccccacaagagagaggtgctgctggccctggccgacagccacgccgacggccagatcggctaccaggacttcgtgagcctgatgagcaacaagagaagcaacagcttcagacaggccatcctgcagggcaacagaagactgagcagcaaggccctgctggaggagaagggcctgagcctgagccagagactgatcagacacgtggcctacgagaccctgcccagagagatcgacagaaagtggtactacgacagctacacctgctgcccccccccctggttcatgatcaccgtgaccctgctggaggtggccttcttcctgtacaacggcgtgagcctgggccagttcgtgctgcaggtgacccaccccagatacctgaagaacagcctggtgtaccacccccagctgagagcccaggtgtggagatacctgacctacatcttcatgcacgccggcatcgagcacctgggcctgaacgtggtgctgcagctgctggtgggcgtgcccctggagatggtgcacggcgccaccagaatcggcctggtgtacgtggccggcgtggtggccggcagcctggccgtgagcgtggccgacatgaccgcccccgtggtgggcagcagcggcggcgtgtacgccctggtgagcgcccacctggccaacatcgtgatgaactggagcggcatgaagtgccagttcaagctgctgagaatggccgtggccctgatctgcatgagcatggagttcggcagagccgtgtggctgagattccaccccagcgcctaccccccctgcccccaccccagcttcgtggcccacctgggcggcgtggccgtgggcatcaccctgggcgtggtggtgctgagaaactacgagcagagactgcaggaccagagcctgtggtggatcttcgtggccatgtacaccgtgttcgtgctgttcgccgtgttctggaacatcttcgcctacaccctgctggacctgaagctgcccccccccccctag

SEQ ID NO: 21619 - DNA, 1287 bp, Artificial Sequence
  Description of Artificial Sequence: Synthetic coding sequence
atgggcgagcaccccagccccggccccgccgtggccgcctgcgccgaggccgagagaatcgaggagctggagcccgaggccgaggagagactgcccgccgcccccgaggaccactggaaggtgctgttcgaccagttcgaccccggcaacaccggctacatcagcaccggcaagttcagaagcctgctggagagccacagcagcaagctggacccccacaagagagaggtgctgctggccctggccgacagccacgccgacggccagatcggctaccaggacttcgtgagcctgatgagcaacaagagaagcaacagcttcagacaggccatcctgcagggcaacagaagactgagcagcaaggccctgctggaggagaagggcctgagcctgagccagagactgatcagacacgtggcctacgagaccctgcccagagagatcgacagaaagtggtactacgacagctacacctgctgcccccccccctggttcatgatcaccgtgaccctgctggaggtggccttcttcctgtacaacggcgtgagcctgggccagttcgtgctgcaggtgacccaccccagatacctgaagaacagcctggtgtaccacccccagctgagagcccaggtgtggagatacctgacctacatcttcatgcacgccggcatcgagcacctgggcctgaacgtggtgctgcagctgctggtgggcgtgcccctggagatggtgcacggcgccaccagaatcggcctggtgtacgtggccggcgtggtggccgagctggtgagacacgaggtgcccgtgcaggccgccgccgacggctgcggcccctacctgtacgagcacggcgtgtgggccggcagagtggcccccctgccccccgtgggcctgagccccgtgcccagccccaagctgtgcggcgccctgggctggagaggcagaggccaccaccccggcagaggcggccccgaggagctgagagccgaggcccccggccccgtgaccgtggtggacttctgcggccacgtgcacagactgagagccgtgagatgcctgctggagcacctgtgcctgcaccccgccggcctgaaggccgccgccagccccctgagagccggcggccccagaagcggcagaggcggcaagagcagcacccacagagagagactgagaggcttcttcagcagccccgcccagctgggcagagccgacaaggacagaagactgtgggccaccgtgatgttcgtgttcagattcggccacaccgtggagaccctgttctag

SEQ ID NO: 21620 - DNA, 921 bp, Artificial Sequence
  Description of Artificial Sequence: Synthetic coding sequence
atgagcaacaagagaagcaacagcttcagacaggccatcctgcagggcaacagaagactgagcagcaaggccctgctggaggagaagggcctgagcctgagccagagactgatcagacacgtggcctacgagaccctgcccagagagatcgacagaaagtggtactacgacagctacacctgctgcccccccccctggttcatgatcaccgtgaccctgctggaggtggccttcttcctgtacaacggcgtgagcctgggccagttcgtgctgcaggtgacccaccccagatacctgaagaacagcctggtgtaccacccccagctgagagcccaggtgtggagatacctgacctacatcttcatgcacgccggcatcgagcacctgggcctgaacgtggtgctgcagctgctggtgggcgtgcccctggagatggtgcacggcgccaccagaatcggcctggtgtacgtggccggcgtggtggccggcagcctggccgtgagcgtggccgacatgaccgcccccgtggtgggcagcagcggcggcgtgtacgccctggtgagcgcccacctggccaacatcgtgatgaactggagcggcatgaagtgccagttcaagctgctgagaatggccgtggccctgatctgcatgagcatggagttcggcagagccgtgtggctgagattccaccccagcgcctaccccccctgcccccaccccagcttcgtggcccacctgggcggcgtggccgtgggcatcaccctgggcgtggtggtgctgagaaactacgagcagagactgcaggaccagagcctgtggtggatcttcgtggccatgtacaccgtgttcgtgctgttcgccgtgttctggaacatcttcgcctacaccctgctggacctgaagctgcccccccccccctag

SEQ ID NO: 21621 - DNA, 1191 bp, Artificial Sequence
  Description of Artificial Sequence: Synthetic coding sequence
atgggcgagcaccccagccccggccccgccgtggccgcctgcgccgaggccgagagaatcgaggagctggagcccgaggccgaggagagactgcccgccgcccccgaggacttcgaccccggcaacaccggctacatcagcaccggcaagttcagaagcctgctggagagccacagcagcaagctggacccccacaagagagaggtgctgctggccctggccgacagccacgccgacggccagatcggctaccaggacttcgtgagcctgatgagcaacaagagaagcaacagcttcagacaggccatcctgcagggcaacagaagactgagcagcaaggccctgctggaggagaagggcctgagcctgagccagagactgatcagacacgtggcctacgagaccctgcccagagagatcgacagaaagtggtactacgacagctacacctgctgcccccccccctggttcatgatcaccgtgaccctgctggaggtggccttcttcctgtacaacggcgtgagcctgggccagttcgtgctgcaggtgacccaccccagatacctgaagaacagcctggtgtaccacccccagctgagagcccaggtgtggagatacctgacctacatcttcatgcacgccggcatcgagcacctgggcctgaacgtggtgctgcagctgctggtgggcgtgcccctggagatggtgcacggcgccaccagaatcggcctggtgtacgtggccggcgtggtggccggcagcctggccgtgagcgtggccgacatgaccgcccccgtggtgggcagcagcggcggcgtgtacgccctggtgagcgcccacctggccaacatcgtgatgaactggagcggcatgaagtgccagttcaagctgctgagaatggccgtggccctgatctgcatgagcatggagttcggcagagccgtgtggctgagattccaccccagcgcctaccccccctgcccccaccccagcttcgtggcccacctgggcggcgtggccgtgggcatcaccctgggcgtggtggtgctgagaaactacgagcagagactgcaggaccagagcctgtggtggatcttcgtggccatgtacaccgtgttcgtgctgttcgccgtgttctggaacatcttcgcctacaccctgctggacctgaagctgcccccccccccctag

SEQ ID NO: 21622 - DNA, 927 bp, Artificial Sequence
  Description of Artificial Sequence: Synthetic coding sequence
atgtgcctgctgctgagcagcgccgtgttcggcgtgaagtacaacctgctggcccacaccaccctgaccctggagagcgccgaggacagcttcaagacccacaacctgagcatcaacggcaacgaggagagcagcttctggctgcccctgtacggcaacatgtgctgcagactggtggcccagcccgcctgcatggccgaggacgccttcgccggcttcctgaaccagcagcagatggtggagggcctgatcagctggagaagactgtactgcgtgctgagaggcggcaagctgtactgcttctacagccccgaggagatcgaggccaaggtggagcccgccctggtggtgcccatcaacaagagcctggtgctgttcgaggacagcctggagggcatccagctggccatcagccagagcttcaaggagaccagaatcagagccatggacaaggacgccaagaagagaatccacaacttcagcgtgatcaaccccgtgcccggccaggccatcacccagatcttcgccgtggacaacagagaggacctgcagaagtggatggaggccttctggcagcacttcttcgacctgagccagtggaagcactgctgcgaggagctgatgaagatcgagatcatgagccccagaaagccccccctgttcctgaccaaggaggccaccagcgtgtaccacgacatgagcatcgacagccccatgaagctggagagcctgaccgacatcatccagaagaagatcgaggagaccaacggccagttcctgatcggccagcacgaggagagcctgccccccccctgggccaccctgttcgacggcaaccaccagatggtgatccagaagaagaacaacagcaaccagctgcacaacctgcagaagctgcccgccaccagcaagttcctgttcacctag

SEQ ID NO: 21623 - DNA, 1830 bp, Artificial Sequence
  Description of Artificial Sequence: Synthetic coding sequence
atggagggccccagcctgagaggccccgccctgagactggccggcctgcccacccagcaggactgcaacatccaggagaagatcgacctggagatcagaatgagagagggcatctggaagctgctgagcctgagcacccagaaggaccaggtgctgcacgccgtgaagaacctgatggtgtgcaacgccagactgatggcctacaccagcgagctgcagaagctggaggagcagatcgccaaccagaccggcagatgcgacgtgaagttcgagagcaaggagagaaccgcctgcaagggcaagatcgccatcagcgacatcagaatccccctgatgtggaaggacagcgaccacttcagcaacaaggagagaagcagaagatacgccatcttctgcctgttcaagatgggcgccaacgtgttcgacaccgacgtggtgaacgtggacaagaccatcaccgacatctgcttcgagaacgtgaccatcttcaacgaggccggccccgacttccagatcaaggtggaggtgtacagctgctgcaccgaggagagcagcatcaccaacacccccaagaagctggccaagaagctgaagaccagcatcagcaaggccaccggcaagaagatcagcagcgtgctgcaggaggaggacgacgagatgtgcctgctgctgagcagcgccgtgttcggcgtgaagtacaacctgctggcccacaccaccctgaccctggagagcgccgaggacagcttcaagacccacaacctgagcatcaacggcaacgaggagagcagcttctggctgcccctgtacggcaacatgtgctgcagactggtggcccagcccgcctgcatggccgaggacgccttcgccggcttcctgaaccagcagcagatggtggagggcctgatcagctggagaagactgtactgcgtgctgagaggcggcaagctgtactgcttctacagccccgaggagatcgaggccaaggtggagcccgccctggtggtgcccatcaacaaggagaccagaatcagagccatggacaaggacgccaagaagagaatccacaacttcagcgtgatcaaccccgtgcccggccaggccatcacccagatcttcgccgtggacaacagagaggacctgcagaagtggatggaggccttctggcagcacttcttcgacctgagccagtggaagcactgctgcgaggagctgatgaagatcgagatcatgagccccagaaagccccccctgttcctgaccaaggaggccaccagcgtgtaccacgacatgagcatcgacagccccatgaagctggagagcctgaccgacatcatccagaagaagatcgaggagaccaacggccagttcctgatcggccagcacgaggagagcctgccccccccctgggccaccctgttcgacggcaaccaccagatggtgatccagaagaaggtgctgtaccccgccagcgagcccctgcacgacgagaagggcaagaagagacaggcccccctgccccccagcgacaagctgcccttcagcctgaagagccagagcaacaccgaccagctggtgaaggacaactggggcaagaccagcgtgagccagaccagcagcctggacaccaagctgagcaccctgatgcaccacctgcagaagcccatggccgcccccagaaagctgctgcccgccagaagaaacagactgagcgacggcgagcacaccgacaccaagaccaacttcgaggccaagcccgtgcccgcccccagacagaagagcatcaaggacatcctggaccccagaagctggctgcaggcccaggtgtag

SEQ ID NO: 21624 - DNA, 492 bp, Artificial Sequence
  Description of Artificial Sequence: Synthetic coding sequence
atggagggccccagcctgagaggccccgccctgagactggccggcctgcccacccagcaggactgcaacatccaggagaagatcgacctggagatcagaatgagagagggcatctggaagctgctgagcctgagcacccagaaggaccaggtgctgcacgccgtgaagaacctgatggtgtgcaacgccagactgatggcctacaccagcgagctgcagaagctggaggagcagatcgccaaccagaccggcagatgcgacgtgaagttcgagagcaaggagagaaccgcctgcaagggcaagatcgccatcagcgacatcagaatccccctgatgtggaaggacagcgaccacttcagcaacaaggagagaagcagaagatacgccatcttctgcctgttcaagatgggcgccaacgtgttcgacaccgacgtggtgaacgtggacaagaccatcaccgacatctgcttcgagaacgtgaccatcctgtag

SEQ ID NO: 21625 - DNA, 1584 bp, Artificial Sequence
  Description of Artificial Sequence: Synthetic coding sequence
atggagggccccagcctgagaggccccgccctgagactggccggcctgcccacccagcaggactgcaacatccaggagaagatcgacctggagatcagaatgagagagggcatctggaagctgctgagcctgagcacccagaaggaccaggtgctgcacgccgtgaagaacctgatggtgtgcaacgccagactgatggcctacaccagcgagctgcagaagctggaggagcagatcgccaaccagaccggcagatgcgacgtgaagttcgagagcaaggagagaaccgcctgcaagggcaagatcgccatcagcgacatcagaatccccctgatgtggaaggacagcgaccacttcagcaacaaggagagaagcagaagatacgccatcttctgcctgttcaagatgggcgccaacgtgttcgacaccgacgtggtgaacgtggacaagaccatcaccgacatctgcttcgagaacgtgaccatcttcaacgaggccggccccgacttccagatcaaggtggaggtgtacagctgctgcaccgaggagagcagcatcaccaacacccccaagaagctggccaagaagctgaagaccagcatcagcaaggccaccggcaagaagatcagcagcgtgctgcaggaggaggacgacgagatgtgcctgctgctgagcagcgccgtgttcggcgtgaagtacaacctgctggcccacaccaccctgaccctggagagcgccgaggacagcttcaagacccacaacctgagcatcaacggcaacgaggagagcagcttctggctgcccctgtacggcaacatgtgctgcagactggtggcccagcccgcctgcatggccgaggacgccttcgccggcttcctgaaccagcagcagatggtggagggcctgatcagctggagaagactgtactgcgtgctgagaggcggcaagctgtactgcttctacagccccgaggagatcgaggccaaggtggagcccgccctggtggtgcccatcaacaagagcctggtgctgttcgaggacagcctggagggcatccagctggccatcagccagagcttcaaggagaccagaatcagagccatggacaaggacgccaagaagagaatccacaacttcagcgtgatcaaccccgtgcccggccaggccatcacccagatcttcgccgtggacaacagagaggacctgcagaagtggatggaggccttctggcagcacttcttcgacctgagccagtggaagcactgctgcgaggagctgatgaagatcgagatcatgagccccagaaagccccccctgttcctgaccaaggaggccaccagcgtgtaccacgacatgagcatcgacagccccatgaagctggagagcctgaccgacatcatccagaagaagatcgaggagaccaacggccagttcctgatcggccagcacgaggagagcctgccccccccctgggccaccctgttcgacggcaaccaccagatggtgatccagaagaagaacaacagcaaccagctgcacaacctgcagaagctgcccgccaccagcaagttcctgttcacctag

SEQ ID NO: 21626 - DNA, 297 bp, Artificial Sequence
  Description of Artificial Sequence: Synthetic coding sequence
atggccagcctgctgtgctgcggccccaagctggccgcctgcggcatcgtgctgagcgcctggggcgtgatcatgctgatcatgctgggcatcttcttcaacgtgcacagcgccgtgctgatcgaggacgtgcccttcaccgagaaggacttcgagaacggcccccagaacatctacaacctgtacgagcaggtgagctacaactgcttcatcgccgccggcctgtacctgctgctgggcggcttcagcttctgccaggtgagactgaacaagagaaaggagtacatggtgagatag

SEQ ID NO: 21627 - DNA, 414 bp, Artificial Sequence
  Description of Artificial Sequence: Synthetic coding sequence
atgggctggctgagacccggccccagacccctgtgcccccccgccagagccagctgggccttcagccacagattccccagccccctggcccccagaagaagccccacccccttcttcatggccagcctgctgtgctgcggccccaagctggccgcctgcggcatcgtgctgagcgcctggggcgtgatcatgctgatcatgctgggcatcttcttcaacgtgcacagcgccgtgctgatcgaggacgtgcccttcaccgagaaggacttcgagaacggcccccagaacatctacaacctgtacgagcaggtgagctacaactgcttcatcgccgccggcctgtacctgctgctgggcggcttcagcttctgccaggtgagactgaacaagagaaaggagtacatggtgagatag

SEQ ID NO: 21628 - DNA, 471 bp, Artificial Sequence
  Description of Artificial Sequence: Synthetic coding sequence
atgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcgccaagaagagaaagaagaagagctacaccacccccaagaagaacaagcacaagagaaagaaggtgaagctggccgtgctgaagtactacaaggtggacgagaacggcaagatcagcagactgagaagagagtgccccagcgacgagtgcggcgccggcgtgttcatggccagccacttcgacagacactactgcggcaagtgctgcctgacctactgcttcaacaagcccgaggacaagtag

SEQ ID NO: 21629 - DNA, 471 bp, Artificial Sequence; identical to SEQ ID NO: 21628
  Description of Artificial Sequence: Synthetic coding sequence

SEQ ID NO: 21630 - DNA, 471 bp, Artificial Sequence; identical to SEQ ID NO: 21628
  Description of Artificial Sequence: Synthetic coding sequence

SEQ ID NO: 21631 - DNA, 321 bp, Artificial Sequence
  Description of Artificial Sequence: Synthetic coding sequence
atgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcgccaagaagagaaagaagaagagctacaccacccccaagaagaacaagcacaagagaaagaaggtgaagctggccgtgctgaagtactactag

SEQ ID NO: 21632 - DNA, 1428 bp, Artificial Sequence
  Description of Artificial Sequence: Synthetic coding sequence
atgcccggcatcagcgccagaggcctgagccacgagggcagaaagcagctggccgtgaacctgaccagagtgctggccctgtacagaagcatcctggacgcctacatcatcgagttcttcaccgacaacctgtgggacaccctgccctgcagctggcaggaggccctggacggcctgaagcccccccagctggccaccatgctgctgggcatgcccggcgagggcgaggtggtgagatacagaagcgtgtggcccctgaccctgctggccctgaagagcaccgcctgcgccctggccttcaccagaatgcccggcttccagacccccagcgagttcctggagaaccccagccagagcagcagactgaccgcccccttcagaaagcacgtgagacccaagaagcagcacgagatcagaagactgggcgagctggtgaagaagctgagcgacttcaccggctgcacccaggtggtggacgtgggcagcggccagggccacctgagcagattcatggccctgggcctgggcctgatggtgaagagcatcgagggcgaccagagactggtggagagagcccagagactggaccaggagctgctgcaggccctggagaaggaggagaagagaaacccccaggtggtgcagaccagccccagacacagcccccaccacgtggtgagatgggtggaccccaccgccctgtgcgaggagctgctgctgcccctggagaacccctgccagggcagagccagactgctgctgaccggcctgcacgcctgcggcgacctgagcgtggccctgctgagacacttcagctgctgccccgaggtggtggccctggccagcgtgggctgctgctacatgaagctgagcgaccccggcggctaccccctgagccagtgggtggccggcctgcccggctacgagctgccctacagactgagagagggcgcctgccacgccctggaggagtacgccgagagactgcagaaggccggccccggcctgagaacccactgctacagagccgccctggagaccgtgatcagaagagccagacccgagctgagaagacccggcgtgcagggcatccccagagtgcacgagctgaagatcgaggagtacgtgcagagaggcctgcagagagtgggcctggacccccagctgcccctgaacctggccgccctgcaggcccacgtggcccaggagaacagagtggtggccttcttcagcctggccctgctgctggcccccctggtggagaccctgatcctgctggacagactgctgtacctgcaggagcagggcttccacgccgagctgctgcccatcttcagccccgagctgagccccagaaacctggtgctggtggccaccaagatgcccctgggccaggccctgagcgtgctggagaccgaggacagctag

SEQ ID NO: 21633 - DNA, 834 bp, Artificial Sequence
  Description of Artificial Sequence: Synthetic coding sequence
atgcccggcatcagcgccagaggcctgagccacgagggcagaaagcagctggccgtgaacctgaccagagtgctggccctgtacagaagcatcctggacgcctacatcatcgagttcttcaccgacaacctgtgggacaccctgccctgcagctggcaggaggccctggacggcctgaagcccccccagctggccaccatgctgctgggcatgcccggcgagggcgaggtggtgagatacagaagcgtgtggcccctgaccctgctggccctgaagagcaccgcctgcgccctggccttcaccagaatgcccggcttccagacccccagcgagttcctggagaaccccagccagagcagcagactgaccgcccccttcagaaagcacgtgagacccaagaagcagcacgagatcagaagactgggcgagctggtgaagaagctgagcgacttcaccggctgcacccaggtggtggacgtgggcagcggccagggccacctgagcagattcatggccctgggcctgggcctgatggtgaagagcatcgagggcgaccagagactggtggagagagcccagagactggaccaggagctgctgcaggccctggagaaggaggagaagagaaacccccagatctgcgccgccggcgccaccgccagcggcgccagaagccccgccgccaccgagagcggctgccccagcggccccagaggccccggcgagccctgcggcggcctgctgcagcccggcagcaccgcctgccccaccggcggcgacgcctacagcaccggccccgccgccgtgcccagcggcaccggcttcccctgctag

SEQ ID NO: 21634 - DNA, 3594 bp, Artificial Sequence
  Description of Artificial Sequence: Synthetic coding sequence
atgggcagaagcggcaagctgcccagcggcgtgagcgccaagctgaagagatggaagaagggccacagcagcgacagcaaccccgccatctgcagacacagacaggccgccagaagcagattcttcagcagacccagcggcagaagcgacctgaccgtggacgccgtgaagctgcacaacgagctgcagagcggcagcctgagactgggcaagagcgaggcccccgagacccccatggaggaggaggccgagctggtgctgaccgagaagagcagcggcaccttcctgagcggcctgagcgactgcaccaacgtgaccttcagcaaggtgcagagattctgggagagcaacagcgccgcccacaaggagatctgcgccgtgctggccgccgtgaccgaggtgatcagaagccagggcggcaaggagaccgagaccgagtacttcgccgccctgatcagaaaggccgcccagcacggcgtgtgcagcgtgctgaagggcagcgagttcatgttcgagaaggcccccgcccaccaccccgccgccatcagcaccgccaagttctgcatccaggagatcgagaagagcggcggcagcaaggaggccaccaccaccctgcacatgctgaccctgctgaaggacctgctgccctgcttccccgagggcctggtgaagagctgcagcgagaccctgctgagagtgatgaccctgagccacgtgctggtgaccgcctgcgccatgcaggccttccacagcctgttccacgccagacccggcctgagcaccctgagcgccgagctgaacgcccagatcatcaccgccctgtacgactacgtgcccagcgagaacgacctgcagcccctgctggcctggctgaaggtgatggagaaggcccacatcaacctggtgagactgcagtgggacctgggcctgggccacctgcccagattcttcggcaccgccgtgacctgcctgctgagcccccacagccaggtgctgaccgccgccacccagagcctgaaggagatcctgaaggagtgcgtggccccccacatggccgacatcggcagcgtgaccagcagcgccagcggccccgcccagagcgtggccaagatgttcagagccgtggaggagggcctgacctacaagttccacgccgcctggagcagcgtgctgcagctgctgtgcgtgttcttcgaggcctgcggcagacaggcccaccccgtgatgagaaagtgcctgcagagcctgtgcgacctgagactgagcccccacttcccccacaccgccgccctggaccaggccgtgggcgccgccgtgaccagcatgggccccgaggtggtgctgcaggccgtgcccctggagatcgacggcagcgaggagaccctggacttccccagaagctggctgctgcccgtgatcagagaccacgtgcaggagaccagactgggcttcttcaccacctacttcctgcccctggccaacaccctgaagagcaaggccatggacctggcccaggccggcagcaccgtggagagcaagatctacgacaccctgcagtggcagatgtggaccctgctgcccggcttctgcaccagacccaccgacgtggccatcagcttcaagggcctggccagaaccctgggcatggccatcagcgagagacccgacctgagagtgaccgtgtgccaggccctgagaaccctgatcaccaagggctgccaggccgaggccgacagagccgaggtgagcagattcgccaagaacttcctgcccatcctgttcaacctgtacggccagcccgtggccgccggcgacacccccgcccccagaagagccgtgctggagaccatcagaacctacctgaccatcaccgacacccagctggtgaacagcctgctggagaaggccagcgagaaggtgctggaccccgccagcagcgacttcaccagactgagcgtgctggacctggtggtggccctggccccctgcgccgacgaggccgccatcagcaagctgtacagcaccatcagaccctacctggagagcaaggcccacggcgtgcagaagaaggcctacagagtgctggaggaggtgtgcgccagcccccagggccccggcgccctgttcgtgcagagccacctggaggacctgaagaagaccctgctggacagcctgagaagcaccagcagccccgccaagagacccagactgaagtgcctgctgcacatcgtgagaaagctgagcgccgagcacaaggagttcatcaccgccctgatccccgaggtgatcctgtgcaccaaggaggtgagcgtgggcgccagaaagaacgccttcgccctgctggtggagatgggccacgccttcctgagattcggcagcaaccaggaggaggccctgcagtgctacctggtgctgatctaccccggcctggtgggcgccgtgaccatggtgagctgcagcatcctggccctgacccacctgctgttcgagttcaagggcctgatgggcaccagcaccgtggagcagctgctggagaacgtgtgcctgctgctggccagcagaaccagagacgtggtgaagagcgccctgggcttcatcaaggtggccgtgaccgtgatggacgtggcccacctggccaagcacgtgcagctggtgatggaggccatcggcaagctgagcgacgacatgagaagacacttcagaatgaagctgagaaacctgttcaccaagttcatcagaaagttcggcttcgagctggtgaagagactgctgcccgaggagtaccacagagtgctggtgaacatcagaaaggccgaggccagagccaagagacacagagccctgagccaggccgccgtggaggaggaggaggaggaggaggaggaggaggagcccgcccagggcaagggcgacagcatcgaggagatcctggccgacagcgaggacgaggaggacaacgaggaggaggagagaagcagaggcaaggagcagagaaagctggccagacagagaagcagagcctggctgaaggagggcggcggcgacgagcccctgaacttcctggaccccaaggtggcccagagagtgctggccacccagcccggccccggcagaggcagaaagaaggaccacggcttcaaggtgagcgccgacggcagactgatcatcagagaggaggccgacggcaacaagatggaggaggaggagggcgccaagggcgaggacgaggagatggccgaccccatggaggacgtgatcatcagaaacaagaagcaccagaagctgaagcaccagaaggaggccgaggaggaggagctggagatccccccccagtaccaggccggcggcagcggcatccacagacccgtggccaagaaggccatgcccggcgccgagtacaaggccaagaaggccaagggcgacgtgaagaagaagggcagacccgacccctacgcctacatccccctgaacagaagcaagctgaacagaagaaagaagatgaagctgcagggccagttcaagggcctggtgaaggccgccagaagaggcagccaggtgggccacaagaacagaagaaaggacagaagaccctag

SEQ ID NO: 21635 - DNA, 3894 bp, Artificial Sequence
  Description of Artificial Sequence: Synthetic coding sequence
atgggcagaagcggcaagctgcccagcggcgtgagcgccaagctgaagagatggaagaagggccacagcagcgacagcaaccccgccatctgcagacacagacaggccgccagaagcagattcttcagcagacccagcggcagaagcgacctgaccgtggacgccgtgaagctgcacaacgagctgcagagcggcagcctgagactgggcaagagcgaggcccccgagacccccatggaggaggaggccgagctggtgctgaccgagaagagcagcggcaccttcctgagcggcctgagcgactgcaccaacgtgaccttcagcaaggtgcagagattctgggagagcaacagcgccgcccacaaggagatctgcgccgtgctggccgccgtgaccgaggtgatcagaagccagggcggcaaggagaccgagaccgagtacttcgccgccctgatgaccaccatggaggccgtggagagccccgagagcctggccgccgtggcctacctgctgaacctggtgctgaagagagtgcccagccccgtgctgatcaagaagttcagcgacaccagcaaggccttcatggacatcatgagcgcccaggccagcagcggcagcaccagcgtgctgagatgggtgctgagctgcctggccaccctgctgagaaagcaggacctggaggcctggggctaccccgtgaccctgcaggtgtaccacggcctgctgagcttcaccgtgcaccccaagcccaagatcagaaaggccgcccagcacggcgtgtgcagcgtgctgaagggcagcgagttcatgttcgagaaggcccccgcccaccaccccgccgccatcagcaccgccaagttctgcatccaggagatcgagaagagcggcggcagcaaggaggccaccaccaccctgcacatgctgaccctgctgaaggacctgctgccctgcttccccgagggcctggtgaagagctgcagcgagaccctgctgagagtgatgaccctgagccacgtgctggtgaccgcctgcgccatgcaggccttccacagcctgttccacgccagacccggcctgagcaccctgagcgccgagctgaacgcccagatcatcaccgccctgtacgactacgtgcccagcgagaacgacctgcagcccctgctggcctggctgaaggtgatggagaaggcccacatcaacctggtgagactgcagtgggacctgggcctgggccacctgcccagattcttcggcaccgccgtgacctgcctgctgagcccccacagccaggtgctgaccgccgccacccagagcctgaaggagatcctgaaggagtgcgtggccccccacatggccgacatcggcagcgtgaccagcagcgccagcggccccgcccagagcgtggccaagatgttcagagccgtggaggagggcctgacctacaagttccacgccgcctggagcagcgtgctgcagctgctgtgcgtgttcttcgaggcctgcggcagacaggcccaccccgtgatgagaaagtgcctgcagagcctgtgcgacctgagactgagcccccacttcccccacaccgccgccctggaccaggccgtgggcgccgccgtgaccagcatgggccccgaggtggtgctgcaggccgtgcccctggagatcgacggcagcgaggagaccctggacttccccagaagctggctgctgcccgtgatcagagaccacgtgcaggagaccagactgggcttcttcaccacctacttcctgcccctggccaacaccctgaagagcaaggccatggacctggcccaggccggcagcaccgtggagagcaagatctacgacaccctgcagtggcagatgtggaccctgctgcccggcttctgcaccagacccaccgacgtggccatcagcttcaagggcctggccagaaccctgggcatggccatcagcgagagacccgacctgagagtgaccgtgtgccaggccctgagaaccctgatcaccaagggctgccaggccgaggccgacagagccgaggtgagcagattcgccaagaacttcctgcccatcctgttcaacctgtacggccagcccgtggccgccggcgacacccccgcccccagaagagccgtgctggagaccatcagaacctacctgaccatcaccgacacccagctggtgaacagcctgctggagaaggccagcgagaaggtgctggaccccgccagcagcgacttcaccagactgagcgtgctggacctggtggtggccctggccccctgcgccgacgaggccgccatcagcaagctgtacagcaccatcagaccctacctggagagcaaggcccacggcgtgcagaagaaggcctacagagtgctggaggaggtgtgcgccagcccccagggccccggcgccctgttcgtgcagagccacctggaggacctgaagaagaccctgctggacagcctgagaagcaccagcagccccgccaagagacccagactgaagtgcctgctgcacatcgtgagaaagctgagcgccgagcacaaggagttcatcaccgccctgatccccgaggtgatcctgtgcaccaaggaggtgagcgtgggcgccagaaagaacgccttcgccctgctggtggagatgggccacgccttcctgagattcggcagcaaccaggaggaggccctgcagtgctacctggtgctgatctaccccggcctggtgggcgccgtgaccatggtgagctgcagcatcctggccctgacccacctgctgttcgagttcaagggcctgatgggcaccagcaccgtggagcagctgctggagaacgtgtgcctgctgctggccagcagaaccagagacgtggtgaagagcgccctgggcttcatcaaggtggccgtgaccgtgatggacgtggcccacctggccaagcacgtgcagctggtgatggaggccatcggcaagctgagcgacgacatgagaagacacttcagaatgaagctgagaaacctgttcaccaagttcatcagaaagttcggcttcgagctggtgaagagactgctgcccgaggagtaccacagagtgctggtgaacatcagaaaggccgaggccagagccaagagacacagagccctgagccaggccgccgtggaggaggaggaggaggaggaggaggaggaggagcccgcccagggcaagggcgacagcatcgaggagatcctggccgacagcgaggacgaggaggacaacgaggaggaggagagaagcagaggcaaggagcagagaaagctggccagacagagaagcagagcctggctgaaggagggcggcggcgacgagcccctgaacttcctggaccccaaggtggcccagagagtgctggccacccagcccggccccggcagaggcagaaagaaggaccacggcttcaaggtgagcgccgacggcagactgatcatcagagaggaggccgacggcaacaagatggaggaggaggagggcgccaagggcgaggacgaggagatggccgaccccatggaggacgtgatcatcagaaacaagaagcaccagaagctgaagcaccagaaggaggccgaggaggaggagctggagatccccccccagtaccaggccggcggcagcggcatccacagacccgtggccaagaaggccatgcccggcgccgagtacaaggccaagaaggccaagggcgacgtgaagaagaagggcagacccgacccctacgcctacatccccctgaacagaagcaagctgaacagaagaaagaagatgaagctgcagggccagttcaagggcctggtgaaggccgccagaagaggcagccaggtgggccacaagaacagaagaaaggacagaagaccctag

SEQ ID NO: 21636 - DNA, 3711 bp, Artificial Sequence
  Description of Artificial Sequence: Synthetic coding sequence
atgggcagaagcggcaagctgcccagcggcgtgagcgccaagctgaagagatggaagaagggccacagcagcgacagcaaccccgccatctgcagacacagacaggccgccagaagcagattcttcagcagacccagcggcagaagcgacctgaccgtggacgccgtgaagctgcacaacgagctgcagagcggcagcctgagactgggcaagagcgaggcccccgagacccccatggaggaggaggccgagctggtgctgaccgagaagagcagcggcaccttcctgagcggcctgagcgactgcaccaacgtgaccttcagcaaggtgcagagattctgggagagcaacagcgccgcccacaaggagatctgcgccgtgctggccgccgtgaccgaggtgatcagaagccagggcggcaaggagaccgagaccgagtacttcgccgccctggtgctgagctgcctggccaccctgctgagaaagcaggacctggaggcctggggctaccccgtgaccctgcaggtgtaccacggcctgctgagcttcaccgtgcaccccaagcccaagatcagaaaggccgcccagcacggcgtgtgcagcgtgctgaagggcagcgagttcatgttcgagaaggcccccgcccaccaccccgccgccatcagcaccgccaagttctgcatccaggagatcgagaagagcggcggcagcaaggaggccaccaccaccctgcacatgctgaccctgctgaaggacctgctgccctgcttccccgagggcctggtgaagagctgcagcgagaccctgctgagagtgatgaccctgagccacgtgctggtgaccgcctgcgccatgcaggccttccacagcctgttccacgccagacccggcctgagcaccctgagcgccgagctgaacgcccagatcatcaccgccctgtacgactacgtgcccagcgagaacgacctgcagcccctgctggcctggctgaaggtgatggagaaggcccacatcaacctggtgagactgcagtgggacctgggcctgggccacctgcccagattcttcggcaccgccgtgacctgcctgctgagcccccacagccaggtgctgaccgccgccacccagagcctgaaggagatcctgaaggagtgcgtggccccccacatggccgacatcggcagcgtgaccagcagcgccagcggccccgcccagagcgtggccaagatgttcagagccgtggaggagggcctgacctacaagttccacgccgcctggagcagcgtgctgcagctgctgtgcgtgttcttcgaggcctgcggcagacaggcccaccccgtgatgagaaagtgcctgcagagcctgtgcgacctgagactgagcccccacttcccccacaccgccgccctggaccaggccgtgggcgccgccgtgaccagcatgggccccgaggtggtgctgcaggccgtgcccctggagatcgacggcagcgaggagaccctggacttccccagaagctggctgctgcccgtgatcagagaccacgtgcaggagaccagactgggcttcttcaccacctacttcctgcccctggccaacaccctgaagagcaaggccatggacctggcccaggccggcagcaccgtggagagcaagatctacgacaccctgcagtggcagatgtggaccctgctgcccggcttctgcaccagacccaccgacgtggccatcagcttcaagggcctggccagaaccctgggcatggccatcagcgagagacccgacctgagagtgaccgtgtgccaggccctgagaaccctgatcaccaagggctgccaggccgaggccgacagagccgaggtgagcagattcgccaagaacttcctgcccatcctgttcaacctgtacggccagcccgtggccgccggcgacacccccgcccccagaagagccgtgctggagaccatcagaacctacctgaccatcaccgacacccagctggtgaacagcctgctggagaaggccagcgagaaggtgctggaccccgccagcagcgacttcaccagactgagcgtgctggacctggtggtggccctggccccctgcgccgacgaggccgccatcagcaagctgtacagcaccatcagaccctacctggagagcaaggcccacggcgtgcagaagaaggcctacagagtgctggaggaggtgtgcgccagcccccagggccccggcgccctgttcgtgcagagccacctggaggacctgaagaagaccctgctggacagcctgagaagcaccagcagccccgccaagagacccagactgaagtgcctgctgcacatcgtgagaaagctgagcgccgagcacaaggagttcatcaccgccctgatccccgaggtgatcctgtgcaccaaggaggtgagcgtgggcgccagaaagaacgccttcgccctgctggtggagatgggccacgccttcctgagattcggcagcaaccaggaggaggccctgcagtgctacctggtgctgatctaccccggcctggtgggcgccgtgaccatggtgagctgcagcatcctggccctgacccacctgctgttcgagttcaagggcctgatgggcaccagcaccgtggagcagctgctggagaacgtgtgcctgctgctggccagcagaaccagagacgtggtgaagagcgccctgggcttcatcaaggtggccgtgaccgtgatggacgtggcccacctggccaagcacgtgcagctggtgatggaggccatcggcaagctgagcgacgacatgagaagacacttcagaatgaagctgagaaacctgttcaccaagttcatcagaaagttcggcttcgagctggtgaagagactgctgcccgaggagtaccacagagtgctggtgaacatcagaaaggccgaggccagagccaagagacacagagccctgagccaggccgccgtggaggaggaggaggaggaggaggaggaggaggagcccgcccagggcaagggcgacagcatcgaggagatcctggccgacagcgaggacgaggaggacaacgaggaggaggagagaagcagaggcaaggagcagagaaagctggccagacagagaagcagagcctggctgaaggagggcggcggcgacgagcccctgaacttcctggaccccaaggtggcccagagagtgctggccacccagcccggccccggcagaggcagaaagaaggaccacggcttcaaggtgagcgccgacggcagactgatcatcagagaggaggccgacggcaacaagatggaggaggaggagggcgccaagggcgaggacgaggagatggccgaccccatggaggacgtgatcatcagaaacaagaagcaccagaagctgaagcaccagaaggaggccgaggaggaggagctggagatccccccccagtaccaggccggcggcagcggcatccacagacccgtggccaagaaggccatgcccggcgccgagtacaaggccaagaaggccaagggcgacgtgaagaagaagggcagacccgacccctacgcctacatccccctgaacagaagcaagctgaacagaagaaagaagatgaagctgcagggccagttcaagggcctggtgaaggccgccagaagaggcagccaggtgggccacaagaacagaagaaaggacagaagaccctag

SEQ ID NO: 21637 - DNA, 3048 bp, Artificial Sequence
  Description of Artificial Sequence: Synthetic coding sequence
atggacatcatgagcgcccaggccagcagcggcagcaccagcgtgctgagatgggtgctgagctgcctggccaccctgctgagaaagcaggacctggaggcctggggctaccccgtgaccctgcaggtgtaccacggcctgctgagcttcaccgtgcaccccaagcccaagctggtgaccgcctgcgccatgcaggccttccacagcctgttccacgccagacccggcctgagcaccctgagcgccgagctgaacgcccagatcatcaccgccctgtacgactacgtgcccagcgagaacgacctgcagcccctgctggcctggctgaaggtgatggagaaggcccacatcaacctggtgagactgcagtgggacctgggcctgggccacctgcccagattcttcggcaccgccgtgacctgcctgctgagcccccacagccaggtgctgaccgccgccacccagagcctgaaggagatcctgaaggagtgcgtggccccccacatggccgacatcggcagcgtgaccagcagcgccagcggccccgcccagagcgtggccaagatgttcagagccgtggaggagggcctgacctacaagttccacgccgcctggagcagcgtgctgcagctgctgtgcgtgttcttcgaggcctgcggcagacaggcccaccccgtgatgagaaagtgcctgcagagcctgtgcgacctgagactgagcccccacttcccccacaccgccgccctggaccaggccgtgggcgccgccgtgaccagcatgggccccgaggtggtgctgcaggccgtgcccctggagatcgacggcagcgaggagaccctggacttccccagaagctggctgctgcccgtgatcagagaccacgtgcaggagaccagactgggcttcttcaccacctacttcctgcccctggccaacaccctgaagagcaaggccatggacctggcccaggccggcagcaccgtggagagcaagatctacgacaccctgcagtggcagatgtggaccctgctgcccggcttctgcaccagacccaccgacgtggccatcagcttcaagggcctggccagaaccctgggcatggccatcagcgagagacccgacctgagagtgaccgtgtgccaggccctgagaaccctgatcaccaagggctgccaggccgaggccgacagagccgaggtgagcagattcgccaagaacttcctgcccatcctgttcaacctgtacggccagcccgtggccgccggcgacacccccgcccccagaagagccgtgctggagaccatcagaacctacctgaccatcaccgacacccagctggtgaacagcctgctggagaaggccagcgagaaggtgctggaccccgccagcagcgacttcaccagactgagcgtgctggacctggtggtggccctggccccctgcgccgacgaggccgccatcagcaagctgtacagcaccatcagaccctacctggagagcaaggcccacggcgtgcagaagaaggcctacagagtgctggaggaggtgtgcgccagcccccagggccccggcgccctgttcgtgcagagccacctggaggacctgaagaagaccctgctggacagcctgagaagcaccagcagccccgccaagagacccagactgaagtgcctgctgcacatcgtgagaaagctgagcgccgagcacaaggagttcatcaccgccctgatccccgaggtgatcctgtgcaccaaggaggtgagcgtgggcgccagaaagaacgccttcgccctgctggtggagatgggccacgccttcctgagattcggcagcaaccaggaggaggccctgcagtgctacctggtgctgatctaccccggcctggtgggcgccgtgaccatggtgagctgcagcatcctggccctgacccacctgctgttcgagttcaagggcctgatgggcaccagcaccgtggagcagctgctggagaacgtgtgcctgctgctggccagcagaaccagagacgtggtgaagagcgccctgggcttcatcaaggtggccgtgaccgtgatggacgtggcccacctggccaagcacgtgcagctggtgatggaggccatcggcaagctgagcgacgacatgagaagacacttcagaatgaagctgagaaacctgttcaccaagttcatcagaaagttcggcttcgagctggtgaagagactgctgcccgaggagtaccacagagtgctggtgaacatcagaaaggccgaggccagagccaagagacacagagccctgagccaggccgccgtggaggaggaggaggaggaggaggaggaggaggagcccgcccagggcaagggcgacagcatcgaggagatcctggccgacagcgaggacgaggaggacaacgaggaggaggagagaagcagaggcaaggagcagagaaagctggccagacagagaagcagagcctggctgaaggagggcggcggcgacgagcccctgaacttcctggaccccaaggtggcccagagagtgctggccacccagcccggccccggcagaggcagaaagaaggaccacggcttcaaggtgagcgccgacggcagactgatcatcagagaggaggccgacggcaacaagatggaggaggaggagggcgccaagggcgaggacgaggagatggccgaccccatggaggacgtgatcatcagaaacaagaagcaccagaagctgaagcaccagaaggaggccgaggaggaggagctggagatccccccccagtaccaggccggcggcagcggcatccacagacccgtggccaagaaggccatgcccggcgccgagtacaaggccaagaaggccaagggcgacgtgaagaagaagggcagacccgacccctacgcctacatccccctgaacagaagcaagctgaacagaagaaagaagatgaagctgcagggccagttcaagggcctggtgaaggccgccagaagaggcagccaggtgggccacaagaacagaagaaaggacagaagaccctag

SEQ ID NO: 21638 - DNA, 849 bp, Artificial Sequence
  Description of Artificial Sequence: Synthetic coding sequence
atggccgccgccgcccccgacagcagagtgagcgaggaggagaacctgaagaagacccccaagaagaagatgaagatggtgaccggcgccgtggccagcgtgctggaggacgaggccaccgacaccagcgacagcgagggcagctgcggcagcgagaaggaccacttctacagcgacgacgacgccatcgaggccgacagcgagggcgacgccgagccctgcgacaaggagaacgagaacgacggcgagagcagcgtgggcaccaacatgggctgggccgacgccatggccaaggtgctgaacaagaagacccccgagagcaagcccaccatcctggtgaagaacaagaagctggagaaggagaaggagaagctgaagcaggagagactggagaagatcaagcagagagacaagagactggagtgggagatgatgtgcagagtgaagcccgacgtggtgcaggacaaggagaccgagagaaacctgcagagaatcgccaccagaggcgtggtgcagctgttcaacgccgtgcagaagcaccagaagaacgtggacgagaaggtgaaggaggccggcagcagcatgagaaagagagccaagctgatcagcaccgtgagcaagaaggacttcatcagcgtgctgagaggcatggacggcagcaccaacgagaccgccagcagcagaaagaagcccaaggccaagcagaccgaggtgaagagcgaggagggccccggctggaccatcctgagagacgacttcatgatgggcgccagcatgaaggactgggacaaggagagcgacggccccgacgacagcagacccgagagcgccagcgacagcgacacctag

SEQ ID NO: 21639 - DNA, 729 bp, Artificial Sequence
  Description of Artificial Sequence: Synthetic coding sequence
atgtgggccgccgccggcggcctgtggagaagcagagccggcctgagagccctgttcagaagcagagacgccgccctgttccccggctgcgagagaggcctgcactgcagcgccgtgagctgcaagaactggctgaagaagttcgccagcaagaccaagaagaaggtgtggtacgagagccccagcctgggcagccacagcacctacaagcccagcaagctggagttcctgatgagaagcaccagcaagaagaccagaaaggaggaccacgccagactgagagccctgaacggcctgctgtacaaggccctgaccgacctgctgtgcacccccgaggtgagccaggagctgtacgacctgaacgtggagctgagcaaggtgagcctgacccccgacttcagcgcctgcagagcctactggaagaccaccctgagcgccgagcagaacgcccacatggaggccgtgctgcagagaagcgccgcccacatgagcctgatcagctactggcagagccagaccctggaccccggcatgaaggagaccaccctgtacaagatgatcagcggcaccctgatgccccacaaccccgccgccccccagagcagaccccaggcccccgtgtgcgtgggcagcatcatgagaagaagcaccagcagactgtggagcaccaagggcggcaagatcaagggcagcggcgcctggtgcggcagaggcagatggctgagctag

SEQ ID NO: 21640 - DNA, 1032 bp, Artificial Sequence
  Description of Artificial Sequence: Synthetic coding sequence
atgtgggccgccgccggcggcctgtggagaagcagagccggcctgagagccctgttcagaagcagagacgccgccctgttccccggctgcgagagaggcctgcactgcagcgccgtgagctgcaagaactggctgaagaagttcgccagcaagaccaagaagaaggtgtggtacgagagccccagcctgggcagccacagcacctacaagcccagcaagctggagttcctgatgagaagcaccagcaagaagaccagaaaggaggaccacgccagactgagagccctgaacggcctgctgtacaaggccctgaccgacctgctgtgcacccccgaggtgagccaggagctgtacgacctgaacgtggagctgagcaaggtgagcctgacccccgacttcagcgcctgcagagcctactggaagaccaccctgagcgccgagcagaacgcccacatggaggccgtgctgcagagaagcgccgcccacatgagacacctgctgatgagccagcagaccctgagaaacgtgccccccatcgtgttcgtgcaggacaagggcaacgccgccctggccgagctggaccagctgctggccgtggccgacttcggccccagagacgagagagacaacttcgtgcagaacgacttcagagaccccgacgccccccagccctgcggcaccaccgagcccaccaccagcagcagcctgtgcggcatcgaccacgaggccctgaacaagcagatcatggagtacaagagaagaaaggacaagggcctgggcggcctggtgtggcagggccaggtggccgagctgaccacccagatgaagaagggcagaaagagagccaagcccagactggagcaggacagcagcctgaagagctacctgagcggcgaggaggtggaggacgacctggacctggtgggcgcccccgagtacgagtgctacgcccccgacaccgaggagctggaggccgagagaggcggcggcagaaccgaggacggccacagctgcggcgccagcagagagtag

SEQ ID NO: 21641 - DNA, 2058 bp, Artificial Sequence
  Description of Artificial Sequence: Synthetic coding sequence
atgtggctgaagctgttcttcctgctgctgtacttcctggtgctgttcgtgctggccagattcttcgaggccatcgtgtggtacgagaccggcatcttcgccacccagctggtggaccccgtggccctgagcttcaagaagctgaagaccatcctggagtgcagaggcctgggctacagcggcctgcccgagaagaaggacgtgagagagctggtggagaagagcggcgacctgatggagggcgagctgtacagcgccctgaaggaggaggaggccagcgagagcgtgagcagcaccaacttcagcggcgagatgcacttctacgagctggtggaggacaccaaggacggcatctggctggtgcaggtgatcgccaacgacagaagccccctggtgggcaagatccactgggagaagatggtgaagaaggtgagcagattcggcatcagaaccggcaccttcaactgcagcagcgaccccagatactgcagaagaagaggctgggtgagaagcaccctgatcatgagcgtgccccagaccagcaccagcaagggcaaggtgatgctgaaggagtacagcggcagaaagatcgaggtggagcacatcttcaagtggatcaccgcccacgccgccagcagaatcaagaccatctacaacgccgagcacctgaaggaggagtggaacaagagcgaccagtactggctgaagatctacctgttcgccaacctggaccagccccccgccttcttcagcgccctgagcatcaagttcaccggcagagtggagttcatcttcgtgaacgtggagaactgggacaacaagagctacatgaccgacatcggcatctacaacatgcccagctacatcctgagaacccccgagggcatctacagatacggcaaccacaccggcgagttcatcagcctgcaggccatggacagcttcctgagaagcctgcagcccgaggtgaacgacctgttcgtgctgagcctggtgctggtgaacctgatggcctggatggacctgttcatcacccagggcgccaccatcaagagattcgtggtgctgatcagcaccctgggcacctacaacagcctgctgatcatcagctggctgcccgtgctgggcttcctgcagctgccctacctggacagcttctacgagtacagcctgaagctgctgagatacagcaacaccaccaccctggccagctgggtgagagccgactggatgttctacagcagccaccccgccctgttcctgagcacctacctgggccacggcctgctgatcgactacttcgagaagaagagaagaagaaacaacaacaacgacgaggtgaacgccaacaacctggagtggctgagcagcctgtgggactggtacaccagctacctgttccaccccatcgccagcttccagaacttccccgtggagagcgactgggacgaggaccccgacctgttcctggagagactggccttccccgacctgtggctgcaccccctgatccccaccgactacatcaagaacctgcccatgtggagattcaagtgcctgggcgtgcagagcgaggaggagatgagcgagggcagccaggacaccgagaacgacagcgagagcgagaacaccgacaccctgagcagcgagaaggaggtgttcgaggacaagcagagcgtgctgcacaacagccccggcaccgccagccactgcgacgccgaggcctgcagctgcgccaacaagtactgccagaccagcccctgcgagagaaagggcagaagctacggcagctacaacaccaacgaggacatggagcccgactggctgacctggcccgccgacatgctgcactgcaccgagtgcgtggtgtgcctggagaacttcgagaacggctgcctgctgatgggcctgccctgcggccacgtgttccaccagaactgcatcgtgatgtggctggccggcggcagacactgctgccccgtgtgcagatggcccagctacaagaagaagcagccctacgcccagcaccagcccctgagcaacgacgtgcccagctag

SEQ ID NO: 21642 - DNA, 984 bp, Artificial Sequence
  Description of Artificial Sequence: Synthetic coding sequence
atggccgccgtggtggaggtggaggtgggcggcggcgccgccggcgagagagagctggacgaggtggacatgagcgacctgagccccgaggagcagtggagagtggagcacgccagaatgcacgccaagcacagaggccacgaggccatgcacgccgagatggtgctgatcctgatcgccaccctggtggtggcccagctgctgctggtgcagtggaagcagagacaccccagaagctacaacatggtgaccctgttccagatgtgggtggtgcccctgtacttcaccgtgaagctgcactggtggagattcctggtgatctggatcctgttcagcgccgtgaccgccttcgtgaccttcagagccaccagaaagcccctggtgcagaccacccccagactggtgtacaagtggttcctgctgatctacaagatcagctacgccaccggcatcgtgggctacatggccgtgatgttcaccctgttcggcctgaacctgctgttcaagatcaagcccgaggacgccatggacttcggcatcagcctgctgttctacggcctgtactacggcgtgctggagagagacttcgccgagatgtgcgccgactacatggccagcaccatcggcttctacagcgagagcggcatgcccaccaagcacctgagcgacagcgtgtgcgccgtgtgcggccagcagatcttcgtggacgtgagcgaggagggcatcatcgagaacacctacagactgagctgcaaccacgtgttccacgagttctgcatcagaggctggtgcatcgtgggcaagaagcagacctgcccctactgcaaggagaaggtggacctgaagagaatgttcagcaacccctgggagagaccccacgtgatgtacggccagctgctggactggctgagatacctggtggcctggcagcccgtgatcatcggcgtggtgcagggcatcaactacatcctgggcctggagtag

SEQ ID NO: 21643 - DNA, 741 bp, Artificial Sequence
  Description of Artificial Sequence: Synthetic coding sequence
atggtgaccctgttccagatgtgggtggtgcccctgtacttcaccgtgaagctgcactggtggagattcctggtgatctggatcctgttcagcgccgtgaccgccttcgtgaccttcagagccaccagaaagcccctggtgcagaccacccccagactggtgtacaagtggttcctgctgatctacaagatcagctacgccaccggcatcgtgggctacatggccgtgatgttcaccctgttcggcctgaacctgctgttcaagatcaagcccgaggacgccatggacttcggcatcagcctgctgttctacggcctgtactacggcgtgctggagagagacttcgccgagatgtgcgccgactacatggccagcaccatcggcttctacagcgagagcggcatgcccaccaagcacctgagcgacagcgtgtgcgccgtgtgcggccagcagatcttcgtggacgtgagcgaggagggcatcatcgagaacacctacagactgagctgcaaccacgtgttccacgagttctgcatcagaggctggtgcatcgtgggcaagaagcagacctgcccctactgcaaggagaaggtggacctgaagagaatgttcagcaacccctgggagagaccccacgtgatgtacggccagctgctggactggctgagatacctggtggcctggcagcccgtgatcatcggcgtggtgcagggcatcaactacatcctgggcctggagtag

SEQ ID NO: 21644 - DNA, 468 bp, Artificial Sequence
  Description of Artificial Sequence: Synthetic coding sequence
atgcaccccttccagtggtgcaacggctgcttctgcggcctgggcctggtgagcaccaacaagagctgcagcatgccccccatcagcttccaggacctgcccctgaacatctacatggtgatcttcggcaccggcatcttcgtgttcatgctgagcctgatcttctgctgctacttcatcagcaagctgagaaaccaggcccagagcgagagatacggctacaaggaggtggtgctgaagggcgacgccaagaagctgcagctgtacggccagacctgcgccgtgtgcctggaggacttcaagggcaaggacgagctgggcgtgctgccctgccagcacgccttccacagaaagtgcctggtgaagtggctggaggtgagatgcgtgtgccccatgtgcaacaagcccatcgccagccccagcgaggccacccagaacatcggcatcctgctggacgagctggtgtag

SEQ ID NO: 21645 - DNA, 1146 bp, Artificial Sequence
  Description of Artificial Sequence: Synthetic coding sequence
atgctgctgagcatcggcatgctgatgctgagcgccacccaggtgtacaccatcctgaccgtgcagctgttcgccttcctgaacctgctgcccgtggaggccgacatcctggcctacaacttcgagaacgccagccagaccttcgacgacctgcccgccagattcggctacagactgcccgccgagggcctgaagggcttcctgatcaacagcaagcccgagaacgcctgcgagcccatcgtgcccccccccgtgaaggacaacagcagcggcaccttcatcgtgctgatcagaagactggactgcaacttcgacatcaaggtgctgaacgcccagagagccggctacaaggccgccatcgtgcacaacgtggacagcgacgacctgatcagcatgggcagcaacgacatcgaggtgctgaagaagatcgacatccccagcgtgttcatcggcgagagcagcgccaacagcctgaaggacgagttcacctacgagaagggcggccacctgatcctggtgcccgagttcagcctgcccctggagtactacctgatccccttcctgatcatcgtgggcatctgcctgatcctgatcgtgatcttcatgatcaccaagttcgtgcaggacagacacagagccagaagaaacagactgagaaaggaccagctgaagaagctgcccgtgcacaagttcaagaagggcgacgagtacgacgtgtgcgccatctgcctggacgagtacgaggacggcgacaagctgagaatcctgccctgcagccacgcctaccactgcaagtgcgtggacccctggctgaccaagaccaagaagacctgccccgtgtgcaagcagaaggtggtgcccagccagggcgacagcgacagcgacaccgacagcagccaggaggagaacgaggtgaccgagcacacccccctgctgagacccctggccagcgtgagcgcccagagcttcggcgccctgagcgagagcagaagccaccagaacatgaccgagagcagcgactacgaggaggacgacaacgaggacaccgacagcagcgacgccgagaacgagatcaacgagcacgacgtggtggtgcagctgcagcccaacggcgagagagactacaacatcgccaacaccgtgtag

SEQ ID NO: 21646 - DNA, 1146 bp, Artificial Sequence; identical to SEQ ID NO: 21645
  Description of Artificial Sequence: Synthetic coding sequence

SEQ ID NO: 21647 - DNA, 498 bp, Artificial Sequence
  Description of Artificial Sequence: Synthetic coding sequence
atgctgctgagcatcggcatgctgatgctgagcgccacccaggtgtacaccatcctgaccgtgcagctgttcgccttcctgaacctgctgcccgtggaggccgacatcctggcctacaacttcgagaacgccagccagaccttcgacgacctgcccgccagattcggctacagactgcccgccgagggcctgaagggcttcctgatcaacagcaagcccgagaacgcctgcgagcccatcgtgcccccccccgtgaaggacaacagcagcggcaccttcatcgtgctgatcagaagactggactgcaacttcgacatcaaggtgctgaacgcccagagagccggctacaaggccgccatcgtgcacaacgtggacagcgacgacctgatcagcatgggcagcaacgacatcgaggtgctgaagaagatcgacatccccagcgtgttcatcggcgagagcagcgccaacagcctgaaggacgagttcacctacgagtag

SEQ ID NO: 21648 - DNA, 219 bp, Artificial Sequence
  Description of Artificial Sequence: Synthetic coding sequence
atgctgctgagcatcggcatgctgatgctgagcgccacccaggtgtacaccatcctgaccgtgcagctgttcgccttcctgaacctgctgcccgtggaggccgacatcctggcctacaacttcgagaacgccagccagaccttcgacgacctgcccgccagattcggctacagactgcccgccgagggcctgaagggcttcctgatcaacagcaagtag

SEQ ID NO: 21649 - DNA, 492 bp, Artificial Sequence
  Description of Artificial Sequence: Synthetic coding sequence
atgctgctgagcatcggcatgctgatgctgagcgccacccaggtgtacaccatcctgaccgtgcagctgttcgccttcctgaacctgctgcccgtggaggccgacatcctggcctacaacttcgagaacgccagccagaccttcgacgacctgcccgccagattcggctacagactgcccgccgagggcctgaagggcttcctgatcaacagcaagcccgagaacgcctgcgagcccatcgtgcccccccccgtgaaggacaacagcagcggcaccttcatcgtgctgatcagaagactggactgcaacttcgacatcaaggtgctgaacgcccagagagccggctacaaggccgccatcgtgcacaacgtggacagcgacgacctgatcagcatgggcagcaacgacatcgaggtgctgaagaagatcgacatccccagcgtgttcatcggcgagagcagcgccaacagcctgaaggacgagttcacctag

SEQ ID NO: 21650 - DNA, 348 bp, Artificial Sequence
  Description of Artificial Sequence: Synthetic coding sequence
atgctgctgagcatcggcatgctgatgctgagcgccacccaggtgtacaccatcctgaccgtgcagctgttcgccttcctgaacctgctgcccgtggaggccgacatcctggcctacaacttcgagaacgccagccagaccttcgacgacctgcccgccagattcggctacagactgcccgccgagggcctgaagggcttcctgatcaacagcaagcccgagaacgcctgcgagcccatcgtgcccccccccgtgaaggacaacagcagcggcaccttcatcgtgctgatcagaagactggactgcaacttcgacatcaaggtgctgaacgcccagagagccggctag

SEQ ID NO: 21651 - DNA, 243 bp, Artificial Sequence
  Description of Artificial Sequence: Synthetic coding sequence
atgctgctgagcatcggcatgctgatgctgagcgccacccaggtgtacaccatcctgaccgtgcagctgttcgccttcctgaacctgctgcccgtggaggccgacatcctggcctacaacttcgagaacgccagccagaccttcgacgacctgcccgccagattcggctacagactgcccgccgagggcctgaagggcttcctgatcaacagcaagcccgagaacgcctgcgagcccatctag

SEQ ID NO: 21652 - DNA, 273 bp, Artificial Sequence
  Description of Artificial Sequence: Synthetic coding sequence
atgctgctgagcatcggcatgctgatgctgagcgccacccaggtgtacaccatcctgaccgtgcagctgttcgccttcctgaacctgctgcccgtggaggccgacatcctggcctacaacttcgagaacgccagccagaccttcgacgacctgcccgccagattcggctacagactgcccgccgagggcctgaagggcttcctgatcaacagcaagcccgagaacgcctgcgagcccatcgtgcccccccccgtgaaggacaacagcagctag

SEQ ID NO: 21653 - DNA, 876 bp, Artificial Sequence
  Description of Artificial Sequence: Synthetic coding sequence
atgctgctgagcatcggcatgctgatgctgagcgccacccaggtgtacaccatcctgaccgtgcagctgttcgccttcctgaacctgctgcccgtggaggccgacatcctggcctacaacttcgagaacgccagccagaccttcgacgacctgcccgccagattcggctacagactgcccgccgagggcctgaagggcttcctgatcaacagcaagcccgagaacgcctgcgagcccatcgtgcccccccccgtgaaggacaacagcagcggcaccttcatcgtgctgatcagaagactggactgcaacttcgacatcaaggtgctgaacgcccagagagccggctacaaggccgccatcgtgcacaacgtggacagcgacgacctgatcagcatgggcagcaacgacatcgaggtgctgaagaagatcgacatccccagcgtgttcatcggcgagagcagcgccaacagcctgaaggacgagttcacctacgagaagggcggccacctgatcctggtgcccgagttcagcctgcccctggagtactacctgatccccttcctgatcatcgtgggcatctgcctgatcctgatcgtgatcttcatgatcaccaagttcgtgcaggacagacacagagccagaagaaacagactgagaaaggaccagctgaagaagctgcccgtgcacaagttcaagaagggcgacgagtacgacgtgtgcgccatctgcctggacgagtacgaggacggcgacaagctgagaatcctgccctgcagccacgcctaccactgcaagtgcgtggacccctggctgaccaagaccaagaagacctgccccgtgtgcaagcagaagcccaagcacaagaagaagaagtag

SEQ ID NO: 21654 - DNA, 1260 bp, Artificial Sequence
  Description of Artificial Sequence: Synthetic coding sequence
atgagctgcgccggcagagccggccccgccagactggccgccctggccctgctgacctgcagcctgtggcccgccagagccgacaacgccagccaggagtactacaccgccctgatcaacgtgaccgtgcaggagcccggcagaggcgcccccctgaccttcagaatcgacagaggcagatacggcctggacagccccaaggccgaggtgagaggccaggtgctggcccccctgcccctgcacggcgtggccgaccacctgggctgcgacccccagaccagattcttcgtgccccccaacatcaagcagtggatcgccctgctgcagagaggcaactgcaccttcaaggagaagatcagcagagccgccttccacaacgccgtggccgtggtgatctacaacaacaagagcaaggaggagcccgtgaccatgacccaccccggcaccggcgacatcatcgccgtgatgatcaccgagctgagaggcaaggacatcctgagctacctggagaagaacatcagcgtgcagatgaccatcgccgtgggcaccagaatgccccccaagaacttcagcagaggcagcctggtgttcgtgagcatcagcttcatcgtgctgatgatcatcagcagcgcctggctgatcttctacttcatccagaagatcagatacaccaacgccagagacagaaaccagagaagactgggcgacgccgccaagaaggccatcagcaagctgaccaccagaaccgtgaagaagggcgacaaggagaccgaccccgacttcgaccactgcgccgtgtgcatcgagagctacaagcagaacgacgtggtgagaatcctgccctgcaagcacgtgttccacaagagctgcgtggacccctggctgagcgagcactgcacctgccccatgtgcaagctgaacatcctgaaggccctgggcatcgtgcccaacctgccctgcaccgacaacgtggccttcgacatggagagactgaccagaacccaggccgtgaacagaagaagcgccctgggcgacctggccggcgacaacagcctgggcctggagcccctgagaaccagcggcatcagccccctgccccaggacggcgagctgacccccagaaccggcgagatcaacatcgccgtgaccaaggagtggttcatcatcgccagcttcggcctgctgagcgccctgaccctgtgctacatgatcatcagagccaccgccagcctgaacgccaacgaggtggagtggttctag

SEQ ID NO: 21655 - DNA, 1131 bp, Artificial Sequence
  Description of Artificial Sequence: Synthetic coding sequence
atgcacctgctgaaggtgggcacctggagaaacaacaccgccagcagctggctgatgaagttcagcgtgctgtggctggtgagccagaactgctgcagagccagcgtggtgtggatggcctacatgaacatcagcttccacgtgggcaaccacgtgctgagcgagctgggcgagaccggcgtgttcggcagaagcagcaccctgaagagagtggccggcgtgatcgtgccccccgagggcaagatccagaacgcctgcaaccccaacaccatcttcagcagaagcaagtacagcgagacctggctggccctgatcgagagaggcggctgcaccttcacccagaagatcaaggtggccaccgagaagggcgccagcggcgtgatcatctacaacgtgcccggcaccggcaaccaggtgttccccatgttccaccaggccttcgaggacgtggtggtggtgatgatcggcaacctgaagggcaccgagatcttccacctgatcaagaagggcgtgctgatcaccgccgtggtggaggtgggcagaaagcacatcatctggatgaaccactacctggtgagcttcgtgatcgtgaccaccgccaccctggcctacttcatcttctaccacatccacagactgtgcctggccagaatccagaacagaagatggcagagactgaccaccgacctgcagaacaccttcggccagctgcagctgagagtggtgaaggagggcgacgaggagatcaaccccaacggcgacagctgcgtgatctgcttcgagagatacaagcccaacgacatcgtgagaatcctgacctgcaagcacttcttccacaagaactgcatcgacccctggatcctgccccacggcacctgccccatctgcaagtgcgacatcctgaaggtgctgggcatccaggtggtggtggagaacggcaccgagcccctgcaggtgctgatgagcaacgagctgcccgagaccctgagccccagcgaggaggagaccaacaacgaggtgagccccgccggcaccagcgacaaggtgatccacgtggaggagaaccccaccagccagaacaacgacatccagccccacagcgtggtggaggacgtgcaccccagcccctag

SEQ ID NO: 21656 - DNA, 879 bp, Artificial Sequence
  Description of Artificial Sequence: Synthetic coding sequence
atgaccaccaccagatacagacccacctgggacctggccctggaccccctggtgagctgcaagctgtgcctgggcgagtaccccgtggagcagatgaccaccatcgcccagtgccagtgcatcttctgcaccctgtgcctgaagcagtacgtggagctgctgatcaaggagggcctggagaccgccatcagctgccccgacgccgcctgccccaagcagggccacctgcaggagaacgagatcgagtgcatggtggccgccgagatcatgcagagatacaagaagctgcagttcgagagagaggtgctgttcgacccctgcagaacctggtgccccgccagcacctgccaggccgtgtgccagctgcaggacgtgggcctgcagaccccccagcccgtgcagtgcaaggcctgcagaatggagttctgcagcacctgcaaggccagctggcaccccggccagggctgccccgagaccatgcccatcaccttcctgcccggcgagaccagcgccgccttcaagatggaggaggacgacgcccccatcaagagatgccccaagtgcaaggtgtacatcgagagagacgagggctgcgcccagatgatgtgcaagaactgcaagcacgccttctgctggtactgcctggagagcctggacgacgacttcctgctgatccactacgacaagggcccctgcagaaacaagctgggccacagcagagccagcgtgatctggcacagaacccaggtggtgggcatcttcgccggcttcggcctgctgctgctggtggccagccccttcctgctgctggccacccccttcgtgctgtgctgcaagtgcaagtgcagcaagggcgacgacgaccccctgcccacctag

SEQ ID NO: 21657 - DNA, 168 bp, Artificial Sequence
  Description of Artificial Sequence: Synthetic coding sequence
atgaccaccaccagatacagacccacctgggacctggccctggaccccctggtgagctgcaagctgtgcctgggcgagtaccccgtggagcagatgaccaccatcgcccagtgccagtgcatcttctgcaccctgtgcctgaagcagtacgtggagctgctgatctag

SEQ ID NO: 21658 - DNA, 597 bp, Artificial Sequence
  Description of Artificial Sequence: Synthetic coding sequence
atgaccaccaccagatacagacccacctgggacctggccctggaccccctggtgagctgcaagctgtgcctgggcgagtaccccgtggagcagatgaccaccatcgcccagtgccagtgcatcttctgcaccctgtgcctgaagcagtacgtggagctgctgatcaaggagggcctggagaccgccatcagctgccccgacgccgcctgccccaagcagggccacctgcaggagaacgagatcgagtgcatggtggccgccgagatcatgcagagatacaagaagctgcagttcgagagagaggtgctgttcgacccctgcagaacctggtgccccgccagcacctgccaggccgtgtgccagctgcaggacgtgggcctgcagaccccccagcccgtgcagtgcaaggcctgcagaatggagttctgcagcacctgcaaggccagctggcaccccggccagggctgccccgagaccatgcccatcaccttcctgcccggcgagaccagcgccgccttcaagatggaggaggacgacgcccccatcaagagatgccccaagtgcagcaagggcgacgacgaccccctgcccacctag

SEQ ID NO: 21659 - DNA, 168 bp, Artificial Sequence; identical to SEQ ID NO: 21657
  Description of Artificial Sequence: Synthetic coding sequence

SEQ ID NO: 21660 - DNA, 912 bp, Artificial Sequence
  Description of Artificial Sequence: Synthetic coding sequence
atgggcagcgccggcagactgcactacctggccatgaccgccgagaaccccacccccggcgacctggcccccgcccccctgatcacctgcaagctgtgcctgtgcgagcagagcctggacaagatgaccaccctgcaggagtgccagtgcatcttctgcaccgcctgcctgaagcagtacatgcagctggccatcagagagggctgcggcagccccatcacctgccccgacatggtgtgcctgaaccacggcaccctgcaggaggccgagatcgcctgcctggtgcccgtggaccagttccagctgtaccagagactgaagttcgagagagaggtgcacctggacccctacagaacctggtgccccgtggccgactgccagaccgtgtgccccgtggccagcagcgaccccggccagcccgtgctggtggagtgccccagctgccacctgaagttctgcagctgctgcaaggacgcctggcacgccgaggtgagctgcagagacagccagcccatcgtgctgcccaccgagcacagagccctgttcggcaccgacgccgaggcccccatcaagcagtgccccgtgtgcagagtgtacatcgagagaaacgagggctgcgcccagatgatgtgcaagaactgcaagcacaccttctgctggtactgcctgcagaacctggacaacgacatcttcctgagacactacgacaagggcccctgcagaaacaagctgggccacagcagagccagcgtgatgtggaacagaacccaggtggtgggcatcctggtgggcctgggcatcatcgccctggtgaccagccccctgctgctgctggccagcccctgcatcatctgctgcgtgtgcaagagctgcagaggcaagaagaagaagcacgaccccagcaccacctag

SEQ ID NO: 21661 - DNA, 645 bp, Artificial Sequence
  Description of Artificial Sequence: Synthetic coding sequence
atgctgtggatcaccatgccccaccccgcccacctgggcctgttcatcgccgtgaccctgagcgaggtgcacctggacccctacagaacctggtgccccgtggccgactgccagaccgtgtgccccgtggccagcagcgaccccggccagcccgtgctggtggagtgccccagctgccacctgaagttctgcagctgctgcaaggacgcctggcacgccgaggtgagctgcagagacagccagcccatcgtgctgcccaccgagcacagagccctgttcggcaccgacgccgaggcccccatcaagcagtgccccgtgtgcagagtgtacatcgagagaaacgagggctgcgcccagatgatgtgcaagaactgcaagcacaccttctgctggtactgcctgcagaacctggacaacgacatcttcctgagacactacgacaagggcccctgcagaaacaagctgggccacagcagagccagcgtgatgtggaacagaacccaggtggtgggcatcctggtgggcctgggcatcatcgccctggtgaccagccccctgctgctgctggccagcccctgcatcatctgctgcgtgtgcaagagctgcagaggcaagaagaagaagcacgaccccagcaccacctag

SEQ ID NO: 21662 - DNA, 2076 bp, Artificial Sequence
  Description of Artificial Sequence: Synthetic coding sequence
atgatgagaaaccacagaatcgccagcagcctgtgcggcgaccaggtgttcagcaagaagaagaagaagaagaagaagaacaacatggccgccaaggagaagctggaggccgtgctgaacgtggccctgagagtgcccagcatcatgctgctggacgtgctgtacagatgggacgtgagcagcttcttccagcagatccagagaagcagcctgagcaacaaccccctgttccagtacaagtacctggccctgaacatgcactacgtgggctacatcctgagcgtggtgctgctgaccctgcccagacagcacctggtgcagctgtacctgtacttcctgaccgccctgctgctgtacgccggccaccagatcagcagagactacgtgagaagcgagctggagttcgcctacgagggccccatgtacctggagcccctgagcatgaacagattcaccaccgccctgatcggccagctggtggtgtgcaccctgtgcagctgcgtgatgaagaccaagcagatctggctgttcagcgcccacatgctgcccctgctggccagactgtgcctggtgcccctggagaccatcgtgatcatcaacaagttcgccatgatcttcaccggcctggaggtgctgtacttcctgggcagcaacctgctggtgccctacaacctggccaagagcgcctacagagagctggtgcaggtggtggaggtgtacggcctgctggccctgggcatgagcctgtggaaccagctggtggtgcccgtgctgttcatggtgttctggctggtgctgttcgccctgcagatctacagctacttcagcaccagagaccagcccgccagcagagagagactgctgttcctgttcctgaccagcatcgccgagtgctgcagcaccccctacagcctgctgggcctggtgttcaccgtgagcttcgtggccctgggcgtgctgaccctgtgcaagttctacctgcagggctacagagccttcatgaacgaccccgccatgaacagaggcatgaccgagggcgtgaccctgctgatcctggccgtgcagaccggcctgatcgagctgcaggtggtgcacagagccttcctgctgagcatcatcctgttcatcgtggtggccagcatcctgcagagcatgctggagatcgccgaccccatcgtgctggccctgggcgccagcagagacaagagcctgtggaagcacttcagagccgtgagcctgtgcctgttcctgctggtgttccccgcctacatggcctacatgatctgccagttcttccacatggacttctggctgctgatcatcatcagcagcagcatcctgaccagcctgcaggtgctgggcaccctgttcatctacgtgctgttcatggtggaggagttcagaaaggagcccgtggagaacatggacgacgtgatctactacgtgaacggcacctacagactgctggagttcctggtggccctgtgcgtggtggcctacggcgtgagcgagaccatcttcggcgagtggaccgtgatgggcagcatgatcatcttcatccacagctactacaacgtgtggctgagagcccagctgggctggaagagcttcctgctgagaagagacgccgtgaacaagatcaagagcctgcccatcgccaccaaggagcagctggagaagcacaacgacatctgcgccatctgctaccaggacatgaagagcgccgtgatcaccccctgcagccacttcttccacgccggctgcctgaagaagtggctgtacgtgcaggagacctgccccctgtgccactgccacctgaagaacagcagccagctgcccggcctgggcaccgagcccgtgctgcagccccacgccggcgccgagcagaacgtgatgttccaggagggcaccgagccccccggccaggagcacacccccggcaccagaatccaggagggcagcagagacaacaacgagtacatcgccagaagacccgacaaccaggagggcgccttcgaccccaaggagtacccccacagcgccaaggacgaggcccaccccgtggagagcgcctag

SEQ ID NO: 21663 - DNA, 2043 bp, Artificial Sequence
  Description of Artificial Sequence: Synthetic coding sequence
atggccgaggtggtgttcagcaagaagaagaagaagaagaagaagaacaacatggccgccaaggagaagctggaggccgtgctgaacgtggccctgagagtgcccagcatcatgctgctggacgtgctgtacagatgggacgtgagcagcttcttccagcagatccagagaagcagcctgagcaacaaccccctgttccagtacaagtacctggccctgaacatgcactacgtgggctacatcctgagcgtggtgctgctgaccctgcccagacagcacctggtgcagctgtacctgtacttcctgaccgccctgctgctgtacgccggccaccagatcagcagagactacgtgagaagcgagctggagttcgcctacgagggccccatgtacctggagcccctgagcatgaacagattcaccaccgccctgatcggccagctggtggtgtgcaccctgtgcagctgcgtgatgaagaccaagcagatctggctgttcagcgcccacatgctgcccctgctggccagactgtgcctggtgcccctggagaccatcgtgatcatcaacaagttcgccatgatcttcaccggcctggaggtgctgtacttcctgggcagcaacctgctggtgccctacaacctggccaagagcgcctacagagagctggtgcaggtggtggaggtgtacggcctgctggccctgggcatgagcctgtggaaccagctggtggtgcccgtgctgttcatggtgttctggctggtgctgttcgccctgcagatctacagctacttcagcaccagagaccagcccgccagcagagagagactgctgttcctgttcctgaccagcatcgccgagtgctgcagcaccccctacagcctgctgggcctggtgttcaccgtgagcttcgtggccctgggcgtgctgaccctgtgcaagttctacctgcagggctacagagccttcatgaacgaccccgccatgaacagaggcatgaccgagggcgtgaccctgctgatcctggccgtgcagaccggcctgatcgagctgcaggtggtgcacagagccttcctgctgagcatcatcctgttcatcgtggtggccagcatcctgcagagcatgctggagatcgccgaccccatcgtgctggccctgggcgccagcagagacaagagcctgtggaagcacttcagagccgtgagcctgtgcctgttcctgctggtgttccccgcctacatggcctacatgatctgccagttcttccacatggacttctggctgctgatcatcatcagcagcagcatcctgaccagcctgcaggtgctgggcaccctgttcatctacgtgctgttcatggtggaggagttcagaaaggagcccgtggagaacatggacgacgtgatctactacgtgaacggcacctacagactgctggagttcctggtggccctgtgcgtggtggcctacggcgtgagcgagaccatcttcggcgagtggaccgtgatgggcagcatgatcatcttcatccacagctactacaacgtgtggctgagagcccagctgggctggaagagcttcctgctgagaagagacgccgtgaacaagatcaagagcctgcccatcgccaccaaggagcagctggagaagcacaacgacatctgcgccatctgctaccaggacatgaagagcgccgtgatcaccccctgcagccacttcttccacgccggctgcctgaagaagtggctgtacgtgcaggagacctgccccctgtgccactgccacctgaagaacagcagccagctgcccggcctgggcaccgagcccgtgctgcagccccacgccggcgccgagcagaacgtgatgttccaggagggcaccgagccccccggccaggagcacacccccggcaccagaatccaggagggcagcagagacaacaacgagtacatcgccagaagacccgacaaccaggagggcgccttcgaccccaaggagtacccccacagcgccaaggacgaggcccaccccgtggagagcgcctag

SEQ ID NO: 21664 - DNA, 1992 bp, Artificial Sequence
  Description of Artificial Sequence: Synthetic coding sequence
atggccgccaaggagaagctggaggccgtgctgaacgtggccctgagagtgcccagcatcatgctgctggacgtgctgtacagatgggacgtgagcagcttcttccagcagatccagagaagcagcctgagcaacaaccccctgttccagtacaagtacctggccctgaacatgcactacgtgggctacatcctgagcgtggtgctgctgaccctgcccagacagcacctggtgcagctgtacctgtacttcctgaccgccctgctgctgtacgccggccaccagatcagcagagactacgtgagaagcgagctggagttcgcctacgagggccccatgtacctggagcccctgagcatgaacagattcaccaccgccctgatcggccagctggtggtgtgcaccctgtgcagctgcgtgatgaagaccaagcagatctggctgttcagcgcccacatgctgcccctgctggccagactgtgcctggtgcccctggagaccatcgtgatcatcaacaagttcgccatgatcttcaccggcctggaggtgctgtacttcctgggcagcaacctgctggtgccctacaacctggccaagagcgcctacagagagctggtgcaggtggtggaggtgtacggcctgctggccctgggcatgagcctgtggaaccagctggtggtgcccgtgctgttcatggtgttctggctggtgctgttcgccctgcagatctacagctacttcagcaccagagaccagcccgccagcagagagagactgctgttcctgttcctgaccagcatcgccgagtgctgcagcaccccctacagcctgctgggcctggtgttcaccgtgagcttcgtggccctgggcgtgctgaccctgtgcaagttctacctgcagggctacagagccttcatgaacgaccccgccatgaacagaggcatgaccgagggcgtgaccctgctgatcctggccgtgcagaccggcctgatcgagctgcaggtggtgcacagagccttcctgctgagcatcatcctgttcatcgtggtggccagcatcctgcagagcatgctggagatcgccgaccccatcgtgctggccctgggcgccagcagagacaagagcctgtggaagcacttcagagccgtgagcctgtgcctgttcctgctggtgttccccgcctacatggcctacatgatctgccagttcttccacatggacttctggctgctgatcatcatcagcagcagcatcctgaccagcctgcaggtgctgggcaccctgttcatctacgtgctgttcatggtggaggagttcagaaaggagcccgtggagaacatggacgacgtgatctactacgtgaacggcacctacagactgctggagttcctggtggccctgtgcgtggtggcctacggcgtgagcgagaccatcttcggcgagtggaccgtgatgggcagcatgatcatcttcatccacagctactacaacgtgtggctgagagcccagctgggctggaagagcttcctgctgagaagagacgccgtgaacaagatcaagagcctgcccatcgccaccaaggagcagctggagaagcacaacgacatctgcgccatctgctaccaggacatgaagagcgccgtgatcaccccctgcagccacttcttccacgccggctgcctgaagaagtggctgtacgtgcaggagacctgccccctgtgccactgccacctgaagaacagcagccagctgcccggcctgggcaccgagcccgtgctgcagccccacgccggcgccgagcagaacgtgatgttccaggagggcaccgagccccccggccaggagcacacccccggcaccagaatccaggagggcagcagagacaacaacgagtacatcgccagaagacccgacaaccaggagggcgccttcgaccccaaggagtacccccacagcgccaaggacgaggcccaccccgtggagagcgcctag

SEQ ID NO: 21665 - DNA, 2082 bp, Artificial Sequence
  Description of Artificial Sequence: Synthetic coding sequence
atgcacagagacagaatcagccccagcaacagccccacctggagcctgcaggtgttcagcaagaagaagaagaagaagaagaagaacaacatggccgccaaggagaagctggaggccgtgctgaacgtggccctgagagtgcccagcatcatgctgctggacgtgctgtacagatgggacgtgagcagcttcttccagcagatccagagaagcagcctgagcaacaaccccctgttccagtacaagtacctggccctgaacatgcactacgtgggctacatcctgagcgtggtgctgctgaccctgcccagacagcacctggtgcagctgtacctgtacttcctgaccgccctgctgctgtacgccggccaccagatcagcagagactacgtgagaagcgagctggagttcgcctacgagggccccatgtacctggagcccctgagcatgaacagattcaccaccgccctgatcggccagctggtggtgtgcaccctgtgcagctgcgtgatgaagaccaagcagatctggctgttcagcgcccacatgctgcccctgctggccagactgtgcctggtgcccctggagaccatcgtgatcatcaacaagttcgccatgatcttcaccggcctggaggtgctgtacttcctgggcagcaacctgctggtgccctacaacctggccaagagcgcctacagagagctggtgcaggtggtggaggtgtacggcctgctggccctgggcatgagcctgtggaaccagctggtggtgcccgtgctgttcatggtgttctggctggtgctgttcgccctgcagatctacagctacttcagcaccagagaccagcccgccagcagagagagactgctgttcctgttcctgaccagcatcgccgagtgctgcagcaccccctacagcctgctgggcctggtgttcaccgtgagcttcgtggccctgggcgtgctgaccctgtgcaagttctacctgcagggctacagagccttcatgaacgaccccgccatgaacagaggcatgaccgagggcgtgaccctgctgatcctggccgtgcagaccggcctgatcgagctgcaggtggtgcacagagccttcctgctgagcatcatcctgttcatcgtggtggccagcatcctgcagagcatgctggagatcgccgaccccatcgtgctggccctgggcgccagcagagacaagagcctgtggaagcacttcagagccgtgagcctgtgcctgttcctgctggtgttccccgcctacatggcctacatgatctgccagttcttccacatggacttctggctgctgatcatcatcagcagcagcatcctgaccagcctgcaggtgctgggcaccctgttcatctacgtgctgttcatggtggaggagttcagaaaggagcccgtggagaacatggacgacgtgatctactacgtgaacggcacctacagactgctggagttcctggtggccctgtgcgtggtggcctacggcgtgagcgagaccatcttcggcgagtggaccgtgatgggcagcatgatcatcttcatccacagctactacaacgtgtggctgagagcccagctgggctggaagagcttcctgctgagaagagacgccgtgaacaagatcaagagcctgcccatcgccaccaaggagcagctggagaagcacaacgacatctgcgccatctgctaccaggacatgaagagcgccgtgatcaccccctgcagccacttcttccacgccggctgcctgaagaagtggctgtacgtgcaggagacctgccccctgtgccactgccacctgaagaacagcagccagctgcccggcctgggcaccgagcccgtgctgcagccccacgccggcgccgagcagaacgtgatgttccaggagggcaccgagccccccggccaggagcacacccccggcaccagaatccaggagggcagcagagacaacaacgagtacatcgccagaagacccgacaaccaggagggcgccttcgaccccaaggagtacccccacagcgccaaggacgaggcccaccccgtggagagcgcctag

SEQ ID NO: 21666 - DNA, 1992 bp, Artificial Sequence; identical to SEQ ID NO: 21664
  Description of Artificial Sequence: Synthetic coding sequence

SEQ ID NO: 21667 - DNA, 2034 bp, Artificial Sequence
  Description of Artificial Sequence: Synthetic coding sequence
atggtgttcagcaagaagaagaagaagaagaagaagaacaacatggccgccaaggagaagctggaggccgtgctgaacgtggccctgagagtgcccagcatcatgctgctggacgtgctgtacagatgggacgtgagcagcttcttccagcagatccagagaagcagcctgagcaacaaccccctgttccagtacaagtacctggccctgaacatgcactacgtgggctacatcctgagcgtggtgctgctgaccctgcccagacagcacctggtgcagctgtacctgtacttcctgaccgccctgctgctgtacgccggccaccagatcagcagagactacgtgagaagcgagctggagttcgcctacgagggccccatgtacctggagcccctgagcatgaacagattcaccaccgccctgatcggccagctggtggtgtgcaccctgtgcagctgcgtgatgaagaccaagcagatctggctgttcagcgcccacatgctgcccctgctggccagactgtgcctggtgcccctggagaccatcgtgatcatcaacaagttcgccatgatcttcaccggcctggaggtgctgtacttcctgggcagcaacctgctggtgccctacaacctggccaagagcgcctacagagagctggtgcaggtggtggaggtgtacggcctgctggccctgggcatgagcctgtggaaccagctggtggtgcccgtgctgttcatggtgttctggctggtgctgttcgccctgcagatctacagctacttcagcaccagagaccagcccgccagcagagagagactgctgttcctgttcctgaccagcatcgccgagtgctgcagcaccccctacagcctgctgggcctggtgttcaccgtgagcttcgtggccctgggcgtgctgaccctgtgcaagttctacctgcagggctacagagccttcatgaacgaccccgccatgaacagaggcatgaccgagggcgtgaccctgctgatcctggccgtgcagaccggcctgatcgagctgcaggtggtgcacagagccttcctgctgagcatcatcctgttcatcgtggtggccagcatcctgcagagcatgctggagatcgccgaccccatcgtgctggccctgggcgccagcagagacaagagcctgtggaagcacttcagagccgtgagcctgtgcctgttcctgctggtgttccccgcctacatggcctacatgatctgccagttcttccacatggacttctggctgctgatcatcatcagcagcagcatcctgaccagcctgcaggtgctgggcaccctgttcatctacgtgctgttcatggtggaggagttcagaaaggagcccgtggagaacatggacgacgtgatctactacgtgaacggcacctacagactgctggagttcctggtggccctgtgcgtggtggcctacggcgtgagcgagaccatcttcggcgagtggaccgtgatgggcagcatgatcatcttcatccacagctactacaacgtgtggctgagagcccagctgggctggaagagcttcctgctgagaagagacgccgtgaacaagatcaagagcctgcccatcgccaccaaggagcagctggagaagcacaacgacatctgcgccatctgctaccaggacatgaagagcgccgtgatcaccccctgcagccacttcttccacgccggctgcctgaagaagtggctgtacgtgcaggagacctgccccctgtgccactgccacctgaagaacagcagccagctgcccggcctgggcaccgagcccgtgctgcagccccacgccggcgccgagcagaacgtgatgttccaggagggcaccgagccccccggccaggagcacacccccggcaccagaatccaggagggcagcagagacaacaacgagtacatcgccagaagacccgacaaccaggagggcgccttcgaccccaaggagtacccccacagcgccaaggacgaggcccaccccgtggagagcgcctag

SEQ ID NO: 21668 - DNA, 2040 bp, Artificial Sequence
  Description of Artificial Sequence: Synthetic coding sequence
atggccgaggtgttcagcaagaagaagaagaagaagaagaagaacaacatggccgccaaggagaagctggaggccgtgctgaacgtggccctgagagtgcccagcatcatgctgctggacgtgctgtacagatgggacgtgagcagcttcttccagcagatccagagaagcagcctgagcaacaaccccctgttccagtacaagtacctggccctgaacatgcactacgtgggctacatcctgagcgtggtgctgctgaccctgcccagacagcacctggtgcagctgtacctgtacttcctgaccgccctgctgctgtacgccggccaccagatcagcagagactacgtgagaagcgagctggagttcgcctacgagggccccatgtacctggagcccctgagcatgaacagattcaccaccgccctgatcggccagctggtggtgtgcaccctgtgcagctgcgtgatgaagaccaagcagatctggctgttcagcgcccacatgctgcccctgctggccagactgtgcctggtgcccctggagaccatcgtgatcatcaacaagttcgccatgatcttcaccggcctggaggtgctgtacttcctgggcagcaacctgctggtgccctacaacctggccaagagcgcctacagagagctggtgcaggtggtggaggtgtacggcctgctggccctgggcatgagcctgtggaaccagctggtggtgcccgtgctgttcatggtgttctggctggtgctgttcgccctgcagatctacagctacttcagcaccagagaccagcccgccagcagagagagactgctgttcctgttcctgaccagcatcgccgagtgctgcagcaccccctacagcctgctgggcctggtgttcaccgtgagcttcgtggccctgggcgtgctgaccctgtgcaagttctacctgcagggctacagagccttcatgaacgaccccgccatgaacagaggcatgaccgagggcgtgaccctgctgatcctggccgtgcagaccggcctgatcgagctgcaggtggtgcacagagccttcctgctgagcatcatcctgttcatcgtggtggccagcatcctgcagagcatgctggagatcgccgaccccatcgtgctggccctgggcgccagcagagacaagagcctgtggaagcacttcagagccgtgagcctgtgcctgttcctgctggtgttccccgcctacatggcctacatgatctgccagttcttccacatggacttctggctgctgatcatcatcagcagcagcatcctgaccagcctgcaggtgctgggcaccctgttcatctacgtgctgttcatggtggaggagttcagaaaggagcccgtggagaacatggacgacgtgatctactacgtgaacggcacctacagactgctggagttcctggtggccctgtgcgtggtggcctacggcgtgagcgagaccatcttcggcgagtggaccgtgatgggcagcatgatcatcttcatccacagctactacaacgtgtggctgagagcccagctgggctggaagagcttcctgctgagaagagacgccgtgaacaagatcaagagcctgcccatcgccaccaaggagcagctggagaagcacaacgacatctgcgccatctgctaccaggacatgaagagcgccgtgatcaccccctgcagccacttcttccacgccggctgcctgaagaagtggctgtacgtgcaggagacctgccccctgtgccactgccacctgaagaacagcagccagctgcccggcctgggcaccgagcccgtgctgcagccccacgccggcgccgagcagaacgtgatgttccaggagggcaccgagccccccggccaggagcacacccccggcaccagaatccaggagggcagcagagacaacaacgagtacatcgccagaagacccgacaaccaggagggcgccttcgaccccaaggagtacccccacagcgccaaggacgaggcccaccccgtggagagcgcctag

SEQ ID NO: 21669 - DNA, 1992 bp, Artificial Sequence; identical to SEQ ID NO: 21664
  Description of Artificial Sequence: Synthetic coding sequence

SEQ ID NO: 21670 - DNA, 918 bp, Artificial Sequence
  Description of Artificial Sequence: Synthetic coding sequence
atgagcttcctgagaatcacccccagcacccacagcagcgtgagcagcggcctgctgagactgagcatcttcctgctgctgagcttccccgacagcaacggcaaggccatctggaccgcccacctgaacatcaccttccaggtgggcaacgagatcaccagcgagctgggcgagagcggcgtgttcggcaaccacagccccctggagagagtgagcggcgtggtggccctgcccgagggctggaaccagaacgcctgccaccccctgaccaacttcagcagacccaagcaggccgacagctggctggccctgatcgagagaggcggctgcaccttcacccacaagatcaacgtggccgccgagaagggcgccaacggcgtgatcatctacaactaccagggcaccggcagcaaggtgttccccatgagccaccagggcaccgagaacatcgtggccgtgatgatcagcaacctgaagggcatggagatcctgcacagcatccagaagggcgtgtacgtgaccgtgatcatcgaggtgggcagaatgcacatgcagtgggtgagccactacatcatgtacctgttcaccttcctggccgccaccatcgcctacttctacctggactgcgtgtggagactgacccccagagtgcccaacagcttcaccagaagaagaagccagatcaagaccgacgtgaagaaggccatcgaccagctgcagctgagagtgctgaaggagggcgacgaggagctggacctgaacgaggacaactgcgtggtgtgcttcgacacctacaagccccaggacgtggtgagaatcctgacctgcaagcacttcttccacaaggcctgcatcgacccctggctgctggcccacagaacctgccccatgtgcaagtgcgacatcctgaagacctag

SEQ ID NO: 21671 - DNA, 1203 bp, Artificial Sequence
  Description of Artificial Sequence: Synthetic coding sequence
atggcctggagaagaagagaggccagcgtgggcgccagaggcgtgctggccctggccctgctggccctggccctgtgcgtgcccggcgccagaggcagagccctggagtggttcagcgccgtggtgaacatcgagtacgtggacccccagaccaacctgaccgtgtggagcgtgagcgagagcggcagattcggcgacagcagccccaaggagggcgcccacggcctggtgggcgtgccctgggcccccggcggcgacctggagggctgcgcccccgacaccagattcttcgtgcccgagcccggcggcagaggcgccgccccctgggtggccctggtggccagaggcggctgcaccttcaaggacaaggtgctggtggccgccagaagaaacgccagcgccgtggtgctgtacaacgaggagagatacggcaacatcaccctgcccatgagccacgccggcaccggcaacatcgtggtgatcatgatcagctaccccaagggcagagagatcctggagctggtgcagaagggcatccccgtgaccatgaccatcggcgtgggcaccagacacgtgcaggagttcatcagcggccagagcgtggtgttcgtggccatcgccttcatcaccatgatgatcatcagcctggcctggctgatcttctactacatccagagattcctgtacaccggcagccagatcggcagccagagccacagaaaggagaccaagaaggtgatcggccagctgctgctgcacaccgtgaagcacggcgagaagggcatcgacgtggacgccgagaactgcgccgtgtgcatcgagaacttcaaggtgaaggacatcatcagaatcctgccctgcaagcacatcttccacagaatctgcatcgacccctggctgctggaccacagaacctgccccatgtgcaagctggacgtgatcaaggccctgggctactggggcgagcccggcgacgtgcaggagatgcccgcccccgagagcccccccggcagagaccccgccgccaacctgagcctggccctgcccgacgacgacggcagcgacgacagcagcccccccagcgccagccccgccgagagcgagccccagtgcgaccccagcttcaagggcgacgccggcgagaacaccgccctgctggaggccggcagaagcgacagcagacacggcggccccatcagctag

SEQ ID NO: 21672 - DNA, 1191 bp, Artificial Sequence
  Description of Artificial Sequence: Synthetic coding sequence
atggccatgagcctgatccaggcctgctgcagcctggccctgagcacctggctgctgagcttctgcttcgtgcacctgctgtgcctggacttcaccgtggccgagaaggaggagtggtacaccgccttcgtgaacatcacctacgccgagcccgcccccgaccccggcgccggcgccgccggcggcggcggcgccgagctgcacaccgagaagaccgagtgcggcagatacggcgagcacagccccaagcaggacgccagaggcgaggtggtgatggccagcagcgcccacgacagactggcctgcgaccccaacaccaagttcgccgcccccaccagaggcaagaactggatcgccctgatccccaagggcaactgcacctacagagacaagatcagaaacgccttcctgcagaacgccagcgccgtggtgatcttcaacgtgggcagcaacaccaacgagaccatcaccatgccccacgccggcgtggaggacatcgtggccatcatgatccccgagcccaagggcaaggagatcgtgagcctgctggagagaaacatcaccgtgaccatgtacatcaccatcggcaccagaaacctgcagaagtacagaagactgggcgacgccgccaagaaggccatcagcaagctgcagatcagaaccatcaagaagggcgacaaggagaccgagagcgacttcgacaactgcgccgtgtgcatcgagggctacaagcccaacgacgtggtgagaatcctgccctgcagacacctgttccacaagagctgcgtggacccctggctgctggaccacagaacctgccccatgtgcaagatgaacatcctgaaggccctgggcatcccccccaacgccgactgcatggacgacctgcccaccgacttcgagggcagcctgggcggcccccccaccaaccagatcaccggcgccagcgacaccaccgtgaacgagagcagcgtgaccctggaccccgccgtgagaaccgtgggcgccctgcaggtggtgcaggacaccgaccccatcccccaggagggcgacgtgatcttcaccaccaacagcgagcaggagcccgccgtgagcagcgacagcgacatcagcctgatcatggccatggaggtgggcctgagcgacgtggagctgagcaccgaccaggactgcgaggaggtgaagagctag

SEQ ID NO: 21673 - DNA, 894 bp, Artificial Sequence
  Description of Artificial Sequence: Synthetic coding sequence
atgagcagccacgcccagcccctgaagctgatcagcccctgcccctacagcctgagcagcggcgtggaggacatcgtggccatcatgatccccgagcccaagggcaaggagatcgtgagcctgctggagagaaacatcaccgtgaccatgtacatcaccatcggcaccagaaacctgcagaagtacgtgagcagaaccagcgtggtgttcgtgagcatcagcttcatcgtgctgatgatcatcagcctggcctggctggtgttctactacatccagagattcagatacgccaacgccagagacagaaaccagagaagactgggcgacgccgccaagaaggccatcagcaagctgcagatcagaaccatcaagaagggcgacaaggagaccgagagcgacttcgacaactgcgccgtgtgcatcgagggctacaagcccaacgacgtggtgagaatcctgccctgcagacacctgttccacaagagctgcgtggacccctggctgctggaccacagaacctgccccatgtgcaagatgaacatcctgaaggccctgggcatcccccccaacgccgactgcatggacgacctgcccaccgacttcgagggcagcctgggcggcccccccaccaaccagatcaccggcgccagcgacaccaccgtgaacgagagcagcgtgaccctggaccccgccgtgagaaccgtgggcgccctgcaggtggtgcaggacaccgaccccatcccccaggagggcgacgtgatcttcaccaccaacagcgagcaggagcccgccgtgagcagcgacagcgacatcagcctgatcatggccatggaggtgggcctgagcgacgtggagctgagcaccgaccaggactgcgaggaggtgaagagctag

SEQ ID NO: 21674 - DNA, 894 bp, Artificial Sequence; identical to SEQ ID NO: 21673
  Description of Artificial Sequence: Synthetic coding sequence

SEQ ID NO: 21675 - DNA, 1218 bp, Artificial Sequence
  Description of Artificial Sequence: Synthetic coding sequence
atggccatgagcctgatccaggcctgctgcagcctggccctgagcacctggctgctgagcttctgcttcgtgcacctgctgtgcctggacttcaccgtggccgagaaggaggagtggtacaccgccttcgtgaacatcacctacgccgagcccgcccccgaccccggcgccggcgccgccggcggcggcggcgccgagctgcacaccgagaagaccgagtgcggcagatacggcgagcacagccccaagcaggacgccagaggcgaggtggtgatggccagcagcgcccacgacagactggcctgcgaccccaacaccaagttcgccgcccccaccagaggcaagaactggatcgccctgatccccaagggcaactgcacctacagagacaagatcagaaacgccttcctgcagaacgccagcgccgtggtgatcttcaacgtgggcagcaacaccaacgagaccatcaccatgccccacgccggcgtggaggacatcgtggccatcatgatccccgagcccaagggcaaggagatcgtgagcctgctggagagaaacatcaccgtgaccatgtacatcaccatcggcaccagaaacctgcagaagtacgtgagcagaaccagcgtggtgttcgtgagcatcagcttcatcgtgctgatgatcatcagcctggcctggctggtgttctactacatccagagattcagatacgccaacgccagagacagaaaccagagaagactgggcgacgccgccaagaaggccatcagcaagctgcagatcagaaccatcaagaagggcgacaaggagaccgagagcgacttcgacaactgcgccgtgtgcatcgagggctacaagcccaacgacgtggtgagaatcctgccctgcagacacctgttccacaagagctgcgtggacccctggctgctggaccacagaacctgccccatgtgcaagatgaacatcctgaaggccctgggcatcccccccaacgccgactgcatggacgacctgcccaccgacttcgagggcagcctgggcggcccccccaccaaccagatcaccggcgccagcgacaccaccgtgaacgagagcagcgtgaccctggaccccgccgtgagaaccgtgggcgccctgcaggtggtgcaggacaccgaccccatcccccaggagggcgacgtgatcttcaccaccaacagcgagttctgccacacctag

SEQ ID NO: 21676 - DNA, 1317 bp, Artificial Sequence
  Description of Artificial Sequence: Synthetic coding sequence
atggccatgagcctgatccaggcctgctgcagcctggccctgagcacctggctgctgagcttctgcttcgtgcacctgctgtgcctggacttcaccgtggccgagaaggaggagtggtacaccgccttcgtgaacatcacctacgccgagcccgcccccgaccccggcgccggcgccgccggcggcggcggcgccgagctgcacaccgagaagaccgagtgcggcagatacggcgagcacagccccaagcaggacgccagaggcgaggtggtgatggccagcagcgcccacgacagactggcctgcgaccccaacaccaagttcgccgcccccaccagaggcaagaactggatcgccctgatccccaagggcaactgcacctacagagacaagatcagaaacgccttcctgcagaacgccagcgccgtggtgatcttcaacgtgggcagcaacaccaacgagaccatcaccatgccccacgccggcgtggaggacatcgtggccatcatgatccccgagcccaagggcaaggagatcgtgagcctgctggagagaaacatcaccgtgaccatgtacatcaccatcggcaccagaaacctgcagaagtacgtgagcagaaccagcgtggtgttcgtgagcatcagcttcatcgtgctgatgatcatcagcctggcctggctggtgttctactacatccagagattcagatacgccaacgccagagacagaaaccagagaagactgggcgacgccgccaagaaggccatcagcaagctgcagatcagaaccatcaagaagggcgacaaggagaccgagagcgacttcgacaactgcgccgtgtgcatcgagggctacaagcccaacgacgtggtgagaatcctgccctgcagacacctgttccacaagagctgcgtggacccctggctgctggaccacagaacctgccccatgtgcaagatgaacatcctgaaggccctgggcatcccccccaacgccgactgcatggacgacctgcccaccgacttcgagggcagcctgggcggcccccccaccaaccagatcaccggcgccagcgacaccaccgtgaacgagagcagcgtgaccctggaccccgccgtgagaaccgtgggcgccctgcaggtggtgcaggacaccgaccccatcccccaggagggcgacgtgatcttcaccaccaacagcgagcaggagcccgccgtgagcagcgacagcgacatcagcctgatcatggccatggaggtgggcctgagcgacgtggagctgagcaccgaccaggactgcgaggaggtgaagagctag

SEQ ID NO: 21677 - DNA, 612 bp, Artificial Sequence
  Description of Artificial Sequence: Synthetic coding sequence
atggagaccctgagccaggacagcctgctggagtgccagatctgcttcaactactacagccccagaagaagacccaagctgctggactgcaagcacacctgctgcagcgtgtgcctgcagcagatgagaaccagccagaaggacgtgagatgcccctggtgcagaggcgtgaccaagctgccccccggcttcagcgtgagccagctgcccgacgaccccgaggtgctggccgtgatcgccatcccccacaccagcgagcacacccccgtgttcatcaagctgcccagcaacggctgctacatgctgcccctgcccatcagcaaggagagagccctgctgcccggcgacatgggctgcagactgctgcccggcagccagcagaagagcgtgaccgtggtgaccatccccgccgagcagcagcccctgcagggcggcgccccccaggaggccgtggaggaggagcaggacagaagaggcgtggtgaagagcagcacctggagcggcgtgtgcaccgtgatcctggtggcctgcgtgctggtgttcctgctgggcatcgtgctgcacaacatgagctgcatcagcaagagattcaccgtgatcagctgcggctag

SEQ ID NO: 21678 - DNA, 1053 bp, Artificial Sequence
  Description of Artificial Sequence: Synthetic coding sequence
atgcaccccgccgccttccccctgcccgtggtggtggccgccgtgctgtggggcgccgcccccaccagaggcctgatcagagccaccagcgaccacaacgccagcatggacttcgccgacctgcccgccctgttcggcgccaccctgagccaggagggcctgcagggcttcctggtggaggcccaccccgacaacgcctgcagccccatcgccccccccccccccgcccccgtgaacggcagcgtgttcatcgccctgctgagaagattcgactgcaacttcgacctgaaggtgctgaacgcccagaaggccggctacggcgccgccgtggtgcacaacgtgaacagcaacgagctgctgaacatggtgtggaacagcgaggagatccagcagcagatctggatccccagcgtgttcatcggcgagagaagcagcgagtacctgagagccctgttcgtgtacgagaagggcgccagagtgctgctggtgcccgacaacaccttccccctgggctactacctgatccccttcaccggcatcgtgggcctgctggtgctggccatgggcgccgtgatgatcgccagatgcatccagcacagaaagagactgcagagaaacagactgaccaaggagcagctgaagcagatccccacccacgactaccagaagggcgaccagtacgacgtgtgcgccatctgcctggacgagtacgaggacggcgacaagctgagagtgctgccctgcgcccacgcctaccacagcagatgcgtggacccctggctgacccagaccagaaagacctgccccatctgcaagcagcccgtgcacagaggccccggcgacgaggaccaggaggaggagacccagggccaggaggagggcgacgagggcgagcccagagaccaccccgccagcgagagaacccccctgctgggcagcagccccaccctgcccaccagcttcggcagcctggcccccgcccccctggtgttccccggccccagcaccgacccccccctgagcccccccagcagccccgtgatcctggtgtag

SEQ ID NO: 21679 - DNA, 489 bp, Artificial Sequence
  Description of Artificial Sequence: Synthetic coding sequence
atgcacctgctgcccctggacagcagcagcaccctgacctgcaccgtgcccagcgcctgcaccaagccccccagcagatggagacccaccgtggacatcttcttcgtggtgaccctgctgctgaccgtgttcggcgaggacgaccagagccaggacgtgctgagactgcaccaggacatcaacgactacaacagaagattcagcggccagcccagaagcatcatggagagaatcatggacctgcccaccctgctgagacacgccttcagagagatgttcagcgtgggcggcctgttctggatgttcagaatcagaatcatcctgtgcctgatgggcgccttcttctacctgatcagccccctggacttcgtgcccgaggccctgttcggcatcctgggcttcctggacgacttcttcgtgatcttcctgctgctgatctacatcagcatcatgtacagagaggtgatcacccagagactgaccagatag

SEQ ID NO: 21680 - DNA, 603 bp, Artificial Sequence
  Description of Artificial Sequence: Synthetic coding sequence
atggccaagtaccagggcgaggtgcagagcctgaagctggacgacgacagcgtgatcgagggcgtgagcgaccaggtgctggtggccgtggtggtgagcttcgccctgatcgccaccctggtgtacgccctgttcagaaacgtgcaccagaacatccaccccgagaaccaggagctggtgagagtgctgagagagcagctgcagaccgagcaggacgcccccgccgccaccagacagcagttctacaccgacatgtactgccccatctgcctgcaccaggccagcttccccgtggagaccaactgcggccacctgttctgcggcgcctgcatcatcgcctactggagatacggcagctggctgggcgccatcagctgccccatctgcagacagaccggcagcagcgagaagagcagcagagccagcgagcagacccaccaggaggccgtggcctgcctggacacccagaacagccccgcctgcaccgtgggctgcagaagcggcccccagcacatcccccacgacagaatgctgcccagcgccagccccagactgtgcttcaccctgctggactgcgtgagcatcctgtggttcagcggctag

SEQ ID NO: 21681 - DNA, 138 bp, Artificial Sequence
  Description of Artificial Sequence: Synthetic coding sequence
atggccaagtaccagggcgaggtgcagagcctgaagctggacgacgacagcgtgatcgagggcgtgagcgaccaggtgctggtggccgtggtggtgagcttcgccctgatcgccaccctggtgtacgccctgttctag

SEQ ID NO: 21682 - DNA, 777 bp, Artificial Sequence
  Description of Artificial Sequence: Synthetic coding sequence
atggccaagtaccagggcgaggtgcagagcctgaagctggacgacgacagcgtgatcgagggcgtgagcgaccaggtgctggtggccgtggtggtgagcttcgccctgatcgccaccctggtgtacgccctgttcagaaacgtgcaccagaacatccaccccgagaaccaggagctggtgagagtgctgagagagcagctgcagaccgagcaggacgcccccgccgccaccagacagcagttctacaccgacatgtactgccccatctgcctgcaccaggccagcttccccgtggagaccaactgcggccacctgttctgcggcgcctgcatcatcgcctactggagatacggcagctggctgggcgccatcagctgccccatctgcagacagaccgtgaccctgctgctgaccgtgttcggcgaggacgaccagagccaggacgtgctgagactgcaccaggacatcaacgactacaacagaagattcagcggccagcccagaagcatcatggagagaatcatggacctgcccaccctgctgagacacgccttcagagagatgttcagcgtgggcggcctgttctggatgttcagaatcagaatcatcctgtgcctgatgggcgccttcttctacctgatcagccccctggacttcgtgcccgaggccctgttcggcatcctgggcttcctggacgacttcttcgtgatcttcctgctgctgatctacatcagcatcatgtacagagaggtgatcacccagagactgaccagatag

SEQ ID NO: 21683 - DNA, 348 bp, Artificial Sequence
  Description of Artificial Sequence: Synthetic coding sequence
atggccaagtaccagggcgaggtgcagagcctgaagctggacgacgacagcgtgatcgagggcgtgagcgaccaggtgctggtggccgtggtggtgagcttcgccctgatcgccaccctggtgtacgccctgttcagaaacgtgcaccagaacatccaccccgagaaccaggagctggtgagagtgctgagagagcagctgcagaccgagcaggacgcccccgccgccaccagacagcagttctacaccgacatgtactgccccatctgcctgcaccaggccagcttccccgtggagaccaactgcggccacctgttctgcggcgcctgcatcatcgcctactggtag

SEQ ID NO: 21684 - DNA, 777 bp, Artificial Sequence; identical to SEQ ID NO: 21682
  Description of Artificial Sequence: Synthetic coding sequence

SEQ ID NO: 21685 - DNA, 525 bp, Artificial Sequence
  Description of Artificial Sequence: Synthetic coding sequence
atgtactgccccatctgcctgcaccaggccagcttccccgtggagaccaactgcggccacctgttctgcggcgcctgcatcatcgcctactggagatacggcagctggctgggcgccatcagctgccccatctgcagacagaccgtgaccctgctgctgaccgtgttcggcgaggacgaccagagccaggacgtgctgagactgcaccaggacatcaacgactacaacagaagattcagcggccagcccagaagcatcatggagagaatcatggacctgcccaccctgctgagacacgccttcagagagatgttcagcgtgggcggcctgttctggatgttcagaatcagaatcatcctgtgcctgatgggcgccttcttctacctgatcagccccctggacttcgtgcccgaggccctgttcggcatcctgggcttcctggacgacttcttcgtgatcttcctgctgctgatctacatcagcatcatgtacagagaggtgatcacccagagactgaccagatag

SEQ ID NO: 21686 - DNA, 546 bp, Artificial Sequence
  Description of Artificial Sequence: Synthetic coding sequence
atggccgaccccaccatcctggtgtacaagtggttcctgctgatctacaagctgagctacgccttcggcgtggtgggctacctggccatcatgttcaccatgtgcggcttcaacctgttcttcaagatcaaggccagagacagcatggacttcggcatcgtgagcctgttctacggcctgtactacggcgtgatgggcagagacttcgccgagatctgcagcgactacatggccagcaccatcggcttctacagcgtgagcagactgcccaccagaagcctgagcgacaacatctgcgccgtgtgcggccagaagatcatcgtggagctggacgaggagggcctgatcgagaacacctaccagctgagctgcaaccacgtgtaccccttccagagaaagctgttcggcctgcaccaggccagcttcttcccccccagccccccccccccccccgtgcccatcagcagcatcctgctgaccttccacgcccagacccccgtgctgtacccccccgcccagagcagcctgcccgtgtgcccctgctag

SEQ ID NO: 21687 - DNA, 987 bp, Artificial Sequence
  Description of Artificial Sequence: Synthetic coding sequence
atggccgccggcaccgccgccagaaaggccgcccccgtgctggaggcccccccccagcaggagcagctgagccacaccaagctgagcgccgaggacacctggaacctgcagcaggagagaatgtacaagatgcacagaggccacgacagcatgcacgtggagatgatcctgatcttcctgtgcgtgctggtgatcgcccagatcgtgctggtgcagtggagacagagacacggcagaagctacaacctggtgaccctgctgcagatgtgggtggtgcccctgtacttcaccatcaagctgtactggtggagattcctgagcatgtggggcatgttcagcgtgatcaccagctacatcctgttcagagccaccagaaagcccctgagcggcagaacccccagactggtgtacaagtggttcctgctgatctacaagctgagctacgccttcggcgtggtgggctacctggccatcatgttcaccatgtgcggcttcaacctgttcttcaagatcaaggccagagacagcatggacttcggcatcgtgagcctgttctacggcctgtactacggcgtgatgggcagagacttcgccgagatctgcagcgactacatggccagcaccatcggcttctacagcgtgagcagactgcccaccagaagcctgagcgacaacatctgcgccgtgtgcggccagaagatcatcgtggagctggacgaggagggcctgatcgagaacacctaccagctgagctgcaaccacgtgttccacgagttctgcatcagaggctggtgcatcgtgggcaagaagcagacctgcccctactgcaaggagaaggtggacctgaagagaatgatcagcaacccctgggagagaacccacttcctgtacggccagatcctggactggctgagatacctggtggcctggcagcccgtggtgatcggcatcgtgcagggcatcatctacagcctgggcctggagtag

SEQ ID NO: 21688 - DNA, 1251 bp, Artificial Sequence
  Description of Artificial Sequence: Synthetic coding sequence
atgaagagaagcaaggagctgatcaccaagaaccacagccaggaggagaccagcatcctgagatgctggaagtgcagaaagtgcatcgccagcagcggctgcttcatggagtacctggagaaccaggtgatcaaggacaaggacgacagcgtggacgcccagaacatctgccacgtgtggcacatgaacgtggaggccctgcccgagtggatcagctgcctgatccagaaggcccagtggaccgtgggcaagctgaactgccccttctgcggcgccagactgggcggcttcaacttcgtgagcacccccaagtgcagctgcggccagctggccgccgtgcacctgagcaagagcagaaccgactaccagcccacccaggccggcagactgatgagacccagcgtgaagtacctgagccaccccagagtgcagagcggctgcgacaaggaggccctgctgaccggcggcggcagcgagaacagaaaccacagactgctgaacatggccagaaacaacaacgaccccggcagactgaccgaggccctgtgcctggaggtgagacccacctacttcgagatgaagaacgagaagctgctgagcaaggccagcgagcccaagtaccagctgttcgtgccccagctggtgaccggcagatgcgccaccagagccttccacagaaagagccacagcctggacctgaacatcagcgagaagctgaccctgctgcccaccctgtacgagatccacagcaagaccaccgcctacagcagactgaacgagacccagcccatcgacctgagcggcctgcccctgcagagcagcaagaacagctacagcttccagaaccccagcagcttcgaccccagcatgctgctgcagagattcagcgtggccccccacgagacccagacccagagaggcggcgagttccagtgcggcctggaggccgccagcgtgtacagcgaccacaccaacaccaacaacctgaccttcctgatggacctgcccagcgccggcagaagcatgcccgaggccagcgaccaggaggagcacctgagccccctggacttcctgcacagcgccaacttcagcctgggcagcatcaaccagagactgaacaagagagagagaagcaagctgaagaacctgagaagaaagcagagaagaagagagagatggctgcagaagcagggcaagtacagcggcgtgggcctgctggaccacatggtgagcatctacctgctgatctag

SEQ ID NO: 21689 - DNA, 291 bp, Artificial Sequence
  Description of Artificial Sequence: Synthetic coding sequence
atgaagagaagcaaggagctgatcaccaagaaccacagccaggaggagaccagcatcctgagatgctggaagtgcagaaagtgcatcgccagcagcggctgcttcatggagtacctggagaaccaggtgatcaaggacaaggacgacagcgtggacgcccagaacatctgccacgtgtggcacatgaacgtggaggccctgcccgagtggatcagctgcctgatccagaagggcaagtacagcggcgtgggcctgctggaccacatggtgagcatctacctgctgatctag

SEQ ID NO: 21690 - DNA, 1779 bp, Artificial Sequence
  Description of Artificial Sequence: Synthetic coding sequence
atgaagagaagcaaggagctgatcaccaagaaccacagccaggaggagaccagcatcctgagatgctggaagtgcagaaagtgcatcgccagcagcggctgcttcatggagtacctggagaaccaggtgatcaaggacaaggacgacagcgtggacgcccagaacatctgccacgtgtggcacatgaacgtggaggccctgcccgagtggatcagctgcctgatccagaaggcccagtggaccgtgggcaagctgaactgccccttctgcggcgccagactgggcggcttcaacttcgtgagcacccccaagtgcagctgcggccagctggccgccgtgcacctgagcaagagcagaaccgactaccagcccacccaggccggcagactgatgagacccagcgtgaagtacctgagccaccccagagtgcagagcggctgcgacaaggaggccctgctgaccggcggcggcagcgagaacagaaaccacagactgctgaacatggccagaaacaacaacgaccccggcagactgaccgaggccctgtgcctggaggtgagacccacctacttcgagatgaagaacgagaagctgctgagcaaggccagcgagcccaagtaccagctgttcgtgccccagctggtgaccggcagatgcgccaccagagccttccacagaaagagccacagcctggacctgaacatcagcgagaagctgaccctgctgcccaccctgtacgagatccacagcaagaccaccgcctacagcagactgaacgagacccagcccatcgacctgagcggcctgcccctgcagagcagcaagaacagctacagcttccagaaccccagcagcttcgaccccagcatgctgctgcagagattcagcgtggccccccacgagacccagacccagagaggcggcgagttccagtgcggcctggaggccgccagcgtgtacagcgaccacaccaacaccaacaacctgaccttcctgatggacctgcccagcgccggcagaagcatgcccgaggccagcgaccaggaggagcacctgagccccctggacttcctgcacagcgccaacttcagcctgggcagcatcaaccagagactgaacaagagagagagaagcaagctgaagaacctgagaagaaagcagagaagaagagagagatggctgcagaagcagggcaagtacagcggcgtgggcctgctggaccacatgaccctgaacaacgagatgagcaccgacgaggacaacgagtacgccgaggagaaggacagctacatctgcgccgtgtgcctggacgtgtacttcaacccctacatgtgctacccctgccaccacatcttctgcgagccctgcctgagaaccctggccaaggacaaccccagcagcaccccctgccccctgtgcagaaccatcatcagcagagtgttcttccagaccgagctgaacaacgccaccaagaccttcttcaccaaggagtacctgaagatcaagcagagcttccagaagagcaacagcgccaagtggcccctgcccagctgcagaaaggccttccacctgttcggcggcttcagaagacacgccgcccccgtgaccagaagacagttcccccacggcgcccacagaatggactacctgcacttcgaggacgacagcagaggctggtggttcgacatggacatggtgatcatctacatctacagcgtgaactgggtgatcggcttcatcgtgttctgcttcctgtgctacttcttcttccccttctag

SEQ ID NO: 21691 - DNA, 324 bp, Artificial Sequence
  Description of Artificial Sequence: Synthetic coding sequence
atgaagagaagcaaggagctgatcaccaagaaccacagccaggaggagaccagcatcctgagatgctggaagtgcagaaagtgcatcgccagcagcggctgcttcatggagtacctggagaaccaggtgatcaaggacaaggacgacagcgtggacgcccagaacatctgccacgtgtggcacatgaacgtggaggccctgcccgagtggatcagctgcctgatccagaaggcccagtggaccgtgggcaagctgaactgccccttctgcggcgccagactgggcggcttcaacttcgtgagcacccccaagtgcagctgctag

SEQ ID NO: 21692 - DNA, 489 bp, Artificial Sequence
  Description of Artificial Sequence: Synthetic coding sequence
atggccagccagccccccgaggacaccgccgagagccaggccagcgacgagctggagtgcaagatctgctacaacagatacaacctgaagcagagaaagcccaaggtgctggagtgctgccacagagtgtgcgccaagtgcctgtacaagatcatcgacttcggcgacagcccccagggcgtgatcgtgtgccccttctgcagattcgagacctgcctgcccgacgacgaggtgagcagcctgcccgacgacaacaacatcctggtgaacctgacctgcggcggcaagggcaagaagtgcctgcccgagaaccccaccgagctgctgctgacccccaagagactggccagcctggtgagccccagccacaccagcagcaactgcctggtgatcaccatcatggaggtgcagagagagagcagccccagcctgagcagcacccccgtggtggagttctacagacccgccagcttcgacagcgtgacctag

SEQ ID NO: 21693 - DNA, 249 bp, Artificial Sequence
  Description of Artificial Sequence: Synthetic coding sequence
atggccagccagccccccgaggacaccgccgagagccaggccagcgacgagctggagtgcaagatctgctacaacagatacaacctgaagcagagaaagcccaaggtgctggagtgctgccacagagtgtgcgccaagtgcctgtacaagatcatcgacttcggcgacagcccccagggcgtgatcgtgtgccccttctgcagattcgagacctgcctgcccgacgacgaggtgagcagcctgccctag

SEQ ID NO: 21694 - DNA, 42 bp, Artificial Sequence
  Description of Artificial Sequence: Synthetic coding sequence
atggccagccagccccccgaggacaccgccgagagccagtag

SEQ ID NO: 21695 - DNA, 744 bp, Artificial Sequence
  Description of Artificial Sequence: Synthetic coding sequence
atggccagccagccccccgaggacaccgccgagagccaggccagcgacgagctggagtgcaagatctgctacaacagatacaacctgaagcagagaaagcccaaggtgctggagtgctgccacagagtgtgcgccaagtgcctgtacaagatcatcgacttcggcgacagcccccagggcgtgatcgtgtgccccttctgcagattcgagacctgcctgcccgacgacgaggtgagcagcctgcccgacgacaacaacatcctggtgaacctgacctgcggcggcaagggcaagaagtgcctgcccgagaaccccaccgagctgctgctgacccccaagagactggccagcctggtgagccccagccacaccagcagcaactgcctggtgatcaccatcatggaggtgcagagagagagcagccccagcctgagcagcacccccgtggtggagttctacagacccgccagcttcgacagcgtgaccaccgtgagccacaactggaccgtgtggaactgcaccagcctgctgttccagaccagcatcagagtgctggtgtggctgctgggcctgctgtacttcagcagcctgcccctgggcatctacctgctggtgagcaagaaggtgaccctgggcgtggtgttcgtgagcctggtgcccagcagcctggtgatcctgatggtgtacggcttctgccagtgcgtgtgccacgagttcctggactgcatggccccccccagctag

SEQ ID NO: 21696 - DNA, 156 bp, Artificial Sequence
  Description of Artificial Sequence: Synthetic coding sequence
atggccagccagccccccgaggacaccgccgagagccaggccagcgacgagctggagtgcaagatctgctacaacagatacaacctgaagcagagaaagcccaaggtgctggagtgctgccacagagtgtgcgccaagtgcctgtacaagatctag

SEQ ID NO: 21697 - DNA, 744 bp, Artificial Sequence; identical to SEQ ID NO: 21695
  Description of Artificial Sequence: Synthetic coding sequence

SEQ ID NO: 21698 - DNA, 744 bp, Artificial Sequence; identical to SEQ ID NO: 21695
  Description of Artificial Sequence: Synthetic coding sequence

SEQ ID NO: 21699 - DNA, 744 bp, Artificial Sequence; identical to SEQ ID NO: 21695
  Description of Artificial Sequence: Synthetic coding sequence

SEQ ID NO: 21700 - DNA, 579 bp, Artificial Sequence
  Description of Artificial Sequence: Synthetic coding sequence
atggccagcaagggccccagcgccagcgccagccccgagaacagcagcgccggcggccccagcggcagcagcaacggcgccggcgagagcggcggccaggacagcaccttcgagtgcaacatctgcctggacaccgccaaggacgccgtgatcagcctgtgcggccacctgttctgctggccctgcctgcaccagtggctggagaccagacccaacagacaggtgtgccccgtgtgcaaggccggcatcagcagagacaaggtgatccccctgtacggcagaggcagcaccggccagcaggaccccagagagaagaccccccccagaccccagggccagagacccgagcccgagaacagaggcggcttccagggcttcggcttcggcgacggcggcttccagatgagcttcggcatcggcgccttccccttcggcatcttcgccaccgccttcaacatcaacgacggcagacccccccccgccgtgcccggcaccccccagtacgtggacgagcagttcctgagcagactgttcctgttcgtggccctggtgatcatgttctggctgctgatcgcctag

SEQ ID NO: 21701 - DNA, 393 bp, Artificial Sequence
  Description of Artificial Sequence: Synthetic coding sequence
atggccctggccagagccgagggcagaaccgccctgagcagcgccaccagcgcctggacccagcccagaatgcccagcagcgcctgcgtggccaccagcagcgtgggcagagtgtacatcagagagaagaccccccccagaccccagggccagagacccgagcccgagaacagaggcggcttccagggcttcggcttcggcgacggcggcttccagatgagcttcggcatcggcgccttccccttcggcatcttcgccaccgccttcaacatcaacgacggcagacccccccccgccgtgcccggcaccccccagtacgtggacgagcagttcctgagcagactgttcctgttcgtggccctggtgatcatgttctggctgctgatcgcctag

SEQ ID NO: 21702 - DNA, 474 bp, Artificial Sequence
  Description of Artificial Sequence: Synthetic coding sequence
atggccagcaagggccccagcgccagcgccagccccgagaacagcagcgccggcggccccagcggcagcagcaacggcgccggcgagagcggcggccaggacagcaccttcgagtgcaacatctgcctggacaccgccaaggacgccgtgatcagcctgtgcggccacctgttctgctggccctgcctgcaccagtggctggagaccagacccaacagacaggtgtgccccgtgtgcaaggccggcatcagcagagacaaggtgatccccctgtacggcagaggcagcaccggccagcaggaccccagagagaagaccccccccagaccccagggccagagacccgagcccgagaacagaggcgtgagaaacatcctgggcgaggccagcaccaacgagctgatggccctggaggtgagcttcctggccctgcagttcttcagcctgatcatcaaggtgaaggagaacctgtag

SEQ ID NO: 21703 - DNA, 579 bp, Artificial Sequence; identical to SEQ ID NO: 21700
  Description of Artificial Sequence: Synthetic coding sequence

SEQ ID NO: 21704 - DNA, 411 bp, Artificial Sequence
  Description of Artificial Sequence: Synthetic coding sequence
atggccagcaagggccccagcgccagcgccagccccgagaacagcagcgccggcggccccagcggcagcagcaacggcgccggcgagagcggcggccaggacagcaccttcgagtgcaacatctgcctggacaccgccaaggacgccgtgatcagcctgtgcggccacctgttctgctggccctgcctgcaccagggcttccagggcttcggcttcggcgacggcggcttccagatgagcttcggcatcggcgccttccccttcggcatcttcgccaccgccttcaacatcaacgacggcagacccccccccgccgtgcccggcaccccccagtacgtggacgagcagttcctgagcagactgttcctgttcgtggccctggtgatcatgttctggctgctgatcgcctag

SEQ ID NO: 21705 - DNA, 2517 bp, Artificial Sequence
  Description of Artificial Sequence: Synthetic coding sequence
atgcaggagcaggagatcggcttcatcagcaagtacaacgagggcctgtgcgtgaacaccgaccccgtgagcatcctgaccagcatcctggacatgagcctgcacagacagatgggcagcgacagagacctgcagagcagcgccagcagcgtgagcctgcccagcgtgaagaaggcccccaagaagagaagaatcagcatcggcagcctgttcagaagaaagaaggacaacaagagaaagagcagagagctgaacggcggcgtggacggcatcgccagcatcgagagcatccacagcgagatgtgcaccgacaagaacagcatcttcagcaccaacaccagcagcgacaacggcctgaccagcatcagcaagcagatcggcgacttcatcgagtgccccctgtgcctgctgagacacagcaaggacagattccccgacatcatgacctgccaccacagaagctgcgtggactgcctgagacagtacctgagaatcgagatcagcgagagcagagtgaacatcagctgccccgagtgcaccgagagattcaacccccacgacatcagactgatcctgagcgacgacgtgctgatggagaagtacgaggagttcatgctgagaagatggctggtggccgaccccgactgcagatggtgccccgcccccgactgcggctacgccgtgatcgccttcggctgcgccagctgccccaagctgacctgcggcagagagggctgcggcaccgagttctgctaccactgcaagcagatctggcaccccaaccagacctgcgacgccgccagacaggagagagcccagagcctgagactgagaaccatcagaagcagcagcatcagctacagccaggagagcggcgccgccgccgacgacatcaagccctgccccagatgcgccgcctacatcatcaagatgaacgacggcagctgcaaccacatgacctgcgccgtgtgcggctgcgagttctgctggctgtgcatgaaggagatcagcgacctgcactacctgagccccagcggctgcaccttctggggcaagaagccctggagcagaaagaagaagatcctgtggcagctgggcaccctggtgggcgcccccgtgggcatcgccctgatcgccggcatcgccatccccgccatgatcatcggcatccccgtgtacgtgggcagaaagatccacaacagatacgagggcaaggacgtgagcaagcacaagagaaacctggccatcgccggcggcgtgaccctgagcgtgatcgtgagccccgtggtggccgccgtgaccgtgggcatcggcgtgcccatcatgctggcctacgtgtacggcgtggtgcccatcagcctgtgcagaagcggcggctgcggcgtgagcgccggcaacggcaagggcgtgagaatcgagttcgacgacgagaacgacatcaacgtgggcggcaccaacaccgccgtggacaccaccagcgtggccgaggccagacacaaccccagcatcggcgagggcagcgtgggcggcctgaccggcagcctgagcgccagcggcagccacatggacagaatcggcgccatcagagacaacctgagcgagaccgccagcaccatggccctggccggcgccagcatcaccggcagcctgagcggcagcgccatggtgaactgcttcaacagactggaggtgcaggccgacgtgcagaaggagagatacagcctgagcggcgagagcggcaccgtgagcctgggcaccgtgagcgacaacgccagcaccaaggccatggccggcagcatcctgaacagctacatccccctggacaaggagggcaacagcatggaggtgcaggtggacatcgagagcaagcccagcaagttcagacacaacagcggcagcagcagcgtggacgacggcagcgccaccagaagccacgccggcggcagcagcagcggcctgcccgagggcaagagcagcgccaccaagtggagcaaggaggccaccgccggcaagaagagcaagagcggcaagctgagaaagaagggcaacatgaagatcaacgagaccagagaggacatggacgcccagctgctggagcagcagagcaccaacagcagcgagttcgaggcccccagcctgagcgacagcatgcccagcgtggccgacagccacagcagccacttcagcgagttcagctgcagcgacctggagagcatgaagaccagctgcagccacggcagcagcgactaccacaccagattcgccaccgtgaacatcctgcccgaggtggagaacgacagactggagaacagcccccaccagtgcagcatcagcgtggtgacccagaccgccagctgcagcgaggtgagccagctgaaccacatcgccgaggagcacggcaacaacggcatcaagcccaacgtggacctgtacttcggcgacgccctgaaggagaccaacaacaaccacagccaccagaccatggagctgaaggtggccatccagaccgagatctag

SEQ ID NO: 21706 - DNA, 270 bp, Artificial Sequence
  Description of Artificial Sequence: Synthetic coding sequence
atgcaggagcaggagatcggcttcatcagcaagtacaacgagggcctgtgcgtgaacaccgaccccgtgagcatcctgaccagcatcctggacatgagcctgcacagacagatgggcagcgacagagacctgcagagcagcgccagcagcgtgagcctgcccagcgtgaagaaggcccccaagaagagaagaatcagcatcggcagcctgttcagaagaaagaaggacaacaagagaaagagcagagagctgaacggcggcgtggactag

SEQ ID NO: 21707 - DNA, 2517 bp, Artificial Sequence; identical to SEQ ID NO: 21705
  Description of Artificial Sequence: Synthetic coding sequence

SEQ ID NO: 21708 - DNA, 498 bp, Artificial Sequence
  Description of Artificial Sequence: Synthetic coding sequence
atgcaggagcaggagatcggcttcatcagcaagtacaacgagggcctgtgcgtgaacaccgaccccgtgagcatcctgaccagcatcctggacatgagcctgcacagacagatgggcagcgacagagacctgcagagcagcgccagcagcgtgagcctgcccagcgtgaagaaggcccccaagaagagaagaatcagcatcggcagcctgttcagaagaaagaaggacaacaagagaaagagcagagagctgaacggcggcgtggacggcatcgccagcatcgagagcatccacagcgagatgtgcaccgacaagaacagcatcttcagcaccaacaccagcagcgacaacggcctgaccagcatcagcaagcagatcggcgacttcatcgagtgccccctgtgcctgctgagacacagcaaggacagattccccgacatcatgacctgccaccacagaagctgcgtggactgcctgagacagtacctgagaatctag

SEQ ID NO: 21709 - DNA, 342 bp, Artificial Sequence
  Description of Artificial Sequence: Synthetic coding sequence
atgcaggagcaggagatcggcttcatcagcaagtacaacgagggcctgtgcgtgaacaccgaccccgtgagcatcctgaccagcatcctggacatgagcctgcacagacagatgggcagcgacagagacctgcagagcagcgccagcagcgtgagcctgcccagcgtgaagaaggcccccaagaagagaagaatcagcatcggcagcctgttcagaagaaagaaggacaacaagagaaagagcagagagctgaacggcggcgtggacggcatcgccagcatcgagagcatccacagcgagatgtgcaccgacaagaacagcatcttcagcaccaacacctag

SEQ ID NO: 21710 - DNA, 471 bp, Artificial Sequence
  Description of Artificial Sequence: Synthetic coding sequence
atgcaggagcaggagatcggcttcatcagcaagtacaacgagggcctgtgcgtgaacaccgaccccgtgagcatcctgaccagcatcctggacatgagcctgcacagacagatgggcagcgacagagacctgcagagcagcgccagcagcgtgagcctgcccagcgtgaagaaggcccccaagaagagaagaatcagcatcggcagcctgttcagaagaaagaaggacaacaagagaaagagcagagagctgaacggcggcgtggacggcatcgccagcatcgagagcatccacagcgagatgtgcaccgacaagaacagcatcttcagcaccaacaccagcagcgacaacggcctgaccagcatcagcaagcagatcggcgacttcatcgagtgccccctgtgcctgctgagacacagcaaggacagattccccgacatcatgacctgccaccacagaagctgcgtgtag

SEQ ID NO: 21711 - DNA, 48 bp, Artificial Sequence
  Description of Artificial Sequence: Synthetic coding sequence
atgcaggagcaggagatcggcttcatcagcaagtacaacgagggctag

SEQ ID NO: 21712 - DNA, 1029 bp, Artificial Sequence
  Description of Artificial Sequence: Synthetic coding sequence
atgagaaaggagacccccccccccctggtgccccccgccgccagagagtggaacctgccccccaacgcccccgcctgcatggagagacagctggaggccgccagatacagaagcgacggcgccctgctgctgggcgccagcagcctgagcggcagatgctgggccggcagcctgtggctgttcaaggacccctgcgccgcccccaacgagggcttctgcagcgccggcgtgcagaccgaggccggcgtggccgacctgacctgggtgggcgagagaggcatcctggtggccagcgacagcggcgccgtggagctgtgggagctggacgagaacgagaccctgatcgtgagcaagttctgcaagtacgagcacgacgacatcgtgagcaccgtgagcgtgctgagcagcggcacccaggccgtgagcggcagcaaggacatctgcatcaaggtgtgggacctggcccagcaggtggtgctgagcagctacagagcccacgccgcccaggtgacctgcgtggccgccagcccccacaaggacagcgtgttcctgagctgcagcgaggacaacagaatcctgctgtgggacaccagatgccccaagcccgccagccagatcggctgcagcgcccccggctacctgcccaccagcctggcctggcacccccagcagagcgaggtgttcgtgttcggcgacgagaacggcaccgtgagcctggtggacaccaagagcaccagctgcgtgctgagcagcgccgtgcacagccagtgcgtgaccggcctggtgttcagcccccacagcgtgcccttcctggccagcctgagcgaggactgcagcctggccgtgctggacagcagcctgagcgagctgttcagaagccaggcccacagagacttcgtgagagacgccacctggagccccctgaaccacagcctgctgaccaccgtgggctgggaccaccaggtggtgcaccacgtggtgcccaccgagcccctgcccgcccccggccccgccagcgtgaccgagtag

SEQ ID NO: 21713 - DNA, 1764 bp, Artificial Sequence
  Description of Artificial Sequence: Synthetic coding sequence
atgggcagcgagaaggacagcgagagccccagaagcaccagcctgcacgccgccgcccccgaccccaagtgcagaagcggcggcagaagaagaagactgaccctgcacagcgtgttcagcgccagcgccagaggcagaagagccagagccaagccccaggccgagccccccccccccgccgcccagcccccccccgcccccgcccccgccgccgcccagggccccccccccgaggccctgcccgccgagcccgccgccgaggccgaggccgaggccgccgccgccgccgccgagcccggcttcgacgacgaggaggccgccgagggcggcggccccggcgccgaggaggtggagtgccccctgtgcctggtgagactgccccccgagagagcccccagactgctgagctgcccccacagaagctgcagagactgcctgagacactacctgagactggagatcagcgagagcagagtgcccatcagctgccccgagtgcagcgagagactgaacccccacgacatcagactgctgctggccgacccccccctgatgcacaagtacgaggagttcatgctgagaagatacctggccagcgaccccgactgcagatggtgccccgcccccgactgcggctacgccgtgatcgcctacggctgcgccagctgccccaagctgacctgcgagagagagggctgccagaccgagttctgctaccactgcaagcagatctggcaccccaaccagacctgcgacatggccagacagcagagagcccagaccctgagagtgagaaccaagcacaccagcggcctgagctacggccaggagagcggccccgacgacatcaagccctgccccagatgcagcgcctacatcatcaagatgaacgacggcagctgcaaccacatgacctgcgccgtgtgcggctgcgagttctgctggctgtgcatgaaggagatcagcgacctgcactacctgagccccagcggctgcaccttctggggcaagaagccctggagcagaaagaagaagatcctgtggcagctgggcaccctgatcggcgcccccgtgggcatcagcctgatcgccggcatcgccatccccgccatggtgatcggcatccccgtgtacgtgggcagaaagatccacagcagatacgagggcagaaagaccagcaagcacaagagaaacctggccatcaccggcggcgtgaccctgagcgtgatcgccagccccgtgatcgccgccgtgagcgtgggcatcggcgtgcccatcatgctggcctacgtgtacggcgtggtgcccatcagcctgtgcagaggcggcggctgcggcgtgagcaccgccaacggcaagggcgtgaagatcgagttcgacgaggacgacggccccatcaccgtggccgacgcctggagagccctgaagaaccccagcatcggcgagagcagcatcgagggcctgaccagcgtgctgagcaccagcggcagccccaccgacggcctgagcgtgatgcagggcccctacagcgagaccgccagcttcgccgccctgagcggcggcaccctgagcggcggcatcctgagcagcggcaagggcaagtacagcagactggaggtgcaggccgacgtgcagaaggagatcttccccaaggacaccgccagcctgggcgccatcagcgacaacgccagcaccagagccatggccggcagcatcatcagcagctacaacccccaggacagattcagcatgatccacgcctag

SEQ ID NO: 21714 - DNA, 2199 bp, Artificial Sequence
  Description of Artificial Sequence: Synthetic coding sequence
atgggcagcgagaaggacagcgagagccccagaagcaccagcctgcacgccgccgcccccgaccccaagtgcagaagcggcggcagaagaagaagactgaccctgcacagcgtgttcagcgccagcgccagaggcagaagagccagagccaagccccaggccgagccccccccccccgccgcccagcccccccccgcccccgcccccgccgccgcccagggccccccccccgaggccctgcccgccgagcccgccgccgaggccgaggccgaggccgccgccgccgccgccgagcccggcttcgacgacgaggaggccgccgagggcggcggccccggcgccgaggaggtggagtgccccctgtgcctggtgagactgccccccgagagagcccccagactgctgagctgcccccacagaagctgcagagactgcctgagacactacctgagactggagatcagcgagagcagagtgcccatcagctgccccgagtgcagcgagagactgaacccccacgacatcagactgctgctggccgacccccccctgatgcacaagtacgaggagttcatgctgagaagatacctggccagcgaccccgactgcagatggtgccccgcccccgactgcggctacgccgtgatcgcctacggctgcgccagctgccccaagctgacctgcgagagagagggctgccagaccgagttctgctaccactgcaagcagatctggcaccccaaccagacctgcgacatggccagacagcagagagcccagaccctgagagtgagaaccaagcacaccagcggcctgagctacggccaggagagcggccccgccgacgacatcaagccctgccccagatgcagcgcctacatcatcaagatgaacgacggcagctgcaaccacatgacctgcgccgtgtgcggctgcgagttctgctggctgtgcatgaaggagatcagcgacctgcactacctgagccccagcggctgcaccttctggggcaagaagccctggagcagaaagaagaagatcctgtggcagctgggcaccctgatcggcgcccccgtgggcatcagcctgatcgccggcatcgccatccccgccatggtgatcggcatccccgtgtacgtgggcagaaagatccacagcagatacgagggcagaaagaccagcaagcacaagagaaacctggccatcaccggcggcgtgaccctgagcgtgatcgccagccccgtgatcgccgccgtgagcgtgggcatcggcgtgcccatcatgctggcctacgtgtacggcgtggtgcccatcagcctgtgcagaggcggcggctgcggcgtgagcaccgccaacggcaagggcgtgaagatcgagttcgacgaggacgacggccccatcaccgtggccgacgcctggagagccctgaagaaccccagcatcggcgagagcagcatcgagggcctgaccagcgtgctgagcaccagcggcagccccaccgacggcctgagcgtgatgcagggcccctacagcgagaccgccagcttcgccgccctgagcggcggcaccctgagcggcggcatcctgagcagcggcaagggcaagtacagcagactggaggtgcaggccgacgtgcagaaggagatcttccccaaggacaccgccagcctgggcgccatcagcgacaacgccagcaccagagccatggccggcagcatcatcagcagctacaacccccaggacagagagtgcaacaacatggagatccaggtggacatcgaggccaagcccagccactaccagctggtgagcggcagcagcaccgaggacagcctgcacgtgcacgcccagatggccgagaacgaggaggagggcagcggcggcggcggcagcgaggaggaccccccctgcagacaccagagctgcgagcagaaggactgcctggccagcaagccctgggacatcagcctggcccagcccgagagcatcagaagcgacctggagagcagcgacgcccagagcgacgacgtgcccgacatcaccagcgacgagtgcggcagccccagaagccacaccgccgcctgccccagcacccccagagcccagggcgcccccagccccagcgcccacatgaacctgagcgccctggccgagggccagaccgtgctgaagcccgagggcggcgaggccagagtgtag

SEQ ID NO: 21715 - DNA, 1461 bp, Artificial Sequence
  Description of Artificial Sequence: Synthetic coding sequence
atgggcagcgagaaggacagcgagagccccagaagcaccagcctgcacgccgccgcccccgaccccaagtgcagaagcggcggcagaagaagaagactgctgagctgcccccacagaagctgcagagactgcctgagacactacctgagactggagatcagcgagagcagagtgcccatcagctgccccgagtgcagcgagagactgaacccccacgacatcagactgctgctggccgacccccccctgatgcacaagtacgaggagttcatgctgagaagatacctggccagcgaccccgactgcagatggtgccccgcccccgactgcggctacgccgtgatcgcctacggctgcgccagctgccccaagctgacctgcgagagagagggctgccagaccgagttctgctaccactgcaagcagatctggcaccccaaccagacctgcgacatggccagacagcagagagcccagaccctgagagtgagaaccaagcacaccagcggcctgagctacggccaggagagcggccccgacgacatcaagccctgccccagatgcagcgcctacatcatcaagatgaacgacggcagctgcaaccacatgacctgcgccgtgtgcggctgcgagttctgctggctgtgcatgaaggagatcagcgacctgcactacctgagccccagcggctgcaccttctggggcaagaagccctggagcagaaagaagaagatcctgtggcagctgggcaccctgatcggcgcccccgtgggcatcagcctgatcgccggcatcgccatccccgccatggtgatcggcatccccgtgtacgtgggcagaaagatccacagcagatacgagggcagaaagaccagcaagcacaagagaaacctggccatcaccggcggcgtgaccctgagcgtgatcgccagccccgtgatcgccgccgtgagcgtgggcatcggcgtgcccatcatgctggcctacgtgtacggcgtggtgcccatcagcctgtgcagaggcggcggctgcggcgtgagcaccgccaacggcaagggcgtgaagatcgagttcgacgaggacgacggccccatcaccgtggccgacgcctggagagccctgaagaaccccagcatcggcgagagcagcatcgagggcctgaccagcgtgctgagcaccagcggcagccccaccgacggcctgagcgtgatgcagggcccctacagcgagaccgccagcttcgccgccctgagcggcggcaccctgagcggcggcatcctgagcagcggcaagggcaagtacagcagactggaggtgcaggccgacgtgcagaaggagatcttccccaaggacaccgccagcctgggcgccatcagcgacaacgccagcaccagagccatggccggcagcatcatcagcagctacaacccccaggacagaagcagcatgccccacgtgtag

SEQ ID NO: 21716 - DNA, 1134 bp, Artificial Sequence
  Description of Artificial Sequence: Synthetic coding sequence
atgggccccgccgccagacccgccctgagaagccccccccccccccccccccccccccccagccccctgctgctgctgctgcccctgctgcccctgtggctgggcctggccggccccggcgccgccgccgacggcagcgagcccgccgccggcgccggcagaggcggcgccagagccgtgagagtggacgtgagactgcccagacaggacgccctggtgctggagggcgtgagaatcggcagcgaggccgaccccgcccccctgctgggcggcagactgctgctgatggacatcgtggacgccgagcaggaggcccccgtggagggctggatcgccgtggcctacgtgggcaaggagcaggccgcccagttccaccaggagaacaagggcagcggcccccaggcctaccccaaggccctggtgcagcagatgagaagagccctgttcctgggcgccagcgccctgctgctgctgatcctgaaccacaacgtggtgagagagctggacatcagccagctgctgctgagacccgtgatcgtgctgcactacagcagcaacgtgaccaagctgctggacgccctgctgcagagaacccaggccaccgccgagatcaccagcggcgagagcctgagcgccaacatcgagtggaagctgaccctgtggaccacctgcggcctgagcaaggacggctacggcggctggcaggacctggtgtgcctgggcggcagcagagcccaggagcagaagcccctgcagcagctgtggaacgccatcctgctggtggccatgctgctgtgcaccggcctggtggtgcaggcccagagacaggccagcagacagagccagagagagctgggcggccaggtggacctgttcaagagaagagtggtgagaagactggccagcctgaagaccagaagatgcagactgagcagagccgcccagggcctgcccgaccccggcgccgagacctgcgccgtgtgcctggactacttctgcaacaagcagtggctgagagtgctgccctgcaagcacgagttccacagagactgcgtggacccctggctgatgctgcagcagacctgccccctgtgcaagttcaacgtgctgggcaacagatacagcgacgactag

SEQ ID NO: 21717 - DNA, 561 bp, Artificial Sequence
  Description of Artificial Sequence: Synthetic coding sequence
atggccccctgcaccgagaccaagatcttcgtgctgtgcgacgagcagatccagtgccccacctgccagttcgtgtggtgcttcaagtgccacagcccctggcacgagggcgtgaactgcaaggagtacaagaagggcgacaagctgctgagacactgggccagcgagatcgagcacggccagagaaacgcccagaagtgccccaagtgcaagatccacatccagagaaccgagggctgcgaccacatgacctgcagccagtgcaacaccaacttctgctacagatgcggcgagagatacagacagctgagattcttcggcgaccacaccagcaacctgagcatcttcggctgcaagtacagatacctgcccgagagaccccacctgagaagactggtgagaggcagcgtgtgcgccggcaagctgttcatcgcccccctgatcatggtgctgggcctggccctgggcgccatcgccgtggtgatcggcctgttcgtgttccccatctactgcctgtgcaagaagcagagaaagagaagcagaaccggcatgcactggtag

SEQ ID NO: 21718 - DNA, 828 bp, Artificial Sequence
  Description of Artificial Sequence: Synthetic coding sequence
atgaaggtgcagctgggccaggtggagatcaagtgccccatcaccgagtgcttcgagttcctggaggagaccaccgtggtgtacaacctgacccacgaggacagcatcaagtacaagtacttcctggagctgggcagaatcgacagcagcaccaagccctgcccccagtgcaagcacttcaccaccttcaagaagaagggccacatccccacccccagcagaagcgagagcaagtacaagatccagtgccccacctgccagttcgtgtggtgcttcaagtgccacagcccctggcacgagggcgtgaactgcaaggagtacaagaagggcgacaagctgctgagacactgggccagcgagatcgagcacggccagagaaacgcccagaagtgccccaagtgcaagatccacatccagagaaccgagggctgcgaccacatgacctgcagccagtgcaacaccaacttctgctacagatgcggcgagagatacagacagctgagattcttcggcgaccacaccagcaacctgagcatcttcggctgcaagtacagatacctgcccgagagaccccacctgagaagactggtgagaggcagcgtgtgcgccggcaagctgttcatcgcccccctgatcatggtgctgggcctggccctgggcgccatcgccgtggtgatcgtggaggagatcaagacctactggaacctgatcagcggcagaaccagaaaccagacccagcacctggccccccagcccgtgctgctgagcgacatgctgtactgcctgaagcaggtgttcatctgcatcagctacctgctgcccctgtag

SEQ ID NO: 21719 - DNA, 9 bp, Artificial Sequence
  Description of Artificial Sequence: Synthetic coding sequence
atgaagtag

SEQ ID NO: 21720 - DNA, 924 bp, Artificial Sequence
  Description of Artificial Sequence: Synthetic coding sequence
atgcccagcctgctgggcgcccccccctacagcggcctgggcggcgtgggcgacccctacgtgcccctgatggtgctgatgtgcagagtgtgcctggaggacaagcccatcaagcccctgccctgctgcaagaaggccgtgtgcgaggagtgcctgaaggtgtacctgagcgcccaggtgcagctgggccaggtggagatcaagtgccccatcaccgagtgcttcgagttcctggaggagaccaccgtggtgtacaacctgacccacgaggacagcatcaagtacaagtacttcctggagctgggcagaatcgacagcagcaccaagccctgcccccagtgcaagcacttcaccaccttcaagaagaagggccacatccccacccccagcagaagcgagagcaagtacaagatccagtgccccacctgccagttcgtgtggtgcttcaagtgccacagcccctggcacgagggcgtgaactgcaaggagtacaagaagggcgacaagctgctgagacactgggccagcgagatcgagcacggccagagaaacgcccagaagtgccccaagtgcaagatccacatccagagaaccgagggctgcgaccacatgacctgcagccagtgcaacaccaacttctgctacagatgcggcgagagatacagacagctgagattcttcggcgaccacaccagcaacctgagcatcttcggctgcaagtacagatacctgcccgagagaccccacctgagaagactggtgagaggcagcgtgtgcgccggcaagctgttcatcgcccccctgatcatggtgctgggcctggccctgggcgccatcgccgtggtgatcggcctgttcgtgttccccatctactgcctgtgcaagaagcagagaaagagaagcagaaccggcatgcactggtag

SEQ ID NO: 21721 - DNA, 750 bp, Artificial Sequence
  Description of Artificial Sequence: Synthetic coding sequence
atgagcagcggccagcaggtgtggcacaccgccgtgcccccccccagaagaagcagcagcatcgccagcatgcccagaagccccagcagcgccggcagccccagaagccccggcacccccggcagcgagagagtggccagccccctggagtgcagcatctgcttcagcggctacgacaacatcttcaagacccccaaggagctgagctgcacccacgtgttctgcctggagtgcctggccagactggccgccgcccagcccgtgggcagacccggcggcgaggccgtgccctgccccttctgcagacagcccaccgccgtgccccccgccggcgcccccgccctgtgcaccagcagacagctgcaggccagaatgcccgcccacctgagaagagaggagcccgtgtggctggagggcaccaagctgtgctgccagcccctgcccaccacccccggcagagagcccggcttcgtgtgcgtggacgtgggcctgagcaagcccgccgagccccccgcccccgccagagaccccgcccccagaagaggcagactggccagatgctgggccagatgcagagactggagaagaatggccctggtgagcgccctgctgctgatgctgttctgcgtggccctgtggcccgtgcagtgcgccctgaagaccggcaacctgagatgcctgcccctgccccccagaccccccgccaccagcaccgccgccagccccctgggccccctgaccgacaactag

SEQ ID NO: 21722 - DNA, 3006 bp, Artificial Sequence
  Description of Artificial Sequence: Synthetic coding sequence
atgagcggccccggcaacaagagagccgccggcgacggcggcagcggcccccccgagaagaagctgagcagagaggagaagaccaccaccaccctgatcgagcccatcagactgggcggcatcagcagcaccgaggagatggacctgaaggtgctgcagttcaagaacaagaagctggccgagagactggagcagagacaggcctgcgaggacgagctgagagagagaatcgagaagctggagaagagacaggccaccgacgacgccaccctgctgatcgtgaacagatactgggcccagctggacgagaccgtggaggccctgctgagatgccacgagagccagggcgagctgagcagcgcccccgaggcccccggcacccaggagggccccacctgcgacggcacccccctgcccgagcccggcaccagcgagctgagagaccccctgctgatgcagctgagaccccccctgagcgagcccgccctggccttcgtggtggccctgggcgccagcagcagcgaggaggtggagctggagctgcagggcagaatggagttcagcaaggccgccgtgagcagagtggtggaggccagcgacagactgcagagaagagtggaggagctgtgccagagagtgtacagcagaggcgacagcgagcccctgagcgaggccgcccaggcccacaccagagagctgggcagagagaacagaagactgcaggacctggccacccagctgcaggagaagcaccacagaatcagcctggagtacagcgagctgcaggacaaggtgaccagcgccgagaccaaggtgctggagatggagaccaccgtggaggacctgcagtgggacatcgagaagctgagaaagagagagcagaagctgaacaagcacctggccgaggccctggagcagctgaacagcggctactacgtgagcggcagcagcagcggcttccagggcggccagatcaccctgagcatgcagaagttcgagatgctgaacgccgagctggaggagaaccaggagctggccaacagcagaatggccgagctggagaagctgcaggccgagctgcagggcgccgtgagaaccaacgagagactgaaggtggccctgagaagcctgcccgaggaggtggtgagagagaccggcgagtacagaatgctgcaggcccagttcagcctgctgtacaacgagagcctgcaggtgaagacccagctggacgaggccagaggcctgctgctggccaccaagaacagccacctgagacacatcgagcacatggagagcgacgagctgggcctgcagaagaagctgagaaccgaggtgatccagctggaggacaccctggcccaggtgagaaaggagtacgagatgctgagaatcgagttcgagcagaacctggccgccaacgagcaggccggccccatcaacagagagatgagacacctgatcagcagcctgcagaaccacaaccaccagctgaagggcgacgcccagagatacaagagaaagctgagagaggtgcaggccgagatcggcaagctgagagcccaggccagcggcagcgcccacagcacccccaacctgggccaccccgaggacagcggcgtgagcgcccccgcccccggcaaggaggagggcggccccggccccgtgagcacccccgacaacagaaaggagatggcccccgtgcccggcaccaccaccaccaccaccagcgtgaagaaggaggagctggtgcccagcgaggaggacttccagggcatcacccccggcgcccagggccccagcagcagaggcagagagcccgaggccagacccaagagagagctgcaggagagagagggccccagcctgggccccccccccgtggccagcgccctgagcagagccgacagagagaaggccaaggtggaggagaccaagagaaaggagagcgagctgctgaagggcctgagagccgagctgaagaaggcccaggagagccagaaggagatgaagctgctgctggacatgtacaagagcgcccccaaggagcagagagacaaggtgcagctgatggccgccgagagaaaggccaaggccgaggtggacgagctgagaagcagaatcagagagctggaggagagagacagaagagagagcaagaagatcgccgacgaggacgccctgagaagaatcagacaggccgaggagcagatcgagcacctgcagagaaagctgggcgccaccaagcaggaggaggaggccctgctgagcgagatggacgtgaccggccaggccttcgaggacatgcaggagcagaacggcagactgctgcagcagctgagagagaaggacgacgccaacttcaagctgatgagcgagagaatcaaggccaaccagatccacaagctgctgagagaggagaaggacgagctgggcgagcaggtgctgggcctgaagagccaggtggacgcccagctgctgaccgtgcagaagctggaggagaaggagagagccctgcagggcagcctgggcggcgtggagaaggagctgaccctgagaagccaggccctggagctgaacaagagaaaggccgtggaggccgcccagctggccgaggacctgaaggtgcagctggagcacgtgcagaccagactgagagagatccagccctgcctggccgagagcagagccgccagagagaaggagagcttcaacctgaagagagcccaggaggacatcagcagactgagaagaaagctggagaagcagagaaaggtggaggtgtacgccgacgccgacgagatcctgcaggaggagatcaaggagtacaaggccagactgacctgcccctgctgcaacaccagaaagaaggacgccgtgctgaccaagtgcttccacgtgttctgcttcgagtgcgtgagaggcagatacgaggccagacagagaaagtgccccaagtgcaacgccgccttcggcgcccacgacttccacagaatctacatcagctag

SEQ ID NO: 21723 - DNA, 2706 bp, Artificial Sequence
  Description of Artificial Sequence: Synthetic coding sequence
atgagcggccccggcaacaagagagccgccggcgacggcggcagcggcccccccgagaagaagctgagcagagaggagaagaccaccaccaccctgatcgagcccatcagactgggcggcatcagcagcaccgaggagatggacctgaaggtgctgcagttcaagaacaagaagctggccgagagactggagcagagacaggcctgcgaggacgagctgagagagagaatcgagaagctggagaagagacaggccaccgacgacgccaccctgctgatcgtgaacagatactgggcccagctggacgagaccgtggaggccctgctgagatgccacgagagccagggcgagctgagcagcgcccccgaggcccccggcacccaggagggccccacctgcgacggcacccccctgcccgagcccggcaccagcgagctgagagaccccctgctgatgcagctgagaccccccctgagcgagcccgccctggccttcgtggtggccctgggcgccagcagcagcgaggaggtggagctggagctgcagggcagaatggagttcagcaaggccgccgtgagcagagtggtggaggccagcgacagactgcagagaagagtggaggagctgtgccagagagtgtacagcagaggcgacagcgagcccctgagcgaggccgcccaggcccacaccagagagctgggcagagagaacagaagactgcaggacctggccacccagctgcaggagaagcaccacagaatcagcctggagtacagcgagctgcaggacaaggtgaccagcgccgagaccaaggtgctggagatggagaccaccgtggaggacctgcagtgggacatcgagaagctgagaaagagagagcagaagctgaacaagcacctggccgaggccctggagcagctgaacagcggctactacgtgagcggcagcagcagcggcttccagggcggccagatcaccctgagcatgcagaagagcgacgagctgggcctgcagaagaagctgagaaccgaggtgatccagctggaggacaccctggcccaggtgagaaaggagtacgagatgctgagaatcgagttcgagcagaacctggccgccaacgagcaggccggccccatcaacagagagatgagacacctgatcagcagcctgcagaaccacaaccaccagctgaagggcgacgcccagagatacaagagaaagctgagagaggtgcaggccgagatcggcaagctgagagcccaggccagcggcagcgcccacagcacccccaacctgggccaccccgaggacagcggcgtgagcgcccccgcccccggcaaggaggagggcggccccggccccgtgagcacccccgacaacagaaaggagatggcccccgtgcccggcaccaccaccaccaccaccagcgtgaagaaggaggagctggtgcccagcgaggaggacttccagggcatcacccccggcgcccagggccccagcagcagaggcagagagcccgaggccagacccaagagagagctgcaggagagagagggccccagcctgggccccccccccgtggccagcgccctgagcagagccgacagagagaaggccaaggtggaggagaccaagagaaaggagagcgagctgctgaagggcctgagagccgagctgaagaaggcccaggagagccagaaggagatgaagctgctgctggacatgtacaagagcgcccccaaggagcagagagacaaggtgcagctgatggccgccgagagaaaggccaaggccgaggtggacgagctgagaagcagaatcagagagctggaggagagagacagaagagagagcaagaagatcgccgacgaggacgccctgagaagaatcagacaggccgaggagcagatcgagcacctgcagagaaagctgggcgccaccaagcaggaggaggaggccctgctgagcgagatggacgtgaccggccaggccttcgaggacatgcaggagcagaacggcagactgctgcagcagctgagagagaaggacgacgccaacttcaagctgatgagcgagagaatcaaggccaaccagatccacaagctgctgagagaggagaaggacgagctgggcgagcaggtgctgggcctgaagagccaggtggacgcccagctgctgaccgtgcagaagctggaggagaaggagagagccctgcagggcagcctgggcggcgtggagaaggagctgaccctgagaagccaggccctggagctgaacaagagaaaggccgtggaggccgcccagctggccgaggacctgaaggtgcagctggagcacgtgcagaccagactgagagagatccagccctgcctggccgagagcagagccgccagagagaaggagagcttcaacctgaagagagcccaggaggacatcagcagactgagaagaaagctggagaagcagagaaaggtggaggtgtacgccgacgccgacgagatcctgcaggaggagatcaaggagtacaaggccagactgacctgcccctgctgcaacaccagaaagaaggacgccgtgctgaccaagtgcttccacgtgttctgcttcgagtgcgtgagaggcagatacgaggccagacagagaaagtgccccaagtgcaacgccgccttcggcgcccacgacttccacagaatctacatcagctag

SEQ ID NO: 21724 - DNA, 2082 bp, Artificial Sequence
  Description of Artificial Sequence: Synthetic coding sequence
atgagcggccccggcaacaagagagccgccggcgacggcggcagcggcccccccgagaagaagctgagcagagaggagaagaccaccaccaccctgatcgagcccatcagactgggcggcatcagcagcaccgaggagatggacctgaaggtgctgcagttcaagaacaagaagctggccgagagactggagcagagacaggcctgcgaggacgagctgagagagagaatcgagaagctggagaagagacaggcccagttcagcctgctgtacaacgagagcctgcaggtgaagacccagctggacgaggccagaggcctgctgctggccaccaagaacagccacctgagacacatcgagcacatggagagcgacgagctgggcctgcagaagaagctgagaaccgaggtgatccagctggaggacaccctggcccaggtgagaaaggagtacgagatgctgagaatcgagttcgagcagaacctggccgccaacgagcaggccggccccatcaacagagagatgagacacctgatcagcagcctgcagaaccacaaccaccagctgaagggcgacgcccagagatacaagagaaagctgagagaggtgcaggccgagatcggcaagctgagagcccaggccagcggcagcgcccacagcacccccaacctgggccaccccgaggacagcggcgtgagcgcccccgcccccggcaaggaggagggcggccccggccccgtgagcacccccgacaacagaaaggagatggcccccgtgcccggcaccaccaccaccaccaccagcgtgaagaaggaggagctggtgcccagcgaggaggacttccagggcatcacccccggcgcccagggccccagcagcagaggcagagagcccgaggccagacccaagagagagctgcaggagagagagggccccagcctgggccccccccccgtggccagcgccctgagcagagccgacagagagaaggccaaggtggaggagaccaagagaaaggagagcgagctgctgaagggcctgagagccgagctgaagaaggcccaggagagccagaaggagatgaagctgctgctggacatgtacaagagcgcccccaaggagcagagagacaaggtgcagctgatggccgccgagagaaaggccaaggccgaggtggacgagctgagaagcagaatcagagagctggaggagagagacagaagagagagcaagaagatcgccgacgaggacgccctgagaagaatcagacaggccgaggagcagatcgagcacctgcagagaaagctgggcgccaccaagcaggaggaggaggccctgctgagcgagatggacgtgaccggccaggccttcgaggacatgcaggagcagaacggcagactgctgcagcagctgagagagaaggacgacgccaacttcaagctgatgagcgagagaatcaaggccaaccagatccacaagctgctgagagaggagaaggacgagctgggcgagcaggtgctgggcctgaagagccaggtggacgcccagctgctgaccgtgcagaagctggaggagaaggagagagccctgcagggcagcctgggcggcgtggagaaggagctgaccctgagaagccaggccctggagctgaacaagagaaaggccgtggaggccgcccagctggccgaggacctgaaggtgcagctggagcacgtgcagaccagactgagagagatccagccctgcctggccgagagcagagccgccagagagaaggagagcttcaacctgaagagagcccaggaggacatcagcagactgagaagaaagctggagaagcagagaaaggtggaggtgtacgccgacgccgacgagatcctgcaggaggagatcaaggagtacaaggccagactgacctgcccctgctgcaacaccagaaagaaggacgccgtgctgaccaagtgcttccacgtgttctgcttcgagtgcgtgagaggcagatacgaggccagacagagaaagtgccccaagtgcaacgccgccttcggcgcccacgacttccacagaatctacatcagctag

SEQ ID NO: 21725 - DNA, 693 bp, Artificial Sequence
  Description of Artificial Sequence: Synthetic coding sequence
atgcagctgagaccccccctgagcgagcccgccctggccttcgtggtggccctgggcgccagcagcagcgaggaggtggagctggagctgcagggcagaatggagttcagcaaggccgccgtgagcagagtggtggaggccagcgacagactgcagagaagagtggaggagctgtgccagagagtgtacagcagaggcgacagcgagcccctgagcgaggccgcccaggcccacaccagagagctgggcagagagaacagaagactgcaggacctggccacccagctgcaggagaagcaccacagaatcagcctggagtacagcgagctgcaggacaaggtgaccagcgccgagaccaaggtgctggagatggagaccaccgtggaggacctgcagtgggacatcgagaagctgagaaagagagagcagaagctgaacaagcacctggccgaggccctggagcagctgaacagcggctactacgtgagcggcagcagcagcggcttccagggcggccagatcaccctgagcatgcagaagttcgagatgctgaacgccgagctggaggagaaccaggagctggccaacagcagaatggccgagctggagaagctgcaggccgagctgcagggcgccgtgagaaccaacttccagagcttccagctggaggagctgccccccgacaccctgtag

SEQ ID NO: 21726 - DNA, 924 bp, Artificial Sequence
  Description of Artificial Sequence: Synthetic coding sequence
atgaagctgctgctggacatgtacaagagcgcccccaaggagcagagagacaaggtgcagctgatggccgccgagagaaaggccaaggccgaggtggacgagctgagaagcagaatcagagagctggaggagagagacagaagagagagcaagaagatcgccgacgaggacgccctgagaagaatcagacaggccgaggagcagatcgagcacctgcagagaaagctgggcgccaccaagcaggaggaggaggccctgctgagcgagatggacgtgaccggccaggccttcgaggacatgcaggagcagaacggcagactgctgcagcagctgagagagaaggacgacgccaacttcaagctgatgagcgagagaatcaaggccaaccagatccacaagctgctgagagaggagaaggacgagctgggcgagcaggtgctgggcctgaagagccaggtggacgcccagctgctgaccgtgcagaagctggaggagaaggagagagccctgcagggcagcctgggcggcgtggagaaggagctgaccctgagaagccaggccctggagctgaacaagagaaaggccgtggaggccgcccagctggccgaggacctgaaggtgcagctggagcacgtgcagaccagactgagagagatccagccctgcctggccgagagcagagccgccagagagaaggagagcttcaacctgaagagagcccaggaggacatcagcagactgagaagaaagctggagaagcagagaaaggtggaggtgtacgccgacgccgacgagatcctgcaggaggagatcaaggagtacaaggtgggcctgtgggccaagctgtgccccatccacctgagaatcgtggacgccggcctgctgagactggtggagagcctgggcaccctggaggtgatgtag

SEQ ID NO: 21727 - DNA, 1308 bp, Artificial Sequence
  Description of Artificial Sequence: Synthetic coding sequence
atgcccctgttcctgctgagcctgcccaccccccccagcgccagcggccacgagagaagacagagacccgaggccaagaccagcggcagcgagaagaagtacctgagagccatgcaggccaacagaagccagctgcacagcccccccggcaccggcagcagcgaggacgccagcaccccccagtgcgtgcacaccagactgaccggcgagggcagctgcccccacagcggcgacgtgcacatccagatcaacagcatccccaaggagtgcgccgagaacgccagcagcagaaacatcagaagcggcgtgcacagctgcgcccacggctgcgtgcacagcagactgagaggccacagccacagcgaggccagactgaccgacgacaccgccgccgagagcggcgaccacggcagcagcagcttcagcgagttcagatacctgttcaagtggctgcagaagagcctgccctacatcctgatcctgagcgtgaagctggtgatgcagcacatcaccggcatcagcctgggcatcggcctgctgaccaccttcatgtacgccaacaagagcatcgtgaaccaggtgttcctgagagagagaagcagcaagatccagtgcgcctggctgctggtgttcctggccggcagcagcgtgctgctgtactacaccttccacagccagagcctgtactacagcctgatcttcctgaaccccaccctggaccacctgagcttctgggaggtgttctggatcgtgggcatcaccgacttcatcctgaagttcttcttcatgggcctgaagtgcctgatcctgctggtgcccagcttcatcatgcccttcaagagcaagggctactggtacatgctgctggaggagctgtgccagtactacagaaccttcgtgcccatccccgtgtggttcagatacctgatcagctacggcgagttcggcaacgtgaccagatggagcctgggcatcctgctggccctgctgtacctgatcctgaagctgctggagttcttcggccacctgagaaccttcagacaggtgctgagaatcttcttcacccagcccagctacggcgtggccgccagcaagagacagtgcagcgacgtggacgacatctgcagcatctgccaggccgagttccagaagcccatcctgctgatctgccagcacatcttctgcgaggagtgcatgaccctgtggttcaacagagagaagacctgccccctgtgcagaaccgtgatcagcgaccacatcaacaagtggaaggacggcgccaccagcagccacctgcagatctactag

SEQ ID NO: 21728 - DNA, 408 bp, Artificial Sequence
  Description of Artificial Sequence: Synthetic coding sequence
atgcaggccaacagaagccagctgcacagcccccccggcaccggcagcagcgaggacgccagcaccccccagtgcgtgcacaccagactgaccggcgagggcagctgcccccacagcggcgacgtgcacatccagatcaacagcatccccaaggagtgcgccgagaacgccagcagcagaaacatcagaagcggcgtgcacagctgcgcccacggctgcgtgcacagcagactgagaggccacagccacagcgaggccagactgaccgacgacaccgccgccgagagcggcgaccacggcagcagcagcttcagcgagttcagatacctgttcaagtggctgcagaagagcctgccctacatcctgatcctgagcgtgaagctggtgatgcagcacatcaccgcctag

SEQ ID NO: 21729 - DNA, 1335 bp, Artificial Sequence
  Description of Artificial Sequence: Synthetic coding sequence
atgtggctgttcaccgtgaaccaggtgctgagaaagatgcagagaagacacagcagcaacaccgacaacatcccccccgagagaaacagaagccaggccctgagcagcgaggccagcgtggacgagggcggcgtgttcgagagcctgaaggccgaggccgccagcccccccgccctgttcagcggcctgagcggcagcctgcccaccagcagcttccccagcagcctggtgctgggcagcagcgccggcggcggcgacgtgttcatccagatgcccgccagcagagaggagggcggcggcagaggcgagggcggcgcctaccaccacagacagccccaccaccacttccaccacggcggccacagaggcggcagcctgctgcagcacgtgggcggcgaccacagaggccacagcgaggagggcggcgacgagcagcccggcacccccgcccccgccctgagcgagctgaaggccgtgatctgctggctgcagaagggcctgcccttcatcctgatcctgctggccaagctgtgcttccagcacaagctgggcatcgccgtgtgcatcggcatggccagcaccttcgcctacgccaacagcaccctgagagagcaggtgagcctgaaggagaagagaagcgtgctggtgatcctgtggatcctggccttcctggccggcaacaccctgtacgtgctgtacaccttcagcagccagcagctgtacaacagcctgatcttcctgaagcccaacctggagatgctggacttcttcgacctgctgtggatcgtgggcatcgccgacttcgtgctgaagtacatcaccatcgccctgaagtgcctgatcgtggccctgcccaagatcatcctggccgtgaagagcaagggcaagttctacctggtgatcgaggagctgagccagctgttcagaagcctggtgcccatccagctgtggtacaagtacatcatgggcgacgacagcagcaacagctacttcctgggcggcgtgctgatcgtgctgtacagcctgtgcaagagcttcgacatctgcggcagagtgggcggcgtgagaaaggccctgaagctgctgtgcaccagccagaactacggcgtgagagccaccggccagcagtgcaccgaggccggcgacatctgcgccatctgccaggccgagttcagagagcccctgatcctgctgtgccagcacgtgttctgcgaggagtgcctgtgcctgtggctggacagagagagaacctgccccctgtgcagaagcgtggccgtggacaccctgagatgctggaaggacggcgccaccagcgcccacttccaggtgtactag

SEQ ID NO: 21730 - DNA, 1335 bp, Artificial Sequence; identical to SEQ ID NO: 21729
  Description of Artificial Sequence: Synthetic coding sequence

SEQ ID NO: 21731 - DNA, 1263 bp, Artificial Sequence
  Description of Artificial Sequence: Synthetic coding sequence
atgtggctgttcaccgtgaaccaggtgctgagaaagatgcagagaagacacagcagcaacaccgacaacatcccccccgagagaaacagaagccaggccctgagcagcgaggccagcgtggacgagggcggcgtgttcgagagcctgaaggccgaggccgccagcccccccgccctgttcagcggcctgagcggcagcctgcccaccagcagcttccccagcagcctggtgctgggcagcagcgccggcggcggcgacgtgttcatccagatgcccgccagcagagaggagggcggcggcagaggcgagggcggcgcctaccaccacagacagccccaccaccacttccaccacggcggccacagaggcggcagcctgctgcagcacgtgggcggcgaccacagaggccacagcgaggagggcggcgacgagcagcccggcacccccgcccccgccctgagcgagctgaaggccgtgatctgctggctgcagaagggcctgcccttcatcctgatcctgctggccaagctgtgcttccagcacaagctgggcatcgccgtgtgcatcggcatggccagcaccttcgcctacgccaacagcaccctgagagagcaggtgagcctgaaggagaagagaagcgtgctggtgatcctgtggatcctggccttcctggccggcaacaccctgtacgtgctgtacaccttcagcagccagcagctgtacaacagcctgatcttcctgaagcccaacctggagatgctggacttcttcgacctgctgtggatcgtgggcatcgccgacttcgtgctgaagtacatcaccatcgccctgaagtgcctgatcgtggccctgcccaagatcatcctggccgtgaagagcaagggcaagttctacctggtgatcgaggagctgagccagctgttcagaagcctggtgcccatccagctgtggtacaagtacatcatgggcgacgacagcagcaacagctacttcctgggcggcgtgctgatcgtgctgtacagcctgtgcaagagcttcgacatctgcggcagagtgggcggcgtgagaaaggccctgaagctgctgtgcaccagccagaactacggcgtgagagccaccggccagcagtgcaccgaggccggcgacatctgcgccatctgccaggccgagttcagagagcccctgatcctgctgtgccagatgctgctgaagggccacaagaagctggagctggagaagatcgacgagagcgccggcgtgtag

SEQ ID NO: 21732 - DNA, 1212 bp, Artificial Sequence
  Description of Artificial Sequence: Synthetic coding sequence
atggccgccttcctgaagatgagcgtgagcgtgaacttcttcagacccttcaccagattcctggtgcccttcaccctgcacagaaagagaaacaacctgaccatcctgcagagatacatgagcagcaagatccccgccgtgacctaccccaagaacgagagcaccccccccagcgaggagctggagctggacaagtggaagaccaccatgaagagcagcgtgcaggaggagtgcgtgagcaccatcagcagcagcaaggacgaggaccccctggccgccaccagagagttcatcgagatgtggagactgctgggcagagaggtgcccgagcacatcaccgaggaggagctgaagaccctgatggagtgcgtgagcaacaccgccaagaagaagtacctgaagtacctgtacaccaaggagaaggtgaagaaggccagacagatcaagaaggagatgaaggccgccgccagagaggaggccaagaacatcaagctgctggagaccaccgaggaggacaagcagaagaacttcctgttcctgagactgtgggacagaaacatggacatcgccatgggctggaagggcgcccaggccatgcagttcggccagcccctggtgttcgacatggcctacgagaactacatgaagagaaaggagctgcagaacaccgtgagccagctgctggagagcgagggctggaacagaagaaacgtggaccccttccacatctacttctgcaacctgaagatcgacggcgccctgcacagagagctggtgaagagataccaggagaagtgggacaagctgctgctgaccagcaccgagaagagccacgtggacctgttccccaaggacagcatcatctacctgaccgccgacagccccaacgtgatgaccaccttcagacacgacaaggtgtacgtgatcggcagcttcgtggacaagagcatgcagcccggcaccagcctggccaaggccaagagactgaacctggccaccgagtgcctgcccctggacaagtacctgcagtgggagatcggcaacaagaacctgaccctggaccagatgatcagaatcctgctgtgcctgaagaacaacggcaactggcaggaggccctgcagttcgtgcccaagagaaagcacaccggcttcctggagatcagccagcacagccaggagttcatcaacagactgaagaaggccaagacctag

SEQ ID NO: 21733 - DNA, 939 bp, Artificial Sequence
  Description of Artificial Sequence: Synthetic coding sequence
atggccgccttcctgaagatgagcgtgagcgtgaacttcttcagacccttcaccagattcctggtgcccttcaccctgcacagaaagagaaacaacctgaccatcctgcagagatacatgagcagcaagatccccgccgtgacctaccccaagaacgagagcaccccccccagcgaggagctggagctggacaagtggaagaccaccatgaagagcagcgtgcaggaggagtgcgtgagcaccatcagcagcagcaaggacgaggaccccctggccgccaccagagagttcatcgagatgtggagactgctgggcagagaggtgcccgagcacatcaccgaggaggagctgaagaccctgatggagtgcgtgagcaacaccgccaagaagaagtacctgaagtacctgtacaccaaggagaaggtgaagaaggccagacagatcaagaaggagatgaaggccgccgccagagaggaggccaagaacatcaagctgctggagaccaccgaggaggacaagcagaagaacttcctgttcctgagactgtgggacagaaacatggacatcgccatgggctggaagggcgcccaggccatgcagttcggccagcccctggtgttcgacatggcctacgagaactacatgaagagaaaggagctgcagaacaccgtgagccagctgctggagagcgagggctggaacagaagaaacgtggaccccttccacatctacttctgcaacctgaagatcgacggcgccctgcacagagagctggtgaagagataccaggagaagtgggacaagctgctgctgaccagcaccgagaagagccacgtggacctgttccccaaggacagcatcatctacctgaccgccgacagccccaacgtgatgaccaccttcagacacgacaaggtgtacgtgatcggcagcttctag

SEQ ID NO: 21734 - DNA, 1134 bp, Artificial Sequence
  Description of Artificial Sequence: Synthetic coding sequence
atggccgcccccagatggagcgccagcggcccctggatcagaggcaacggccagggctgcggcagcctgttcaccctggtgagcaagcccttctgcgccgccgccgccgccagcaccgccatcaacgcccagagactggccgagaagctgagagcccagaagagagagcaggacaccaagaaggagcccgtgagcaccaacgccgtgcagagaagagtgcaggagatcgtgagattcaccagacagctgcagagagtgcaccccaacgtgctggccaaggccctgaccagaggcatcctgcaccaggacaagaacctggtggtgatcaacaagccctacggcctgcccgtgcacggcggccccggcgtgcagctgtgcatcaccgacgtgctgcccatcctggccaagatgctgcacggccacaaggccgagcccctgcacctgtgccacagactggacaaggagaccaccggcgtgatggtgctggcctgggacaaggacatggcccaccaggtgcaggagctgttcagaaccagacaggtggtgaagaagtactgggccatcaccgtgcacgtgcccatgcccagcgccggcgtggtggacatccccatcgtggagaaggaggcccagggccagcagcagcaccacaagatgaccctgagccccagctacagaatggacgacggcaagatggtgaaggtgagaagaagcagaaacgcccaggtggccgtgacccagtaccaggtgctgagcagcaccctgagcagcgccctggtggagctgcagcccatcaccggcatcaagcaccagctgagagtgcacctgagcttcggcctggactgccccatcctgggcgaccacaagtacagcgactggaacagactggccccccagaagctgagcgtgggcaccctgaagaagctgggcctggagcagagcaaggccagatacatccccctgcacctgcacgccagacagctgatcctgcccgccctgggcagcggcaaggaggagctgaacctggtgtgcaagctgcccagattcttcgtgcacagcctgcacagactgagactggagatgcccaacgaggaccagaacgagaacaacgaggccaagtgcctgggcgcccagtag

SEQ ID NO: 21735 - DNA, 1041 bp, Artificial Sequence
  Description of Artificial Sequence: Synthetic coding sequence
atggccgcccccagatggagcgccagcggcccctggatcagaggcaacggccagggctgcggcagcctgttcaccctggtgagcaagcccttctgcgccgccgccgccgccagcaccgccatcaacgcccagagactggccgagaagctgagagcccagaagagagagcaggacaccaagaaggagcccgtgagcaccaacgccgtgcagagaagagtgcaggagatcgtgagattcaccagacagctgcagagagtgcaccccaacgtgctggccaaggccctgaccagaggcatcctgcaccaggacaagaacctggtggtgatcaacaagccctacggcctgcccgtgcacggcggccccggcgtgcagctgtgcatcaccgacgtgctgcccatcctggccaagatgctgcacggccacaaggccgagcccctgcacctgtgccacagactggacaaggagaccaccggcgtgatggtgctggcctgggacaaggacatggcccaccaggtgcaggagctgttcagaaccagacaggtggtgaagaagtactgggccatcaccgtgcacgtgcccatgcccagcgccggcgtggtggacatccccatcgtggagaaggaggcccaggtggccgtgacccagtaccaggtgctgagcagcaccctgagcagcgccctggtggagctgcagcccatcaccggcatcaagcaccagctgagagtgcacctgagcttcggcctggactgccccatcctgggcgaccacaagtacagcgactggaacagactggccccccagaagctgagcgtgggcaccctgaagaagctgggcctggagcagagcaaggccagatacatccccctgcacctgcacgccagacagctgatcctgcccgccctgggcagcggcaaggaggagctgaacctggtgtgcaagctgcccagattcttcgtgcacagcctgcacagactgagactggagatgcccaacgaggaccagaacgagaacaacgaggccaagtgcctgggcgcccagtag

SEQ ID NO: 21736 - DNA, 1098 bp, Artificial Sequence
  Description of Artificial Sequence: Synthetic coding sequence
atggagggccagagcgtggaggagctgctggccaaggccgagcaggacgaggccgagaagctgcagagaatcaccgtgcacaaggagctggagctgcagttcgacctgggcaacctgctggccagcgacagaaacccccccaccggcctgagatgcgccggccccacccccgaggccgagctgcaggccctggccagagacaacacccagctgctgatcaaccagctgtggcagctgcccaccgagagagtggaggaggccatcgtggccagactgcccgagcccaccaccagactgcccagagagaagcccctgcccagacccagacccctgaccagatggcagcagttcgccagactgaagggcatcagacccaagaagaagaccaacctggtgtgggacgaggtgagcggccagtggagaagaagatggggctaccagagagccagagacgacaccaaggagtggctgatcgaggtgcccggcaacgccgaccccctggaggaccagttcgccaagagaatccaggccaagaaggagagagtggccaagaacgagctgaacagactgagaaacctggccagagcccacaagatgcagctgcccagcgccgccggcctgcaccccaccggccaccagagcaaggaggagctgggcagagccatgcaggtggccaaggtgagcaccgccagcgtgggcagattccaggagagactgcccaaggagaaggtgcccagaggcagcggcaagaagagaaagttccagcccctgttcggcgacttcgccgccgagaagaagaaccagctggagctgctgagagtgatgaacagcaagaagccccagctggacgtgaccagagccaccaacaagcagatgagagaggaggaccaggaggaggccgccaagagaagaaagatgagccagaagggcaagagaaagggcggcagacagggccccggcggcaagagaaagggcggcccccccagccagggcggcaagagaaagggcggcctgggcggcaagatgaacagcggcccccccggcctgggcggcaagagaaagggcggccagagacccggcggcaagagaagaaagtag

SEQ ID NO: 21737 - DNA, 2127 bp, Artificial Sequence
  Description of Artificial Sequence: Synthetic coding sequence
atggccgacagagagggcggctgcgccgccggcagaggcagagagctggagcccgagctggagcccggccccggccccggcagcgccctggagcccggcgaggagttcgagatcgtggacagaagccagctgcccggccccggcgacctgagaagcgccaccagacccagagccgccgagggctggagcgcccccatcctgaccctggccagaagagccaccggcaacctgagcgccagctgcggcagcgccctgagagccgccgccggcctgggcggcggcgacagcggcgacggcaccgccagagccgccagcaagtgccagatgatggaggagagagccaacctgatgcacatgatgaagctgagcatcaaggtgctgctgcagagcgccctgagcctgggcagaagcctggacgccgaccacgcccccctgcagcagttcttcgtggtgatggagcactgcctgaagcacggcctgaaggtgaagaagagcttcatcggccagaacaagagcttcttcggccccctggagctggtggagaagctgtgccccgaggccagcgacatcgccaccagcgtgagaaacctgcccgagctgaagaccgccgtgggcagaggcagagcctggctgtacctggccctgatgcagaagaagctggccgactacctgaaggtgctgatcgacaacaagcacctgctgagcgagttctacgagcccgaggccctgatgatggaggaggagggcatggtgatcgtgggcctgctggtgggcctgaacgtgctggacgccaacctgtgcctgaagggcgaggacctggacagccaggtgggcgtgatcgacttcagcctgtacctgaaggacgtgcaggacctggacggcggcaaggagcacgagagaatcaccgacgtgctggaccagaagaactacgtggaggagctgaacagacacctgagctgcaccgtgggcgacctgcagaccaagatcgacggcctggagaagaccaacagcaagctgcaggaggagctgagcgccgccaccgacagaatctgcagcctgcaggaggagcagcagcagctgagagagcagaacgagctgatcagagagagaagcgagaagagcgtggagatcaccaagcaggacaccaaggtggagctggagacctacaagcagaccagacagggcctggacgagatgtacagcgacgtgtggaagcagctgaaggaggagaagaaggtgagactggagctggagaaggagctggagctgcagatcggcatgaagaccgagatggagatcgccatgaagctgctggagaaggacacccacgagaagcaggacaccctggtggccctgagacagcagctggaggaggtgaaggccatcaacctgcagatgttccacaaggcccagaacgccgagagcagcctgcagcagaagaacgaggccatcaccagcttcgagggcaagaccaaccaggtgatgagcagcatgaagcagatggaggagagactgcagcacagcgagagagccagacagggcgccgaggagagaagccacaagctgcagcaggagctgggcggcagaatcggcgccctgcagctgcagctgagccagctgcacgagcagtgcagcagcctggagaaggagctgaagagcgagaaggagcagagacaggccctgcagagagagctgcagcacgagaaggacaccagcagcctgctgagaatggagctgcagcaggtggagggcctgaagaaggagctgagagagctgcaggacgagaaggccgagctgcagaagatctgcgaggagcaggagcaggccctgcaggagatgggcctgcacctgagccagagcaagctgaagatggaggacatcaaggaggtgaaccaggccctgaagggccacgcctggctgaaggacgacgaggccacccactgcagacagtgcgagaaggagttcagcatcagcagaagaaagcaccactgcagaaactgcggccacatcttctgcaacacctgcagcagcaacgagctggccctgcccagctaccccaagcccgtgagagtgtgcgacagctgccacaccctgctgctgcagagatgcagcagcaccgccagctag

SEQ ID NO: 21738 - DNA, 933 bp, Artificial Sequence
  Description of Artificial Sequence: Synthetic coding sequence
atgtacagcgacgtgtggaagcagctgaaggaggagaagaaggtgagactggagctggagaaggagctggagctgcagatcggcatgaagaccgagatggagatcgccatgaagctgctggagaaggacacccacgagaagcaggacaccctggtggccctgagacagcagctggaggaggtgaaggccatcaacctgcagatgttccacaaggcccagaacgccgagagcagcctgcagcagaagaacgaggccatcaccagcttcgagggcaagaccaaccaggtgatgagcagcatgaagcagatggaggagagactgcagcacagcgagagagccagacagggcgccgaggagagaagccacaagctgcagcaggagctgggcggcagaatcggcgccctgcagctgcagctgagccagctgcacgagcagtgcagcagcctggagaaggagctgaagagcgagaaggagcagagacaggccctgcagagagagctgcagcacgagaaggacaccagcagcctgctgagaatggagctgcagcaggtggagggcctgaagaaggagctgagagagctgcaggacgagaaggccgagctgcagaagatctgcgaggagcaggagcaggccctgcaggagatgggcctgcacctgagccagagcaagctgaagatggaggacatcaaggaggtgaaccaggccctgaagggccacgcctggctgaaggacgacgaggccacccactgcagacagtgcgagaaggagttcagcatcagcagaagaaagcaccactgcagaaactgcggccacatcttctgcaacacctgcagcagcaacgagctggccctgcccagctaccccaagcccgtgagagtgtgcgacagctgccacaccctgctgctgcagagatgcagcagcaccgccagctag

SEQ ID NO: 21739 - DNA, 1239 bp, Artificial Sequence
  Description of Artificial Sequence: Synthetic coding sequence
atggccgacagagagggcggctgcgccgccggcagaggcagagagctggagcccgagctggagcccggccccggccccggcagcgccctggagcccggcgaggagttcgagatcgtggacagaagccagctgcccggccccggcgacctgagaagcgccaccagacccagagccgccgagggctggagcgcccccatcctgaccctggccagaagagccaccggcaacctgagcgccagctgcggcagcgccctgagagccgccgccggcctgggcggcggcgacagcggcgacggcaccgccagagccgccagcaagtgccagatgatggaggagagagccaacctgatgcacatgatgaagctgagcatcaaggtgctgctgcagagcgccctgagcctgggcagaagcctggacgccgaccacgcccccctgcagcagttcttcgtggtgatggagcactgcctgaagcacggcctgaaggtgaagaagagcttcatcggccagaacaagagcttcttcggccccctggagctggtggagaagctgtgccccgaggccagcgacatcgccaccagcgtgagaaacctgcccgagctgaagaccgccgtgggcagaggcagagcctggctgtacctggccctgatgcagaagaagctggccgactacctgaaggtgctgatcgacaacaagcacctgctgagcgagttctacgagcccgaggccctgatgatggaggaggagggcatggtgatcgtgggcctgctggtgggcctgaacgtgctggacgccaacctgtgcctgaagggcgaggacctggacagccaggtgggcgtgatcgacttcagcctgtacctgaaggacgtgcaggacctggacggcggcaaggagcacgagagaatcaccgacgtgctggaccagaagaactacgtggaggagctgaacagacacctgagctgcaccgtgggcgacctgcagaccaagatcgacggcctggagaagaccaacagcaagctgcaggaggaggaggagagaatgaagggccaggacaagggcggcctgagcagaggcagagagctggccgccagctgccccgccgtgagcctgctggacaccagctgcctgctgctggccggcggcggctgcagcgccctgctgagactgagcaccgccttcagctgcaacagacccaacctgctgaccagcagaagaaccgccgccgtgaagagaaccaagtag

SEQ ID NO: 21740 - DNA, 1803 bp, Artificial Sequence
  Description of Artificial Sequence: Synthetic coding sequence
atgatggaggagagagccaacctgatgcacatgatgaagctgagcatcaaggtgctgctgcagagcgccctgagcctgggcagaagcctggacgccgaccacgcccccctgcagcagttcttcgtggtgatggagcactgcctgaagcacggcctgaaggtgaagaagagcttcatcggccagaacaagagcttcttcggccccctggagctggtggagaagctgtgccccgaggccagcgacatcgccaccagcgtgagaaacctgcccgagctgaagaccgccgtgggcagaggcagagcctggctgtacctggccctgatgcagaagaagctggccgactacctgaaggtgctgatcgacaacaagcacctgctgagcgagttctacgagcccgaggccctgatgatggaggaggagggcatggtgatcgtgggcctgctggtgggcctgaacgtgctggacgccaacctgtgcctgaagggcgaggacctggacagccaggtgggcgtgatcgacttcagcctgtacctgaaggacgtgcaggacctggacggcggcaaggagcacgagagaatcaccgacgtgctggaccagaagaactacgtggaggagctgaacagacacctgagctgcaccgtgggcgacctgcagaccaagatcgacggcctggagaagaccaacagcaagctgcaggaggagctgagcgccgccaccgacagaatctgcagcctgcaggaggagcagcagcagctgagagagcagaacgagctgatcagagagagaagcgagaagagcgtggagatcaccaagcaggacaccaaggtggagctggagacctacaagcagaccagacagggcctggacgagatgtacagcgacgtgtggaagcagctgaaggaggagaagaaggtgagactggagctggagaaggagctggagctgcagatcggcatgaagaccgagatggagatcgccatgaagctgctggagaaggacacccacgagaagcaggacaccctggtggccctgagacagcagctggaggaggtgaaggccatcaacctgcagatgttccacaaggcccagaacgccgagagcagcctgcagcagaagaacgaggccatcaccagcttcgagggcaagaccaaccaggtgatgagcagcatgaagcagatggaggagagactgcagcacagcgagagagccagacagggcgccgaggagagaagccacaagctgcagcaggagctgggcggcagaatcggcgccctgcagctgcagctgagccagctgcacgagcagtgcagcagcctggagaaggagctgaagagcgagaaggagcagagacaggccctgcagagagagctgcagcacgagaaggacaccagcagcctgctgagaatggagctgcagcaggtggagggcctgaagaaggagctgagagagctgcaggacgagaaggccgagctgcagaagatctgcgaggagcaggagcaggccctgcaggagatgggcctgcacctgagccagagcaagctgaagatggaggacatcaaggaggtgaaccaggccctgaagggccacgcctggctgaaggacgacgaggccacccactgcagacagtgcgagaaggagttcagcatcagcagaagaaagcaccactgcagaaactgcggccacatcttctgcaacacctgcagcagcaacgagctggccctgcccagctaccccaagcccgtgagagtgtgcgacagctgccacaccctgctgctgcagagatgcagcagcaccgccagctag

SEQ ID NO: 21741 - DNA, 1803 bp, Artificial Sequence; identical to SEQ ID NO: 21740
  Description of Artificial Sequence: Synthetic coding sequence

SEQ ID NO: 21742 - DNA, 1827 bp, Artificial Sequence
  Description of Artificial Sequence: Synthetic coding sequence
gcctgggccgccagactgggcagacccggcagaagctgcctgcccggcgccagaggcagagcccccccccccccccccctgctgctgctgctggccctgctgcccctgctgcccgcccccggcgccgccgccgcccccgcccccagaccccccgagctgcagagcgccagcgccggccccagcgtgagcctgtacctgagcgaggacgaggtgagaagactgatcggcctggacgccgagctgtactacgtgagaaacgacctgatcagccactacgccctgagcttcagcctgctggtgcccagcgagaccaacttcctgcacttcacctggcacgccaagagcaaggtggagtacaagctgggcttccaggtggacaacgtgctggccatggacatgccccaggtgaacatcagcgtgcagggcgaggtgcccagaaccctgagcgtgttcagagtggagctgagctgcaccggcaaggtggacagcgaggtgatgatcctgatgcagctgaacctgaccgtgaacagcagcaagaacttcaccgtgctgaacttcaagagaagaaagatgtgctacaagaagctggaggaggtgaagaccagcgccctggacaagaacaccagcagaaccatctacgaccccgtgcacgccgcccccaccaccagcaccagagtgttctacatcagcgtgggcgtgtgctgcgccgtgatcttcctggtggccatcatcctggccgtgctgcacctgcacagcatgaagagaatcgagctggacgacagcatcagcgccagcagcagcagccagggcctgagccagcccagcacccagaccacccagtacctgagagccgacacccccaacaacgccacccccatcaccagcagcctgggctaccccaccctgagaatcgagaagaacgacctgagaagcgtgaccctgctggaggccaagggcaaggtgaaggacatcgccatcagcagagagagaatcaccctgaaggacgtgctgcaggagggcaccttcggcagaatcttccacggcatcctgatcgacgagaaggaccccaacaaggagaagcaggccttcgtgaagaccgtgaaggaccaggccagcgagatccaggtgaccatgatgctgaccgagagctgcaagctgagaggcctgcaccacagaaacctgctgcccatcacccacgtgtgcatcgaggagggcgagaagcccatggtgatcctgccctacatgaactggggcaacctgaagctgttcctgagacagtgcaagctggtggaggccaacaacccccaggccatcagccagcaggacctggtgcacatggccatccagatcgcctgcggcatgagctacctggccagaagagaggtgatccacaaggacctggccgccagaaactgcgtgatcgacgacaccctgcaggtgaagatcaccgacaacgccctgagcagagacctgttccccatggactaccactgcctgggcgacaacgagaacagacccgtgagatggatggccctggagagcctggtgaacaacgagttcagcagcgccagcgacgtgtgggccttcggcgtgaccctgtgggagctgatgaccctgggccagaccccctacgtggacatcgaccccttcgagatggccgcctacctgaaggacggctacagaatcgcccagcccatcaactgccccgacgagctgttcgccgtgatggcctgctgctgggccctggaccccgaggagagacccaagttccagcagctggtgcagtgcctgaccgagttccacgccgccctgggcgcctacgtgtag

SEQ ID NO: 21743 - DNA, 1257 bp, Artificial Sequence
  Description of Artificial Sequence: Synthetic coding sequence
atgtgctacaagaagctggaggaggtgaagaccagcgccctggacaagaacaccagcagaaccatctacgaccccgtgcacgccgcccccaccaccagcaccagagtgttctacatcagcgtgggcgtgtgctgcgccgtgatcttcctggtggccatcatcctggccgtgctgcacctgcacagcatgaagagaatcgagctggacgacagcatcagcgccagcagcagcagccagggcctgagccagcccagcacccagaccacccagtacctgagagccgacacccccaacaacgccacccccatcaccagcagcctgggctaccccaccctgagaatcgagaagaacgacctgagaagcgtgaccctgctggaggccaagggcaaggtgaaggacatcgccatcagcagagagagaatcaccctgaaggacgtgctgcaggagggcaccttcggcagaatcttccacggcatcctgatcgacgagaaggaccccaacaaggagaagcaggccttcgtgaagaccgtgaaggaccaggccagcgagatccaggtgaccatgatgctgaccgagagctgcaagctgagaggcctgcaccacagaaacctgctgcccatcacccacgtgtgcatcgaggagggcgagaagcccatggtgatcctgccctacatgaactggggcaacctgaagctgttcctgagacagtgcaagctggtggaggccaacaacccccaggccatcagccagcaggacctggtgcacatggccatccagatcgcctgcggcatgagctacctggccagaagagaggtgatccacaaggacctggccgccagaaactgcgtgatcgacgacaccctgcaggtgaagatcaccgacaacgccctgagcagagacctgttccccatggactaccactgcctgggcgacaacgagaacagacccgtgagatggatggccctggagagcctggtgaacaacgagttcagcagcgccagcgacgtgtgggccttcggcgtgaccctgtgggagctgatgaccctgggccagaccccctacgtggacatcgaccccttcgagatggccgcctacctgaaggacggctacagaatcgcccagcccatcaactgccccgacgagctgttcgccgtgatggcctgctgctgggccctggaccccgaggagagacccaagttccagcagctggtgcagtgcctgaccgagttccacgccgccctgggcgcctacgtgtag

SEQ ID NO: 21744 - DNA, 1764 bp, Artificial Sequence
  Description of Artificial Sequence: Synthetic coding sequence
tgaagagcccccccccccccccccctgctgctgctgctggccctgctgcccctgctgcccgcccccggcgccgccgccgcccccgcccccagaccccccgagctgcagagcgccagcgccggccccagcgtgagcctgtacctgagcgaggacgaggtgagaagactgatcggcctggacgccgagctgtactacgtgagaaacgacctgatcagccactacgccctgagcttcagcctgctggtgcccagcgagaccaacttcctgcacttcacctggcacgccaagagcaaggtggagtacaagctgggcttccaggtggacaacgtgctggccatggacatgccccaggtgaacatcagcgtgcagggcgaggtgcccagaaccctgagcgtgttcagagtggagctgagctgcaccggcaaggtggacagcgaggtgatgatcctgatgcagctgaacctgaccgtgaacagcagcaagaacttcaccgtgctgaacttcaagagaagaaagatgtgctacaagaagctggaggaggtgaagaccagcgccctggacaagaacaccagcagaaccatctacgaccccgtgcacgccgcccccaccaccagcaccagagtgttctacatcagcgtgggcgtgtgctgcgccgtgatcttcctggtggccatcatcctggccgtgctgcacctgcacagcatgaagagaatcgagctggacgacagcatcagcgccagcagcagcagccagggcctgagccagcccagcacccagaccacccagtacctgagagccgacacccccaacaacgccacccccatcaccagctaccccaccctgagaatcgagaagaacgacctgagaagcgtgaccctgctggaggccaagggcaaggtgaaggacatcgccatcagcagagagagaatcaccctgaaggacgtgctgcaggagggcaccttcggcagaatcttccacggcatcctgatcgacgagaaggaccccaacaaggagaagcaggccttcgtgaagaccgtgaaggaccaggccagcgagatccaggtgaccatgatgctgaccgagagctgcaagctgagaggcctgcaccacagaaacctgctgcccatcacccacgtgtgcatcgaggagggcgagaagcccatggtgatcctgccctacatgaactggggcaacctgaagctgttcctgagacagtgcaagctggtggaggccaacaacccccaggccatcagccagcaggacctggtgcacatggccatccagatcgcctgcggcatgagctacctggccagaagagaggtgatccacaaggacctggccgccagaaactgcgtgatcgacgacaccctgcaggtgaagatcaccgacaacgccctgagcagagacctgttccccatggactaccactgcctgggcgacaacgagaacagacccgtgagatggatggccctggagagcctggtgaacaacgagttcagcagcgccagcgacgtgtgggccttcggcgtgaccctgtgggagctgatgaccctgggccagaccccctacgtggacatcgaccccttcgagatggccgcctacctgaaggacggctacagaatcgcccagcccatcaactgccccgacgagctgttcgccgtgatggcctgctgctgggccctggaccccgaggagagacccaagttccagcagctggtgcagtgcctgaccgagttccacgccgccctgggcgcctacgtgtag

SEQ ID NO: 21745 - DNA, 240 bp, Artificial Sequence
  Description of Artificial Sequence: Synthetic coding sequence
atgagcaccaagaagagccccgaggagctgaagagaatcttcgagaagtacgccgccaaggagggcgaccccgaccagctgagcaaggacgagctgaagctgctgatccaggccgagttccccagcctgctgaagggccccaacaccctggacgacctgttccaggagctggacaagaacggcgacggcgaggtgagcttcgaggagttccaggtgctggtgaagaagatcagccagtag

SEQ ID NO: 21746 - DNA, 726 bp, Artificial Sequence
  Description of Artificial Sequence: Synthetic coding sequence
atgaacggcaccctgaccgccgtggagagcttcctgaccatccacagcggccccgagggcctgagcatccacgacggcacctggaagagcgccatctacggcttcggcgaccagagcaacctgagaaagctgagaaacgtgagcaacctgaagcccgtgcccctgatcggccccaagctgaagagaagatggcccatcagctactgcagagagctgaagggctacagcatccccttcatgggcagcgacgtgagcgtggtgagaagaacccagagatacctgtacgagaacctggaggagagccccgtgcagtacgccgcctacgtgaccgtgggcggcatcaccagcgtgatcaagctgatgttcgccggcctgttcttcctgttcttcgtgagattcggcatcggcagacagctgctgatcaagatcgacgccgccagcttcaccctgaccttcttcggccagggctacagccagggcaccggcaccgacaagaacaagcccaacatcaagatctgcacccaggtgaagggccccgaggccggctacgtggccacccccatcgccatggtgcaggccgccatgaccctgctgagcgacgccagccacctgcccaaggccggcggcgtgttcacccccggcgccgccttcagcaagaccaagctgatcgacagactgaacaagcacggcatcgagttcagcgtgatcagcagcagcgaggtgtag

SEQ ID NO: 21747 - DNA, 1290 bp, Artificial Sequence
  Description of Artificial Sequence: Synthetic coding sequence
atggccaccgagcagagacccttccacctggtggtgttcggcgccagcggcttcaccggccagttcgtgaccgaggaggtggccagagagcaggtggaccccgagagaagcagcagactgccctgggccgtggccggcagaagcagagagaagctgcagagagtgctggagaaggccgccctgaagctgggcagacccaccctgagcagcgaggtgggcatcatcatctgcgacatcgccaaccccgccagcctggacgagatggccaagcaggccaccgtggtgctgaactgcgtgggcccctacagattctacggcgagcccgtgatcaaggcctgcatcgagaacggcgccagctgcatcgacatcagcggcgagccccagttcctggagctgatgcagctgaagtaccacgagaaggccgccgacaagggcgtgtacatcatcggcagcagcggcttcgacagcatccccgccgacctgggcgtgatctacaccagaaacaagatgaacggcaccctgaccgccgtggagagcttcctgaccatccacagcggccccgagggcctgagcatccacgacggcacctggaagagcgccatctacggcttcggcgaccagagcaacctgagaaagctgagaaacgtgagcaacctgaagcccgtgcccctgatcggccccaagctgaagagaagatggcccatcagctactgcagagagctgaagggctacagcatccccttcatgggcagcgacgtgagcgtggtgagaagaacccagagatacctgtacgagaacctggaggagagccccgtgcagtacgccgcctacgtgaccgtgggcggcatcaccagcgtgatcaagctgatgttcgccggcctgttcttcctgttcttcgtgagattcggcatcggcagacagctgctgatcaagttcccctggttcttcagcttcggctacttcagcaagcagggccccacccagaagcagatcgacgccgccagcttcaccctgaccttcttcggccagggctacagccagggcaccggcaccgacaagaacaagcccaacatcaagatctgcacccaggtgaagggccccgaggccggctacgtggccacccccatcgccatggtgcaggccgccatgaccctgctgagcgacgccagccacctgcccaaggccggcggcgtgttcacccccggcgccgccttcagcaagaccaagctgatcgacagactgaacaagcacggcatcgagttcagcgtgatcagcagcagcgaggtgtag

SEQ ID NO: 21748 - DNA, 1074 bp, Artificial Sequence
  Description of Artificial Sequence: Synthetic coding sequence
atgagcggcaagaccaaggccagaagagccgccatgttcttcagaagatgcagcgaggacgccagcggcagcgccagcggcaacgccctgctgagcgaggacgagaaccccgacgccaacggcgtgaccagaagctggaagatcatcctgagcaccatgctgaccctgaccttcctgctggtgggcctgctgaaccaccagtggctgaaggagaccgacgtgccccagaagagcagacagctgtacgccatcatcgccgagtacggcagcagactgtacaagtaccaggccagactgagaatgcccaaggagcagctggagctgctgaagaaggagagccagaacctggagaacaacttcagacagatcctgttcctgatcgagcagatcgacgtgctgaaggccctgctgagagacatgaaggacggcatggacaacaaccacaactggaacacccacggcgaccccgtggaggaccccgaccacaccgaggaggtgagcaacctggtgaactacgtgctgaagaagctgagagaggaccaggtggagatggccgactacgccctgaagagcgccggcgccagcatcatcgaggccggcaccagcgagagctacaagaacaacaaggccaagctgtactggcacggcatcggcttcctgaaccacgagatgccccccgacatcatcctgcagcccgacgtgtaccccggcaagtgctgggccttccccggcagccagggccacaccctgatcaagctggccaccaagatcatccccaccgccgtgaccatggagcacatcagcgagaaggtgagccccagcggcaacatcagcagcgcccccaaggagttcagcgtgtacggcatcaccaagaagtgcgagggcgaggagatcttcctgggccagttcatctacaacaagaccggcaccaccgtgcagaccttcgagctgcagcacgccgtgagcgagtacctgctgtgcgtgaagctgaacatcttcagcaactggggccaccccaagtacacctgcctgtacagattcagagtgcacggcacccccggcaagcacatctag

SEQ ID NO: 21749 - DNA, 1074 bp, Artificial Sequence; identical to SEQ ID NO: 21748
  Description of Artificial Sequence: Synthetic coding sequence

SEQ ID NO: 21750 - DNA, 810 bp, Artificial Sequence
  Description of Artificial Sequence: Synthetic coding sequence
atgcccaaggagcagctggagctgctgaagaaggagagccagaacctggagaacaacttcagacagatcctgttcctgatcgagcagatcgacgtgctgaaggccctgctgagagacatgaaggacggcatggacaacaaccacaactggaacacccacggcgaccccgtggaggaccccgaccacaccgaggaggtgagcaacctggtgaactacgtgctgaagaagctgagagaggaccaggtggagatggccgactacgccctgaagagcgccggcgccagcatcatcgaggccggcaccagcgagagctacaagaacaacaaggccaagctgtactggcacggcatcggcttcctgaaccacgagatgccccccgacatcatcctgcagcccgacgtgtaccccggcaagtgctgggccttccccggcagccagggccacaccctgatcaagctggccaccaagatcatccccaccgccgtgaccatggagcacatcagcgagaaggtgagccccagcggcaacatcagcagcgcccccaaggagttcagcgtgtacgtgcagagatacatgtgcagattcgtgatccaggccggcatcaccaagaagtgcgagggcgaggagatcttcctgggccagttcatctacaacaagaccggcaccaccgtgcagaccttcgagctgcagcacgccgtgagcgagtacctgctgtgcgtgaagctgaacatcttcagcaactggggccaccccaagtacacctgcctgtacagattcagagtgcacggcacccccggcaagcacatctag

SEQ ID NO: 21751 - DNA, 810 bp, Artificial Sequence; identical to SEQ ID NO: 21750
  Description of Artificial Sequence: Synthetic coding sequence

SEQ ID NO: 21752 - DNA, 846 bp, Artificial Sequence
  Description of Artificial Sequence: Synthetic coding sequence
tgatacgccatcatcgccgagtacggcagcagactgtacaagtaccaggccagactgagaatgcccaaggagcagctggagctgctgaagaaggagagccagaacctggagaacaacttcagacagatcctgttcctgatcgagcagatcgacgtgctgaaggccctgctgagagacatgaaggacggcatggacaacaaccacaactggaacacccacggcgaccccgtggaggaccccgaccacaccgaggtgctggacgaggaggtgagcaacctggtgaactacgtgctgaagaagctgagagaggaccaggtggagatggccgactacgccctgaagagcgccggcgccagcatcatcgaggccggcaccagcgagagctacaagaacaacaaggccaagctgtactggcacggcatcggcttcctgaaccacgagatgccccccgacatcatcctgcagcccgacgtgtaccccggcaagtgctgggccttccccggcagccagggccacaccctgatcaagctggccaccaagatcatccccaccgccgtgaccatggagcacatcagcgagaaggtgagccccagcggcaacatcagcagcgcccccaaggagttcagcgtgtacggcatcaccaagaagtgcgagggcgaggagatcttcctgggccagttcatctacaacaagaccggcaccaccgtgcagaccttcgagctgcagcacgccgtgagcgagtacctgctgtgcgtgaagctgaacatcttcagcaactggggccaccccaagtacacctgcctgtacagattcagagtgcacggcacccccggcaagcacatctag

SEQ ID NO: 21753 - DNA, 1038 bp, Artificial Sequence
  Description of Artificial Sequence: Synthetic coding sequence
atggaggactacagcaagtacaacgcctacaccgacttcagcagctgcagactggagtgcagcggcgccatcctggcccactgcaacctgcacctgctgggcagcagcatcagccccgccagcgccagcagagtggccggcaccaccggcctgctgaaccaccagtggctgaaggagaccgacgtgccccagaagagcagacagctgtacgccatcatcgccgagtacggcagcagactgtacaagtaccaggccagactgagaatgcccaaggagcagctggagctgctgaagaaggagagccagaacctggagaacaacttcagacagatcctgttcctgatcgagcagatcgacgtgctgaaggccctgctgagagacatgaaggacggcatggacaacaaccacaactggaacacccacggcgaccccgtggaggaccccgaccacaccgaggaggtgagcaacctggtgaactacgtgctgaagaagctgagagaggaccaggtggagatggccgactacgccctgaagagcgccggcgccagcatcatcgaggccggcaccagcgagagctacaagaacaacaaggccaagctgtactggcacggcatcggcttcctgaaccacgagatgccccccgacatcatcctgcagcccgacgtgtaccccggcaagtgctgggccttccccggcagccagggccacaccctgatcaagctggccaccaagatcatccccaccgccgtgaccatggagcacatcagcgagaaggtgagccccagcggcaacatcagcagcgcccccaaggagttcagcgtgtacggcatcaccaagaagtgcgagggcgaggagatcttcctgggccagttcatctacaacaagaccggcaccaccgtgcagaccttcgagctgcagcacgccgtgagcgagtacctgctgtgcgtgaagctgaacatcttcagcaactggggccaccccaagtacacctgcctgtacagattcagagtgcacggcacccccggcaagcacatctag

SEQ ID NO: 21754 - DNA, 939 bp, Artificial Sequence
  Description of Artificial Sequence: Synthetic coding sequence
atggacagaagcaccaacctggacatcgaggagctgaagatgaccagagagcagtacatcctggccacccagcagaacaacctgcccagaaccgagaacgcccagctgtaccccgtgggcatctacggctggagaaagagatgcctgtacttcttcgtgctgctgctgctggtgaccatgatcgtgaacctggccatgaccatctggatcctgaaggtgatgaacttcaccgtggacggcatgggcaacctgagagtgaccaagaagggcatcagactggagggcatcagcgagttcctgctgcccctgtacgtgaaggagatccacagcagaaaggacagccccctggtgctgcagagcgacagaaacgtgaccgtgaacgccagaaaccacatgggccagctgaccggccagctgaccatcggcgccgacgccgtggaggcccagtgcaagagattcgaggtgagagccagcgaggacggcagagtgctgttcagcgccgacgaggacgagatcaccatcggcgccgagaagctgaaggtgaccggcaccgagggcgccgtgttcggccacagcgtggagaccccccacatcagagccgagcccagccaggacctgagactggagagccccaccagaagcctgatcatggaggcccccagaggcgtgcaggtgagcgccgccgccggcgacttcaaggccacctgcagaaaggagctgcacctgcagagcaccgagggcgagatcttcctgaacgccgagaccatcaagctgggcaacctgcccaccggcagcttcagcagcagcagccccagcagcagcagcagcagacagaccgtgtacgagctgtgcgtgtgccccaacggcaagctgtacctgagccccgccggcgtgggcagcacctgccagagcagcagcaacatctgcctgtggagctag

SEQ ID NO: 21755 - DNA, 798 bp, Artificial Sequence
  Description of Artificial Sequence: Synthetic coding sequence
atgaccagagagcagtacatcctggccacccagcagaacaacctgcccagaaccgagaacgcccagctgtaccccgtgggcatctacggctggagaaagagatgcctgtacttcttcgtgctgctgctgctggtgaccatgatcgtgaacctggccatgaccatctggatcctgaaggtgatgaacttcaccgtggacagccccctggtgctgcagagcgacagaaacgtgaccgtgaacgccagaaaccacatgggccagctgaccggccagctgaccatcggcgccgacgccgtggaggcccagtgcaagagattcgaggtgagagccagcgaggacggcagagtgctgttcagcgccgacgaggacgagatcaccatcggcgccgagaagctgaaggtgaccggcaccgagggcgccgtgttcggccacagcgtggagaccccccacatcagagccgagcccagccaggacctgagactggagagccccaccagaagcctgatcatggaggcccccagaggcgtgcaggtgagcgccgccgccggcgacttcaaggccacctgcagaaaggagctgcacctgcagagcaccgagggcgagatcttcctgaacgccgagaccatcaagctgggcaacctgcccaccggcagcttcagcagcagcagccccagcagcagcagcagcagacagaccgtgtacgagctgtgcgtgtgccccaacggcaagctgtacctgagccccgccggcgtgggcagcacctgccagagcagcagcaacatctgcctgtggagctag

SEQ ID NO: 21756 - DNA, 2436 bp, Artificial Sequence
  Description of Artificial Sequence: Synthetic coding sequence
atgcccagcgccctggccatcttcacctgcagacccaacagccaccccttccaggagagacacgtgtacctggacgagcccatcaagatcggcagaagcgtggccagatgcagacccgcccagaacaacgccaccttcgactgcaaggtgctgagcagaaaccacgccctggtgtggttcgaccacaagaccggcaagttctacctgcaggacaccaagagcagcaacggcaccttcatcaacagccagagactgagcagaggcagcgaggagagccccccctgcgagatcctgagcggcgacatcatccagttcggcgtggacgtgaccgagaacaccagaaaggtgacccacggctgcatcgtgagcaccatcaagctgttcctgcccgacggcatggaggccagactgagaagcgacgtgatccacgcccccctgcccagccccgtggacaaggtggccgccaacacccccagcatgtacagccaggagctgttccagctgagccagtacctgcaggaggccctgcacagagagcagatgctggagcagaagctggccaccctgcagagactgctggccatcacccaggaggccagcgacaccagctggcaggccctgatcgacgaggacagactgctgagcagactggaggtgatgggcaaccagctgcaggcctgcagcaagaaccagaccgaggacagcctgagaaaggagctgatcgccctgcaggaggacaagcacaactacgagaccaccgccaaggagagcctgagaagagtgctgcaggagaagatcgaggtggtgagaaagctgagcgaggtggagagaagcctgagcaacaccgaggacgagtgcacccacctgaaggagatgaacgagagaacccaggaggagctgagagagctggccaacaagtacaacggcgccgtgaacgagatcaaggacctgagcgacaagctgaaggtggccgagggcaagcaggaggagatccagcagaagggccaggccgagaagaaggagctgcagcacaagatcgacgagatggaggagaaggagcaggagctgcaggccaagatcgaggccctgcaggccgacaacgacttcaccaacgagagactgaccgccctgcaggagcacctgctgagcaagagcggcggcgactgcaccttcatccaccagttcatcgagtgccagaagaagctgatcgtggagggccacctgaccaaggccgtggaggagaccaagctgagcaaggagaaccagaccagagccaaggagagcgacttcagcgacaccctgagccccagcaaggagaagagcagcgacgacaccaccgacgcccagatggacgagcaggacctgaacgagcccctggccaaggtgagcctgctgaaggacgacctgcagggcgcccagagcgagatcgaggccaagcaggagatccagcacctgagaaaggagctgatcgaggcccaggagctggccagaaccagcaagcagaagtgcttcgagctgcaggccctgctggaggaggagagaaaggcctacagaaaccaggtggaggagagcaccaagcagatccaggtgctgcaggcccagctgcagagactgcacatcgacaccgagaacctgagagaggagaaggacagcgagatcaccagcaccagagacgagctgctgagcgccagagacgagatcctgctgctgcaccaggccgccgccaaggtggccagcgagagagacaccgacatcgccagcctgcaggaggagctgaagaaggtgagagccgagctggagagatggagaaaggccgccagcgagtacgagaaggagatcaccagcctgcagaacagcttccagctgagatgccagcagtgcgaggaccagcagagagaggaggccaccagactgcagggcgagctggagaagctgagaaaggagtggaacgccctggagaccgagtgccacagcctgaagagagagaacgtgctgctgagcagcgagctgcagagacaggagaaggagctgcacaacagccagaagcagagcctggagctgaccagcgacctgagcatcctgcagatgagcagaaaggagctggagaaccaggtgggcagcctgaaggagcagcacctgagagacagcgccgacctgaagaccctgctgagcaaggccgagaaccaggccaaggacgtgcagaaggagtacgagaagacccagaccgtgctgagcgagctgaagctgaagttcgagatgaccgagcaggagaagcagagcatcaccgacgagctgaagcagtgcaagaacaacctgaagctgctgagagagaagggcaacaacaagccctggccctggatgcccatgctggccgccctggtggccgtgaccgccatcgtgctgtacgtgcccggcctggccagagccagcccctag

SEQ ID NO: 21757 - DNA, 2436 bp, Artificial Sequence; identical to SEQ ID NO: 21756
  Description of Artificial Sequence: Synthetic coding sequence

SEQ ID NO: 21758 - DNA, 1521 bp, Artificial Sequence
  Description of Artificial Sequence: Synthetic coding sequence
atgcccagcgccctggccatcttcacctgcagacccaacagccaccccttccaggagagacacgtgtacctggacgagcccatcaagatcggcagaagcgtggccagatgcagacccgcccagaacaacgccaccttcgactgcaaggtgctgagcagaaaccacgccctggtgtggttcgaccacaagaccggcaagttctacctgcaggacaccaagagcagcaacggcaccttcatcaacagccagagactgagcagaggcagcgaggagagccccccctgcgagatcctgagcggcgacatcatccagttcggcgtggacgtgaccgagaacaccagaaaggtgacccacggctgcatcgtgagcaccatcaagctgttcctgcccgacggcatggaggccagactgagaagcgacgtgatccacgcccccctgcccagccccgtggacaaggtggccgccaacacccccagcatgtacagccaggagctgttccagctgagccagtacctgcaggaggccctgcacagagagcagatgctggagcagaagctggccaccctgcagagactgctggccatcacccaggaggccagcgacaccagctggcaggccctgatcgacgaggacagactgctgagcagactggaggtgatgggcaaccagctgcaggcctgcagcaagaaccagaccgaggacagcctgagaaaggagctgatcgccctgcaggaggacaagcacaactacgagaccaccgccaaggagagcctgagaagagtgctgcaggagaagatcgaggtggtgagaaagctgagcgaggtggagagaagcctgagcaacaccgaggacgagtgcacccacctgaaggagatgaacgagagaacccaggaggagctgagagagctggccaacaagtacaacggcgccgtgaacgagatcaaggacctgagcgacaagctgaaggtggccgagggcaagcaggaggagatccagcagaagggccaggccgagaagaaggagctgcagcacaagatcgacgagatggaggagaaggagcaggagctgcaggccaagatcgaggccctgcaggccgacaacgacttcaccaacgagagactgaccgccctgcaggtgagactggagcacctgcaggagaagaccctgaaggagtgcagcagcctgggcatccaggtggacgacttcctgcccaagatcaacggcagcaccgagaaggagaagctgatcgtggagggccacctgaccaaggccgtggaggagaccaagctgagcaaggagaaccagaccagagccaaggagagcgacttcagcgacaccctgagccccagcaaggagaagagcagcgacgacaccaccgacgcccagatggacgagcaggacctgaacgagcccctggccaaggtgagcctgctgaagggcaccctgacctgcttctacgacatcgtgaaccagggcatcaagagccccttcgccatcaagagcgtgctggacatcatgtag

SEQ ID NO: 21759 - DNA, 816 bp, Artificial Sequence
  Description of Artificial Sequence: Synthetic coding sequence
atggacgagcaggacctgaacgagcccctggccaaggtgagcctgctgaaggccctgctggaggaggagagaaaggcctacagaaaccaggtggaggagagcaccaagcagatccaggtgctgcaggcccagctgcagagactgcacatcgacaccgagaacctgagagaggagaaggacagcgagatcaccagcaccagagacgagctgctgagcgccagagacgagatcctgctgctgcaccaggccgccgccaaggtggccagcgagagagacaccgacatcgccagcctgcaggaggagctgaagaaggtgagagccgagctggagagatggagaaaggccgccagcgagtacgagaaggagatcaccagcctgcagaacagcttccagctgagatgccagcagtgcgaggaccagcagagagaggaggccaccagactgcagggcgagctggagaagctgagaaaggagtggaacgccctggagaccgagtgccacagcctgaagagagagaacgtgctgctgagcagcgagctgcagagacaggagaaggagctgcacaacagccagaagcagagcctggagctgaccagcgacctgagcatcctgcagatgagcagaaaggagctggagaaccaggtgggcagcctgaaggagcagcacctgagagacagcgccgacctgaagaccctgctgagcaaggccgagaaccaggccaaggacgtgcagaaggaggtgaagagaaaggacatcatgagccccatcatggtgggcctgaaggccaagagcaagagcgacatccacgccagctag

SEQ ID NO: 21760 - DNA, 1230 bp, Artificial Sequence
  Description of Artificial Sequence: Synthetic coding sequence
tgaaagctgatcgtggagggccacctgaccaaggccgtggaggagaccaagctgagcaaggagaaccagaccagagccaaggagagcgacttcagcgacaccctgagccccagcaaggagaagagcagcgacgacaccaccgacgcccagatggacgagcaggacctgaacgagcccctggccaaggtgagcctgctgaaggacgacctgcagggcgcccagagcgagatcgaggccaagcaggagatccagcacctgagaaaggagctgatcgaggcccaggagctggccagaaccagcaagcagaagtgcttcgagctgcaggccctgctggaggaggagagaaaggcctacagaaaccaggtggaggagagcaccaagcagatccaggtgctgcaggcccagctgcagagactgcacatcgacaccgagaacctgagagaggagaaggacagcgagatcaccagcaccagagacgagctgctgagcgccagagacgagatcctgctgctgcaccaggccgccgccaaggtggccagcgagagagacaccgacatcgccagcctgcaggaggagctgaagaaggtgagagccgagctggagagatggagaaaggccgccagcgagtacgagaaggagatcaccagcctgcagaacagcttccagctgagatgccagcagtgcgaggaccagcagagagaggaggccaccagactgcagggcgagctggagaagctgagaaaggagtggaacgccctggagaccgagtgccacagcctgaagagagagaacgtgctgctgagcagcgagctgcagagacaggagaaggagctgcacaacagccagaagcagagcctggagctgaccagcgacctgagcatcctgcagatgagcagaaaggagctggagaaccaggtgggcagcctgaaggagcagcacctgagagacagcgccgacctgaagaccctgctgagcaaggccgagaaccaggccaaggacgtgcagaaggagtacgagaagacccagaccgtgctgagcgagctgaagctgaagttcgagatgaccgagcaggagaagcagagcatcaccgacgagctgaagcagtgcaagaacaacctgaagctgctgagagagaagggcaacaaccccagcatcctgcagcccgtgcccgccgtgttcatcggcctgttcctggccttcctgttctggtgcttcggccccctgtggtag

SEQ ID NO: 21761 - DNA, 2487 bp, Artificial Sequence
  Description of Artificial Sequence: Synthetic coding sequence
atgcccagcgccctggccatcttcacctgcagacccaacagccaccccttccaggagagacacgtgtacctggacgagcccatcaagatcggcagaagcgtggccagatgcagacccgcccagaacaacgccaccttcgactgcaaggtgctgagcagaaaccacgccctggtgtggttcgaccacaagaccggcaagttctacctgcaggacaccaagagcagcaacggcaccttcatcaacagccagagactgagcagaggcagcgaggagagccccccctgcgagatcctgagcggcgacatcatccagttcggcgtggacgtgaccgagaacaccagaaaggtgacccacggctgcatcgtgagcaccatcaagctgttcctgcccgacggcatggaggccagactgagaagcgacgtgatccacgcccccctgcccagccccgtggacaaggtggccgccaacacccccagcatgtacagccaggagctgttccagctgagccagtacctgcaggaggccctgcacagagagcagatgctggagcagaagctggccaccctgcagagactgctggccatcacccaggaggccagcgacaccagctggcaggccctgatcgacgaggacagactgctgagcagactggaggtgatgggcaaccagctgcaggcctgcagcaagaaccagaccgaggacagcctgagaaaggagctgatcgccctgcaggaggacaagcacaactacgagaccaccgccaaggagagcctgagaagagtgctgcaggagaagatcgaggtggtgagaaagctgagcgaggtggagagaagcctgagcaacaccgaggacgagtgcacccacctgaaggagatgaacgagagaacccaggaggagctgagagagctggccaacaagtacaacggcgccgtgaacgagatcaaggacctgagcgacaagctgaaggtggccgagggcaagcaggaggagatccagcagaagggccaggccgagaagaaggagctgcagcacaagatcgacgagatggaggagaaggagcaggagctgcaggccaagatcgaggccctgcaggccgacaacgacttcaccaacgagagactgaccgccctgcaggtgagactggagcacctgcaggagaagaccctgaaggagtgcagcagcctggagcacctgctgagcaagagcggcggcgactgcaccttcatccaccagttcatcgagtgccagaagaagctgatcgtggagggccacctgaccaaggccgtggaggagaccaagctgagcaaggagaaccagaccagagccaaggagagcgacttcagcgacaccctgagccccagcaaggagaagagcagcgacgacaccaccgacgcccagatggacgagcaggacctgaacgagcccctggccaaggtgagcctgctgaaggacgacctgcagggcgcccagagcgagatcgaggccaagcaggagatccagcacctgagaaaggagctgatcgaggcccaggagctggccagaaccagcaagcagaagtgcttcgagctgcaggccctgctggaggaggagagaaaggcctacagaaaccaggtggaggagagcaccaagcagatccaggtgctgcaggcccagctgcagagactgcacatcgacaccgagaacctgagagaggagaaggacagcgagatcaccagcaccagagacgagctgctgagcgccagagacgagatcctgctgctgcaccaggccgccgccaaggtggccagcgagagagacaccgacatcgccagcctgcaggaggagctgaagaaggtgagagccgagctggagagatggagaaaggccgccagcgagtacgagaaggagatcaccagcctgcagaacagcttccagctgagatgccagcagtgcgaggaccagcagagagaggaggccaccagactgcagggcgagctggagaagctgagaaaggagtggaacgccctggagaccgagtgccacagcctgaagagagagaacgtgctgctgagcagcgagctgcagagacaggagaaggagctgcacaacagccagaagcagagcctggagctgaccagcgacctgagcatcctgcagatgagcagaaaggagctggagaaccaggtgggcagcctgaaggagcagcacctgagagacagcgccgacctgaagaccctgctgagcaaggccgagaaccaggccaaggacgtgcagaaggagtacgagaagacccagaccgtgctgagcgagctgaagctgaagttcgagatgaccgagcaggagaagcagagcatcaccgacgagctgaagcagtgcaagaacaacctgaagctgctgagagagaagggcaacaacaagccctggccctggatgcccatgctggccgccctggtggccgtgaccgccatcgtgctgtacgtgcccggcctggccagagccagcccctag

SEQ ID NO: 21762 - DNA, 951 bp, Artificial Sequence
  Description of Artificial Sequence: Synthetic coding sequence
tgaggccacctgaccaaggccgtggaggagaccaagctgagcaaggagaaccagaccagagccaaggagagcgacttcagcgacaccctgagccccagcaaggagaagagcagcgacgacaccaccgacgcccagatggacgagcaggacctgaacgagcccctggccaaggtgagcctgctgaaggccctgctggaggaggagagaaaggcctacagaaaccaggtggaggagagcaccaagcagatccaggtgctgcaggcccagctgcagagactgcacatcgacaccgagaacctgagagaggagaaggacagcgagatcaccagcaccagagacgagctgctgagcgccagagacgagatcctgctgctgcaccaggccgccgccaaggtggccagcgagagagacaccgacatcgccagcctgcaggaggagctgaagaaggtgagagccgagctggagagatggagaaaggccgccagcgagtacgagaaggagatcaccagcctgcagaacagcttccagctgagatgccagcagtgcgaggaccagcagagagaggaggccaccagactgcagggcgagctggagaagctgagaaaggagtggaacgccctggagaccgagtgccacagcctgaagagagagaacgtgctgctgagcagcgagctgcagagacaggagaaggagctgcacaacagccagaagcagagcctggagctgaccagcgacctgagcatcctgcagatgagcagaaaggagctggagaaccaggtgggcagcctgaaggagcagcacctgagagacagcgccgacctgaagaccctgctgagcaaggccgagaaccaggccaaggacgtgcagaaggaggtgaagagaaaggacatcatgagccccatcatggtgggcctgaaggccaagagcaagagcgacatccacgccagctag

SEQ ID NO: 21763 - DNA, 891 bp, Artificial Sequence
  Description of Artificial Sequence: Synthetic coding sequence
atggacgagcaggacctgaacgagcccctggccaaggtgagcctgctgaaggcccagctgcagagactgcacatcgacaccgagaacctgagagaggagaaggacagcgagatcaccagcaccagagacgagctgctgagcgccagagacgagatcctgctgctgcaccaggccgccgccaaggtggccagcgagagagacaccgacatcgccagcctgcaggaggagctgaagaaggtgagagccgagctggagagatggagaaaggccgccagcgagtacgagaaggagatcaccagcctgcagaacagcttccagctgagatgccagcagtgcgaggaccagcagagagaggaggccaccagactgcagggcgagctggagaagctgagaaaggagtggaacgccctggagaccgagtgccacagcctgaagagagagaacgtgctgctgagcagcgagctgcagagacaggagaaggagctgcacaacagccagaagcagagcctggagctgaccagcgacctgagcatcctgcagatgagcagaaaggagctggagaaccaggtgggcagcctgaaggagcagcacctgagagacagcgccgacctgaagaccctgctgagcaaggccgagaaccaggccaaggacgtgcagaaggagtacgagaagacccagaccgtgctgagcgagctgaagctgaagttcgagatgaccgagcaggagaagcagagcatcaccgacgagctgaagcagtgcaagaacaacctgaagctgctgagagagaagggcaacaacaagccctggccctggatgcccatgctggccgccctggtggccgtgaccgccatcgtgctgtacgtgcccggcctggccagagccagcccctag

SEQ ID NO: 21764 - DNA, 2373 bp, Artificial Sequence
  Description of Artificial Sequence: Synthetic coding sequence
atgcccagcgccctggccatcttcacctgcagacccaacagccaccccttccaggagagacacgtgtacctggacgagcccatcaagatcggcagaagcgtggccagatgcagacccgcccagaacaacgccaccttcgactgcaaggtgctgagcagaaaccacgccctggtgtggttcgaccacaagaccggcaagttctacctgcaggacaccaagagcagcaacggcaccttcatcaacagccagagactgagcagaggcagcgaggagagccccccctgcgagatcctgagcggcgacatcatccagttcggcgtggacgtgaccgagaacaccagaaaggtgacccacggctgcatcgtgagcaccatcaagctgttcctgcccgacggcatggaggccagactgagaagcgacgtgatccacgcccccctgcccagccccgtggacaaggtggccgccaacacccccagcatgtacagccaggagctgttccagctgagccagtacctgcaggaggccctgcacagagagcagatgctggagcagaagctggccaccctgcagagactgctggccatcacccaggaggccagcgacaccagctggcaggccctgatcgacgaggacagactgctgagcagactggaggtgatgggcaaccagctgcaggcctgcagcaagaaccagaccgaggacagcctgagaaaggagctgatcgccctgcaggaggacaagcacaactacgagaccaccgccaaggagagcctgagaagagtgctgcaggagaagatcgaggtggtgagaaagctgagcgaggtggagagaagcctgagcaacaccgaggacgagtgcacccacctgaaggagatgaacgagagaacccaggaggagctgagagagctggccaacaagtacaacggcgccgtgaacgagatcaaggacctgagcgacaagctgaaggtggccgagggcaagcaggaggagatccagcagaagggccaggccgagaagaaggagctgcagcacaagatcgacgagatggaggagaaggagcaggagctgcaggccaagatcgaggccctgcaggccgacaacgacttcaccaacgagagactgaccgccctgcaggagaagctgatcgtggagggccacctgaccaaggccgtggaggagaccaagctgagcaaggagaaccagaccagagccaaggagagcgacttcagcgacaccctgagccccagcaaggagaagagcagcgacgacaccaccgacgcccagatggacgagcaggacctgaacgagcccctggccaaggtgagcctgctgaaggacgacctgcagggcgcccagagcgagatcgaggccaagcaggagatccagcacctgagaaaggagctgatcgaggcccaggagctggccagaaccagcaagcagaagtgcttcgagctgcaggccctgctggaggaggagagaaaggcctacagaaaccaggtggaggagagcaccaagcagatccaggtgctgcaggcccagctgcagagactgcacatcgacaccgagaacctgagagaggagaaggacagcgagatcaccagcaccagagacgagctgctgagcgccagagacgagatcctgctgctgcaccaggccgccgccaaggtggccagcgagagagacaccgacatcgccagcctgcaggaggagctgaagaaggtgagagccgagctggagagatggagaaaggccgccagcgagtacgagaaggagatcaccagcctgcagaacagcttccagctgagatgccagcagtgcgaggaccagcagagagaggaggccaccagactgcagggcgagctggagaagctgagaaaggagtggaacgccctggagaccgagtgccacagcctgaagagagagaacgtgctgctgagcagcgagctgcagagacaggagaaggagctgcacaacagccagaagcagagcctggagctgaccagcgacctgagcatcctgcagatgagcagaaaggagctggagaaccaggtgggcagcctgaaggagcagcacctgagagacagcgccgacctgaagaccctgctgagcaaggccgagaaccaggccaaggacgtgcagaaggagtacgagaagacccagaccgtgctgagcgagctgaagctgaagttcgagatgaccgagcaggagaagcagagcatcaccgacgagctgaagcagtgcaagaacaacctgaagctgctgagagagaagggcaacaacaagccctggccctggatgcccatgctggccgccctggtggccgtgaccgccatcgtgctgtacgtgcccggcctggccagagccagcccctag

SEQ ID NO: 21765 - DNA, 957 bp, Artificial Sequence
  Description of Artificial Sequence: Synthetic coding sequence
atggacgagcaggacctgaacgagcccctggccaaggtgagcctgctgaaggccctgctggaggaggagagaaaggcctacagaaaccaggtggaggagagcaccaagcagatccaggtgctgcaggcccagctgcagagactgcacatcgacaccgagaacctgagagaggagaaggacagcgagatcaccagcaccagagacgagctgctgagcgccagagacgagatcctgctgctgcaccaggccgccgccaaggtggccagcgagagagacaccgacatcgccagcctgcaggaggagctgaagaaggtgagagccgagctggagagatggagaaaggccgccagcgagtacgagaaggagatcaccagcctgcagaacagcttccagctgagatgccagcagtgcgaggaccagcagagagaggaggccaccagactgcagggcgagctggagaagctgagaaaggagtggaacgccctggagaccgagtgccacagcctgaagagagagaacgtgctgctgagcagcgagctgcagagacaggagaaggagctgcacaacagccagaagcagagcctggagctgaccagcgacctgagcatcctgcagatgagcagaaaggagctggagaaccaggtgggcagcctgaaggagcagcacctgagagacagcgccgacctgaagaccctgctgagcaaggccgagaaccaggccaaggacgtgcagaaggagtacgagaagacccagaccgtgctgagcgagctgaagctgaagttcgagatgaccgagcaggagaagcagagcatcaccgacgagctgaagcagtgcaagaacaacctgaagctgctgagagagaagggcaacaaccccagcatcctgcagcccgtgcccgccgtgttcatcggcctgttcctggccttcctgttctggtgcttcggccccctgtggtag

SEQ ID NO: 21766 - DNA, 1089 bp, Artificial Sequence
  Description of Artificial Sequence: Synthetic coding sequence
atggacgagcaggacctgaacgagcccctggccaaggtgagcctgctgaaggacgacctgcagggcgcccagagcgagatcgaggccaagcaggagatccagcacctgagaaaggagctgatcgaggcccaggagctggccagaaccagcaagcagaagtgcttcgagctgcaggccctgctggaggaggagagaaaggcctacagaaaccaggtggaggagagcaccaagcagatccaggtgctgcaggcccagctgcagagactgcacatcgacaccgagaacctgagagaggagaaggacagcgagatcaccagcaccagagacgagctgctgagcgccagagacgagatcctgctgctgcaccaggccgccgccaaggtggccagcgagagagacaccgacatcgccagcctgcaggaggagctgaagaaggtgagagccgagctggagagatggagaaaggccgccagcgagtacgagaaggagatcaccagcctgcagaacagcttccagctgagatgccagcagtgcgaggaccagcagagagaggaggccaccagactgcagggcgagctggagaagctgagaaaggagtggaacgccctggagaccgagtgccacagcctgaagagagagaacgtgctgctgagcagcgagctgcagagacaggagaaggagctgcacaacagccagaagcagagcctggagctgaccagcgacctgagcatcctgcagatgagcagaaaggagctggagaaccaggtgggcagcctgaaggagcagcacctgagagacagcgccgacctgaagaccctgctgagcaaggccgagaaccaggccaaggacgtgcagaaggagtacgagaagacccagaccgtgctgagcgagctgaagctgaagttcgagatgaccgagcaggagaagcagagcatcaccgacgagctgaagcagtgcaagaacaacctgaagctgctgagagagaagggcaacaacaagccctggccctggatgcccatgctggccgccctggtggccgtgaccgccatcgtgctgtacgtgcccggcctggccagagccagcccctag

SEQ ID NO: 21767 - DNA, 1356 bp, Artificial Sequence
  Description of Artificial Sequence: Synthetic coding sequence
atggaggagaaggagcaggagctgcaggccaagatcgaggccctgcaggccgacaacgacttcaccaacgagagactgaccgccctgcaggagaaccagaccagagccaaggagagcgacttcagcgacaccctgagccccagcaaggagaagagcagcgacgacaccaccgacgcccagatggacgagcaggacctgaacgagcccctggccaaggtgagcctgctgaaggacgacctgcagggcgcccagagcgagatcgaggccaagcaggagatccagcacctgagaaaggagctgatcgaggcccaggagctggccagaaccagcaagcagaagtgcttcgagctgcaggccctgctggaggaggagagaaaggcctacagaaaccaggtggaggagagcaccaagcagatccaggtgctgcaggcccagctgcagagactgcacatcgacaccgagaacctgagagaggagaaggacagcgagatcaccagcaccagagacgagctgctgagcgccagagacgagatcctgctgctgcaccaggccgccgccaaggtggccagcgagagagacaccgacatcgccagcctgcaggaggagctgaagaaggtgagagccgagctggagagatggagaaaggccgccagcgagtacgagaaggagatcaccagcctgcagaacagcttccagctgagatgccagcagtgcgaggaccagcagagagaggaggccaccagactgcagggcgagctggagaagctgagaaaggagtggaacgccctggagaccgagtgccacagcctgaagagagagaacgtgctgctgagcagcgagctgcagagacaggagaaggagctgcacaacagccagaagcagagcctggagctgaccagcgacctgagcatcctgcagatgagcagaaaggagctggagaaccaggtgggcagcctgaaggagcagcacctgagagacagcgccgacctgaagaccctgctgagcaaggccgagaaccaggccaaggacgtgcagaaggagtacgagaagacccagaccgtgctgagcgagctgaagctgaagttcgagatgaccgagcaggagaagcagagcatcaccgacgagctgaagcagtgcaagaacaacctgaagctgctgagagagaagggcaacaaccccagcatcctgcagcccgtgcccagaatccacagacccatccccggcttccccgtgctggtgttcagaagcatcgtggtggagcagaagccctggccctggatgcccatgctggccgccctggtggccgtgaccgccatcgtgctgtacgtgcccggcctggccagagccagcccctag

SEQ ID NO: 21768 - DNA, 2427 bp, Artificial Sequence
  Description of Artificial Sequence: Synthetic coding sequence
atggccggcaccgtggtgctggacgacgtggagctgagagaggcccagagagactacctggacttcctggacgacgaggaggaccagggcatctaccagagcaaggtgagagagctgatcagcgacaaccagtacagactgatcgtgaacgtgaacgacctgagaagaaagaacgagaagagagccaacagactgctgaacaacgccttcgaggagctggtggccttccagagagccctgaaggacttcgtggccagcatcgacgccacctacgccaagcagtacgaggagttctacgtgggcctggagggcagcttcggcagcaagcacgtgagccccagaaccctgaccagctgcttcctgagctgcgtggtgtgcgtggagggcatcgtgaccaagtgcagcctggtgagacccaaggtggtgagaagcgtgcactactgccccgccaccaagaagaccatcgagagaagatacagcgacctgaccaccctggtggccttccccagcagcagcgtgtaccccaccaaggacgaggagaacaaccccctggagaccgagtacggcctgagcgtgtacaaggaccaccagaccatcaccatccaggagatgcccgagaaggcccccgccggccagctgcccagaagcgtggacgtgatcctggacgacgacctggtggacaaggccaagcccggcgacagagtgcaggtggtgggcacctacagatgcctgcccggcaagaagggcggctacaccagcggcaccttcagaaccgtgctgatcgcctgcaacgtgaagcagatgagcaaggacgcccagcccagcttcagcgccgaggacatcgccaagatcaagaagttcagcaagaccagaagcaaggacatcttcgaccagctggccaagagcctggcccccagcatccacggccacgactacgtgaagaaggccatcctgtgcctgctgctgggcggcgtggagagagacctggagaacggcagccacatcagaggcgacatcaacatcctgctgatcggcgaccccagcgtggccaagagccagctgctgagatacgtgctgtgcaccgcccccagagccatccccaccaccggcagaggcagcagcggcgtgggcctgaccgccgccgtgaccaccgaccaggagaccggcgagagaagactggaggccggcgccatggtgctggccgacagaggcgtggtgtgcatcgacgagttcgacaagatgagcgacatggacagaaccgccatccacgaggtgatggagcagggcagagtgaccatcgccaaggccggcatccacgccagactgaacgccagatgcagcgtgctggccgccgccaaccccgtgtacggcagatacgaccagtacaagacccccatggagaacatcggcctgcaggacagcctgctgagcagattcgacctgctgttcatcatgctggaccagatggaccccgagcaggacagagagatcagcgaccacgtgctgagaatgcacagatacagagcccccggcgagcaggacggcgacgccatgcccctgggcagcgccgtggacatcctggccaccgacgaccccaacttcagccaggaggaccagcaggacacccagatctacgagaagcacgacaacctgctgcacggcaccaagaagaagaaggagaagatggtgagcgccgccttcatgaagaagtacatccacgtggccaagatcatcaagcccgtgctgacccaggagagcgccacctacatcgccgaggagtacagcagactgagaagccaggacagcatgagcagcgacaccgccagaaccagccccgtgaccgccagaaccctggagaccctgatcagactggccaccgcccacgccaaggccagaatgagcaagaccgtggacctgcaggacgccgaggaggccgtggagctggtgcagtacgcctacttcaagaaggtgctggagaaggagaagaagagaaagaagagaagcgaggacgagagcgagaccgaggacgaggaggagaagagccaggaggaccaggagcagaagagaaagagaagaaagaccagacagcccgacgccaaggacggcgacagctacgacccctacgacttcagcgacaccgaggaggagatgccccaggtgcacacccccaagaccgccgacagccaggagaccaaggagagccagaaggtggagctgagcgagagcagactgaaggccttcaaggtggccctgctggacgtgttcagagaggcccacgcccagagcatcggcatgaacagactgaccgagagcatcaacagagacagcgaggagcccttcagcagcgtggagatccaggccgccctgagcaagatgcaggacgacaaccaggtgatggtgagcgagggcatcatcttcctgatctag

SEQ ID NO: 21769 - DNA, 351 bp, Artificial Sequence
  Description of Artificial Sequence: Synthetic coding sequence
atgctggaggccgcccagccccagggcagcaccagcgagaccccctggaacaccgccatccccctgcccagctgctgggaccagagcttcctgaccaacatcaccttcctgaaggtgctgctgtggctggtgctgctgggcctgttcgtggagctggagttcggcctggcctacttcgtgctgagcctgttctactggatgtacgtgggcaccagaggccccgaggagaagaaggagggcgagaagagcgcctacagcgtgttcaaccccggctgcgaggccatccagggcaccctgaccgccgagcagctggagagagagctgcagctgagacccctggccggcagatag

SEQ ID NO: 21770 - DNA, 1074 bp, Artificial Sequence
  Description of Artificial Sequence: Synthetic coding sequence
atggagaacaaggccatgtacctgcacaccgtgagcgactgcgacaccagcagcatctgcgaggacagcttcgacggcagaagcctgagcaagctgaacctgtgcgaggacgtgagcagacccagaagcagccccgacgacctgaaggccctgaccagaaacgtgaacagactgaacgagagcttcagagacctgcagctgagactgctgcaggcccccctgcaggccgacctgaccgagcaggtgtggaaggtgcaggacgccctgcagaaccagagcgacagcctgctggccctggccggcgccgtgcagagactggagggcgccctgtggggcctgcaggcccaggccgtgcagaccgagcaggccgtggccctgctgagagacagaaccggccagcagagcgacaccgcccagctggagctgtaccagctgcaggtggagagcaacagcagccagctgctgctgagaagacacgccggcctgctggacggcctggccagaagagtgggcatcctgggcgaggagctggccgacgtgggcggcgtgctgagaggcctgaaccacagcctgagctacgacgtggccctgcacagaaccagactgcaggacctgagagtgctggtgagcaacgccagcgaggacaccagaagactgagactggcccacgtgggcatggagctgcagctgaagcaggagctggccatgctgaacgccgtgaccgaggacctgagactgaaggactgggagcacagcatcgccctgagaaacatcagcctggccaagggcccccccggccccaagggcgaccagggcgacgagggcaaggagggcagacccggcatccccggcctgcccggcctgagaggcctgcccggcgagagaggcacccccggcctgcccggccccaagggcgacgacggcaagctgggcgccaccggccccatgggcatgagaggcttcaagggcgacagaggccccaagggcgagaagggcgagaagggcgacagagccggcgacgccagcaaggacatcctgctgggcccctgggacatggtgctggcccagggctag

SEQ ID NO: 21771 - DNA, 1488 bp, Artificial Sequence
  Description of Artificial Sequence: Synthetic coding sequence
atggagaacaaggccatgtacctgcacaccgtgagcgactgcgacaccagcagcatctgcgaggacagcttcgacggcagaagcctgagcaagctgaacctgtgcgaggacggcccctgccacaagagaagagccagcatctgctgcacccagctgggcagcctgagcgccctgaagcacgccgtgctgggcctgtacctgctggtgttcctgatcctggtgggcatcttcatcctggccgtgagcagacccagaagcagccccgacgacctgaaggccctgaccagaaacgtgaacagactgaacgagagcttcagagacctgcagctgagactgctgcaggcccccctgcaggccgacctgaccgagcaggtgtggaaggtgcaggacgccctgcagaaccagagcgacagcctgctggccctggccggcgccgtgcagagactggagggcgccctgtggggcctgcaggcccaggccgtgcagaccgagcaggccgtggccctgctgagagacagaaccggccagcagagcgacaccgcccagctggagctgtaccagctgcaggtggagagcaacagcagccagctgctgctgagaagacacgccggcctgctggacggcctggccagaagagtgggcatcctgggcgaggagctggccgacgtgggcggcgtgctgagaggcctgaaccacagcctgagctacgacgtggccctgcacagaaccagactgcaggacctgagagtgctggtgagcaacgccagcgaggacaccagaagactgagactggcccacgtgggcatggagctgcagctgaagcaggagctggccatgctgaacgccgtgaccgaggacctgagactgaaggactgggagcacagcatcgccctgagaaacatcagcctggccaagggcccccccggccccaagggcgaccagggcgacgagggcaaggagggcagacccggcatccccggcctgcccggcctgagaggcctgcccggcgagagaggcacccccggcctgcccggccccaagggcgacgacggcaagctgggcgccaccggccccatgggcatgagaggcttcaagggcgacagaggccccaagggcgagaagggcgagaagggcgacagagccggcgacgccagcggcgtggaggcccccatgatgatcagactggtgaacggcagcggcccccacgagggcagagtggaggtgtaccacgacagaagatggggcaccgtgtgcgacgacggctgggacaagaaggacggcgacgtggtgtgcagaatgctgggcttcagaggcgtggaggaggtgtacagaaccgccagattcggccagggcaccggcagaatctggatggacgacgtggcctgcaagggcaccgaggagaccatcttcagatgcagcttcagcaagtggggcgtgaccaactgcggccacgccgaggacgccagcgtgacctgcaacagacactag

SEQ ID NO: 21772 - DNA, 813 bp, Artificial Sequence
  Description of Artificial Sequence: Synthetic coding sequence
atggagaacaaggccatgtacctgcacaccgtgagcgactgcgacaccagcagcatctgcgaggacagcttcgacggcagaagcctgagcaagctgaacctgtgcgaggacggcccctgccacaagagaagagccagcatctgctgcacccagctgggcagcctgagcgccctgaagcacgccgtgctgggcctgtacctgctggtgttcctgatcctggtgggcatcttcatcctggccggcccccccggccccaagggcgaccagggcgacgagggcaaggagggcagacccggcatccccggcctgcccggcctgagaggcctgcccggcgagagaggcacccccggcctgcccggccccaagggcgacgacggcaagctgggcgccaccggccccatgggcatgagaggcttcaagggcgacagaggccccaagggcgagaagggcgagaagggcgacagagccggcgacgccagcggcgtggaggcccccatgatgatcagactggtgaacggcagcggcccccacgagggcagagtggaggtgtaccacgacagaagatggggcaccgtgtgcgacgacggctgggacaagaaggacggcgacgtggtgtgcagaatgctgggcttcagaggcgtggaggaggtgtacagaaccgccagattcggccagggcaccggcagaatctggatggacgacgtggcctgcaagggcaccgaggagaccatcttcagatgcagcttcagcaagtggggcgtgaccaactgcggccacgccgaggacgccagcgtgacctgcaacagacactag

SEQ ID NO: 21773 - DNA, 1074 bp, Artificial Sequence; identical to SEQ ID NO: 21770
  Description of Artificial Sequence: Synthetic coding sequence

SEQ ID NO: 21774 - DNA, 1203 bp, Artificial Sequence
  Description of Artificial Sequence: Synthetic coding sequence
atggagaacaaggccatgtacctgcacaccgtgagcgactgcgacaccagcagcatctgcgaggacagcttcgacggcagaagcctgagcaagctgaacctgtgcgaggacggcccctgccacaagagaagagccagcatctgctgcacccagctgggcagcctgagcgccctgaagcacgccgtgctgggcctgtacctgctggtgttcctgatcctggtgggcatcttcatcctggccgtgagcagacccagaagcagccccgacgacctgaaggccctgaccagaaacgtgaacagactgaacgagagcttcagagacctgcagctgagactgctgcaggcccccctgcaggccgacctgaccgagcaggtgtggaaggtgcaggacgccctgcagaaccagagcgacagcctgctggccctggccggcgccgtgcagagactggagggcgccctgtggggcctgcaggcccaggccgtgcagaccgagcaggccgtggccctgctgagagacagaaccggccagcagagcgacaccgcccagctggagctgtaccagctgcaggtggagagcaacagcagccagctgctgctgagaagacacgccggcctgctggacggcctggccagaagagtgggcatcctgggcgaggagctggccgacgtgggcggcgtgctgagaggcctgaaccacagcctgagctacgacgtggccctgcacagaaccagactgcaggacctgagagtgctggtgagcaacgccagcgaggacaccagaagactgagactggcccacgtgggcatggagctgcagctgaagcaggagctggccatgctgaacgccgtgaccgaggacctgagactgaaggactgggagcacagcatcgccctgagaaacatcagcctggccaagggcccccccggccccaagggcgaccagggcgacgagggcaaggagggcagacccggcatccccggcctgcccggcctgagaggcctgcccggcgagagaggcacccccggcctgcccggccccaagggcgacgacggcaagctgggcgccaccggccccatgggcatgagaggcttcaagggcgacagaggccccaagggcgagaagggcgagaagggcgacagagccggcgacgccagcaaggacatcctgctgggcccctgggacatggtgctggcccagggctag

SEQ ID NO: 21775 - DNA, 1002 bp, Artificial Sequence
  Description of Artificial Sequence: Synthetic coding sequence
atggtgcacggcaacatcacccccgagaacatcatcctgaacaagagcggcgcctggaagatcatgggcttcgacttctgcgtgagcagcaccaaccccagcgagcaggagcccaagttcccctgcaaggagtgggaccccaacctgcccagcctgtgcctgcccaaccccgagtacctggcccccgagtacatcctgagcgtgagctgcgagaccgccagcgacatgtacagcctgggcaccgtgatgtacgccgtgttcaacaagggcaagcccatcttcgaggtgaacaagcaggacatctacaagagcttcagcagacagctggaccagctgagcagactgggcagcagcagcctgaccaacatccccgaggaggtgagagagcacgtgaagctgctgctgaacgtgacccccaccgtgagacccgacgccgaccagatgaccaagatccccttcttcgacgacgtgggcgccgtgaccctgcagtacttcgacaccctgttccagagagacaacctgcagaagagccagttcttcaagggcctgcccaaggtgctgcccaagctgcccaagagagtgatcgtgcagagaatcctgccctgcctgaccagcgagttcgtgaaccccgacatggtgcccttcgtgctgcccaacgtgctgctgatcgccgaggagtgcaccaaggaggagtacgtgaagctgatcctgcccgagctgggccccgtgttcaagcagcaggagcccatccagatcctgctgatcttcctgcagaagatggacctgctgctgaccaagaccccccccgacgagatcaagaacagcgtgctgcccatggtgtacagagccctggaggcccccagcatccagatccaggagctgtgcctgaacatcatccccaccttcgccaacctgatcgactaccccagcatgaagaacgccctgatccccagaatcaagaacgcctgctacaagcacctgcccctgagattccagcagtag

SEQ ID NO: 21776 - DNA, 2790 bp, Artificial Sequence
  Description of Artificial Sequence: Synthetic coding sequence
atggagagcatgctgaacaagctgaagagcaccgtgaccaaggtgaccgccgacgtgaccagcgccgtgatgggcaaccccgtgaccagagagttcgacgtgggcagacacatcgccagcggcggcaacggcctggcctggaagatcttcaacggcaccaagaagagcaccaagcaggaggtggccgtgttcgtgttcgacaagaagctgatcgacaagtaccagaagttcgagaaggaccagatcatcgacagcctgaagagaggcgtgcagcagctgaccagactgagacaccccagactgctgaccgtgcagcaccccctggaggagagcagagactgcctggccttctgcaccgagcccgtgttcgccagcctggccaacgtgctgggcaactgggagaacctgcccagccccatcagccccgacatcaaggactacaagctgtacgacgtggagaccaagtacggcctgctgcaggtgagcgagggcctgagcttcctgcacagcagcgtgaagatggtgcacggcaacatcacccccgagaacatcatcctgaacaagagcggcgcctggaagatcatgggcttcgacttctgcgtgagcagcaccaaccccagcgagcaggagcccaagttcccctgcaaggagtgggaccccaacctgcccagcctgtgcctgcccaaccccgagtacctggcccccgagtacatcctgagcgtgagctgcgagaccgccagcgacatgtacagcctgggcaccgtgatgtacgccgtgttcaacaagggcaagcccatcttcgaggtgaacaagcaggacatctacaagagcttcagcagacagctggaccagctgagcagactgggcagcagcagcctgaccaacatccccgaggaggtgagagagcacgtgaagctgctgctgaacgtgacccccaccgtgagacccgacgccgaccagatgaccaagatccccttcttcgacgacgtgggcgccgtgaccctgcagtacttcgacaccctgttccagagagacaacctgcagaagagccagttcttcaagggcctgcccaaggtgctgcccaagctgcccaagagagtgatcgtgcagagaatcctgccctgcctgaccagcgagttcgtgaaccccgacatggtgcccttcgtgctgcccaacgtgctgctgatcgccgaggagtgcaccaaggaggagtacgtgaagctgatcctgcccgagctgggccccgtgttcaagcagcaggagcccatccagatcctgctgatcttcctgcagaagatggacctgctgctgaccaagaccccccccgacgagatcaagaacagcgtgctgcccatggtgtacagagccctggaggcccccagcatccagatccaggagctgtgcctgaacatcatccccaccttcgccaacctgatcgactaccccagcatgaagaacgccctgatccccagaatcaagaacgcctgcctgcagaccagcagcctggccgtgagagtgaacagcctggtgtgcctgggcaagatcctggagtacctggacaagtggttcgtgctggacgacatcctgcccttcctgcagcagatccccagcaaggagcccgccgtgctgatgggcatcctgggcatctacaagtgcaccttcacccacaagaagctgggcatcaccaaggagcagctggccggcaaggtgctgccccacctgatccccctgagcatcgagaacaacctgaacctgaaccagttcaacagcttcatcagcgtgatcaaggagatgctgaacagactggagagcgagcacaagaccaagctggagcagctgcacatcatgcaggagcagcagaagagcctggacatcggcaaccagatgaacgtgagcgaggagatgaaggtgaccaacatcggcaaccagcagatcgacaaggtgttcaacaacatcggcgccgacctgctgaccggcagcgagagcgagaacaaggaggacggcctgcagaacaagcacaagagagccagcctgaccctggaggagaagcagaagctggccaaggagcaggagcaggcccagaagctgaagagccagcagcccctgaagccccaggtgcacacccccgtggccaccgtgaagcagaccaaggacctgaccgacaccctgatggacaacatgagcagcctgaccagcctgagcgtgagcacccccaagagcagcgccagcagcaccttcaccagcgtgcccagcatgggcatcggcatgatgttcagcacccccaccgacaacaccaagagaaacctgaccaacggcctgaacgccaacatgggcttccagaccagcggcttcaacatgcccgtgaacaccaaccagaacttctacagcagccccagcaccgtgggcgtgaccaagatgaccctgggcaccccccccaccctgcccaacttcaacgccctgagcgtgccccccgccggcgccaagcagacccagcagagacccaccgacatgagcgccctgaacaacctgttcggcccccagaagcccaaggtgagcatgaaccagctgagccagcagaagcccaaccagtggctgaaccagttcgtgcccccccagggcagccccaccatgggcagcagcgtgatgggcacccagatgaacgtgatcggccagagcgccttcggcatgcagggcaaccccttcttcaacccccagaacttcgcccagccccccaccaccatgaccaacagcagcagcgccagcaacgacctgaaggacctgttcggctag

SEQ ID NO: 21777 - DNA, 2046 bp, Artificial Sequence
  Description of Artificial Sequence: Synthetic coding sequence
atggagagcatgctgaacaagctgaagagcaccgtgaccaaggtgaccgccgacgtgaccagcgccgtgatgggcaaccccgtgaccagagagttcgacgtgggcagacacatcgccagcggcggcaacggcctggcctggaagatcttcaacggcaccaagaagagcaccaagcaggaggtggccgtgttcgtgttcgacaagaagctgatcgacaagtaccagaagttcgagaaggaccagatcatcgacagcctgaagagaggcgtgcagcagctgaccagactgagacaccccagactgctgaccgtgcagcaccccctggaggagagcagagactgcctggccttctgcaccgagcccgtgttcgccagcctggccaacgtgctgggcaactgggagaacctgcccagccccatcagccccgacatcaaggactacaagctgtacgacgtggagaccaagtacggcctgctgcaggtgagcgagggcctgagcttcctgcacagcagcgtgaagatggtgcacggcaacatcacccccgagaacatcatcctgaacaagagcggcgcctggaagatcatgggcttcgacttctgcgtgagcagcaccaaccccagcgagcaggagcccaagttcccctgcaaggagtgggaccccaacctgcccagcctgtgcctgcccaaccccgagtacctggcccccgagtacatcctgagcgtgagctgcgagaccgccagcgacatgtacagcctgggcaccgtgatgtacgccgtgttcaacaagggcaagcccatcttcgaggtgaacaagcaggacatctacaagagcttcagcagacagctggaccagctgagcagactgggcagcagcagcctgaccaacatccccgaggaggtgagagagcacgtgaagctgctgctgaacgtgacccccaccgtgagacccgacgccgaccagatgaccaagatccccttcttcgacgacgtgggcgccgtgaccctgcagtacttcgacaccctgttccagagagacaacctgcagaagagccagttcttcaagggcctgcccaaggtgctgcccaagctgcccaagagagtgatcgtgcagagaatcctgccctgcctgaccagcgagttcgtgaaccccgacatggtgcccttcgtgctgcccaacgtgctgctgatcgccgaggagtgcaccaaggaggagtacgtgaagctgatcctgcccgagctgggccccgtgttcaagcagcaggagcccatccagatcctgctgatcttcctgcagaagatggacctgctgctgaccaagaccccccccgacgagatcaagaacagcgtgctgcccatggtgtacagagccctggaggcccccagcatccagatccaggagctgtgcctgaacatcatccccaccttcgccaacctgatcgactaccccagcatgaagaacgccctgatccccagaatcaagaacgcctgcctgcagaccagcagcctggccgtgagagtgaacagcctggtgtgcctgggcaagatcctggagtacctggacaagtggttcgtgctggacgacatcctgcccttcctgcagcagatccccagcaaggagcccgccgtgctgatgggcatcctgggcatctacaagtgcaccttcacccacaagaagctgggcatcaccaaggagcagctggccggcaaggtgctgccccacctgatccccctgagcatcgagaacaacctgaacctgaaccagttcaacagcttcatcagcgtgatcaaggagatgctgaacagactggagagcgagcacaagaccaagctggagcagctgcacatcatgcaggagcagcagaagagcctggacatcggcaaccagatgaacgtgagcgaggagatgaaggtgaccaacatcggcaaccagcagatcgacaaggtgttcaacaacatcggcgccgacctgctgaccggcagcgagagcgagaacaaggaggacggcctgcagaacaagcacaagagagccagcctgaccctggagtag

SEQ ID NO: 21778 - DNA, 1653 bp, Artificial Sequence
  Description of Artificial Sequence: Synthetic coding sequence
atgcccaccgaggagaacatcgacagaatgtgccaggacctgagaaaccagctgtacgagagctactacctgaacttcatcagcgccatcagcagaagcaagctggaggacatcgccaacgccgccctggccgccagcgccgtgacccaggtggccaaggtgttcgaccagtacctgaacttcatcaccctggaggacgacatgttcgtgctgtgcaaccagaacaaggagctggtgagctacagagccatcaacagacccgacatcaccgacaccgagatggagaccgtgatggacaccatcgtggacagcctgttctgcttcttcgtgaccctgggcgccgtgcccatcatcagatgcagcagaggcaccgccgccgagatggtggccgtgaagctggacaagaagctgagagagaacctgagagacgccagaaacagcctgttcaccggcgacaccctgggcgccggccagttcagcttccagagacccctgctggtgctggtggacagaaacatcgacctggccacccccctgcaccacacctggacctaccaggccctggtgcacgacgtgctggacttccacctgaacagagtgaacctggaggagagcagcggcgtggagaacagccccgccggcgccagacccaagagaaagaacaagaagagctacgacctgacccccgtggacaagttctggcagaagcacaagggcagccccttccccgaggtggccgagagcgtgcagcaggagctggagagctacagagcccaggaggacgaggtgaagagactgaagagcatcatgggcctggagggcgaggacgagggcgccatcagcatgctgagcgacaacaccgccaagctgaccagcgccgtgagcagcctgcccgagctgctggagaagaagagactgatcgacctgcacaccaacgtggccaccgccgtgctggagcacatcaaggccagaaagctggacgtgtacttcgagtacgaggagaagatcatgagcaagaccaccctggacaagagcctgctggacatcatcagcgaccccgacgccggcacccccgaggacaagatgagactgttcctgatctactacatcagcacccagcaggcccccagcgaggccgacctggagcagtacaagaaggccctgaccgacgccggctgcaacctgaaccccctgcagtacatcaagcagtggaaggccttcaccaagatggccagcgcccccgccagctacggcagcaccaccaccaagcccatgggcctgctgagcagagtgatgaacaccggcagccagttcgtgatggagggcgtgaagaacctggtgctgaagcagcagaacctgcccgtgaccagaatcctggacaacctgatggagatgaagagcaaccccgagaccgacgactacagatacttcgaccccaagatgctgagaggcaacgacagcagcgtgcccagaaacaagaaccccttccaggaggccatcgtgttcgtggtgggcggcggcaactacatcgagtaccagaacctggtggactacatcaagggcaagcagggcaagcacatcctgtacggctgcagcgagctgttcaacgccacccagttcatcaagcagctgagccagctgggccagaagtag

SEQ ID NO: 21779 - DNA, 1752 bp, Artificial Sequence
  Description of Artificial Sequence: Synthetic coding sequence
atgtgcctgatcctgaagaccgcccaggagaaccagtacggcagactgctgcacagcgacagagaccccatccccgacgtgcccgccgtgtacttcgtgatgcccaccgaggagaacatcgacagaatgtgccaggacctgagaaaccagctgtacgagagctactacctgaacttcatcagcgccatcagcagaagcaagctggaggacatcgccaacgccgccctggccgccagcgccgtgacccaggtggccaaggtgttcgaccagtacctgaacttcatcaccctggaggacgacatgttcgtgctgtgcaaccagaacaaggagctggtgagctacagagccatcaacagacccgacatcaccgacaccgagatggagaccgtgatggacaccatcgtggacagcctgttctgcttcttcgtgaccctgggcgccgtgcccatcatcagatgcagcagaggcaccgccgccgagatggtggccgtgaagctggacaagaagctgagagagaacctgagagacgccagaaacagcctgttcaccggcgacaccctgggcgccggccagttcagcttccagagacccctgctggtgctggtggacagaaacatcgacctggccacccccctgcaccacacctggacctaccaggccctggtgcacgacgtgctggacttccacctgaacagagtgaacctggaggagagcagcggcgtggagaacagccccgccggcgccagacccaagagaaagaacaagaagagctacgacctgacccccgtggacaagttctggcagaagcacaagggcagccccttccccgaggtggccgagagcgtgcagcaggagctggagagctacagagcccaggaggacgaggtgaagagactgaagagcatcatgggcctggagggcgaggacgagggcgccatcagcatgctgagcgacaacaccgccaagctgaccagcgccgtgagcagcctgcccgagctgctggagaagaagagactgatcgacctgcacaccaacgtggccaccgccgtgctggagcacatcaaggccagaaagctggacgtgtacttcgagtacgaggagaagatcatgagcaagaccaccctggacaagagcctgctggacatcatcagcgaccccgacgccggcacccccgaggacaagatgagactgttcctgatctactacatcagcacccagcaggcccccagcgaggccgacctggagcagtacaagaaggccctgaccgacgccggctgcaacctgaaccccctgcagtacatcaagcagtggaaggccttcaccaagatggccagcgcccccgccagctacggcagcaccaccaccaagcccatgggcctgctgagcagagtgatgaacaccggcagccagttcgtgatggagggcgtgaagaacctggtgctgaagcagcagaacctgcccgtgaccagaatcctggacaacctgatggagatgaagagcaaccccgagaccgacgactacagatacttcgaccccaagatgctgagaggcaacgacagcagcgtgcccagaaacaagaaccccttccaggaggccatcgtgttcgtggtgggcggcggcaactacatcgagtaccagaacctggtggactacatcaagggcaagcagggcaagcacatcctgtacggctgcagcgagctgttcaacgccacccagttcatcaagcagctgagccagctgggccagaagtag

SEQ ID NO: 21780 - DNA, 1929 bp, Artificial Sequence
  Description of Artificial Sequence: Synthetic coding sequence
atggccgccgccgccgccgccaccgccgccgccgccgccagcatcagagagagacagaccgtggccctgaagagaatgctgaacttcaacgtgccccacatcaagaacagcaccggcgagcccgtgtggaaggtgctgatctacgacagattcggccaggacatcatcagccccctgctgagcgtgaaggagctgagagacatgggcatcaccctgcacctgctgctgcacagcgacagagaccccatccccgacgtgcccgccgtgtacttcgtgatgcccaccgaggagaacatcgacagaatgtgccaggacctgagaaaccagctgtacgagagctactacctgaacttcatcagcgccatcagcagaagcaagctggaggacatcgccaacgccgccctggccgccagcgccgtgacccaggtggccaaggtgttcgaccagtacctgaacttcatcaccctggaggacgacatgttcgtgctgtgcaaccagaacaaggagctggtgagctacagagccatcaacagacccgacatcaccgacaccgagatggagaccgtgatggacaccatcgtggacagcctgttctgcttcttcgtgaccctgggcgccgtgcccatcatcagatgcagcagaggcaccgccgccgagatggtggccgtgaagctggacaagaagctgagagagaacctgagagacgccagaaacagcctgttcaccggcgacaccctgggcgccggccagttcagcttccagagacccctgctggtgctggtggacagaaacatcgacctggccacccccctgcaccacacctggacctaccaggccctggtgcacgacgtgctggacttccacctgaacagagtgaacctggaggagagcagcggcgtggagaacagccccgccggcgccagacccaagagaaagaacaagaagagctacgacctgacccccgtggacaagttctggcagaagcacaagggcagccccttccccgaggtggccgagagcgtgcagcaggagctggagagctacagagcccaggaggacgaggtgaagagactgaagagcatcatgggcctggagggcgaggacgagggcgccatcagcatgctgagcgacaacaccgccaagctgaccagcgccgtgagcagcctgcccgagctgctggagaagaagagactgatcgacctgcacaccaacgtggccaccgccgtgctggagcacatcaaggccagaaagctggacgtgtacttcgagtacgaggagaagatcatgagcaagaccaccctggacaagagcctgctggacatcatcagcgaccccgacgccggcacccccgaggacaagatgagactgttcctgatctactacatcagcacccagcaggcccccagcgaggccgacctggagcagtacaagaaggccctgaccgacgccggctgcaacctgaaccccctgcagtacatcaagcagtggaaggccttcaccaagatggccagcgcccccgccagctacggcagcaccaccaccaagcccatgggcctgctgagcagagtgatgaacaccggcagccagttcgtgatggagggcgtgaagaacctggtgctgaagcagcagaacctgcccgtgaccagaatcctggacaacctgatggagatgaagagcaaccccgagaccgacgactacagatacttcgaccccaagatgctgagaggcaacgacagcagcgtgcccagaaacaagaaccccttccaggaggccatcgtgttcgtggtgggcggcggcaactacatcgagtaccagaacctggtggactacatcaagggcaagcagggcaagcacatcctgtacggctgcagcgagctgttcaacgccacccagttcatcaagcagctgagccagctgggccagaagtag

SEQ ID NO: 21781 - DNA, 1374 bp, Artificial Sequence
  Description of Artificial Sequence: Synthetic coding sequence
atggagaccgtgatggacaccatcgtggacagcctgttctgcttcttcgtgaccctgggcgccgtgcccatcatcagatgcagcagaggcaccgccgccgagatggtggccgtgaagctggacaagaagctgagagagaacctgagagacgccagaaacagcctgttcaccggcgacaccctgggcgccggccagttcagcttccagagacccctgctggtgctggtggacagaaacatcgacctggccacccccctgcaccacacctggacctaccaggccctggtgcacgacgtgctggacttccacctgaacagagtgaacctggaggagagcagcggcgtggagaacagccccgccggcgccagacccaagagaaagaacaagaagagctacgacctgacccccgtggacaagttctggcagaagcacaagggcagccccttccccgaggtggccgagagcgtgcagcaggagctggagagctacagagcccaggaggacgaggtgaagagactgaagagcatcatgggcctggagggcgaggacgagggcgccatcagcatgctgagcgacaacaccgccaagctgaccagcgccgtgagcagcctgcccgagctgctggagaagaagagactgatcgacctgcacaccaacgtggccaccgccgtgctggagcacatcaaggccagaaagctggacgtgtacttcgagtacgaggagaagatcatgagcaagaccaccctggacaagagcctgctggacatcatcagcgaccccgacgccggcacccccgaggacaagatgagactgttcctgatctactacatcagcacccagcaggcccccagcgaggccgacctggagcagtacaagaaggccctgaccgacgccggctgcaacctgaaccccctgcagtacatcaagcagtggaaggccttcaccaagatggccagcgcccccgccagctacggcagcaccaccaccaagcccatgggcctgctgagcagagtgatgaacaccggcagccagttcgtgatggagggcgtgaagaacctggtgctgaagcagcagaacctgcccgtgaccagaatcctggacaacctgatggagatgaagagcaaccccgagaccgacgactacagatacttcgaccccaagatgctgagaggcaacgacagcagcgtgcccagaaacaagaaccccttccaggaggccatcgtgttcgtggtgggcggcggcaactacatcgagtaccagaacctggtggactacatcaagggcaagcagggcaagcacatcctgtacggctgcagcgagctgttcaacgccacccagttcatcaagcagctgagccagctgggccagaagtag

SEQ ID NO: 21782 - DNA, 1728 bp, Artificial Sequence
  Description of Artificial Sequence: Synthetic coding sequence
atgggcatcaccctgcacctgctgctgcacagcgacagagaccccatccccgacgtgcccgccgtgtacttcgtgatgcccaccgaggagaacatcgacagaatgtgccaggacctgagaaaccagctgtacgagagctactacctgaacttcatcagcgccatcagcagaagcaagctggaggacatcgccaacgccgccctggccgccagcgccgtgacccaggtggccaaggtgttcgaccagtacctgaacttcatcaccctggaggacgacatgttcgtgctgtgcaaccagaacaaggagctggtgagctacagagccatcaacagacccgacatcaccgacaccgagatggagaccgtgatggacaccatcgtggacagcctgttctgcttcttcgtgaccctgggcgccgtgcccatcatcagatgcagcagaggcaccgccgccgagatggtggccgtgaagctggacaagaagctgagagagaacctgagagacgccagaaacagcctgttcaccggcgacaccctgggcgccggccagttcagcttccagagacccctgctggtgctggtggacagaaacatcgacctggccacccccctgcaccacacctggacctaccaggccctggtgcacgacgtgctggacttccacctgaacagagtgaacctggaggagagcagcggcgtggagaacagccccgccggcgccagacccaagagaaagaacaagaagagctacgacctgacccccgtggacaagttctggcagaagcacaagggcagccccttccccgaggtggccgagagcgtgcagcaggagctggagagctacagagcccaggaggacgaggtgaagagactgaagagcatcatgggcctggagggcgaggacgagggcgccatcagcatgctgagcgacaacaccgccaagctgaccagcgccgtgagcagcctgcccgagctgctggagaagaagagactgatcgacctgcacaccaacgtggccaccgccgtgctggagcacatcaaggccagaaagctggacgtgtacttcgagtacgaggagaagatcatgagcaagaccaccctggacaagagcctgctggacatcatcagcgaccccgacgccggcacccccgaggacaagatgagactgttcctgatctactacatcagcacccagcaggcccccagcgaggccgacctggagcagtacaagaaggccctgaccgacgccggctgcaacctgaaccccctgcagtacatcaagcagtggaaggccttcaccaagatggccagcgcccccgccagctacggcagcaccaccaccaagcccatgggcctgctgagcagagtgatgaacaccggcagccagttcgtgatggagggcgtgaagaacctggtgctgaagcagcagaacctgcccgtgaccagaatcctggacaacctgatggagatgaagagcaaccccgagaccgacgactacagatacttcgaccccaagatgctgagaggcaacgacagcagcgtgcccagaaacaagaaccccttccaggaggccatcgtgttcgtggtgggcggcggcaactacatcgagtaccagaacctggtggactacatcaagggcaagcagggcaagcacatcctgtacggctgcagcgagctgttcaacgccacccagttcatcaagcagctgagccagctgggccagaagtag

SEQ ID NO: 21783 - DNA, 540 bp, Artificial Sequence
  Description of Artificial Sequence: Synthetic coding sequence
atgctgagcctggacttcctggacgacgtgagaagaatgaacaagagacagctgtactaccaggtgctgaacttcggcatgatcgtgagcagcgccctgatgatctggaagggcctgatggtgatcaccggcagcgagagccccatcgtggtggtgctgagcggcagcatggagcccgccttccacagaggcgacctgctgttcctgaccaacagagtggaggaccccatcagagtgggcgagatcgtggtgttcagaatcgagggcagagagatccccatcgtgcacagagtgctgaagatccacgagaagcagaacggccacatcaagttcctgaccaagggcgacaacaacgccgtggacgacagaggcctgtacaagcagggccagcactggctggagaagaaggacgtggtgggcagagccagaggcttcgtgccctacatcggcatcgtgaccatcctgatgaacgactaccccaagttcaagtacgccgtgctgttcctgctgggcctgttcgtgctggtgcacagagagtag

SEQ ID NO: 21784 - DNA, 462 bp, Artificial Sequence
  Description of Artificial Sequence: Synthetic coding sequence
atgatcgtgagcagcgccctgatgatctggaagggcctgatggtgatcaccggcagcgagagccccatcgtggtggtgctgagcggcagcatggagcccgccttccacagaggcgacctgctgttcctgaccaacagagtggaggaccccatcagagtgggcgagatcgtggtgttcagaatcgagggcagagagatccccatcgtgcacagagtgctgaagatccacgagaagcagaacggccacatcaagttcctgaccaagggcgacaacaacgccgtggacgacagaggcctgtacaagcagggccagcactggctggagaagaaggacgtggtgggcagagccagaggcttcgtgccctacatcggcatcgtgaccatcctgatgaacgactaccccaagttcaagtacgccgtgctgttcctgctgggcctgttcgtgctggtgcacagagagtag

SEQ ID NO: 21785 - DNA, 579 bp, Artificial Sequence
  Description of Artificial Sequence: Synthetic coding sequence
atggtgagagccggcgccgtgggcgcccacctgcccgccagcggcctggacatcttcggcgacctgaagaagatgaacaagagacagctgtactaccaggtgctgaacttcgccatgatcgtgagcagcgccctgatgatctggaagggcctgatcgtgctgaccggcagcgagagccccatcgtggtggtgctgagcggcagcatggagcccgccttccacagaggcgacctgctgttcctgaccaacttcagagaggaccccatcagagccggcgagatcgtggtgttcaaggtggagggcagagacatccccatcgtgcacagagtgatcaaggtgcacgagaaggacaacggcgacatcaagttcctgaccaagggcgacaacaacgaggtggacgacagaggcctgtacaaggagggccagaactggctggagaagaaggacgtggtgggcagagccagaggcttcctgccctacgtgggcatggtgaccatcatcatgaacgactaccccaagttcaagtacgccctgctggccgtgatgggcgcctacgtgctgctgaagagagagagctag

SEQ ID NO: 21786 - DNA, 471 bp, Artificial Sequence
  Description of Artificial Sequence: Synthetic coding sequence
atggtgagagccggcgccgtgggcgcccacctgcccgccagcggcctggacatcttcggcgacctgaagaagatgaacaagagacagctgtactaccaggtgctgaacttcgccatgatcgtgagcagcgccctgatgatctggaagggcctgatcgtgctgaccggcagcgagagccccatcgtggtggtgctgagcggcagcatggagcccgccttccacagaggcgacctgctgttcctgaccaacttcagagaggaccccatcagagccggcgagatcgtggtgttcaaggtggagggcagagacatccccatcgtgcacagagtgatcaaggtgcacgagaaggacaacggcgacatcaagttcctgaccaagggcgacaacaacgaggtggacgacagaggcctgtacaaggagggccagaactggctggagaagaaggacgtggtgggcagagccagaggctag

SEQ ID NO: 21787 - DNA, 579 bp, Artificial Sequence; identical to SEQ ID NO: 21785
  Description of Artificial Sequence: Synthetic coding sequence

SEQ ID NO: 21788 - DNA, 2091 bp, Artificial Sequence
  Description of Artificial Sequence: Synthetic coding sequence
atggaggccagcgtgatcctgcccatcctgaagaagaagctggccttcctgagcggcggcaaggacagaagaagcggcctgatcctgaccatccccctgtgcctggagcagaccaacatggacgagctgagcgtgaccctggactacctgctgagcatccccagcgagaagtgcaaggccagaggcttcaccgtgatcgtggacggcagaaagagccagtggaacgtggtgaagaccgtggtggtgatgctgcagaacgtggtgcccgccgaggtgagcctggtgtgcgtggtgaagcccgacgagttctgggacaagaaggtgacccacttctgcttctggaaggagaaggacagactgggcttcgaggtgatcctggtgagcgccaacaagctgaccagatacatcgagccctgccagctgaccgaggacttcggcggcagcctgacctacgaccacatggactggctgaacaagagactggtgttcgagaagttcaccaaggagagcaccagcctgctggacgagctggccctgatcaacaacggcagcgacaagggcaaccagcaggagaaggagagaagcgtggacctgaacttcctgcccagcgtggaccccgagaccgtgctgcagaccggccacgagctgctgagcgagctgcagcagagaagattcaacggcagcgacggcggcgtgagctggagccccatggacgacgagctgctggcccagccccaggtgatgaagctgctggacagcctgagagagcagtacaccagataccaggaggtgtgcagacagagaagcaagagaacccagctggaggagatccagcagaaggtgatgcaggtggtgaactggctggagggccccggcagcgagcagctgagagcccagtggggcatcggcgacagcatcagagccagccaggccctgcagcagaagcacgaggagatcgagagccagcacagcgagtggttcgccgtgtacgtggagctgaaccagcagatcgccgccctgctgaacgccggcgacgaggaggacctggtggagctgaagagcctgcagcagcagctgagcgacgtgtgctacagacaggccagccagctggagttcagacagaacctgctgcaggccgccctggagttccacggcgtggcccaggacctgagccagcagctggacggcctgctgggcatgctgtgcgtggacgtggcccccgccgacggcgccagcatccagcagaccctgaagctgctggaggagaagctgaagagcgtggacgtgggcctgcagggcctgagagagaagggccagggcctgctggaccagatcagcaaccaggccagctgggcctacggcaaggacgtgaccatcgagaacaaggagaacgtggaccacatccagggcgtgatggaggacatgcagctgagaaagcagagatgcgaggacatggtggacgtgagaagactgaagatgctgcagatggtgcagctgttcaagtgcgaggaggacgccgcccaggccgtggagtggctgagcgagctgctggacgccctgctgaagacccacatcagactgggcgacgacgcccaggagaccaaggtgctgctggagaagcacagaaagttcgtggacgtggcccagagcacctacgactacggcagacagctgctgcaggccaccgtggtgctgtgccagagcctgagatgcaccagcagaagcagcggcgacaccctgcccagactgaacagagtgtggaagcagttcaccatcgccagcgaggagagagtgcacagactggagatggccatcgccttccacagcaacgccgagaagatcctgcaggactgccccgaggagcccgaggccatcaacgacgaggagcagttcgacgagatcgaggccgtgggcaagagcctgctggacagactgaccgtgcccgtggtgtaccccgacggcaccgagcagtacttcggcagccccagcgacatggccagcaccgccgagaacatcagagacagaatgaagctggtgaacctgaagagacagcagctgagacaccccgagatggtgaccaccgagagctag

SEQ ID NO: 21789 - DNA, 432 bp, Artificial Sequence
  Description of Artificial Sequence: Synthetic coding sequence
atggaggccagcgtgatcctgcccatcctgaagaagaagctggccttcctgagcggcggcaaggacagaagaagcggcctgatcctgaccatccccctgtgcctggagcagaccaacatggacgagctgagcgtgaccctggactacctgctgagcatccccagcgagaagtgcaaggccagaggcttcaccgtgatcgtggacggcagaaagagccagtggaacgtggtgaagaccgtggtggtgatgctgcagaacgtggtgcccgccgaggtgagcctggtgtgcgtggtgaagcccgacgagttctgggacaagaaggtgacccacttctgcttctggaaggagaaggacagactgggcttcgaggtgatcctggtgagcgccaacaagctgaccagatacatcgagccctgccagctgaccgagtag

SEQ ID NO: 21790 - DNA, 441 bp, Artificial Sequence
  Description of Artificial Sequence: Synthetic coding sequence
atggaggccagcgtgatcctgcccatcctgaagaagaagctggccttcctgagcggcggcaaggacagaagaagcggcctgatcctgaccatccccctgtgcctggagcagaccaacatggacgagctgagcgtgaccctggactacctgctgagcatccccagcgagaagtgcaaggccagaggcttcaccgtgatcgtggacggcagaaagagccagtggaacgtggtgaagaccgtggtggtgatgctgcagaacgtggtgcccgccgaggtgagcctggtgtgcgtggtgaagcccgacgagttctgggacaagaaggtgacccacttctgcttctggaaggagaaggacagactgggcttcgaggtgatcctggtgagcgccaacaagctgaccagatacatcgagccctgccagctgaccgaggacttcggctag

SEQ ID NO: 21791 - DNA, 2160 bp, Artificial Sequence
  Description of Artificial Sequence: Synthetic coding sequence
atggtgcagaagtaccagagccccgtgagagtgtacaagtaccccttcgagctgatcatggccgcctacgagagaagattccccacctgccccctgatccccatgttcgtgggcagcgacaccgtgaacgagttcaagagcgaggacggcgccatccacgtgatcgagagaagatgcaagctggacgtggacgcccccagactgctgaagaagatcgccggcgtggactacgtgtacttcgtgcagaagaacagcctgaacagcagagagagaaccctgcacatcgaggcctacaacgagaccttcagcaacagagtgatcatcaacgagcactgctgctacaccgtgcaccccgagaacgaggactggacctgcttcgagcagagcgccagcctggacatcaagagcttcttcggcttcgagagcaccgtggagaagatcgccatgaagcagtacaccagcaacatcaagaagggcaaggagatcatcgagtactacctgagacagctggaggaggagggcatcaccttcgtgcccagatggagcccccccagcatcaccaccagcagcgagaccagcagcagcagcagcaagaagcaggccgccagcatggccgtggtgatccccgaggccgccctgaaggagggcctgagcggcgacgccctgagcagccccagcgcccccgagcccgtggtgggcacccccgacgacaagctggacgccgactacatcaagagatacctgggcgacctgacccccctgcaggagagctgcctgatcagactgagacagtggctgcaggagacccacaagggcaagatccccaaggacgagcacatcctgagattcctgagagccagagacttcaacatcgacaaggccagagagatcatgtgccagagcctgacctggagaaagcagcaccaggtggactacatcctggagacctggacccccccccaggtgctgcaggactactacgccggcggctggcaccaccacgacaaggacggcagacccctgtacgtgctgagactgggccagatggacaccaagggcctggtgagagccctgggcgaggaggccctgctgagatacgtgctgagcatcaacgaggagggcctgagaagatgcgaggagaacaccaaggtgttcggcagacccatcagcagctggacctgcctggtggacctggagggcctgaacatgagacacctgtggagacccggcgtgaaggccctgctgagaatcatcgaggtggtggaggccaactaccccgagaccctgggcagactgctgatcctgagagcccccagagtgttccccgtgctgtggaccctggtgagccccttcatcgacgacaacaccagaagaaagttcctgatctacgccggcaacgactaccagggccccggcggcctgctggactacatcgacaaggagatcatccccgacttcctgagcggcgagtgcatgtgcgaggtgcccgagggcggcctggtgcccaagagcctgtacagaaccgccgaggagctggagaacgaggacctgaagctgtggaccgagaccatctaccagagcgccagcgtgttcaagggcgccccccacgagatcctgatccagatcgtggacgccagcagcgtgatcacctgggacttcgacgtgtgcaagggcgacatcgtgttcaacatctaccacagcaagagaagcccccagccccccaagaaggacagcctgggcgcccacagcatcaccagccccggcggcaacaacgtgcagctgatcgacaaggtgtggcagctgggcagagactacagcatggtggagagccccctgatctgcaaggagggcgagagcgtgcagggcagccacgtgaccagatggcccggcttctacatcctgcagtggaagttccacagcatgcccgcctgcgccgccagcagcctgcccagagtggacgacgtgctggccagcctgcaggtgagcagccacaagtgcaaggtgatgtactacaccgaggtgatcggcagcgaggacttcagaggcagcatgaccagcctggagagcagccacagcggcttcagccagctgagcgccgccaccaccagcagcagccagagccacagcagcagcatgatcagcagatggagattctgctag

SEQ ID NO: 21792 - DNA, 2148 bp, Artificial Sequence
  Description of Artificial Sequence: Synthetic coding sequence
atggtgcagaagtaccagagccccgtgagagtgtacaagtaccccttcgagctgatcatggccgcctacgagagaagattccccacctgccccctgatccccatgttcgtgggcagcgacaccgtgaacgagttcaagagcgaggacggcgccatccacgtgatcgagagaagatgcaagctggacgtggacgcccccagactgctgaagaagatcgccggcgtggactacgtgtacttcgtgcagaagaacagcctgaacagcagagagagaaccctgcacatcgaggcctacaacgagaccttcagcaacagagtgatcatcaacgagcactgctgctacaccgtgcaccccgagaacgaggactggacctgcttcgagcagagcgccagcctggacatcaagagcttcttcggcttcgagagcaccgtggagaagatcgccatgaagcagtacaccagcaacatcaagaagggcaaggagatcatcgagtactacctgagacagctggaggaggagggcatcaccttcgtgcccagatggagcccccccagcatcaccaccagcagcgagaccagcagcagcagcagcaagaagcaggccgccagcatggccgtggtgatccccgaggccgccctgaaggagggcctgagcggcgacgccctgagcagccccagcgcccccgagcccgtggtgggcacccccgacgacaagctggacgccgactacatcaagagatacctgggcgacctgacccccctgcaggagagctgcctgatcagactgagacagtggctgcaggagacccacaagggcaagatccccaaggacgagcacatcctgagattcctgagagccagagacttcaacatcgacaaggccagagagatcatgtgccagagcctgacctggagaaagcagcaccaggtggactacatcctggagacctggacccccccccaggtgctgcaggactactacgccggcggctggcaccaccacgacaaggacggcagacccctgtacgtgctgagactgggccagatggacaccaagggcctggtgagagccctgggcgaggaggccctgctgagatacgtgctgagcatcaacgaggagggcctgagaagatgcgaggagaacaccaaggtgttcggcagacccatcagcagctggacctgcctggtggacctggagggcctgaacatgagacacctgtggagacccggcgtgaaggccctgctgagaatcatcgaggtggtggaggccaactaccccgagaccctgggcagactgctgatcctgagagcccccagagtgttccccgtgctgtggaccctggtgagccccttcatcgacgacaacaccagaagaaagttcctgatctacgccggcaacgactaccagggccccggcggcctgctggactacatcgacaaggagatcatccccgacttcctgagcggcgagtgcatgtgcgaggtgcccgagggcggcctggtgcccaagagcctgtacagaaccgccgaggagctggagaacgaggacctgaagctgtggaccgagaccatctaccagagcgccagcgtgttcaagggcgccccccacgagatcctgatccagatcgtggacgccagcagcgtgatcacctgggacttcgacgtgtgcaagggcgacatcgtgttcaacatctaccacagcaagagaagcccccagccccccaagaaggacagcctgggcgcccacagcatcaccagccccggcggcaacaacgtgcagctgatcgacaaggtgtggcagctgggcagagactacagcatggtggagagccccctgatctgcaaggagggcgagagcgtgcagggcagccacgtgaccagatggcccggcttctacatcctgcagtggaagttccacagcatgcccgcctgcgccgccagcagcctgcccagagtggacgacgtgctggccagcctgcaggtgagcagccacaagtgcaaggtgatgtactacaccgaggtgatcggcagcgaggacttcagaggcagcatgaccagcctggagagcagccacagcggcttcagccagctgagcgccgccaccaccagcagcagccagagccacagcagcagcatgatcagcagatag

SEQ ID NO: 21793 - DNA, 2148 bp, Artificial Sequence; identical to SEQ ID NO: 21792
  Description of Artificial Sequence: Synthetic coding sequence

SEQ ID NO: 21794 - DNA, 2046 bp, Artificial Sequence
  Description of Artificial Sequence: Synthetic coding sequence
atgttcgtgggcagcgacaccgtgaacgagttcaagagcgaggacggcgccatccacgtgatcgagagaagatgcaagctggacgtggacgcccccagactgctgaagaagatcgccggcgtggactacgtgtacttcgtgcagaagaacagcctgaacagcagagagagaaccctgcacatcgaggcctacaacgagaccttcagcaacagagtgatcatcaacgagcactgctgctacaccgtgcaccccgagaacgaggactggacctgcttcgagcagagcgccagcctggacatcaagagcttcttcggcttcgagagcaccgtggagaagatcgccatgaagcagtacaccagcaacatcaagaagggcaaggagatcatcgagtactacctgagacagctggaggaggagggcatcaccttcgtgcccagatggagcccccccagcatcaccaccagcagcgagaccagcagcagcagcagcaagaagcaggccgccagcatggccgtggtgatccccgaggccgccctgaaggagggcctgagcggcgacgccctgagcagccccagcgcccccgagcccgtggtgggcacccccgacgacaagctggacgccgactacatcaagagatacctgggcgacctgacccccctgcaggagagctgcctgatcagactgagacagtggctgcaggagacccacaagggcaagatccccaaggacgagcacatcctgagattcctgagagccagagacttcaacatcgacaaggccagagagatcatgtgccagagcctgacctggagaaagcagcaccaggtggactacatcctggagacctggacccccccccaggtgctgcaggactactacgccggcggctggcaccaccacgacaaggacggcagacccctgtacgtgctgagactgggccagatggacaccaagggcctggtgagagccctgggcgaggaggccctgctgagatacgtgctgagcatcaacgaggagggcctgagaagatgcgaggagaacaccaaggtgttcggcagacccatcagcagctggacctgcctggtggacctggagggcctgaacatgagacacctgtggagacccggcgtgaaggccctgctgagaatcatcgaggtggtggaggccaactaccccgagaccctgggcagactgctgatcctgagagcccccagagtgttccccgtgctgtggaccctggtgagccccttcatcgacgacaacaccagaagaaagttcctgatctacgccggcaacgactaccagggccccggcggcctgctggactacatcgacaaggagatcatccccgacttcctgagcggcgagtgcatgtgcgaggtgcccgagggcggcctggtgcccaagagcctgtacagaaccgccgaggagctggagaacgaggacctgaagctgtggaccgagaccatctaccagagcgccagcgtgttcaagggcgccccccacgagatcctgatccagatcgtggacgccagcagcgtgatcacctgggacttcgacgtgtgcaagggcgacatcgtgttcaacatctaccacagcaagagaagcccccagccccccaagaaggacagcctgggcgcccacagcatcaccagccccggcggcaacaacgtgcagctgatcgacaaggtgtggcagctgggcagagactacagcatggtggagagccccctgatctgcaaggagggcgagagcgtgcagggcagccacgtgaccagatggcccggcttctacatcctgcagtggaagttccacagcatgcccgcctgcgccgccagcagcctgcccagagtggacgacgtgctggccagcctgcaggtgagcagccacaagtgcaaggtgatgtactacaccgaggtgatcggcagcgaggacttcagaggcagcatgaccagcctggagagcagccacagcggcttcagccagctgagcgccgccaccaccagcagcagccagagccacagcagcagcatgatcagcagatag

SEQ ID NO: 21795 - DNA, 2148 bp, Artificial Sequence; identical to SEQ ID NO: 21792
  Description of Artificial Sequence: Synthetic coding sequence

SEQ ID NO: 21796 - DNA, 2160 bp, Artificial Sequence; identical to SEQ ID NO: 21791
  Description of Artificial Sequence: Synthetic coding sequence

SEQ ID NO: 21797 - DNA, 2091 bp, Artificial Sequence
  Description of Artificial Sequence: Synthetic coding sequence
atggtgcagagataccagagccccgtgagagtgtacaagtaccccttcgagctggtgatggccgcctacgagaagagattccccacctgcccccagatccccgtgttcctgggcagcgaggtgctgagagagagcagaagccccgacggcgccgtgcacgtggtggagagaagctgcagactgagagtggacgcccccagactgctgagaaagatcgccggcgtggagcacgtggtgttcgtgcagaccaacatcctgaactggaaggagagaaccctgctgatcgaggcccacaacgagaccttcgccaacagagtggtggtgaacgagcactgcagctacaccgtgcaccccgagaacgaggactggacctgcttcgagcagagcgccagcctggacatcagaagcttcttcggcttcgagaacgccctggagaagatcgccatgaagcagtacaccgccaacgtgaagagaggcaaggaggtgatcgagcactacctgaacgagctgatcagccagggcaccagccacatccccagatggacccccgcccccgtgagagaggaggacgccagaaaccaggccggccccagagaccccagcagcctggaggcccacggccccagaagcaccctgggccccgccctggaggccgtgagcatggacggcgacaagctggacgccgactacatcgagagatgcctgggccacctgacccccatgcaggagagctgcctgatccagctgagacactggctgcaggagacccacaagggcaagatccccaaggacgagcacatcctgagattcctgagagcccacgacttccacctggacaaggccagagagatgctgagacagagcctgagctggagaaagcagcaccaggtggacctgctgctgcagacctggcagccccccgccctgctggaggagttctacgccggcggctggcactaccaggacatcgacggcagacccctgtacatcctgagactgggccagatggacaccaagggcctgatgaaggccgtgggcgaggaggccctgctgagacacgtgctgagcgtgaacgaggagggccagaagagatgcgagggcagcaccagacagctgggcagacccatcagcagctggacctgcctgctggacctggagggcctgaacatgagacacctgtggagacccggcgtgaaggccctgctgagaatgatcgaggtggtggaggacaactaccccgagaccctgggcagactgctgatcgtgagagcccccagagtgttccccgtgctgtggaccctgatcagccccttcatcaacgagaacaccagaagaaagttcctgatctacagcggcagcaactaccagggccccggcggcctggtggactacctggacagagaggtgatccccgacttcctgggcggcgagagcgtgtgcaacgtgcccgagggcggcctggtgcccaagagcctgtacatgaccgaggaggagcaggagcacaccgaccagctgtggcagtggagcgagacctaccacagcgccagcgtgctgagaggcgccccccacgaggtggccgtggagatcctggagggcgagagcgtgatcacctgggacttcgacatcctgagaggcgacgtggtgttcagcctgtaccacaccaagcaggcccccagactgggcgccagagagcccggcaccagagccagcggccagctgatcgacaagggctgggtgctgggcagagactacagcagagtggaggcccccctggtgtgcagagagggcgagagcatccagggcagccacgtgaccagatggcccggcgtgtacctgctgcagtggcagatgcacagcccccccagcagcgtggcctgcagcctgcccggcgtggacgacgtgctgaccgccctgcacagccccggccccaagtgcaagctgctgtactactgcgaggtgctggccagcgaggacttcagaggcagcatgagcagcctggagagctgcaccagcggcttcagccagctgagcgccgccaccagcagcagcagcagcggccagagccacagcagcagcctggtgagcagatag

SEQ ID NO: 21798 - DNA, 912 bp, Artificial Sequence
  Description of Artificial Sequence: Synthetic coding sequence
atgagcgtgatcttcttcgcctgcgtggtgagagtgagagacggcctgcccctgagcgccagcaccgacttctaccacacccaggacttcctggagtggagaagaagactgaagagcctggccctgagactggcccagtaccccggcagaggcagcgccgagggctgcgacttcagcatccacttcagcagcttcggcgacgtggcctgcatggccatctgcagctgccagtgccccgccgccatggccttctgcttcctggagaccctgtggtgggagttcaccgccagctacgacaccacctgcatcggcctggccagcagaccctacgccttcctggagttcgacagcatcatccagaaggtgaagtggcacttcaactacgtgagcagcagccagatggagtgcagcctggagaagatccaggaggagctgaagctgcagccccccgccgtgctgaccctggaggacaccgacgtggccaacggcgtgatgaacggccacacccccatgcacctggagcccgcccccaacttcagaatggagcccgtgaccgccctgggcatcctgagcctgatcctgaacatcatgtgcgccgccctgaacctgatcagaggcgtgcacctggccgagcacagcctgcaggtggcccacgaggagatcggcaacatcctggccttcctggtgcccttcgtggcctgcatcttccagtgctacctgtacctgttctacagccccgccagaaccatgaaggtggtgctgatgctgctgttcatctgcctgggcaacatgtacctgcacggcctgagaaacctgtggcagatcctgttccacatcggcgtggccttcctgagcagctaccagatcctgaccagacagctgcaggagaagcagagcgactgcggcgtgtag

SEQ ID NO: 21799 - DNA, 753 bp, Artificial Sequence
  Description of Artificial Sequence: Synthetic coding sequence
atgagcgtgatcttcttcgcctgcgtggtgagagtgagagacggcctgcccctgagcgccagcaccgacttctaccacacccaggacttcctggagtggagaagaagactgaagagcctggccctgagactggcccagtaccccggcagaggcagcgccgagggctgcgacttcagcatccacttcagcagcttcggcgacgtggcctgcatggccatctgcagctgccagtgccccgccgccatggccttctgcttcctggagaccctgtggtgggagttcaccgccagctacgacaccacctgcatcggcctggccagcagaccctacgccttcctggagttcgacagcatcatccagaaggtgaagtggcacttcaactacgtgagcagcagccagatggagtgcagcctggagaagatccaggaggagctgaagctgcagccccccgccgtgctgaccctggaggacaccgacgtggccaacggcgtgatgaacggccacacccccatgcacctggagcccgcccccaacttcagaatggagcccgtgaccgccctgggcatcctgagcctgatcctgaacatcatgtgcgccgccctgaacctgatcagaggcgtgcacctggccgagcacagcctgcaggtggcccacgaggagatcggcaacatcctggccttcctggtgcccttcgtggcctgcatcttccaggaccccagaagctggttctgctggctggaccagaccagctag

SEQ ID NO: 21800 - DNA, 753 bp, Artificial Sequence; identical to SEQ ID NO: 21799
  Description of Artificial Sequence: Synthetic coding sequence

SEQ ID NO: 21801 - DNA, 687 bp, Artificial Sequence
  Description of Artificial Sequence: Synthetic coding sequence
atgagcgtgatcttcttcgcctgcgtggtgagagtgagagacggcctgcccctgagcgccagcaccgacttctaccacacccaggacttcctggagtggagaagaagactgaagagcctggccctgagactggcccagtaccccggcagaggcagcgccgagggctgcgacttcagcatccacttcagcagcttcggcgacgtggcctgcatggccatctgcagctgccagtgccccgccgccatggccttctgcttcctggagaccctgtggtgggagttcaccgccagctacgacaccacctgcatcggcctggccagcagaccctacgccttcctggagttcgacagcatcatccagaaggtgaagtggcacttcaactacgtgagcagcagccagatggagtgcagcctggagaagatccaggaggagctgaagctgcagccccccgccgtgctgaccctggaggacaccgacgtggccaacggcgtgatgaacggccacacccccatgcacctggagcccgcccccaacttcagaatggagcccgtgaccgccctgggcatcctgagcctgatcctgaacatcatgtgcgccgccctgaacctgatcagaggcgtgcacctggccgagcacagcctgcaggaccccagaagctggttctgctggctggaccagaccagctag

SEQ ID NO: 21802 - DNA, 543 bp, Artificial Sequence
  Description of Artificial Sequence: Synthetic coding sequence
atggccatctgcagctgccagtgccccgccgccatggccttctgcttcctggagaccctgtggtgggagttcaccgccagctacgacaccacctgcatcggcctggccagcagaccctacgccttcctggagttcgacagcatcatccagaaggtgaagtggcacttcaactacgtgagcagcagccagatggagtgcagcctggagaagatccaggaggagctgaagctgcagccccccgccgtgctgaccctggaggacaccgacgtggccaacggcgtgatgaacggccacacccccatgcacctggagcccgcccccaacttcagaatggagcccgtgaccgccctgggcatcctgagcctgatcctgaacatcatgtgcgccgccctgaacctgatcagaggcgtgcacctggccgagcacagcctgcaggtggcccacgaggagatcggcaacatcctggccttcctggtgcccttcgtggcctgcatcttccaggaccccagaagctggttctgctggctggaccagaccagctag

SEQ ID NO: 21803 - DNA, 1842 bp, Artificial Sequence
  Description of Artificial Sequence: Synthetic coding sequence
atgagccagcccggcatccccgccagcggcggcgcccccgccagcctgcaggcccagaacggcgccgccctggccagcggcagcccctacaccaacggccccgtgcagaacgccctgctgagcagccaggagagcgtgagccagggctacaacttccagctgcccggcagctacccccaccccatccccgccaagaccctgaaccccgtgagcggccagagcaactacggcggcagccagggcagcggccagaccctgaacagaccccccgtggccagcaaccccgtgacccccagcctgcacagcggccccgcccccagaatgcccctgcccgccagccagaaccccgccaccacccccatgcccagcagcagcttcctgcccgaggccaacctgcccccccccctgaactggcagtacaactaccccagcaccgccagccagaccaaccactgccccagagccagcagccagcccaccgtgagcggcaacaccagcctgaccaccaaccaccagtacgtgagcagcggctaccccagcctgcagaacagcttcatcaagagcggccccagcgtgccccccctggtgaacccccccctgcccaccaccttccagcccggcgccccccacggccccccccccgccggcggccccccccccgtgagagccctgacccccctgaccagcagctacagagacgtgccccagcccctgttcaacagcgccgtgaaccaggagggcatcaccagcaacaccaacaacggcagcatggtggtgcacagcagctacgacgagatcgagggcggcggcctgctggccaccccccagctgaccaacaagaaccccaagatgagcagaagcgtgggctacagctaccccagcctgccccccggctaccagaacaccaccccccccggcgccaccggcgtgccccccagcagcctgaactaccccagcggcccccaggccttcacccagacccccctgggcgccaaccacctgaccaccagcatgagcggcctgagcctgcagcccgagggcctgagagtggtgaacctgctgcaggagagaaacatgctgcccagcacccccctgaagccccccgtgcccaacctgcacgaggacatccagaagctgaactgcaaccccgagctgttcagatgcaccctgaccagcatcccccagacccaggccctgctgaacaaggccaagctgcccctgggcctgctgctgcaccccttcaaggacctggtgcagctgcccgtggtgaccagcagcaccatcgtgagatgcagaagctgcagaacctacatcaaccccttcgtgagcttcctggaccagagaagatggaagtgcaacctgtgctacagagtgaacgacgtgcccgaggagttcctgtacaaccccctgaccagagtgtacggcgagccccacagaagacccgaggtgcagaacgccaccatcgagttcatggcccccagcgagtacatgctgagacccccccagccccccgtgtacctgttcgtgttcgacgtgagccacaacgccgtggagaccggctacctgaacagcgtgtgccagagcctgctggacaacctggacctgctgcccggcaacaccagaaccaagatcggcttcatcaccttcgacagcaccatccacttctacggcctgcaggagagcctgagccagccccagatgctgatcgtgagcgacatcgaggacgtgttcatccccatgcccgagaacctgctggtgaacctgaacgagagcaaggagagcgtgatcggcgtgagcagcgaggagaccctgatcacctgcctggagatcgccatgagatag

SEQ ID NO: 21804 - DNA, 3282 bp, Artificial Sequence
  Description of Artificial Sequence: Synthetic coding sequence
atgagccagcccggcatccccgccagcggcggcgcccccgccagcctgcaggcccagaacggcgccgccctggccagcggcagcccctacaccaacggccccgtgcagaacgccctgctgagcagccaggagagcgtgagccagggctacaacttccagctgcccggcagctacccccaccccatccccgccaagaccctgaaccccgtgagcggccagagcaactacggcggcagccagggcagcggccagaccctgaacagaccccccgtggccagcaaccccgtgacccccagcctgcacagcggccccgcccccagaatgcccctgcccgccagccagaaccccgccaccacccccatgcccagcagcagcttcctgcccgaggccaacctgcccccccccctgaactggcagtacaactaccccagcaccgccagccagaccaaccactgccccagagccagcagccagcccaccgtgagcggcaacaccagcctgaccaccaaccaccagtacgtgagcagcggctaccccagcctgcagaacagcttcatcaagagcggccccagcgtgccccccctggtgaacccccccctgcccaccaccttccagcccggcgccccccacggccccccccccgccggcggccccccccccgtgagagccctgacccccctgaccagcagctacagagacgtgccccagcccctgttcaacagcgccgtgaaccaggagggcatcaccagcaacaccaacaacggcagcatggtggtgcacagcagctacgacgagatcgagggcggcggcctgctggccaccccccagctgaccaacaagaaccccaagatgagcagaagcgtgggctacagctaccccagcctgccccccggctaccagaacaccaccccccccggcgccaccggcgtgccccccagcagcctgaactaccccagcggcccccaggccttcacccagacccccctgggcgccaaccacctgaccaccagcatgagcggcctgagcctgcagcccgagggcctgagagtggtgaacctgctgcaggagagaaacatgctgcccagcacccccctgaagccccccgtgcccaacctgcacgaggacatccagaagctgaactgcaaccccgagctgttcagatgcaccctgaccagcatcccccagacccaggccctgctgaacaaggccaagctgcccctgggcctgctgctgcaccccttcaaggacctggtgcagctgcccgtggtgaccagcagcaccatcgtgagatgcagaagctgcagaacctacatcaaccccttcgtgagcttcctggaccagagaagatggaagtgcaacctgtgctacagagtgaacgacgtgcccgaggagttcctgtacaaccccctgaccagagtgtacggcgagccccacagaagacccgaggtgcagaacgccaccatcgagttcatggcccccagcgagtacatgctgagacccccccagccccccgtgtacctgttcgtgttcgacgtgagccacaacgccgtggagaccggctacctgaacagcgtgtgccagagcctgctggacaacctggacctgctgcccggcaacaccagaaccaagatcggcttcatcaccttcgacagcaccatccacttctacggcctgcaggagagcctgagccagccccagatgctgatcgtgagcgacatcgaggacgtgttcatccccatgcccgagaacctgctggtgaacctgaacgagagcaaggagctggtgcaggacctgctgaagaccctgccccagatgttcaccaagaccctggagacccagagcgccctgggccccgccctgcaggccgccttcaagctgatgagccccaccggcggcagaatgagcgtgttccagacccagctgcccaccctgggcgtgggcgccctgaagcccagagaggagcccaaccacagaagcagcgccaaggacatccacatgacccccagcaccgacttctacaagaagctggccctggactgcagcggccagcaggtggccgtggacctgttcctgctgagcggccagtacagcgacctggccagcctgggctgcatcagcagatacagcgccggcagcgtgtactactaccccagctaccaccaccagcacaaccccgtgcaggtgcagaagctgcagaaggagctgcagagatacctgaccagaaagatcggcttcgaggccgtgatgagaatcagatgcaccaagggcctgagcatccacaccttccacggcaacttcttcgtgagaagcaccgacctgctgagcctgcccaacgtgaaccccgacgccggctacgccgtgcagatgagcgtggaggagagcctgaccgacacccagctggtgagcttccagagcgccctgctgtacaccagcagcaagggcgagagaagaatcagagtgcacaccctgtgcctgcccgtggtgagcaccctgaacgacgtgttcctgggcgccgacgtgcaggccatcagcggcctgctggccaacatggccgtggacagaagcatgaccgccagcctgagcgacgccagagacgccctggtgaacgccgtgatcgacagcctgagcgcctacagaagcagcgtgctgagcaaccagcagcccggcctgatggtgcccttcagcctgagactgttccccctgttcgtgctggccctgctgaagcagaagagcttccagaccggcaccaacgccagactggacgagagaatcttcgccatgtgccaggtgaagaaccagcccctggtgtacctgatgctgaccacccaccccagcctgtacagagtggacaacctgagcgacgagggcgccctgaacatcagcgacagaaccatcccccagccccccatcctgcagctgagcgtggagaagctgagcagagacggcgccttcctgatggacgccggcagcgtgctgatgctgtgggtgggcaagaactgcacccagaacttcctgagccaggtgctgggcgtgcagaactacgccagcatcccccagcccatgaccgacctgcccgagctggacacccccgagagcgccagaatcatcgccttcatcagctggctgagagagcagagacccttcttccccatcctgtacgtgatcagagacgagagccccatgaaggccaacttcctgcagaacatgatcgaggacagaaccgagagcgccctgagctactacgagttcctgctgcacatccagcagcaggtgaacaagtag

SEQ ID NO: 21805 - DNA, 3807 bp, Artificial Sequence
  Description of Artificial Sequence: Synthetic coding sequence
atgagcgcccccgccggcagcagccaccccgccgccagcgccagaatcccccccaagttcggcggcgccgccgtgagcggcgccgccgcccccgccggccccggcgccggccccgccccccaccagcagaacggccccgcccagaaccagatgcaggtgcccagcggctacggcctgcaccaccagaactacatcgcccccagcggccactacagccagggccccggcaagatgaccagcctgcccctggacacccagtgcggcgactactacagcgccctgtacaccgtgcccacccagaacgtgacccccaacaccgtgaaccagcagcccggcgcccagcagctgtacagcagaggcccccccgccccccacatcgtgggcagcaccctgggcagcttccagggcgccgccagcagcgccagccacctgcacaccagcgccagccagccctacagcagcttcgtgaaccactacaacagccccgccatgtacagcgccagcagcagcgtggccagccagggcttccccagcacctgcggccactacgccatgagcaccgtgagcaacgccgcctaccccagcgtgagctaccccagcctgcccgccggcgacacctacggccagatgttcaccagccagaacgcccccaccgtgagacccgtgaaggacaacagcttcagcggccagaacaccgccatcagccaccccagccccctgccccccctgcccagccagcagcaccaccagcagcagagcctgagcggctacagcaccctgacctggagcagccccggcctgcccagcacccaggacaacctgatcagaaaccacaccggcagcctggccgtggccaacaacaaccccaccatcaccgtggccgacagcctgagctgccccgtgatgcagaacgtgcagccccccaagagcagccccgtggtgagcaccgtgctgagcggcagcagcggcagcagcagcaccagaaccccccccaccgccaaccaccccgtggagcccgtgaccagcgtgacccagcccagcgagctgctgcagcagaagggcgtgcagtacggcgagtacgtgaacaaccaggccagcagcgcccccacccccctgagcagcaccagcgacgacgaggaggaggaggaggaggacgaggaggccggcgtggacagcagcagcaccaccagcagcgccagccccatgcccaacagctacgacgccctggagggcggcagctaccccgacatgctgagcagcagcgccagcagccccgcccccgaccccgcccccgagcccgaccccgccagcgcccccgcccccgccagcgcccccgcccccgtggtgccccagcccagcaagatggccaagcccttcggctacggctaccccaccctgcagcccggctaccagaacgccaccgcccccctgatcagcggcgtgcagcccagcaaccccgtgtacagcggcttccagcagtacccccagcagtaccccggcgtgaaccagctgagcagcagcatcggcggcctgagcctgcagagcagcccccagcccgagagcctgagacccgtgaacctgacccaggagagaaacatcctgcccatgacccccgtgtgggcccccgtgcccaacctgaacgccgacctgaagaagctgaactgcagccccgacagcttcagatgcaccctgaccaacatcccccagacccaggccctgctgaacaaggccaagctgcccctgggcctgctgctgcaccccttcagagacctgacccagctgcccgtgatcaccagcaacaccatcgtgagatgcagaagctgcagaacctacatcaaccccttcgtgagcttcatcgaccagagaagatggaagtgcaacctgtgctacagagtgaacgacgtgcccgaggagttcatgtacaaccccctgaccagaagctacggcgagccccacaagagacccgaggtgcagaacagcaccgtggagttcatcgccagcagcgactacatgctgagacccccccagcccgccgtgtacctgttcgtgctggacgtgagccacaacgccgtggaggccggctacctgaccatcctgtgccagagcctgctggagaacctggacaagctgcccggcgacagcagaaccagaatcggcttcatgaccttcgacagcaccatccacttctacaacctgcaggagggcctgagccagccccagatgctgatcgtgagcgacatcgacgacgtgttcctgcccacccccgacagcctgctggtgaacctgtacgagagcaaggagctgatcaaggacctgctgaacgccctgcccaacatgttcaccaacaccagagagacccacagcgccctgggccccgccctgcaggccgccttcaagctgatgagccccaccggcggcagagtgagcgtgttccagacccagctgcccagcctgggcgccggcctgctgcagagcagagaggaccccaaccagagaagcagcaccaaggtggtgcagcacctgggccccgccaccgacttctacaagaagctggccctggactgcagcggccagcagaccgccgtggacctgttcctgctgagcagccagtacagcgacctggccagcctggcctgcatgagcaagtacagcgccggctgcatctactactaccccagcttccactacacccacaaccccagccaggccgagaagctgcagaaggacctgaagagatacctgaccagaaagatcggcttcgaggccgtgatgagaatcagatgcaccaagggcctgagcatgcacaccttccacggcaacttcttcgtgagaagcaccgacctgctgagcctggccaacatcaaccccgacgccggcttcgccgtgcagctgagcatcgaggagagcctgaccgacaccagcctggtgtgcttccagaccgccctgctgtacaccagcagcaagggcgagagaagaatcagagtgcacaccctgtgcctgcccgtggtgagcagcctggccgacgtgtacgccggcgtggacgtgcaggccgccatctgcctgctggccaacatggccgtggacagaagcgtgagcagcagcctgagcgacgccagagacgccctggtgaacgccgtggtggacagcctgagcgcctacggcagcaccgtgagcaacctgcagcacagcgccctgatggcccccagcagcctgaagctgttccccctgtacgtgctggccctgctgaagcagaaggccttcagaaccggcaccagcaccagactggacgacagagtgtacgccatgtgccagatcaagagccagcccctggtgcacctgatgaagatgatccaccccaacctgtacagaatcgacagactgaccgacgagggcgccgtgcacgtgaacgacagaatcgtgccccagccccccctgcagaagctgagcgccgagaagctgaccagagagggcgccttcctgatggactgcggcagcgtgttctacatctgggtgggcaagggctgcgacaacaacttcatcgaggacgtgctgggctacaccaacttcgccagcatcccccagaagatgacccacctgcccgagctggacaccctgagcagcgagagagccagaagcttcatcacctggctgagagacagcagacccctgagccccatcctgcacatcgtgaaggacgagagccccgccaaggccgagttcttccagcacctgatcgaggacagaaccgaggccgccttcagctactacgagttcctgctgcacgtgcagcagcagatctgcaagtag

SEQ ID NO: 21806 - DNA, 3702 bp, Artificial Sequence
  Description of Artificial Sequence: Synthetic coding sequence
atgagcgcccccgccggcagcagccaccccgccgccagcgccagaatcccccccaagttcggcggcgccgccgtgagcggcgccgccgcccccgccggccccggcgccggccccgccccccaccagcagaacggccccgcccagaaccagatgcaggtgcccagcggctacggcctgcaccaccagaactacatcgcccccagcggccactacagccagggccccggcaagatgaccagcctgcccctggacacccagtgcggcgactactacagcgccctgtacaccgtgcccacccagaacgtgacccccaacaccgtgaaccagcagcccggcgcccagcagctgtacagcagaggcccccccgccccccacatcgtgggcagcaccctgggcagcttccagggcgccgccagcagcgccagccacctgcacaccagcgccagccagccctacagcagcttcgtgaaccactacaacagccccgccatgtacagcgccagcagcagcgtggccagccagggcttccccagcacctgcggccactacgccatgagcaccgtgagcaacgccgcctaccccagcgtgagctaccccagcctgcccgccggcgacacctacggccagatgttcaccagccagaacgcccccaccgtgagacccgtgaaggacaacagcttcagcggccagaacaccgccatcagccaccccagccccctgccccccctgcccagccagcagcaccaccagcagcagagcctgagcggctacagcaccctgacctggagcagccccggcctgcccagcacccaggacaacctgatcagaaaccacaccggcagcctggccgtggccaacaacaaccccaccatcaccgtggccgacagcctgagctgccccgtgatgcagaacgtgcagccccccaagagcagccccgtggtgagcaccgtgctgagcggcagcagcggcagcagcagcaccagaaccccccccaccgccaaccaccccgtggagcccgtgaccagcgtgacccagcccagcgagctgctgcagcagaagggcgtggacagcagcagcaccaccagcagcgccagccccatgcccaacagctacgacgccctggagggcggcagctaccccgacatgctgagcagcagcgccagcagccccgcccccgaccccgcccccgagcccgaccccgccagcgcccccgcccccgccagcgcccccgcccccgtggtgccccagcccagcaagatggccaagcccttcggctacggctaccccaccctgcagcccggctaccagaacgccaccgcccccctgatcagcggcgtgcagcccagcaaccccgtgtacagcggcttccagcagtacccccagcagtaccccggcgtgaaccagctgagcagcagcatcggcggcctgagcctgcagagcagcccccagcccgagagcctgagacccgtgaacctgacccaggagagaaacatcctgcccatgacccccgtgtgggcccccgtgcccaacctgaacgccgacctgaagaagctgaactgcagccccgacagcttcagatgcaccctgaccaacatcccccagacccaggccctgctgaacaaggccaagctgcccctgggcctgctgctgcaccccttcagagacctgacccagctgcccgtgatcaccagcaacaccatcgtgagatgcagaagctgcagaacctacatcaaccccttcgtgagcttcatcgaccagagaagatggaagtgcaacctgtgctacagagtgaacgacgtgcccgaggagttcatgtacaaccccctgaccagaagctacggcgagccccacaagagacccgaggtgcagaacagcaccgtggagttcatcgccagcagcgactacatgctgagacccccccagcccgccgtgtacctgttcgtgctggacgtgagccacaacgccgtggaggccggctacctgaccatcctgtgccagagcctgctggagaacctggacaagctgcccggcgacagcagaaccagaatcggcttcatgaccttcgacagcaccatccacttctacaacctgcaggagggcctgagccagccccagatgctgatcgtgagcgacatcgacgacgtgttcctgcccacccccgacagcctgctggtgaacctgtacgagagcaaggagctgatcaaggacctgctgaacgccctgcccaacatgttcaccaacaccagagagacccacagcgccctgggccccgccctgcaggccgccttcaagctgatgagccccaccggcggcagagtgagcgtgttccagacccagctgcccagcctgggcgccggcctgctgcagagcagagaggaccccaaccagagaagcagcaccaaggtggtgcagcacctgggccccgccaccgacttctacaagaagctggccctggactgcagcggccagcagaccgccgtggacctgttcctgctgagcagccagtacagcgacctggccagcctggcctgcatgagcaagtacagcgccggctgcatctactactaccccagcttccactacacccacaaccccagccaggccgagaagctgcagaaggacctgaagagatacctgaccagaaagatcggcttcgaggccgtgatgagaatcagatgcaccaagggcctgagcatgcacaccttccacggcaacttcttcgtgagaagcaccgacctgctgagcctggccaacatcaaccccgacgccggcttcgccgtgcagctgagcatcgaggagagcctgaccgacaccagcctggtgtgcttccagaccgccctgctgtacaccagcagcaagggcgagagaagaatcagagtgcacaccctgtgcctgcccgtggtgagcagcctggccgacgtgtacgccggcgtggacgtgcaggccgccatctgcctgctggccaacatggccgtggacagaagcgtgagcagcagcctgagcgacgccagagacgccctggtgaacgccgtggtggacagcctgagcgcctacggcagcaccgtgagcaacctgcagcacagcgccctgatggcccccagcagcctgaagctgttccccctgtacgtgctggccctgctgaagcagaaggccttcagaaccggcaccagcaccagactggacgacagagtgtacgccatgtgccagatcaagagccagcccctggtgcacctgatgaagatgatccaccccaacctgtacagaatcgacagactgaccgacgagggcgccgtgcacgtgaacgacagaatcgtgccccagccccccctgcagaagctgagcgccgagaagctgaccagagagggcgccttcctgatggactgcggcagcgtgttctacatctgggtgggcaagggctgcgacaacaacttcatcgaggacgtgctgggctacaccaacttcgccagcatcccccagaagatgacccacctgcccgagctggacaccctgagcagcgagagagccagaagcttcatcacctggctgagagacagcagacccctgagccccatcctgcacatcgtgaaggacgagagccccgccaaggccgagttcttccagcacctgatcgaggacagaaccgaggccgccttcagctactacgagttcctgctgcacgtgcagcagcagatctgcaagtag

SEQ ID NO: 21807 - DNA, 3897 bp, Artificial Sequence
  Description of Artificial Sequence: Synthetic coding sequence
atgagcgcccccgccggcagcagccaccccgccgccagcgccagaatcccccccaagttcggcggcgccgccgtgagcggcgccgccgcccccgccggccccggcgccggccccgccccccaccagcagaacgagaccggcttccaccacgtggcccaggccagcctggagctgctggaccccagcaacctgcccgccagcgccagccagatcgccggcagcaccggccccgcccagaaccagatgcaggtgcccagcggctacggcctgcaccaccagaactacatcgcccccagcggccactacagccagggccccggcaagatgaccagcctgcccctggacacccagtgcggcgactactacagcgccctgtacaccgtgcccacccagaacgtgacccccaacaccgtgaaccagcagcccggcgcccagcagctgtacagcagaggcccccccgccccccacatcgtgggcagcaccctgggcagcttccagggcgccgccagcagcgccagccacctgcacaccagcgccagccagccctacagcagcttcgtgaaccactacaacagccccgccatgtacagcgccagcagcagcgtggccagccagggcttccccagcacctgcggccactacgccatgagcaccgtgagcaacgccgcctaccccagcgtgagctaccccagcctgcccgccggcgacacctacggccagatgttcaccagccagaacgcccccaccgtgagacccgtgaaggacaacagcttcagcggccagaacaccgccatcagccaccccagccccctgccccccctgcccagccagcagcaccaccagcagcagagcctgagcggctacagcaccctgacctggagcagccccggcctgcccagcacccaggacaacctgatcagaaaccacaccggcagcctggccgtggccaacaacaaccccaccatcaccgtggccgacagcctgagctgccccgtgatgcagaacgtgcagccccccaagagcagccccgtggtgagcaccgtgctgagcggcagcagcggcagcagcagcaccagaaccccccccaccgccaaccaccccgtggagcccgtgaccagcgtgacccagcccagcgagctgctgcagcagaagggcgtgcagtacggcgagtacgtgaacaaccaggccagcagcgcccccacccccctgagcagcaccagcgacgacgaggaggaggaggaggaggacgaggaggccggcgtggacagcagcagcaccaccagcagcgccagccccatgcccaacagctacgacgccctggagggcggcagctaccccgacatgctgagcagcagcgccagcagccccgcccccgaccccgcccccgagcccgaccccgccagcgcccccgcccccgccagcgcccccgcccccgtggtgccccagcccagcaagatggccaagcccttcggctacggctaccccaccctgcagcccggctaccagaacgccaccgcccccctgatcagcggcgtgcagcccagcaaccccgtgtacagcggcttccagcagtacccccagtaccccggcgtgaaccagctgagcagcagcatcggcggcctgagcctgcagagcagcccccagcccgagagcctgagacccgtgaacctgacccaggagagaaacatcctgcccatgacccccgtgtgggcccccgtgcccaacctgaacgccgacctgaagaagctgaactgcagccccgacagcttcagatgcaccctgaccaacatcccccagacccaggccctgctgaacaaggccaagctgcccctgggcctgctgctgcaccccttcagagacctgacccagctgcccgtgatcaccagcaacaccatcgtgagatgcagaagctgcagaacctacatcaaccccttcgtgagcttcatcgaccagagaagatggaagtgcaacctgtgctacagagtgaacgacgtgcccgaggagttcatgtacaaccccctgaccagaagctacggcgagccccacaagagacccgaggtgcagaacagcaccgtggagttcatcgccagcagcgactacatgctgagacccccccagcccgccgtgtacctgttcgtgctggacgtgagccacaacgccgtggaggccggctacctgaccatcctgtgccagagcctgctggagaacctggacaagctgcccggcgacagcagaaccagaatcggcttcatgaccttcgacagcaccatccacttctacaacctgcaggagggcctgagccagccccagatgctgatcgtgagcgacatcgacgacgtgttcctgcccacccccgacagcctgctggtgaacctgtacgagagcaaggagctgatcaaggacctgctgaacgccctgcccaacatgttcaccaacaccagagagacccacagcgccctgggccccgccctgcaggccgccttcaagctgatgagccccaccggcggcagagtgagcgtgttccagacccagctgcccagcctgggcgccggcctgctgcagagcagagaggaccccaaccagagaagcagcaccaaggtggtgcagcacctgggccccgccaccgacttctacaagaagctggccctggactgcagcggccagcagaccgccgtggacctgttcctgctgagcagccagtacagcgacctggccagcctggcctgcatgagcaagtacagcgccggctgcatctactactaccccagcttccactacacccacaaccccagccaggccgagaagctgcagaaggacctgaagagatacctgaccagaaagatcggcttcgaggccgtgatgagaatcagatgcaccaagggcctgagcatgcacaccttccacggcaacttcttcgtgagaagcaccgacctgctgagcctggccaacatcaaccccgacgccggcttcgccgtgcagctgagcatcgaggagagcctgaccgacaccagcctggtgtgcttccagaccgccctgctgtacaccagcagcaagggcgagagaagaatcagagtgcacaccctgtgcctgcccgtggtgagcagcctggccgacgtgtacgccggcgtggacgtgcaggccgccatctgcctgctggccaacatggccgtggacagaagcgtgagcagcagcctgagcgacgccagagacgccctggtgaacgccgtggtggacagcctgagcgcctacggcagcaccgtgagcaacctgcagcacagcgccctgatggcccccagcagcctgaagctgttccccctgtacgtgctggccctgctgaagcagaaggccttcagaaccggcaccagcaccagactggacgacagagtgtacgccatgtgccagatcaagagccagcccctggtgcacctgatgaagatgatccaccccaacctgtacagaatcgacagactgaccgacgagggcgccgtgcacgtgaacgacagaatcgtgccccagccccccctgcagaagctgagcgccgagaagctgaccagagagggcgccttcctgatggactgcggcagcgtgttctacatctgggtgggcaagggctgcgacaacaacttcatcgaggacgtgctgggctacaccaacttcgccagcatcccccagaagatgacccacctgcccgagctggacaccctgagcagcgagagagccagaagcttcatcacctggctgagagacagcagacccctgagccccatcctgcacatcgtgaaggacgagagccccgccaaggccgagttcttccagcacctgatcgaggacagaaccgaggccgccttcagctactacgagttcctgctgcacgtgcagcagcagatctgcaagtag

SEQ ID NO: 21808 - DNA, 3285 bp, Artificial Sequence
  Description of Artificial Sequence: Synthetic coding sequence
atgaacgtgaaccagagcgtgccccccgtgccccccttcggccagccccagcccatctaccccggctaccaccagagcagctacggcggccagagcggcagcaccgcccccgccatcccctacggcgcctacaacggccccgtgcccggctaccagcagacccccccccagggcatgagcagagccccccccagcagcggcgccccccccgccagcaccgcccaggccccctgcggccaggccgcctacggccagttcggccagggcgacgtgcagaacggccccagcagcaccgtgcagatgcagagactgcccggcagccagcccttcggcagccccctggcccccgtgggcaaccagccccccgtgctgcagccctacggccccccccccaccagcgcccaggtggccacccagctgagcggcatgcagatcagcggcgccgtggcccccgccccccccagcagcggcctgggcttcggcccccccaccagcctggccagcgccagcggcagcttccccaacagcggcctgtacggcagctacccccagggccaggccccccccctgagccaggcccagggccaccccggcatccagaccccccagagaagcgcccccagccaggccagcagcttcaccccccccgccagcggcggccccagactgcccagcatgaccggccccctgctgcccggccagagcttcggcggccccagcgtgagccagcccaaccacgtgagcagccccccccaggccctgccccccggcacccagatgaccggccccctgggccccctgccccccatgcacagcccccagcagcccggctaccagccccagcagaacggcagcttcggccccgccagaggcccccagagcaactacggcggcccctaccccgccgcccccaccttcggcagccagcccggccccccccagcccctgccccccaagagactggaccccgacgccatccccagccccatccaggtgatcgaggacgacagaaacaacagaggcaccgagcccttcgtgaccggcgtgagaggccaggtgccccccctggtgaccaccaacttcctggtgaaggaccagggcaacgccagccccagatacatcagatgcaccagctacaacatcccctgcaccagcgacatggccaagcaggcccaggtgcccctggccgccgtgatcaagcccctggccagactgccccccgaggaggccagcccctacgtggtggaccacggcgagagcggccccctgagatgcaacagatgcaaggcctacatgtgccccttcatgcagttcatcgagggcggcagaagattccagtgctgcttctgcagctgcatcaacgacgtgcccccccagtacttccagcacctggaccacaccggcaagagagtggacgcctacgacagacccgagctgagcctgggcagctacgagttcctggccaccgtggactactgcaagaacaacaagttccccagcccccccgccttcatcttcatgatcgacgtgagctacaacgccatcagaaccggcctggtgagactgctgtgcgaggagctgaagagcctgctggacttcctgcccagagagggcggcgccgaggagagcgccatcagagtgggcttcgtgacctacaacaaggtgctgcacttctacaacgtgaagagcagcctggcccagccccagatgatggtggtgagcgacgtggccgacatgttcgtgcccctgctggacggcttcctggtgaacgtgaacgagagcagagccgtgatcaccagcctgctggaccagatccccgagatgttcgccgacaccagagagaccgagaccgtgttcgtgcccgtgatccaggccggcatggaggccctgaaggccgccgagtgcgccggcaagctgttcctgttccacaccagcctgcccatcgccgaggcccccggcaagctgaagaacagagacgacagaaagctgatcaacaccgacaaggagaagaccctgttccagccccagaccggcgcctaccagaccctggccaaggagtgcgtggcccagggctgctgcgtggacctgttcctgttccccaaccagtacgtggacgtggccaccctgagcgtggtgccccagctgaccggcggcagcgtgtacaagtacgccagcttccaggtggagaacgaccaggagagattcctgagcgacctgagaagagacgtgcagaaggtggtgggcttcgacgccgtgatgagagtgagaaccagcaccggcatcagagccgtggacttcttcggcgccttctacatgagcaacaccaccgacgtggagctggccggcctggacggcgacaagaccgtgaccgtggagttcaagcacgacgacagactgaacgaggagagcggcgccctgctgcagtgcgccctgctgtacaccagctgcgccggccagagaagactgagaatccacaacctggccctgaactgctgcacccagctggccgacctgtacagaaactgcgagaccgacaccctgatcaactacatggccaagttcgcctacagaggcgtgctgaacagccccgtgaaggccgtgagagacaccctgatcacccagtgcgcccagatcctggcctgctacagaaagaactgcgccagccccagcagcgccggccagctgatcctgcccgagtgcatgaagctgctgcccgtgtacctgaactgcgtgctgaagagcgacgtgctgcagcccggcgccgaggtgaccaccgacgacagagcctacgtgagacagctggtgaccagcatggacgtgaccgagaccaacgtgttcttctaccccagactgctgcccctgaccaagagccccgtggagagcaccaccgagccccccgccgtgagagccagcgaggagagactgagcaacggcgacatctacctgctggagaacggcctgaacctgttcctgtgggtgggcgccagcgtgcagcagggcgtggtgcagagcctgttcagcgtgagcagcttcagccagatcaccagcggcctgagcgtgctgcccgtgctggacaaccccctgagcaagaaggtgagaggcctgatcgacagcctgagagcccagagaagcagatacatgaagctgaccgtggtgaagcaggaggacaagatggagatgctgttcaagcacttcctggtggaggacaagagcctgagcggcggcgccagctacgtggacttcctgtgccacatgcacaaggagatcagacagctgctgagctag

SEQ ID NO: 21809 - DNA, 3285 bp, Artificial Sequence; identical to SEQ ID NO: 21808
  Description of Artificial Sequence: Synthetic coding sequence

SEQ ID NO: 21810 - DNA, 2928 bp, Artificial Sequence
  Description of Artificial Sequence: Synthetic coding sequence
atgcagatcagcggcgccgtggcccccgccccccccagcagcggcctgggcttcggcccccccaccagcctggccagcgccagcggcagcttccccaacagcggcctgtacggcagctacccccagggccaggccccccccctgagccaggcccagggccaccccggcatccagaccccccagagaagcgcccccagccaggccagcagcttcaccccccccgccagcggcggccccagactgcccagcatgaccggccccctgctgcccggccagagcttcggcggccccagcgtgagccagcccaaccacgtgagcagccccccccaggccctgccccccggcacccagatgaccggccccctgggccccctgccccccatgcacagcccccagcagcccggctaccagccccagcagaacggcagcttcggccccgccagaggcccccagagcaactacggcggcccctaccccgccgcccccaccttcggcagccagcccggccccccccagcccctgccccccaagagactggaccccgacgccatccccagcccccagctgagcgagctgcccccccagcagaagaccagacacagaatcgaccccgacgccatccccagccccatccaggtgatcgaggacgacagaaacaacagaggcaccgagcccttcgtgaccggcgtgagaggccaggtgccccccctggtgaccaccaacttcctggtgaaggaccagggcaacgccagccccagatacatcagatgcaccagctacaacatcccctgcaccagcgacatggccaagcaggcccaggtgcccctggccgccgtgatcaagcccctggccagactgccccccgaggaggccagcccctacgtggtggaccacggcgagagcggccccctgagatgcaacagatgcaaggcctacatgtgccccttcatgcagttcatcgagggcggcagaagattccagtgctgcttctgcagctgcatcaacgacgtgcccccccagtacttccagcacctggaccacaccggcaagagagtggacgcctacgacagacccgagctgagcctgggcagctacgagttcctggccaccgtggactactgcaagaacaacaagttccccagcccccccgccttcatcttcatgatcgacgtgagctacaacgccatcagaaccggcctggtgagactgctgtgcgaggagctgaagagcctgctggacttcctgcccagagagggcggcgccgaggagagcgccatcagagtgggcttcgtgacctacaacaaggtgctgcacttctacaacgtgaagagcagcctggcccagccccagatgatggtggtgagcgacgtggccgacatgttcgtgcccctgctggacggcttcctggtgaacgtgaacgagagcagagccgtgatcaccagcctgctggaccagatccccgagatgttcgccgacaccagagagaccgagaccgtgttcgtgcccgtgatccaggccggcatggaggccctgaaggccgccgagtgcgccggcaagctgttcctgttccacaccagcctgcccatcgccgaggcccccggcaagctgaagaacagagacgacagaaagctgatcaacaccgacaaggagaagaccctgttccagccccagaccggcgcctaccagaccctggccaaggagtgcgtggcccagggctgctgcgtggacctgttcctgttccccaaccagtacgtggacgtggccaccctgagcgtggtgccccagctgaccggcggcagcgtgtacaagtacgccagcttccaggtggagaacgaccaggagagattcctgagcgacctgagaagagacgtgcagaaggtggtgggcttcgacgccgtgatgagagtgagaaccagcaccggcatcagagccgtggacttcttcggcgccttctacatgagcaacaccaccgacgtggagctggccggcctggacggcgacaagaccgtgaccgtggagttcaagcacgacgacagactgaacgaggagagcggcgccctgctgcagtgcgccctgctgtacaccagctgcgccggccagagaagactgagaatccacaacctggccctgaactgctgcacccagctggccgacctgtacagaaactgcgagaccgacaccctgatcaactacatggccaagttcgcctacagaggcgtgctgaacagccccgtgaaggccgtgagagacaccctgatcacccagtgcgcccagatcctggcctgctacagaaagaactgcgccagccccagcagcgccggccagctgatcctgcccgagtgcatgaagctgctgcccgtgtacctgaactgcgtgctgaagagcgacgtgctgcagcccggcgccgaggtgaccaccgacgacagagcctacgtgagacagctggtgaccagcatggacgtgaccgagaccaacgtgttcttctaccccagactgctgcccctgaccaagagccccgtggagagcaccaccgagccccccgccgtgagagccagcgaggagagactgagcaacggcgacatctacctgctggagaacggcctgaacctgttcctgtgggtgggcgccagcgtgcagcagggcgtggtgcagagcctgttcagcgtgagcagcttcagccagatcaccagcggcctgagcgtgctgcccgtgctggacaaccccctgagcaagaaggtgagaggcctgatcgacagcctgagagcccagagaagcagatacatgaagctgaccgtggtgaagcaggaggacaagatggagatgctgttcaagcacttcctggtggaggacaagagcctgagcggcggcgccagctacgtggacttcctgtgccacatgcacaaggagatcagacagctgctgagctag

SEQ ID NO: 21811 - DNA, 1029 bp, Artificial Sequence
  Description of Artificial Sequence: Synthetic coding sequence
atgagagtgagaaccagcaccggcatcagagccgtggacttcttcggcgccttctacatgagcaacaccaccgacgtggagctggccggcctggacggcgacaagaccgtgaccgtggagttcaagcacgacgacagactgaacgaggagagcggcgccctgctgcagtgcgccctgctgtacaccagctgcgccggccagagaagactgagaatccacaacctggccctgaactgctgcacccagctggccgacctgtacagaaactgcgagaccgacaccctgatcaactacatggccaagttcgcctacagaggcgtgctgaacagccccgtgaaggccgtgagagacaccctgatcacccagtgcgcccagatcctggcctgctacagaaagaactgcgccagccccagcagcgccggccagctgatcctgcccgagtgcatgaagctgctgcccgtgtacctgaactgcgtgctgaagagcgacgtgctgcagcccggcgccgaggtgaccaccgacgacagagcctacgtgagacagctggtgaccagcatggacgtgaccgagaccaacgtgttcttctaccccagactgctgcccctgaccaagagccccgtggagagcaccaccgagccccccgccgtgagagccagcgaggagagactgagcaacggcgacatctacctgctggagaacggcctgaacctgttcctgtgggtgggcgccagcgtgcagcagggcgtggtgcagagcctgttcagcgtgagcagcttcagccagatcaccagcggcctgagcgtgctgcccgtgctggacaaccccctgagcaagaaggtgagaggcctgatcgacagcctgagagcccagagaagcagatacatgaagctgaccgtggtgaagcaggaggacaagatggagatgctgttcaagcacttcctggtggaggacaagagcctgagcggcggcgccagctacgtggacttcctgtgccacatgcacaaggagatcagacagctgctgagctag

SEQ ID NO: 21812 - DNA, 1029 bp, Artificial Sequence; identical to SEQ ID NO: 21811
  Description of Artificial Sequence: Synthetic coding sequence

SEQ ID NO: 21813 - DNA, 3099 bp, Artificial Sequence
  Description of Artificial Sequence: Synthetic coding sequence
atgagccagcagggctacgtggccacccccccctacagccagccccagcccggcatcggcctgagccccccccactacggccactacggcgaccccagccacaccgccagccccaccggcatgatgaagcccgccggccccctgggcgccaccgccaccagaggcatgctgccccccggcccccccccccccggcccccaccagttcggccagaacggcgcccacgccaccggccaccccccccagagattccccggccccccccccgtgaacaacgtggccagcagccacgccccctaccagcccagcgcccagagcagctaccccggccccatcagcaccagcagcgtgacccagctgggcagccagctgagcgccatgcagatcaacagctacggcagcggcatggccccccccagccagggcccccccggccccctgagcgccaccagcctgcagaccccccccagacccccccagcccagcatcctgcagcccggcagccaggtgctgccccccccccccaccaccctgaacggccccggcgccagccccctgcccctgcccatgtacagacccgacggcctgagcggcccccccccccccaacgcccagtaccagcccccccccctgcccggccagaccctgggcgccggctaccccccccagcaggccaacagcggcccccagatggccggcgcccagctgagctaccccggcggcttccccggcggccccgcccagatggccggccccccccagccccagaagaagctggaccccgacagcatccccagccccatccaggtgatcgagaacgacagagccagcagaggcggccaggtgtacgccaccaacaccagaggccagatcccccccctggtgaccaccgactgcatgatccaggaccagggcaacgccagccccagattcatcagatgcaccacctactgcttcccctgcaccagcgacatggccaagcaggcccagatccccctggccgccgtgatcaagcccttcgccaccatccccagcaacgagagccccctgtacctggtgaaccacggcgagagcggccccgtgagatgcaacagatgcaaggcctacatgtgccccttcatgcagttcatcgagggcggcagaagataccagtgcggcttctgcaactgcgtgaacgacgtgccccccttctacttccagcacctggaccacatcggcagaagactggaccactacgagaagcccgagctgagcctgggcagctacgagtacgtggccaccctggactactgcagaaagagcaagccccccaacccccccgccttcatcttcatgatcgacgtgagctacagcaacatcaagaacggcctggtgaagctgatctgcgaggagctgaagaccatgctggagaagatccccaaggaggagcaggaggagaccagcgccatcagagtgggcttcatcacctacaacaaggtgctgcacttcttcaacgtgaagagcaacctggcccagccccagatgatggtggtgaccgacgtgggcgaggtgttcgtgcccctgctggacggcttcctggtgaactaccaggagagccagagcgtgatccacaacctgctggaccagatccccgacatgttcgccgacagcaacgagaacgagaccgtgttcgcccccgtgatccaggccggcatggaggccctgaaggccgccgactgccccggcaagctgttcatcttccacagcagcctgcccaccgccgaggcccccggcaagctgaagaacagagacgacaagaagctggtgaacaccgacaaggagaagatcctgttccagccccagaccaacgtgtacgacagcctggccaaggactgcgtggcccacggctgcagcgtgaccctgttcctgttccccagccagtacgtggacgtggccagcctgggcctggtgccccagctgaccggcggcaccctgtacaagtacaacaacttccagatgcacctggacagacagcagttcctgaacgacctgagaaacgacatcgagaagaagatcggcttcgacgccatcatgagagtgagaaccagcaccggcttcagagccaccgacttcttcggcggcatcctgatgaacaacaccaccgacgtggagatggccgccatcgactgcgacaaggccgtgaccgtggagttcaagcacgacgacaagctgagcgaggacagcggcgccctgatccagtgcgccgtgctgtacaccaccatcagcggccagagaagactgagaatccacaacctgggcctgaactgcagcagccagctggccgacctgtacaagagctgcgagaccgacgccctgatcaacttcttcgccaagagcgccttcaaggccgtgctgcaccagcccctgaaggtgatcagagagatcctggtgaaccagaccgcccacatgctggcctgctacagaaagaactgcgccagccccagcgccgccagccagctgatcctgcccgacagcatgaaggtgctgcccgtgtacatgaactgcctgctgaagaactgcgtgctgctgagcagacccgagatcagcaccgacgagagagcctaccagagacagctggtgatgaccatgggcgtggccgacagccagctgttcttctacccccagctgctgcccatccacaccctggacgtgaagagcaccatgctgcccgccgccgtgagatgcagcgagagcagactgagcgaggagggcatcttcctgctggccaacggcctgcacatgttcctgtggctgggcgtgagcagcccccccgagctgatccagggcatcttcaacgtgcccagcttcgcccacatcaacaccgacatgaccctgctgcccgaggtgggcaacccctacagccagcagctgagaatgatcatgggcatcatccagcagaagagaccctacagcatgaagctgaccatcgtgaagcagagagagcagcccgagatggtgttcagacagttcctggtggaggacaagggcctgtacggcggcagcagctacgtggacttcctgtgctgcgtgcacaaggagatctgccagctgctgaactag

SEQ ID NO: 21814 - DNA, 3102 bp, Artificial Sequence
  Description of Artificial Sequence: Synthetic coding sequence
atgagccagcagggctacgtggccacccccccctacagccagccccagcccggcatcggcctgagccccccccactacggccactacggcgaccccagccacaccgccagccccaccggcatgatgaagcccgccggccccctgggcgccaccgccaccagaggcatgctgccccccggcccccccccccccggcccccaccagttcggccagaacggcgcccacgccaccggccaccccccccagagattccccggccccccccccgtgaacaacgtggccagcagccacgccccctaccagcccagcgcccagagcagctaccccggccccatcagcaccagcagcgtgacccagctgggcagccagctgagcgccatgcagatcaacagctacggcagcggcatggccccccccagccagggcccccccggccccctgagcgccaccagcctgcagaccccccccagacccccccagcccagcatcctgcagcccggcagccaggtgctgccccccccccccaccaccctgaacggccccggcgccagccccctgcccctgcccatgtacagacccgacggcctgagcggcccccccccccccaacgcccagtaccagcccccccccctgcccggccagaccctgggcgccggctaccccccccagcaggccgccaacagcggcccccagatggccggcgcccagctgagctaccccggcggcttccccggcggccccgcccagatggccggccccccccagccccagaagaagctggaccccgacagcatccccagccccatccaggtgatcgagaacgacagagccagcagaggcggccaggtgtacgccaccaacaccagaggccagatcccccccctggtgaccaccgactgcatgatccaggaccagggcaacgccagccccagattcatcagatgcaccacctactgcttcccctgcaccagcgacatggccaagcaggcccagatccccctggccgccgtgatcaagcccttcgccaccatccccagcaacgagagccccctgtacctggtgaaccacggcgagagcggccccgtgagatgcaacagatgcaaggcctacatgtgccccttcatgcagttcatcgagggcggcagaagataccagtgcggcttctgcaactgcgtgaacgacgtgccccccttctacttccagcacctggaccacatcggcagaagactggaccactacgagaagcccgagctgagcctgggcagctacgagtacgtggccaccctggactactgcagaaagagcaagccccccaacccccccgccttcatcttcatgatcgacgtgagctacagcaacatcaagaacggcctggtgaagctgatctgcgaggagctgaagaccatgctggagaagatccccaaggaggagcaggaggagaccagcgccatcagagtgggcttcatcacctacaacaaggtgctgcacttcttcaacgtgaagagcaacctggcccagccccagatgatggtggtgaccgacgtgggcgaggtgttcgtgcccctgctggacggcttcctggtgaactaccaggagagccagagcgtgatccacaacctgctggaccagatccccgacatgttcgccgacagcaacgagaacgagaccgtgttcgcccccgtgatccaggccggcatggaggccctgaaggccgccgactgccccggcaagctgttcatcttccacagcagcctgcccaccgccgaggcccccggcaagctgaagaacagagacgacaagaagctggtgaacaccgacaaggagaagatcctgttccagccccagaccaacgtgtacgacagcctggccaaggactgcgtggcccacggctgcagcgtgaccctgttcctgttccccagccagtacgtggacgtggccagcctgggcctggtgccccagctgaccggcggcaccctgtacaagtacaacaacttccagatgcacctggacagacagcagttcctgaacgacctgagaaacgacatcgagaagaagatcggcttcgacgccatcatgagagtgagaaccagcaccggcttcagagccaccgacttcttcggcggcatcctgatgaacaacaccaccgacgtggagatggccgccatcgactgcgacaaggccgtgaccgtggagttcaagcacgacgacaagctgagcgaggacagcggcgccctgatccagtgcgccgtgctgtacaccaccatcagcggccagagaagactgagaatccacaacctgggcctgaactgcagcagccagctggccgacctgtacaagagctgcgagaccgacgccctgatcaacttcttcgccaagagcgccttcaaggccgtgctgcaccagcccctgaaggtgatcagagagatcctggtgaaccagaccgcccacatgctggcctgctacagaaagaactgcgccagccccagcgccgccagccagctgatcctgcccgacagcatgaaggtgctgcccgtgtacatgaactgcctgctgaagaactgcgtgctgctgagcagacccgagatcagcaccgacgagagagcctaccagagacagctggtgatgaccatgggcgtggccgacagccagctgttcttctacccccagctgctgcccatccacaccctggacgtgaagagcaccatgctgcccgccgccgtgagatgcagcgagagcagactgagcgaggagggcatcttcctgctggccaacggcctgcacatgttcctgtggctgggcgtgagcagcccccccgagctgatccagggcatcttcaacgtgcccagcttcgcccacatcaacaccgacatgaccctgctgcccgaggtgggcaacccctacagccagcagctgagaatgatcatgggcatcatccagcagaagagaccctacagcatgaagctgaccatcgtgaagcagagagagcagcccgagatggtgttcagacagttcctggtggaggacaagggcctgtacggcggcagcagctacgtggacttcctgtgctgcgtgcacaaggagatctgccagctgctgaactag

SEQ ID NO: 21815 - DNA, 1182 bp, Artificial Sequence
  Description of Artificial Sequence: Synthetic coding sequence
atgatcgacgtgagctacagcaacatcaagaacggcctggtgaagctgatctgcgaggagctgaagaccatgctggagaagatccccaaggaggagcaggaggagaccagcgccatcagagtgggcttcatcacctacaacaaggtgctgcacttcttcaacgtgaagagcaacctggcccagccccagatgatggtggtgaccgacgtgggcgaggtgttcgtgcccctgctggacggcttcctggtgaactaccaggagagccagagcgtgatccacaacctgctggaccagatccccgacatgttcgccgacagcaacgagaacgagaccgtgttcgcccccgtgatccaggccggcatggaggccctgaaggccgccgactgccccggcaagctgttcatcttccacagcagcctgcccaccgccgaggcccccggcaagctgaagaacagagacgacaagaagctggtgaacaccgacaaggagaagatcctgttccagccccagaccaacgtgtacgacagcctggccaaggactgcgtggcccacggctgcagcgtgaccctgttcctgttccccagccagtacgtggacgtggccagcctgggcctggtgccccagctgaccggcggcaccctgtacaagtacaacaacttccagatgcacctggacagacagcagttcctgaacgacctgagaaacgacatcgagaagaagatcggcttcgacgccatcatgagagtgagaaccagcaccggcttcagagccaccgacttcttcggcggcatcctgatgaacaacaccaccgacgtggagatggccgccatcgactgcgacaaggccgtgaccgtggagttcaagcacgacgacaagctgagcgaggacagcggcgccctgatccagtgcgccgtgctgtacaccaccatcagcggccagagaagactgagaatccacaacctgggcctgaactgcagcagccagctggccgacctgtacaagagctgcgagaccgacgccctgatcaacttcttcgccaagagcgccttcaaggccgtgctgcaccagcccctgaaggtgatcagagagatcctggtgaaccagaccgcccacatgctggcctgctacagaaagaactgcgccagccccagcgccgccagccagttcacctgcgagaagtag

SEQ ID NO: 21816 - DNA, 1182 bp, Artificial Sequence; identical to SEQ ID NO: 21815
  Description of Artificial Sequence: Synthetic coding sequence

SEQ ID NO: 21817 - DNA, 2910 bp, Artificial Sequence
  Description of Artificial Sequence: Synthetic coding sequence
atggtgaagctggtgctgctgagcatcgtgctgctgaaggtgaccgtgcccaagctgagcaacgacctgctgcagctggacttcatgcccatccacagaggcatcctggccatcgcctggagcatggccgaccccgagctgctgctgagctgcggcaaggacgccaagatcctgtgcagcaaccccaacaccggcgaggtgctgtacgagctgcccaccaacacccagtggtgcttcgacatccagtggtgccccagaaaccccgccgtgctgagcgccgccagcttcgacggcagaatcagcgtgtacagcatcatgggcggcagcaccgacggcctgagacagaagcaggtggacaagctgagcagcagcttcggcaacctggaccccttcggcaccggccagcccctgccccccctgcagatcccccagcagaccgcccagcacagcatcgtgctgcccctgaagaagccccccaagtggatcagaagacccgtgggcgccagcttcagcttcggcggcaagctggtgaccttcgagaacgtgagaatgcccagccaccagggcgccgagcagcagcagcagcagcaccacgtgttcatcagccaggtggtgaccgagaaggagttcctgagcagaagcgaccagctgcagcaggccgtgcagagccagggcttcatcaactactgccagaagaagatcgacgccagccagaccgagttcgagaagaacgtgtggagcttcctgaaggtgaacttcgaggacgacagcagaggcaagtacctggagctgctgggctacagaaaggaggacctgggcaagaagcacatcaaggaggagaaggaggagagcgagttcctgcccagcagcggcggcaccttcaacatcagcgtgagcggcgacatcgacggcctgatcacccaggccctgctgaccggcaacttcgagagcgccgtggacctgtgcctgcacgacaacagaatggccgacgccatcatcctggccatcgccggcggccaggagctgctggccagaacccagaagaagtacttcgccaagagccagagcaagatcaccagactgatcaccgccgtggtgatgaagaactggaaggagatcgtggagagctgcgacctgaagaactggagagaggccctggccgccgtgctgacctacgccaagcccgacgagttcagcgccctgtgcgacctgctgggcaccagactggagaacgagggcgacagcctgctgcagacccaggcctgcctgtgctacatctgcgccggcaacgtggagaagctggtggcctgctggaccaaggcccaggacggcagccaccccctgagcctgcaggacctgatcgagaaggtggtgatcctgagaaaggccgtgcagctgacccaggccatggacaccagcaccgtgggcgtgctgctggccgccaagatgagccagtacgccaacctgctggccgcccagggcagcatcgccgccgccctggccttcctgcccgacaacaccaaccagcccaacatcatgcagctgagagacagactgtgcagagcccagggcgagcccgtggccggccacgagagccccaagatcccctacgagaagcagcagctgcccaagggcagacccggccccgtggccggccaccaccagatgcccagagtgcagacccagcagtactacccccacgtgagaatcgcccccaccgtgaccacctggagcaacaagacccccaccgccctgcccagccacccccccgccgccagccccagcgacacccagggcgagaacccccccccccccggcttcatcatgcacggcaacgtgaaccccaacgccgccggccagctgcccaccagccccggccacatgcacacccaggtgcccccctacccccagccccagccctaccagcccgcccagccctaccccttcggcaccggcggcagcgccatgtacagaccccagcagcccgtggccccccccaccagcaacgcctaccccaacaccccctacatcagcagcgccagcagctacaccggccagagccagctgtacgccgcccagcaccaggccagcagccccaccagcagccccgccaccagcttcccccccccccccagcagcggcgccagcttccagcacggcggccccggcgccccccccagcagcagcgcctacgccctgccccccggcaccaccggcccccagaacggctggaacgacccccccgccctgaacagagtgcccaagaagaagaagatgcccgagaacttcatgccccccgtgcccatcaccagccccatcatgaaccccctgggcgacccccagagccagatgctgcagcagcagcccagcgcccccgtgcccctgagcagccagagcagcttcccccagccccacctgcccggcggccagcccttccacggcgtgcagcagcccctgggccagaccggcatgccccccagcttcagcaagcccaacatcgagggcgcccccggcgcccccatcggcaacaccttccagcacgtgcagagcctgcccaccaagaagatcaccaagaagcccatccccgacgagcacctgatcctgaagaccaccttcgaggacctgatccagagatgcctgagcagcgccaccgacccccagaccaagagaaagctggacgacgccagcaagagactggagttcctgtacgacaagctgagagagcagaccctgagccccaccatcaccagcggcctgcacaacatcgccagaagcatcgagaccagaaactacagcgagggcctgaccatgcacacccacatcgtgagcaccagcaacttcagcgagaccagcgccttcatgcccgtgctgaaggtggtgctgacccaggccaacaagctgggcgtgtag

SEQ ID NO: 21818 - DNA, 3321 bp, Artificial Sequence
  Description of Artificial Sequence: Synthetic coding sequence
atgaagctgaaggaggtggacagaaccgccatgcaggcctggagccccgcccagaaccaccccatctacctggccaccggcaccagcgcccagcagctggacgccaccttcagcaccaacgccagcctggagatcttcgagctggacctgagcgaccccagcctggacatgaagagctgcgccaccttcagcagcagccacagataccacaagctgatctggggcccctacaagatggacagcaagggcgacgtgagcggcgtgctgatcgccggcggcgagaacggcaacatcatcctgtacgaccccagcaagatcatcgccggcgacaaggaggtggtgatcgcccagaacgacaagcacaccggccccgtgagagccctggacgtgaacatcttccagaccaacctggtggccagcggcgccaacgagagcgagatctacatctgggacctgaacaacttcgccacccccatgacccccggcgccaagacccagccccccgaggacatcagctgcatcgcctggaacagacaggtgcagcacatcctggccagcgccagccccagcggcagagccaccgtgtgggacctgagaaagaacgagcccatcatcaaggtgagcgaccacagcaacagaatgcactgcagcggcctggcctggcaccccgacgtggccacccagatggtgctggccagcgaggacgacagactgcccgtgatccagatgtgggacctgagattcgccagcagccccctgagagtgctggagaaccacgccagaggcatcctggccatcgcctggagcatggccgaccccgagctgctgctgagctgcggcaaggacgccaagatcctgtgcagcaaccccaacaccggcgaggtgctgtacgagctgcccaccaacacccagtggtgcttcgacatccagtggtgccccagaaaccccgccgtgctgagcgccgccagcttcgacggcagaatcagcgtgtacagcatcatgggcggcagcaccgacggcctgagacagaagcaggtggacaagctgagcagcagcttcggcaacctggaccccttcggcaccggccagcccctgccccccctgcagatcccccagcagaccgcccagcacagcatcgtgctgcccctgaagaagccccccaagtggatcagaagacccgtgggcgccagcttcagcttcggcggcaagctggtgaccttcgagaacgtgagaatgcccagccaccagggcgccgagcagcagcagcagcagcaccacgtgttcatcagccaggtggtgaccgagaaggagttcctgagcagaagcgaccagctgcagcaggccgtgcagagccagggcttcatcaactactgccagaagaagatcgacgccagccagaccgagttcgagaagaacgtgtggagcttcctgaaggtgaacttcgaggacgacagcagaggcaagtacctggagctgctgggctacagaaaggaggacctgggcaagaagatcgccctggccctgaacaaggtggacggcgccaacgtggccctgaaggacagcgaccaggtggcccagagcgacggcgaggagagccccgccgccgaggagcagctgctgggcgagcacatcaaggaggagaaggaggagagcgagttcctgcccagcagcggcggcaccttcaacatcagcgtgagcggcgacatcgacggcctgatcacccaggccctgctgaccggcaacttcgagagcgccgtggacctgtgcctgcacgacaacagaatggccgacgccatcatcctggccatcgccggcggccaggagctgctggccagaacccagaagaagtacttcgccaagagccagagcaagatcaccagactgatcaccgccgtggtgatgaagaactggaaggagatcgtggagagctgcgacctgaagaactggagagaggccctggccgccgtgctgacctacgccaagcccgacgagttcagcgccctgtgcgacctgctgggcaccagactggagaacgagggcgacagcctgctgcagacccaggcctgcctgtgctacatctgcgccggcaacgtggagaagctggtggcctgctggaccaaggcccaggacggcagccaccccctgagcctgcaggacctgatcgagaaggtggtgatcctgagaaaggccgtgcagctgacccaggccatggacaccagcaccgtgggcgtgctgctggccgccaagatgagccagtacgccaacctgctggccgcccagggcagcatcgccgccgccctggccttcctgcccgacaacaccaaccagcccaacatcatgcagctgagagacagactgtgcagagcccagggcgagcccgtggccggccacgagagccccaagatcccctacgagaagcagcagctgcccaagggcagacccggccccgtggccggccaccaccagatgcccagagtgcagacccagcagtactacccccacggcgagaacccccccccccccggcttcatcatgcacggcaacgtgaaccccaacgccgccggccagctgcccaccagccccggccacatgcacacccaggtgcccccctacccccagccccagagaccccagaacggctggaacgacccccccgccctgaacagagtgcccaagaagaagaagatgcccgagaacttcatgccccccgtgcccatcaccagccccatcatgaaccccctgggcgacccccagagccagatgctgcagcagcagcccagcgcccccgtgcccctgagcagccagagcagcttcccccagccccacctgcccggcggccagcccttccacggcgtgcagcagcccctgggccagaccggcatgccccccagcttcagcaagcccaacatcgagggcgcccccggcgcccccatcggcaacaccttccagcacgtgcagagcctgcccaccaagaagatcaccaagaagcccatccccgacgagcacctgatcctgaagaccaccttcgaggacctgatccagagatgcctgagcagcgccaccgacccccagaccaagagaaagctggacgacgccagcaagagactggagttcctgtacgacaagctgagagagcagaccctgagccccaccatcaccagcggcctgcacaacatcgccagaagcatcgagaccagaaactacagcgagggcctgaccatgcacacccacatcgtgagcaccagcaacttcagcgagaccagcgccttcatgcccgtgctgaaggtggtgctgacccaggccaacaagctgggcgtgtag

SEQ ID NO: 21819 - DNA, 3546 bp, Artificial Sequence
  Description of Artificial Sequence: Synthetic coding sequence
atgaagctgaaggaggtggacagaaccgccatgcaggcctggagccccgcccagaaccaccccatctacctggccaccggcaccagcgcccagcagctggacgccaccttcagcaccaacgccagcctggagatcttcgagctggacctgagcgaccccagcctggacatgaagagctgcgccaccttcagcagcagccacagataccacaagctgatctggggcccctacaagatggacagcaagggcgacgtgagcggcgtgctgatcgccggcggcgagaacggcaacatcatcctgtacgaccccagcaagatcatcgccggcgacaaggaggtggtgatcgcccagaacgacaagcacaccggccccgtgagagccctggacgtgaacatcttccagaccaacctggtggccagcggcgccaacgagagcgagatctacatctgggacctgaacaacttcgccacccccatgacccccggcgccaagacccagccccccgaggacatcagctgcatcgcctggaacagacaggtgcagcacatcctggccagcgccagccccagcggcagagccaccgtgtgggacctgagaaagaacgagcccatcatcaaggtgagcgaccacagcaacagaatgcactgcagcggcctggcctggcaccccgacgtggccacccagatggtgctggccagcgaggacgacagactgcccgtgatccagatgtgggacctgagattcgccagcagccccctgagagtgctggagaaccacgccagaggcatcctggccatcgcctggagcatggccgaccccgagctgctgctgagctgcggcaaggacgccaagatcctgtgcagcaaccccaacaccggcgaggtgctgtacgagctgcccaccaacacccagtggtgcttcgacatccagtggtgccccagaaaccccgccgtgctgagcgccgccagcttcgacggcagaatcagcgtgtacagcatcatgggcggcagcaccgacggcctgagacagaagcaggtggacaagctgagcagcagcttcggcaacctggaccccttcggcaccggccagcccctgccccccctgcagatcccccagcagaccgcccagcacagcatcgtgctgcccctgaagaagccccccaagtggatcagaagacccgtgggcgccagcttcagcttcggcggcaagctggtgaccttcgagaacgtgagaatgcccagccaccagggcgccgagcagcagcagcagcagcaccacgtgttcatcagccaggtggtgaccgagaaggagttcctgagcagaagcgaccagctgcagcaggccgtgcagagccagggcttcatcaactactgccagaagaagatcgacgccagccagaccgagttcgagaagaacgtgtggagcttcctgaaggtgaacttcgaggacgacagcagaggcaagtacctggagctgctgggctacagaaaggaggacctgggcaagaagcacatcaaggaggagaaggaggagagcgagttcctgcccagcagcggcggcaccttcaacatcagcgtgagcggcgacatcgacggcctgatcacccaggccctgctgaccggcaacttcgagagcgccgtggacctgtgcctgcacgacaacagaatggccgacgccatcatcctggccatcgccggcggccaggagctgctggccagaacccagaagaagtacttcgccaagagccagagcaagatcaccagactgatcaccgccgtggtgatgaagaactggaaggagatcgtggagagctgcgacctgaagaactggagagaggccctggccgccgtgctgacctacgccaagcccgacgagttcagcgccctgtgcgacctgctgggcaccagactggagaacgagggcgacagcctgctgcagacccaggcctgcctgtgctacatctgcgccggcaacgtggagaagctggtggcctgctggaccaaggcccaggacggcagccaccccctgagcctgcaggacctgatcgagaaggtggtgatcctgagaaaggccgtgcagctgacccaggccatggacaccagcaccgtgggcgtgctgctggccgccaagatgagccagtacgccaacctgctggccgcccagggcagcatcgccgccgccctggccttcctgcccgacaacaccaaccagcccaacatcatgcagctgagagacagactgtgcagagcccagggcgagcccgtggccggccacgagagccccaagatcccctacgagaagcagcagctgcccaagggcagacccggccccgtggccggccaccaccagatgcccagagtgcagacccagcagtactacccccacggcgagaacccccccccccccggcttcatcatgcacggcaacgtgaaccccaacgccgccggccagctgcccaccagccccggccacatgcacacccaggtgcccccctacccccagccccagccctaccagcccgcccagccctaccccttcggcaccggcggcagcgccatgtacagaccccagcagcccgtggccccccccaccagcaacgcctaccccaacaccccctacatcagcagcgccagcagctacaccggccagagccagctgtacgccgcccagcaccaggccagcagccccaccagcagccccgccaccagcttcccccccccccccagcagcggcgccagcttccagcacggcggccccggcgccccccccagcagcagcgcctacgccctgccccccggcaccaccggcaccctgcccgccgccagcgagctgcccgccagccagagaaccggcccccagaacggctggaacgacccccccgccctgaacagagtgcccaagaagaagaagatgcccgagaacttcatgccccccgtgcccatcaccagccccatcatgaaccccctgggcgacccccagagccagatgctgcagcagcagcccagcgcccccgtgcccctgagcagccagagcagcttcccccagccccacctgcccggcggccagcccttccacggcgtgcagcagcccctgggccagaccggcatgccccccagcttcagcaagcccaacatcgagggcgcccccggcgcccccatcggcaacaccttccagcacgtgcagagcctgcccaccaagaagatcaccaagaagcccatccccgacgagcacctgatcctgaagaccaccttcgaggacctgatccagagatgcctgagcagcgccaccgacccccagaccaagagaaagctggacgacgccagcaagagactggagttcctgtacgacaagctgagagagcagaccctgagccccaccatcaccagcggcctgcacaacatcgccagaagcatcgagaccagaaactacagcgagggcctgaccatgcacacccacatcgtgagcaccagcaacttcagcgagaccagcgccttcatgcccgtgctgaaggtggtgctgacccaggccaacaagctgggcgtgtag

SEQ ID NO: 21820 - DNA, 3546 bp, Artificial Sequence; identical to SEQ ID NO: 21819
  Description of Artificial Sequence: Synthetic coding sequence

SEQ ID NO: 21821 - DNA, 3663 bp, Artificial Sequence
  Description of Artificial Sequence: Synthetic coding sequence
atgaagctgaaggaggtggacagaaccgccatgcaggcctggagccccgcccagaaccaccccatctacctggccaccggcaccagcgcccagcagctggacgccaccttcagcaccaacgccagcctggagatcttcgagctggacctgagcgaccccagcctggacatgaagagctgcgccaccttcagcagcagccacagataccacaagctgatctggggcccctacaagatggacagcaagggcgacgtgagcggcgtgctgatcgccggcggcgagaacggcaacatcatcctgtacgaccccagcaagatcatcgccggcgacaaggaggtggtgatcgcccagaacgacaagcacaccggccccgtgagagccctggacgtgaacatcttccagaccaacctggtggccagcggcgccaacgagagcgagatctacatctgggacctgaacaacttcgccacccccatgacccccggcgccaagacccagccccccgaggacatcagctgcatcgcctggaacagacaggtgcagcacatcctggccagcgccagccccagcggcagagccaccgtgtgggacctgagaaagaacgagcccatcatcaaggtgagcgaccacagcaacagaatgcactgcagcggcctggcctggcaccccgacgtggccacccagatggtgctggccagcgaggacgacagactgcccgtgatccagatgtgggacctgagattcgccagcagccccctgagagtgctggagaaccacgccagaggcatcctggccatcgcctggagcatggccgaccccgagctgctgctgagctgcggcaaggacgccaagatcctgtgcagcaaccccaacaccggcgaggtgctgtacgagctgcccaccaacacccagtggtgcttcgacatccagtggtgccccagaaaccccgccgtgctgagcgccgccagcttcgacggcagaatcagcgtgtacagcatcatgggcggcagcaccgacggcctgagacagaagcaggtggacaagctgagcagcagcttcggcaacctggaccccttcggcaccggccagcccctgccccccctgcagatcccccagcagaccgcccagcacagcatcgtgctgcccctgaagaagccccccaagtggatcagaagacccgtgggcgccagcttcagcttcggcggcaagctggtgaccttcgagaacgtgagaatgcccagccaccagggcgccgagcagcagcagcagcagcaccacgtgttcatcagccaggtggtgaccgagaaggagttcctgagcagaagcgaccagctgcagcaggccgtgcagagccagggcttcatcaactactgccagaagaagatcgacgccagccagaccgagttcgagaagaacgtgtggagcttcctgaaggtgaacttcgaggacgacagcagaggcaagtacctggagctgctgggctacagaaaggaggacctgggcaagaagatcgccctggccctgaacaaggtggacggcgccaacgtggccctgaaggacagcgaccaggtggcccagagcgacggcgaggagagccccgccgccgaggagcagctgctgggcgagcacatcaaggaggagaaggaggagagcgagttcctgcccagcagcggcggcaccttcaacatcagcgtgagcggcgacatcgacggcctgatcacccaggccctgctgaccggcaacttcgagagcgccgtggacctgtgcctgcacgacaacagaatggccgacgccatcatcctggccatcgccggcggccaggagctgctggccagaacccagaagaagtacttcgccaagagccagagcaagatcaccagactgatcaccgccgtggtgatgaagaactggaaggagatcgtggagagctgcgacctgaagaactggagagaggccctggccgccgtgctgacctacgccaagcccgacgagttcagcgccctgtgcgacctgctgggcaccagactggagaacgagggcgacagcctgctgcagacccaggcctgcctgtgctacatctgcgccggcaacgtggagaagctggtggcctgctggaccaaggcccaggacggcagccaccccctgagcctgcaggacctgatcgagaaggtggtgatcctgagaaaggccgtgcagctgacccaggccatggacaccagcaccgtgggcgtgctgctggccgccaagatgagccagtacgccaacctgctggccgcccagggcagcatcgccgccgccctggccttcctgcccgacaacaccaaccagcccaacatcatgcagctgagagacagactgtgcagagcccagggcgagcccgtggccggccacgagagccccaagatcccctacgagaagcagcagctgcccaagggcagacccggccccgtggccggccaccaccagatgcccagagtgcagacccagcagtactacccccacggcgagaacccccccccccccggcttcatcatgcacggcaacgtgaaccccaacgccgccggccagctgcccaccagccccggccacatgcacacccaggtgcccccctacccccagccccagccctaccagcccgcccagccctaccccttcggcaccggcggcagcgccatgtacagaccccagcagcccgtggccccccccaccagcaacgcctaccccaacaccccctacatcagcagcgccagcagctacaccggccagagccagctgtacgccgcccagcaccaggccagcagccccaccagcagccccgccaccagcttcccccccccccccagcagcggcgccagcttccagcacggcggccccggcgccccccccagcagcagcgcctacgccctgccccccggcaccaccggcaccctgcccgccgccagcgagctgcccgccagccagagaaccggcccccagaacggctggaacgacccccccgccctgaacagagtgcccaagaagaagaagatgcccgagaacttcatgccccccgtgcccatcaccagccccatcatgaaccccctgggcgacccccagagccagatgctgcagcagcagcccagcgcccccgtgcccctgagcagccagagcagcttcccccagccccacctgcccggcggccagcccttccacggcgtgcagcagcccctgggccagaccggcatgccccccagcttcagcaagcccaacatcgagggcgcccccggcgcccccatcggcaacaccttccagcacgtgcagagcctgcccaccaagaagatcaccaagaagcccatccccgacgagcacctgatcctgaagaccaccttcgaggacctgatccagagatgcctgagcagcgccaccgacccccagaccaagagaaagctggacgacgccagcaagagactggagttcctgtacgacaagctgagagagcagaccctgagccccaccatcaccagcggcctgcacaacatcgccagaagcatcgagaccagaaactacagcgagggcctgaccatgcacacccacatcgtgagcaccagcaacttcagcgagaccagcgccttcatgcccgtgctgaaggtggtgctgacccaggccaacaagctgggcgtgtag

SEQ ID NO: 21822 - DNA, 3663 bp, Artificial Sequence; identical to SEQ ID NO: 21821
  Description of Artificial Sequence: Synthetic coding sequence

SEQ ID NO: 21823 - DNA, 3702 bp, Artificial Sequence
  Description of Artificial Sequence: Synthetic coding sequence
atgaagctgaaggaggtggacagaaccgccatgcaggcctggagccccgcccagaaccaccccatctacctggccaccggcaccagcgcccagcagctggacgccaccttcagcaccaacgccagcctggagatcttcgagctggacctgagcgaccccagcctggacatgaagagctgcgccaccttcagcagcagccacagataccacaagctgatctggggcccctacaagatggacagcaagggcgacgtgagcggcgtgctgatcgccggcggcgagaacggcaacatcatcctgtacgaccccagcaagatcatcgccggcgacaaggaggtggtgatcgcccagaacgacaagcacaccggccccgtgagagccctggacgtgaacatcttccagaccaacctggtggccagcggcgccaacgagagcgagatctacatctgggacctgaacaacttcgccacccccatgacccccggcgccaagacccagccccccgaggacatcagctgcatcgcctggaacagacaggtgcagcacatcctggccagcgccagccccagcggcagagccaccgtgtgggacctgagaaagaacgagcccatcatcaaggtgagcgaccacagcaacagaatgcactgcagcggcctggcctggcaccccgacgtggccacccagatggtgctggccagcgaggacgacagactgcccgtgatccagatgtgggacctgagattcgccagcagccccctgagagtgctggagaaccacgccagaggcatcctggccatcgcctggagcatggccgaccccgagctgctgctgagctgcggcaaggacgccaagatcctgtgcagcaaccccaacaccggcgaggtgctgtacgagctgcccaccaacacccagtggtgcttcgacatccagtggtgccccagaaaccccgccgtgctgagcgccgccagcttcgacggcagaatcagcgtgtacagcatcatgggcggcagcaccgacggcctgagacagaagcaggtggacaagctgagcagcagcttcggcaacctggaccccttcggcaccggccagcccctgccccccctgcagatcccccagcagaccgcccagcacagcatcgtgctgcccctgaagaagccccccaagtggatcagaagacccgtgggcgccagcttcagcttcggcggcaagctggtgaccttcgagaacgtgagaatgcccagccaccagggcgccgagcagcagcagcagcagcaccacgtgttcatcagccaggtggtgaccgagaaggagttcctgagcagaagcgaccagctgcagcaggccgtgcagagccagggcttcatcaactactgccagaagaagatcgacgccagccagaccgagttcgagaagaacgtgtggagcttcctgaaggtgaacttcgaggacgacagcagaggcaagtacctggagctgctgggctacagaaaggaggacctgggcaagaagatcgccctggccctgaacaaggtggacggcgccaacgtggccctgaaggacagcgaccaggtggcccagagcgacggcgaggagagccccgccgccgaggagcagctgctgggcgagcacatcaaggaggagaaggaggagagcgagttcctgcccagcagcggcggcaccttcaacatcagcgtgagcggcgacatcgacggcctgatcacccaggccctgctgaccggcaacttcgagagcgccgtggacctgtgcctgcacgacaacagaatggccgacgccatcatcctggccatcgccggcggccaggagctgctggccagaacccagaagaagtacttcgccaagagccagagcaagatcaccagactgatcaccgccgtggtgatgaagaactggaaggagatcgtggagagctgcgacctgaagaactggagagaggccctggccgccgtgctgacctacgccaagcccgacgagttcagcgccctgtgcgacctgctgggcaccagactggagaacgagggcgacagcctgctgcagacccaggcctgcctgtgctacatctgcgccggcaacgtggagaagctggtggcctgctggaccaaggcccaggacggcagccaccccctgagcctgcaggacctgatcgagaaggtggtgatcctgagaaaggccgtgcagctgacccaggccatggacaccagcaccgtgggcgtgctgctggccgccaagatgagccagtacgccaacctgctggccgcccagggcagcatcgccgccgccctggccttcctgcccgacaacaccaaccagcccaacatcatgcagctgagagacagactgtgcagagcccagggcgagcccgtggccggccacgagagccccaagatcccctacgagaagcagcagctgcccaagggcagacccggccccgtggccggccaccaccagatgcccagagtgcagacccagcagtactacccccacggcgagaacccccccccccccggcttcatcatgcacggcaacgtgaaccccaacgccgccggccagctgcccaccagccccggccacatgcacacccaggtgcccccctacccccagccccagccctaccagcccgcccagccctaccccttcggcaccggcggcagcgccatgtacagaccccagcagcccgtggccccccccaccagcaacgcctaccccaacaccccctacatcagcagcgccagcagctacaccggccagagccagctgtacgccgcccagcaccaggccagcagccccaccagcagccccgccaccagcttcccccccccccccagcagcggcgccagcttccagcacggcggccccggcgccccccccagcagcagcgcctacgccctgccccccggcaccaccggcaccctgcccgccgccagcgagctgcccgccagccagagaaccgagaaccagagcatccaggaccaggcccccatgctggagggcccccagaacggctggaacgacccccccgccctgaacagagtgcccaagaagaagaagatgcccgagaacttcatgccccccgtgcccatcaccagccccatcatgaaccccctgggcgacccccagagccagatgctgcagcagcagcccagcgcccccgtgcccctgagcagccagagcagcttcccccagccccacctgcccggcggccagcccttccacggcgtgcagcagcccctgggccagaccggcatgccccccagcttcagcaagcccaacatcgagggcgcccccggcgcccccatcggcaacaccttccagcacgtgcagagcctgcccaccaagaagatcaccaagaagcccatccccgacgagcacctgatcctgaagaccaccttcgaggacctgatccagagatgcctgagcagcgccaccgacccccagaccaagagaaagctggacgacgccagcaagagactggagttcctgtacgacaagctgagagagcagaccctgagccccaccatcaccagcggcctgcacaacatcgccagaagcatcgagaccagaaactacagcgagggcctgaccatgcacacccacatcgtgagcaccagcaacttcagcgagaccagcgccttcatgcccgtgctgaaggtggtgctgacccaggccaacaagctgggcgtgtag

SEQ ID NO: 21824 - DNA, 3663 bp, Artificial Sequence; identical to SEQ ID NO: 21821
  Description of Artificial Sequence: Synthetic coding sequence

SEQ ID NO: 21825 - DNA, 3204 bp, Artificial Sequence
  Description of Artificial Sequence: Synthetic coding sequence
atgaagctgaaggaggtggacagaaccgccatgcaggcctggagccccgcccagaaccaccccatctacctggccaccggcaccagcgcccagcagctggacgccaccttcagcaccaacgccagcctggagatcttcgagctggacctgagcgaccccagcctggacatgaagagctgcgccaccttcagcagcagccacagataccacaagctgatctggggcccctacaagatggacagcaagggcgacgtgagcggcgtgctgatcgccggcggcgagaacggcaacatcatcctgtacgaccccagcaagatcatcgccggcgacaaggaggtggtgatcgcccagaacgacaagcacaccggccccgtgagagccctggacgtgaacatcttccagaccaacctggtggccagcggcgccaacgagagcgagatctacatctgggacctgaacaacttcgccacccccatgacccccggcgccaagacccagccccccgaggacatcagctgcatcgcctggaacagacaggtgcagcacatcctggccagcgccagccccagcggcagagccaccgtgtgggacctgagaaagaacgagcccatcatcaaggtgagcgaccacagcaacagaatgcactgcagcggcctggcctggcaccccgacgtggccacccagatggtgctggccagcgaggacgacagactgcccgtgatccagatgtgggacctgagattcgccagcagccccctgagagtgctggagaaccacgccagaggcatcctggccatcgcctggagcatggccgaccccgagctgctgctgagctgcggcaaggacgccaagatcctgtgcagcaaccccaacaccggcgaggtgctgtacgagctgcccaccaacacccagtggtgcttcgacatccagtggtgccccagaaaccccgccgtgctgagcgccgccagcttcgacggcagaatcagcgtgtacagcatcatgggcggcagcaccgacggcctgagacagaagcaggtggacaagctgagcagcagcttcggcaacctggaccccttcggcaccggccagcccctgccccccctgcagatcccccagcagaccgcccagcacagcatcgtgctgcccctgaagaagccccccaagtggatcagaagacccgtgggcgccagcttcagcttcggcggcaagctggtgaccttcgagaacgtgagaatgcccagccaccagggcgccgagcagcagcagcagcagcaccacgtgttcatcagccaggtggtgaccgagaaggagttcctgagcagaagcgaccagctgcagcaggccgtgcagagccagggcttcatcaactactgccagaagaagatcgacgccagccagaccgagttcgagaagaacgtgtggagcttcctgaaggtgaacttcgaggacgacagcagaggcaagtacctggagctgctgggctacagaaaggaggacctgggcaagaagcacatcaaggaggagaaggaggagagcgagttcctgcccagcagcggcggcaccttcaacatcagcgtgagcggcgacatcgacggcctgatcacccaggccctgctgaccggcaacttcgagagcgccgtggacctgtgcctgcacgacaacagaatggccgacgccatcatcctggccatcgccggcggccaggagctgctggccagaacccagaagaagtacttcgccaagagccagagcaagatcaccagactgatcaccgccgtggtgatgaagaactggaaggagatcgtggagagctgcgacctgaagaactggagagaggccctggccgccgtgctgacctacgccaagcccgacgagttcagcgccctgtgcgacctgctgggcaccagactggagaacgagggcgacagcctgctgcagacccaggcctgcctgtgctacatctgcgccggcaacgtggagaagctggtggcctgctggaccaaggcccaggacggcagccaccccctgagcctgcaggacctgatcgagaaggtggtgatcctgagaaaggccgtgcagctgacccaggccatggacaccagcaccgtgggcgtgctgctggccgccaagatgagccagtacgccaacctgctggccgcccagggcagcatcgccgccgccctggccttcctgcccgacaacaccaaccagcccaacatcatgcagctgagagacagactgtgcagagcccagggcgagcccgtggccggccacgagagccccaagatcccctacgagaagcagcagctgcccaagggcagacccggccccgtggccggccaccaccagatgcccagagtgcagacccagcagtactacccccacggcgagaacccccccccccccggcttcatcatgcacggcaacgtgaaccccaacgccgccggccagctgcccaccagccccggccacatgcacacccaggtgcccccctacccccagccccagagaccccagaacggctggaacgacccccccgccctgaacagagtgcccaagaagaagaagatgcccgagaacttcatgccccccgtgcccatcaccagccccatcatgaaccccctgggcgacccccagagccagatgctgcagcagcagcccagcgcccccgtgcccctgagcagccagagcagcttcccccagccccacctgcccggcggccagcccttccacggcgtgcagcagcccctgggccagaccggcatgccccccagcttcagcaagcccaacatcgagggcgcccccggcgcccccatcggcaacaccttccagcacgtgcagagcctgcccaccaagaagatcaccaagaagcccatccccgacgagcacctgatcctgaagaccaccttcgaggacctgatccagagatgcctgagcagcgccaccgacccccagaccaagagaaagctggacgacgccagcaagagactggagttcctgtacgacaagctgagagagcagaccctgagccccaccatcaccagcggcctgcacaacatcgccagaagcatcgagaccagaaactacagcgagggcctgaccatgcacacccacatcgtgagcaccagcaacttcagcgagaccagcgccttcatgcccgtgctgaaggtggtgctgacccaggccaacaagctgggcgtgtag

SEQ ID NO: 21826 - DNA, 246 bp, Artificial Sequence
  Description of Artificial Sequence: Synthetic coding sequence
atgaagctgaaggaggtggacagaaccgccatgcaggcctggagccccgcccagaaccaccccatctacctggccaccggcaccagcgcccagcagctggacgccaccttcagcaccaacgccagcctggagatcttcgagctggacctgagcgaccccagcctggacatgaagagctgcgccaccttcagcagcagccacagataccacaagctgatctggggcccctacaagatggacagctag

SEQ ID NO: 21827 - DNA, 201 bp, Artificial Sequence
  Description of Artificial Sequence: Synthetic coding sequence
atgaagctgaaggaggtggacagaaccgccatgcaggcctggagccccgcccagaaccaccccatctacctggccaccggcaccagcgcccagcagctggacgccaccttcagcaccaacgccagcctggagatcttcgagctggacctgagcgaccccagcctggacatgaagagctgcgccaccttcagcagcagctag

SEQ ID NO: 21828 - DNA, 3501 bp, Artificial Sequence
  Description of Artificial Sequence: Synthetic coding sequence
atgaagctgaaggaggtggacagaaccgccatgcaggcctggagccccgcccagaaccaccccatctacctggccaccggcaccagcgcccagcagctggacgccaccttcagcaccaacgccagcctggagatcttcgagctggacctgagcgaccccagcctggacatgaagagctgcgccaccttcagcagcagccacagataccacaagctgatctggggcccctacaagatggacagcaagggcgacgtgagcggcgtgctgatcgccggcggcgagaacggcaacatcatcctgtacgaccccagcaagatcatcgccggcgacaaggaggtggtgatcgcccagaacgacaagcacaccggccccgtgagagccctggacgtgaacatcttccagaccaacctggtggccagcggcgccaacgagagcgagatctacatctgggacctgaacaacttcgccacccccatgacccccggcgccaagacccagccccccgaggacatcagctgcatcgcctggaacagacaggtgcagcacatcctggccagcgccagccccagcggcagagccaccgtgtgggacctgagaaagaacgagcccatcatcaaggtgagcgaccacagcaacagaatgcactgcagcggcctggcctggcaccccgacgtggccacccagatggtgctggccagcgaggacgacagactgcccgtgatccagatgtgggacctgagattcgccagcagccccctgagagtgctggagaaccacgccagaggcatcctggccatcgcctggagcatggccgaccccgagctgctgctgagctgcggcaaggacgccaagatcctgtgcagcaaccccaacaccggcgaggtgctgtacgagctgcccaccaacacccagtggtgcttcgacatccagtggtgccccagaaaccccgccgtgctgagcgccgccagcttcgacggcagaatcagcgtgtacagcatcatgggcggcagcaccgacggcctgagacagaagcaggtggacaagctgagcagcagcttcggcaacctggaccccttcggcaccggccagcccctgccccccctgcagatcccccagcagaccgcccagcacagcatcgtgctgcccctgaagaagccccccaagtggatcagaagacccgtgggcgccagcttcagcttcggcggcaagctggtgaccttcgagaacgtgagaatgcccagccaccagggcgccgagcagcagcagcagcagcaccacgtgttcatcagccaggtggtgaccgagaaggagttcctgagcagaagcgaccagctgcagcaggccgtgcagagccagggcttcatcaactactgccagaagaagatcgacgccagccagaccgagttcgagaagaacgtgtggagcttcctgaaggtgaacttcgaggacgacagcagaggcaagtacctggagctgctgggctacagaaaggaggacctgggcaagaagcacatcaaggaggagaaggaggagagcgagttcctgcccagcagcggcggcaccttcaacatcagcgtgagcggcgacatcgacggcctgatcacccaggccctgctgaccggcaacttcgagagcgccgtggacctgtgcctgcacgacaacagaatggccgacgccatcatcctggccatcgccggcggccaggagctgctggccagaacccagaagaagtacttcgccaagagccagagcaagatcaccagactgatcaccgccgtggtgatgaagaactggaaggagatcgtggagagctgcgacctgaagaactggagagaggccctggccgccgtgctgacctacgccaagcccgacgagttcagcgccctgtgcgacctgctgggcaccagactggagaacgagggcgacagcctgctgcagacccaggcctgcctgtgctacatctgcgccggcaacgtggagaagctggtggcctgctggaccaaggcccaggacggcagccaccccctgagcctgcaggacctgatcgagaaggtggtgatcctgagaaaggccgtgcagctgacccaggccatggacaccagcaccgtgggcgtgctgctggccgccaagatgagccagtacgccaacctgctggccgcccagggcagcatcgccgccgccctggccttcctgcccgacaacaccaaccagcccaacatcatgcagctgagagacagactgtgcagagcccagggcgagcccgtggccggccacgagagccccaagatcccctacgagaagcagcagctgcccaagggcagacccggccccgtggccggccaccaccagatgcccagagtgcagacccagcagtactacccccacggcgagaacccccccccccccggcttcatcatgcacggcaacgtgaaccccaacgccgccggccagctgcccaccagccccggccacatgcacacccaggtgcccccctacccccagccccagccctaccagcccgcccagccctaccccttcggcaccggcggcagcgccatgtacagaccccagcagcccgtggccccccccaccagcaacgcctaccccaacaccccctacatcagcagcgccagcagctacaccggccagagccagctgtacgccgcccagcaccaggccagcagccccaccagcagccccgccaccagcttcccccccccccccagcagcggcgccagcttccagcacggcggccccggcgccccccccagcagcagcgcctacgccctgccccccggcaccaccggcccccagaacggctggaacgacccccccgccctgaacagagtgcccaagaagaagaagatgcccgagaacttcatgccccccgtgcccatcaccagccccatcatgaaccccctgggcgacccccagagccagatgctgcagcagcagcccagcgcccccgtgcccctgagcagccagagcagcttcccccagccccacctgcccggcggccagcccttccacggcgtgcagcagcccctgggccagaccggcatgccccccagcttcagcaagcccaacatcgagggcgcccccggcgcccccatcggcaacaccttccagcacgtgcagagcctgcccaccaagaagatcaccaagaagcccatccccgacgagcacctgatcctgaagaccaccttcgaggacctgatccagagatgcctgagcagcgccaccgacccccagaccaagagaaagctggacgacgccagcaagagactggagttcctgtacgacaagctgagagagcagaccctgagccccaccatcaccagcggcctgcacaacatcgccagaagcatcgagaccagaaactacagcgagggcctgaccatgcacacccacatcgtgagcaccagcaacttcagcgagaccagcgccttcatgcccgtgctgaaggtggtgctgacccaggccaacaagctgggcgtgtag

SEQ ID NO: 21829 - DNA, 84 bp, Artificial Sequence
  Description of Artificial Sequence: Synthetic coding sequence
atgaagctgaaggaggtggacagaaccgccatgcaggcctggagccccgcccagaaccaccccatctacctggccaccggctag

SEQ ID NO: 21830 - DNA, 3618 bp, Artificial Sequence
  Description of Artificial Sequence: Synthetic coding sequence
atgaagctgaaggaggtggacagaaccgccatgcaggcctggagccccgcccagaaccaccccatctacctggccaccggcaccagcgcccagcagctggacgccaccttcagcaccaacgccagcctggagatcttcgagctggacctgagcgaccccagcctggacatgaagagctgcgccaccttcagcagcagccacagataccacaagctgatctggggcccctacaagatggacagcaagggcgacgtgagcggcgtgctgatcgccggcggcgagaacggcaacatcatcctgtacgaccccagcaagatcatcgccggcgacaaggaggtggtgatcgcccagaacgacaagcacaccggccccgtgagagccctggacgtgaacatcttccagaccaacctggtggccagcggcgccaacgagagcgagatctacatctgggacctgaacaacttcgccacccccatgacccccggcgccaagacccagccccccgaggacatcagctgcatcgcctggaacagacaggtgcagcacatcctggccagcgccagccccagcggcagagccaccgtgtgggacctgagaaagaacgagcccatcatcaaggtgagcgaccacagcaacagaatgcactgcagcggcctggcctggcaccccgacgtggccacccagatggtgctggccagcgaggacgacagactgcccgtgatccagatgtgggacctgagattcgccagcagccccctgagagtgctggagaaccacgccagaggcatcctggccatcgcctggagcatggccgaccccgagctgctgctgagctgcggcaaggacgccaagatcctgtgcagcaaccccaacaccggcgaggtgctgtacgagctgcccaccaacacccagtggtgcttcgacatccagtggtgccccagaaaccccgccgtgctgagcgccgccagcttcgacggcagaatcagcgtgtacagcatcatgggcggcagcaccgacggcctgagacagaagcaggtggacaagctgagcagcagcttcggcaacctggaccccttcggcaccggccagcccctgccccccctgcagatcccccagcagaccgcccagcacagcatcgtgctgcccctgaagaagccccccaagtggatcagaagacccgtgggcgccagcttcagcttcggcggcaagctggtgaccttcgagaacgtgagaatgcccagccaccagggcgccgagcagcagcagcagcagcaccacgtgttcatcagccaggtggtgaccgagaaggagttcctgagcagaagcgaccagctgcagcaggccgtgcagagccagggcttcatcaactactgccagaagaagatcgacgccagccagaccgagttcgagaagaacgtgtggagcttcctgaaggtgaacttcgaggacgacagcagaggcaagtacctggagctgctgggctacagaaaggaggacctgggcaagaagatcgccctggccctgaacaaggtggacggcgccaacgtggccctgaaggacagcgaccaggtggcccagagcgacggcgaggagagccccgccgccgaggagcagctgctgggcgagcacatcaaggaggagaaggaggagagcgagttcctgcccagcagcggcggcaccttcaacatcagcgtgagcggcgacatcgacggcctgatcacccaggccctgctgaccggcaacttcgagagcgccgtggacctgtgcctgcacgacaacagaatggccgacgccatcatcctggccatcgccggcggccaggagctgctggccagaacccagaagaagtacttcgccaagagccagagcaagatcaccagactgatcaccgccgtggtgatgaagaactggaaggagatcgtggagagctgcgacctgaagaactggagagaggccctggccgccgtgctgacctacgccaagcccgacgagttcagcgccctgtgcgacctgctgggcaccagactggagaacgagggcgacagcctgctgcagacccaggcctgcctgtgctacatctgcgccggcaacgtggagaagctggtggcctgctggaccaaggcccaggacggcagccaccccctgagcctgcaggacctgatcgagaaggtggtgatcctgagaaaggccgtgcagctgacccaggccatggacaccagcaccgtgggcgtgctgctggccgccaagatgagccagtacgccaacctgctggccgcccagggcagcatcgccgccgccctggccttcctgcccgacaacaccaaccagcccaacatcatgcagctgagagacagactgtgcagagcccagggcgagcccgtggccggccacgagagccccaagatcccctacgagaagcagcagctgcccaagggcagacccggccccgtggccggccaccaccagatgcccagagtgcagacccagcagtactacccccacggcgagaacccccccccccccggcttcatcatgcacggcaacgtgaaccccaacgccgccggccagctgcccaccagccccggccacatgcacacccaggtgcccccctacccccagccccagccctaccagcccgcccagccctaccccttcggcaccggcggcagcgccatgtacagaccccagcagcccgtggccccccccaccagcaacgcctaccccaacaccccctacatcagcagcgccagcagctacaccggccagagccagctgtacgccgcccagcaccaggccagcagccccaccagcagccccgccaccagcttcccccccccccccagcagcggcgccagcttccagcacggcggccccggcgccccccccagcagcagcgcctacgccctgccccccggcaccaccggcccccagaacggctggaacgacccccccgccctgaacagagtgcccaagaagaagaagatgcccgagaacttcatgccccccgtgcccatcaccagccccatcatgaaccccctgggcgacccccagagccagatgctgcagcagcagcccagcgcccccgtgcccctgagcagccagagcagcttcccccagccccacctgcccggcggccagcccttccacggcgtgcagcagcccctgggccagaccggcatgccccccagcttcagcaagcccaacatcgagggcgcccccggcgcccccatcggcaacaccttccagcacgtgcagagcctgcccaccaagaagatcaccaagaagcccatccccgacgagcacctgatcctgaagaccaccttcgaggacctgatccagagatgcctgagcagcgccaccgacccccagaccaagagaaagctggacgacgccagcaagagactggagttcctgtacgacaagctgagagagcagaccctgagccccaccatcaccagcggcctgcacaacatcgccagaagcatcgagaccagaaactacagcgagggcctgaccatgcacacccacatcgtgagcaccagcaacttcagcgagaccagcgccttcatgcccgtgctgaaggtggtgctgacccaggccaacaagctgggcgtgtag

SEQ ID NO: 21831 - DNA, 3321 bp, Artificial Sequence; identical to SEQ ID NO: 21818
  Description of Artificial Sequence: Synthetic coding sequence

SEQ ID NO: 21832 - DNA, 498 bp, Artificial Sequence
  Description of Artificial Sequence: Synthetic coding sequence
atgaagctgaaggaggtggacagaaccgccatgcaggcctggagccccgcccagaaccaccccatctacctggccaccggcaccagcgcccagcagctggacgccaccttcagcaccaacgccagcctggagatcttcgagctggacctgagcgaccccagcctggacatgaagagctgcgccaccttcagcagcagccacagataccacaagctgatctggggcccctacaagatggacagcaagggcgacgtgagcggcgtgctgatcgccggcggcgagaacggcaacatcatcctgtacgaccccagcaagatcatcgccggcgacaaggaggtggtgatcgcccagaacgacaagcacaccggccccgtgagagccctggacgtgaacatcttccagaccaacctggtggccagcggcgccaacgagagcgagatctacatctgggacctgaacaacttcgccacccccatgacccccggcgccaagacctag

SEQ ID NO: 21833 - DNA, 501 bp, Artificial Sequence
  Description of Artificial Sequence: Synthetic coding sequence
atgaagctgaaggaggtggacagaaccgccatgcaggcctggagccccgcccagaaccaccccatctacctggccaccggcaccagcgcccagcagctggacgccaccttcagcaccaacgccagcctggagatcttcgagctggacctgagcgaccccagcctggacatgaagagctgcgccaccttcagcagcagccacagataccacaagctgatctggggcccctacaagatggacagcaagggcgacgtgagcggcgtgctgatcgccggcggcgagaacggcaacatcatcctgtacgaccccagcaagatcatcgccggcgacaaggaggtggtgatcgcccagaacgacaagcacaccggccccgtgagagccctggacgtgaacatcttccagaccaacctggtggccagcggcgccaacgagagcgagatctacatctgggacctgaacaacttcgccacccccatgacccccggcgccaagacccagtag

SEQ ID NO: 21834 - DNA, 3603 bp, Artificial Sequence
  Description of Artificial Sequence: Synthetic coding sequence
atgctgggcgagagcgacgagagatgcaccaacgccggcagcggctgcagaagaagcagccccggcaccagcgcccagcagctggacgccaccttcagcaccaacgccagcctggagatcttcgagctggacctgagcgaccccagcctggacatgaagagctgcgccaccttcagcagcagccacagataccacaagctgatctggggcccctacaagatggacagcaagggcgacgtgagcggcgtgctgatcgccggcggcgagaacggcaacatcatcctgtacgaccccagcaagatcatcgccggcgacaaggaggtggtgatcgcccagaacgacaagcacaccggccccgtgagagccctggacgtgaacatcttccagaccaacctggtggccagcggcgccaacgagagcgagatctacatctgggacctgaacaacttcgccacccccatgacccccggcgccaagacccagccccccgaggacatcagctgcatcgcctggaacagacaggtgcagcacatcctggccagcgccagccccagcggcagagccaccgtgtgggacctgagaaagaacgagcccatcatcaaggtgagcgaccacagcaacagaatgcactgcagcggcctggcctggcaccccgacgtggccacccagatggtgctggccagcgaggacgacagactgcccgtgatccagatgtgggacctgagattcgccagcagccccctgagagtgctggagaaccacgccagaggcatcctggccatcgcctggagcatggccgaccccgagctgctgctgagctgcggcaaggacgccaagatcctgtgcagcaaccccaacaccggcgaggtgctgtacgagctgcccaccaacacccagtggtgcttcgacatccagtggtgccccagaaaccccgccgtgctgagcgccgccagcttcgacggcagaatcagcgtgtacagcatcatgggcggcagcaccgacggcctgagacagaagcaggtggacaagctgagcagcagcttcggcaacctggaccccttcggcaccggccagcccctgccccccctgcagatcccccagcagaccgcccagcacagcatcgtgctgcccctgaagaagccccccaagtggatcagaagacccgtgggcgccagcttcagcttcggcggcaagctggtgaccttcgagaacgtgagaatgcccagccaccagggcgccgagcagcagcagcagcagcaccacgtgttcatcagccaggtggtgaccgagaaggagttcctgagcagaagcgaccagctgcagcaggccgtgcagagccagggcttcatcaactactgccagaagaagatcgacgccagccagaccgagttcgagaagaacgtgtggagcttcctgaaggtgaacttcgaggacgacagcagaggcaagtacctggagctgctgggctacagaaaggaggacctgggcaagaagatcgccctggccctgaacaaggtggacggcgccaacgtggccctgaaggacagcgaccaggtggcccagagcgacggcgaggagagccccgccgccgaggagcagctgctgggcgagcacatcaaggaggagaaggaggagagcgagttcctgcccagcagcggcggcaccttcaacatcagcgtgagcggcgacatcgacggcctgatcacccaggccctgctgaccggcaacttcgagagcgccgtggacctgtgcctgcacgacaacagaatggccgacgccatcatcctggccatcgccggcggccaggagctgctggccagaacccagaagaagtacttcgccaagagccagagcaagatcaccagactgatcaccgccgtggtgatgaagaactggaaggagatcgtggagagctgcgacctgaagaactggagagaggccctggccgccgtgctgacctacgccaagcccgacgagttcagcgccctgtgcgacctgctgggcaccagactggagaacgagggcgacagcctgctgcagacccaggcctgcctgtgctacatctgcgccggcaacgtggagaagctggtggcctgctggaccaaggcccaggacggcagccaccccctgagcctgcaggacctgatcgagaaggtggtgatcctgagaaaggccgtgcagctgacccaggccatggacaccagcaccgtgggcgtgctgctggccgccaagatgagccagtacgccaacctgctggccgcccagggcagcatcgccgccgccctggccttcctgcccgacaacaccaaccagcccaacatcatgcagctgagagacagactgtgcagagcccagggcgagcccgtggccggccacgagagccccaagatcccctacgagaagcagcagctgcccaagggcagacccggccccgtggccggccaccaccagatgcccagagtgcagacccagcagtactacccccacggcgagaacccccccccccccggcttcatcatgcacggcaacgtgaaccccaacgccgccggccagctgcccaccagccccggccacatgcacacccaggtgcccccctacccccagccccagccctaccagcccgcccagccctaccccttcggcaccggcggcagcgccatgtacagaccccagcagcccgtggccccccccaccagcaacgcctaccccaacaccccctacatcagcagcgccagcagctacaccggccagagccagctgtacgccgcccagcaccaggccagcagccccaccagcagccccgccaccagcttcccccccccccccagcagcggcgccagcttccagcacggcggccccggcgccccccccagcagcagcgcctacgccctgccccccggcaccaccggcccccagaacggctggaacgacccccccgccctgaacagagtgcccaagaagaagaagatgcccgagaacttcatgccccccgtgcccatcaccagccccatcatgaaccccctgggcgacccccagagccagatgctgcagcagcagcccagcgcccccgtgcccctgagcagccagagcagcttcccccagccccacctgcccggcggccagcccttccacggcgtgcagcagcccctgggccagaccggcatgccccccagcttcagcaagcccaacatcgagggcgcccccggcgcccccatcggcaacaccttccagcacgtgcagagcctgcccaccaagaagatcaccaagaagcccatccccgacgagcacctgatcctgaagaccaccttcgaggacctgatccagagatgcctgagcagcgccaccgacccccagaccaagagaaagctggacgacgccagcaagagactggagttcctgtacgacaagctgagagagcagaccctgagccccaccatcaccagcggcctgcacaacatcgccagaagcatcgagaccagaaactacagcgagggcctgaccatgcacacccacatcgtgagcaccagcaacttcagcgagaccagcgccttcatgcccgtgctgaaggtggtgctgacccaggccaacaagctgggcgtgtag

SEQ ID NO: 21835 - DNA, 1431 bp, Artificial Sequence
  Description of Artificial Sequence: Synthetic coding sequence
atggccatcaagttcctggaggtgatcaagcccttctgcgtgatcctgcccgagatccagaagcccgagagaaagatccagttcaaggagaaggtgctgtggaccgccatcaccctgttcatcttcctggtgtgctgccagatccccctgttcggcatcatgagcagcgacagcgccgaccccttctactggatgagagtgatcctggccagcaacagaggcaccctgatggagctgggcatcagccccatcgtgaccagcggcctgatcatgcagctgctggccggcgccaagatcatcgaggtgggcgacacccccaaggacagagccctgttcaacggcgcccagaagctgttcggcatgatcatcaccatcggccagagcatcgtgtacgtgatgaccggcatgtacggcgaccccagcgagatgggcgccggcatctgcctgctgatcaccatccagctgttcgtggccggcctgatcgtgctgctgctggacgagctgctgcagaagggctacggcctgggcagcggcatcagcctgttcatcgccaccaacatctgcgagaccatcgtgtggaaggccttcagccccaccaccgtgaacaccggcagaggcatggagttcgagggcgccatcatcgccctgttccacctgctggccaccagaaccgacaaggtgagagccctgagagaggccttctacagacagaacctgcccaacctgatgaacctgatcgccaccatcttcgtgttcgccgtggtgatctacttccagggcttcagagtggacctgcccatcaagagcgccagatacagaggccagtacaacacctaccccatcaagctgttctacaccagcaacatccccatcatcctgcagagcgccctggtgagcaacctgtacgtgatcagccagatgctgagcgccagattcagcggcaacctgctggtgagcctgctgggcacctggagcgacaccagcagcggcggccccgccagagcctaccccgtgggcggcctgtgctactacctgagcccccccgagagcttcggcagcgtgctggaggaccccgtgcacgccgtggtgtacatcgtgttcatgctgggcagctgcgccttcttcagcaagacctggatcgaggtgagcggcagcagcgccaaggacgtggccaagcagctgaaggagcagcagatggtgatgagaggccacagagagaccagcatggtgcacgagctgaacagatacatccccaccgccgccgccttcggcggcctgtgcatcggcgccctgagcgtgctggccgacttcctgggcgccatcggcagcggcaccggcatcctgctggccgtgaccatcatctaccagtacttcgagatcttcgtgaaggagcagagcgaggtgggcagcatgggcgccctgctgttctag

SEQ ID NO: 21836 - DNA, 1071 bp, Artificial Sequence
  Description of Artificial Sequence: Synthetic coding sequence
atgatcatcaccatcggccagagcatcgtgtacgtgatgaccggcatgtacggcgaccccagcgagatgggcgccggcatctgcctgctgatcaccatccagctgttcgtggccggcctgatcgtgctgctgctggacgagctgctgcagaagggctacggcctgggcagcggcatcagcctgttcatcgccaccaacatctgcgagaccatcgtgtggaaggccttcagccccaccaccgtgaacaccggcagaggcatggagttcgagggcgccatcatcgccctgttccacctgctggccaccagaaccgacaaggtgagagccctgagagaggccttctacagacagaacctgcccaacctgatgaacctgatcgccaccatcttcgtgttcgccgtggtgatctacttccagggcttcagagtggacctgcccatcaagagcgccagatacagaggccagtacaacacctaccccatcaagctgttctacaccagcaacatccccatcatcctgcagagcgccctggtgagcaacctgtacgtgatcagccagatgctgagcgccagattcagcggcaacctgctggtgagcctgctgggcacctggagcgacaccagcagcggcggccccgccagagcctaccccgtgggcggcctgtgctactacctgagcccccccgagagcttcggcagcgtgctggaggaccccgtgcacgccgtggtgtacatcgtgttcatgctgggcagctgcgccttcttcagcaagacctggatcgaggtgagcggcagcagcgccaaggacgtggccaagcagctgaaggagcagcagatggtgatgagaggccacagagagaccagcatggtgcacgagctgaacagatacatccccaccgccgccgccttcggcggcctgtgcatcggcgccctgagcgtgctggccgacttcctgggcgccatcggcagcggcaccggcatcctgctggccgtgaccatcatctaccagtacttcgagatcttcgtgaaggagcagagcgaggtgggcagcatgggcgccctgctgttctag

SEQ ID NO: 21837 - DNA, 1449 bp, Artificial Sequence
  Description of Artificial Sequence: Synthetic coding sequence
atgacccagaccgccagagtgctggtgaagttcctggaggtgatcaagcccttctgcgtgatcctgcccgagatccagaagcccgagagaaagatccagttcaaggagaaggtgctgtggaccgccatcaccctgttcatcttcctggtgtgctgccagatccccctgttcggcatcatgagcagcgacagcgccgaccccttctactggatgagagtgatcctggccagcaacagaggcaccctgatggagctgggcatcagccccatcgtgaccagcggcctgatcatgcagctgctggccggcgccaagatcatcgaggtgggcgacacccccaaggacagagccctgttcaacggcgcccagaagctgttcggcatgatcatcaccatcggccagagcatcgtgtacgtgatgaccggcatgtacggcgaccccagcgagatgggcgccggcatctgcctgctgatcaccatccagctgttcgtggccggcctgatcgtgctgctgctggacgagctgctgcagaagggctacggcctgggcagcggcatcagcctgttcatcgccaccaacatctgcgagaccatcgtgtggaaggccttcagccccaccaccgtgaacaccggcagaggcatggagttcgagggcgccatcatcgccctgttccacctgctggccaccagaaccgacaaggtgagagccctgagagaggccttctacagacagaacctgcccaacctgatgaacctgatcgccaccatcttcgtgttcgccgtggtgatctacttccagggcttcagagtggacctgcccatcaagagcgccagatacagaggccagtacaacacctaccccatcaagctgttctacaccagcaacatccccatcatcctgcagagcgccctggtgagcaacctgtacgtgatcagccagatgctgagcgccagattcagcggcaacctgctggtgagcctgctgggcacctggagcgacaccagcagcggcggccccgccagagcctaccccgtgggcggcctgtgctactacctgagcccccccgagagcttcggcagcgtgctggaggaccccgtgcacgccgtggtgtacatcgtgttcatgctgggcagctgcgccttcttcagcaagacctggatcgaggtgagcggcagcagcgccaaggacgtggccaagcagctgaaggagcagcagatggtgatgagaggccacagagagaccagcatggtgcacgagctgaacagatacatccccaccgccgccgccttcggcggcctgtgcatcggcgccctgagcgtgctggccgacttcctgggcgccatcggcagcggcaccggcatcctgctggccgtgaccatcatctaccagtacttcgagatcttcgtgaaggagcagagcgaggtgggcagcatgggcgccctgctgttctag

SEQ ID NO: 21838 - DNA, 1431 bp, Artificial Sequence
  Description of Artificial Sequence: Synthetic coding sequence
atgggcatcaagttcctggaggtgatcaagcccttctgcgccgtgctgcccgagatccagaagcccgagagaaagatccagttcagagagaaggtgctgtggaccgccatcaccctgttcatcttcctggtgtgctgccagatccccctgttcggcatcatgagcagcgacagcgccgaccccttctactggatgagagtgatcctggccagcaacagaggcaccctgatggagctgggcatcagccccatcgtgaccagcggcctgatcatgcagctgctggccggcgccaagatcatcgaggtgggcgacacccccaaggacagagccctgttcaacggcgcccagaagctgttcggcatgatcatcaccatcggccaggccatcgtgtacgtgatgaccggcatgtacggcgaccccgccgagatgggcgccggcatctgcctgctgatcatcatccagctgttcgtggccggcctgatcgtgctgctgctggacgagctgctgcagaagggctacggcctgggcagcggcatcagcctgttcatcgccaccaacatctgcgagaccatcgtgtggaaggccttcagccccaccaccatcaacaccggcagaggcaccgagttcgagggcgccgtgatcgccctgttccacctgctggccaccagaaccgacaaggtgagagccctgagagaggccttctacagacagaacctgcccaacctgatgaacctgatcgccaccgtgttcgtgttcgccgtggtgatctacttccagggcttcagagtggacctgcccatcaagagcgccagatacagaggccagtacagcagctaccccatcaagctgttctacaccagcaacatccccatcatcctgcagagcgccctggtgagcaacctgtacgtgatcagccagatgctgagcgtgagattcagcggcaacttcctggtgaacctgctgggccagtgggccgacgtgagcggcggcggccccgccagaagctaccccgtgggcggcctgtgctactacctgagcccccccgagagcatgggcgccatcttcgaggaccccgtgcacgtggtggtgtacatcatcttcatgctgggcagctgcgccttcttcagcaagacctggatcgaggtgagcggcagcagcgccaaggacgtggccaagcagctgaaggagcagcagatggtgatgagaggccacagagacaccagcatggtgcacgagctgaacagatacatccccaccgccgccgccttcggcggcctgtgcatcggcgccctgagcgtgctggccgacttcctgggcgccatcggcagcggcaccggcatcctgctggccgtgaccatcatctaccagtacttcgagatcttcgtgaaggagcaggccgaggtgggcggcatgggcgccctgttcttctag

SEQ ID NO: 21839 - DNA, 1314 bp, Artificial Sequence
  Description of Artificial Sequence: Synthetic coding sequence
atgggcatcaagttcctggaggtgatcaagcccttctgcgccgtgctgcccgagatccagaagcccgagagaaagatccagttcagagagaaggtgctgtggaccgccatcaccctgttcatcttcctggtgtgctgccagatccccctgttcggcatcatgagcagcgacagcgccgaccccttctactggatgagagtgatcctggccagcaacagaggcaccctgatggagctgggcatcagccccatcgtgaccagcggcctgatcatgcagctgctggccggcgccaagatcatcgaggtgggcgacacccccaaggacagagccctgttcaacggcgcccagaagctgttcggcatgatcatcaccatcggccaggccatcgtgtacgtgatgaccggcatgtacggcgaccccgccgagatgggcgccggcatctgcctgctgatcatcatccagctgttcgtggccggcctgatcgtgctgctgctggacgagctgctgcagaagggctacggcctgggcagcggcatcagcctgttcatcgccaccaacatctgcgagaccatcgtgtggaaggccttcagccccaccaccatcaacaccggcagaggcaccgagttcgagggcgccgtgatcgccctgttccacctgctggccaccagaaccgacaaggtgagagccctgagagaggccttctacagacagaacctgcccaacctgatgaacctgatcgccaccgtgttcgtgttcgccgtggtgatctacttccagggcttcagagtggacctgcccatcaagagcgccagatacagaggccagtacagcagctaccccatcaagctgttctacaccagcaacatccccatcatcctgcagagcgccctggtgagcaacctgtacgtgatcagccagatgctgagcgtgagattcagcggcaacttcctggtgaacctgctgggccagtgggccgacgtgagcggcggcggccccgccagaagctaccccgtgggcggcctgtgctactacctgagcccccccgagagcatgggcgccatcttcgaggaccccgtgcacgtggtggtgtacatcatcttcatgctgggcagctgcgccttcttcagcaagacctggatcgaggtgagcggcagcagcgccaaggacgtggccaagcagctgaaggagcagcagatggtgatgagaggccacagagacaccagcatggtgcacgagctgaacagacccaaggtgaagctgagaagatggaagggcgagggcagacacttcaccaagagaatcctgttctactag

SEQ ID NO: 21840 - DNA, 507 bp, Artificial Sequence
  Description of Artificial Sequence: Synthetic coding sequence
atgggcatcaagttcctggaggtgatcaagcccttctgcgccgtgctgcccgagatccagaagcccgagagaaagatccagttcagagagaaggtgctgtggaccgccatcaccctgttcatcttcctggtgtgctgccagatccccctgttcggcatcatgagcagcgacagcgccgaccccttctactggatgagagtgatcctggccagcaacagaggcaccctgatggagctgggcatcagccccatcgtgaccagcggcctgatcatgcagctgctggccggcgccaagatcatcgaggtgggcgacacccccaaggacagagccctgttcaacggcgcccagaagctgttcggcatgatcatcaccatcggccaggccatcgtgtacgtgatgaccggcatgtacggcgaccccgccgagatgggcgccggcatctgcctgctgatcatcatccaggccctgctgaccctgaagatctgcggctacaccgaggagctgtag

SEQ ID NO: 21841 - DNA, 1233 bp, Artificial Sequence
  Description of Artificial Sequence: Synthetic coding sequence
atgggcatcaagttcctggaggtgatcaagcccttctgcgccgtgctgcccgagatccagaagcccgagagaaagatccagttcagagagaaggtgctgtggaccgccatcaccctgttcatcttcctggtgtgctgccagatccccctgttcggcatcatgagcagcgacagcgccgaccccttctactggatgagagtgatcctggccagcaacagaggcaccctgatggagctgggcatcagccccatcgtgaccagcggcctgatcatgcagctgctggccggcgccaagatcatcgaggtgggcgacacccccaaggacagagccctgttcaacggcgcccagaagctgttcggcatgatcatcaccatcggccaggccatcgtgtacgtgatgaccggcatgtacggcgaccccgccgagatgggcgccggcatctgcctgctgatcatcatccagctgttcgtggccggcctgatcgtgctgctgctggacgagctgctgcagaagggctacggcctgggcagcggcatcagcctgttcatcgccaccaacatctgcgagaccatcgtgtggaaggccttcagccccaccaccatcaacaccggcagaggcaccgagttcgagggcgccgtgatcgccctgttccacctgctggccaccagaaccgacaaggtgagagccctgagagaggccttctacagacagaacctgcccaacctgatgaacctgatcgccaccgtgttcgtgttcgccgtggtgatctacttccaggacgtgagcggcggcggccccgccagaagctaccccgtgggcggcctgtgctactacctgagcccccccgagagcatgggcgccatcttcgaggaccccgtgcacgtggtggtgtacatcatcttcatgctgggcagctgcgccttcttcagcaagacctggatcgaggtgagcggcagcagcgccaaggacgtggccaagcagctgaaggagcagcagatggtgatgagaggccacagagacaccagcatggtgcacgagctgaacagatacatccccaccgccgccgccttcggcggcctgtgcatcggcgccctgagcgtgctggccgacttcctgggcgccatcggcagcggcaccggcatcctgctggccgtgaccatcatctaccagtacttcgagatcttcgtgaaggagcaggccgaggtgggcggcatgggcgccctgttcttctag

SEQ ID NO: 21842 - DNA, 1365 bp, Artificial Sequence
  Description of Artificial Sequence: Synthetic coding sequence
atgggcatcaagttcctggaggtgatcaagcccttctgcgccgtgctgcccgagatccagaagcccgagagaaagatccccctgttcggcatcatgagcagcgacagcgccgaccccttctactggatgagagtgatcctggccagcaacagaggcaccctgatggagctgggcatcagccccatcgtgaccagcggcctgatcatgcagctgctggccggcgccaagatcatcgaggtgggcgacacccccaaggacagagccctgttcaacggcgcccagaagctgttcggcatgatcatcaccatcggccaggccatcgtgtacgtgatgaccggcatgtacggcgaccccgccgagatgggcgccggcatctgcctgctgatcatcatccagctgttcgtggccggcctgatcgtgctgctgctggacgagctgctgcagaagggctacggcctgggcagcggcatcagcctgttcatcgccaccaacatctgcgagaccatcgtgtggaaggccttcagccccaccaccatcaacaccggcagaggcaccgagttcgagggcgccgtgatcgccctgttccacctgctggccaccagaaccgacaaggtgagagccctgagagaggccttctacagacagaacctgcccaacctgatgaacctgatcgccaccgtgttcgtgttcgccgtggtgatctacttccagggcttcagagtggacctgcccatcaagagcgccagatacagaggccagtacagcagctaccccatcaagctgttctacaccagcaacatccccatcatcctgcagagcgccctggtgagcaacctgtacgtgatcagccagatgctgagcgtgagattcagcggcaacttcctggtgaacctgctgggccagtgggccgacgtgagcggcggcggccccgccagaagctaccccgtgggcggcctgtgctactacctgagcccccccgagagcatgggcgccatcttcgaggaccccgtgcacgtggtggtgtacatcatcttcatgctgggcagctgcgccttcttcagcaagacctggatcgaggtgagcggcagcagcgccaaggacgtggccaagcagctgaaggagcagcagatggtgatgagaggccacagagacaccagcatggtgcacgagctgaacagatacatccccaccgccgccgccttcggcggcctgtgcatcggcgccctgagcgtgctggccgacttcctgggcgccatcggcagcggcaccggcatcctgctggccgtgaccatcatctaccagtacttcgagatcttcgtgaaggagcaggccgaggtgggcggcatgggcgccctgttcttctag

SEQ ID NO: 21843 - DNA, 480 bp, Artificial Sequence
  Description of Artificial Sequence: Synthetic coding sequence
atgggcatcaagttcctggaggtgatcaagcccttctgcgccgtgctgcccgagatccagaagcccgagagaaagatccagttcagagagaaggtgctgtggaccgccatcaccctgttcatcttcctggtgtgctgccagatccccctgttcggcatcatgagcagcgacagcgccgaccccttctactggatgagagtgatcctggccagcaacagaggcaccctgatggagctgggcatcagccccatcgtgaccagcggcctgatcatgcagctgctggccggcgccaagatcatcgaggtgggcgacacccccaaggacagagccctgttcaacggcgcccagaagctgttcggcatgatcatcaccatcggccaggccatcgtgtacgtgatgaccggcatgtacggcgaccccgccgagatgggcgccggcatctgcctgctgatcatcatccaggaccagcacagcccctag

SEQ ID NO: 21844 - DNA, 438 bp, Artificial Sequence
  Description of Artificial Sequence: Synthetic coding sequence
tgaagcgacagcgccgaccccttctactggatgagagtgatcctggccagcaacagaggcaccctgatggagctgggcatcagccccatcgtgaccagcggcctgatcatgcagctgctggccggcgccaagatcatcgaggtgggcgacacccccaaggacagagccctgttcaacggcgcccagaagctgttcggcatgatcatcaccatcggccaggccatcgtgtacgtgatgaccggcatgtacggcgaccccgccgagatgggcgccggcatctgcctgctgatcatcatccagggcttcagagtggacctgcccatcaagagcgccagatacagaggccagtacagcagctaccccatcaagctgttctacaccagcaacatccccatcatcctgcagagcgccctggtgagcaacctgtacgtgatctag

SEQ ID NO: 21845 - DNA, 687 bp, Artificial Sequence
  Description of Artificial Sequence: Synthetic coding sequence
tgaggcatgatcatcaccatcggccaggccatcgtgtacgtgatgaccggcatgtacggcgaccccgccgagatgggcgccggcatctgcctgctgatcatcatccagctgttcgtggccggcctgatcgtgctgctgctggacgagctgctgcagaagggctacggcctgggcagcggcatcagcctgttcatcgccaccaacatctgcgagaccatcgtgtggaaggccttcagccccaccaccatcaacaccggcagaggcaccgagttcgagggcgccgtgatcgccctgttccacctgctggccaccagaaccgacaaggtgagagccctgagagaggccttctacagacagaacctgcccaacctgatgaacctgatcgccaccgtgttcgtgttcgccgtggtgatctacttccaggtggccaagcagctgaaggagcagcagatggtgatgagaggccacagagacaccagcatggtgcacgagctgaacagatacatccccaccgccgccgccttcggcggcctgtgcatcggcgccctgagcgtgctggccgacttcctgggcgccatcggcagcggcaccggcatcctgctggccgtgaccatcatctaccagtacttcgagatcttcgtgaaggagcaggccgaggtgggcggcatgggcgccctgttcttctag

SEQ ID NO: 21846 - DNA, 633 bp, Artificial Sequence
  Description of Artificial Sequence: Synthetic coding sequence
aagtacaacctgttcaccaagggcttcagagtggacctgcccatcaagagcgccagatacagaggccagtacagcagctaccccatcaagctgttctacaccagcaacatccccatcatcctgcagagcgccctggtgagcaacctgtacgtgatcagccagatgctgagcgtgagattcagcggcaacttcctggtgaacctgctgggccagtgggccgacgtgagcggcggcggccccgccagaagctaccccgtgggcggcctgtgctactacctgagcccccccgagagcatgggcgccatcttcgaggaccccgtgcacgtggtggtgtacatcatcttcatgctgggcagctgcgccttcttcagcaagacctggatcgaggtgagcggcagcagcgccaaggacgtggccaagcagctgaaggagcagcagatggtgatgagaggccacagagacaccagcatggtgcacgagctgaacagatacatccccaccgccgccgccttcggcggcctgtgcatcggcgccctgagcgtgctggccgacttcctgggcgccatcggcagcggcaccggcatcctgctggccgtgaccatcatctaccagtacttcgagatcttcgtgtag

SEQ ID NO: 21847 - DNA, 570 bp, Artificial Sequence
  Description of Artificial Sequence: Synthetic coding sequence
atgggcatcaagttcctggaggtgatcaagcccttctgcgccgtgctgcccgagatccagaagcccgagagaaagatccagttcagagagaaggtgctgtggaccgccatcaccctgttcatcttcctggtgtgctgccagatccccctgttcggcatcatgagcagcgacagcgccgaccccttctactggatgagagtgatcctggccagcaacagaggcaccctgatggagctgggcatcagccccatcgtgaccagcggcctgatcatgcagctgctggccggcgccaagatcatcgaggtgggcgacacccccaaggacagagccctgttcaacggcgcccagaagagaaccgagttcgagggcgccgtgatcgccctgttccacctgctggccaccagaaccgacaaggtgagagccctgagagaggccttctacagacagaacctgcccaacctgatgaacctgatcgccaccgtgttcgtgttcgccgtggtgatctacttccagggcttcagagtggacctgcccatcaagagcgccagatacagaggccagtacagctag

SEQ ID NO: 21848 - DNA, 285 bp, Artificial Sequence
  Description of Artificial Sequence: Synthetic coding sequence
tgattcagagagaaggtgctgtggaccgccatcaccctgttcatcttcctggtgtgctgccagatccccctgttcggcatcatgagcagcgacagcgccgaccccttctactggatgagagtgatcctggccagcaacagaggcaccctgatggagctgggcatcagccccatcgtgaccagcggcctgatcatgcagctgctggccggcgccaagatcatcgaggtgggcgacacccccaaggacagagccctgttcaacggcgcccagaagagagagcactag

SEQ ID NO: 21849 - DNA, 1257 bp, Artificial Sequence
  Description of Artificial Sequence: Synthetic coding sequence
atgggcatcaagttcctggaggtgatcaagcccttctgcgccgtgctgcccgagatccagaagcccgagagaaagatccagttcagagagaaggtgctgtggaccgccatcaccctgttcatcttcctggtgtgctgccagatccccctgttcggcatcatgagcagcgacagcgccgaccccttctactggatgagagtgatcctggccagcaacagaggcaccctgatggagctgggcatcagccccatcgtgaccagcggcctgatcatgcagctgctggccggcgccaagatcatcgaggtgggcgacacccccaaggacagagccctgttcaacggcgcccagaagctgttcggcatgatcatcaccatcggccaggccatcgtgtacgtgatgaccggcatgtacggcgaccccgccgagatgggcgccggcatctgcctgctgatcatcatccagctgttcgtggccggcctgatcgtgctgctgctggacgagctgctgcagaagggctacggcctgggcagcggcatcagcctgttcatcgccaccaacatctgcgagaccatcgtgtggaaggccttcagccccaccaccatcaacaccggcagaggcaccgagttcgagggcgccgtgatcgccctgttccacctgctggccaccagaaccgacaaggtgagagccctgagagaggccttctacagacagaacctgcccaacctgatgaacctgatcgccaccgtgttcgtgttcgccgtggtgatctacttccagggcttcagagtggacctgcccatcaagagcgccagatacagaggccagtacagcagctaccccatcaagctgttctacaccagcaacatccccatcatcctgcagagcgccctggtgagcaacctgtacgtgatcagccagatgctgagcgtgagattcagcggcaacttcctggtgaacctgctgggccagtgggccgacgtgagcggcggcggccccgccagaagctaccccgtgggcggcctgtgctactacctgagcccccccgagagcatgggcgccatcttcgaggaccccgtgcacgtggtggtgtacatcatcttcatgctgggcagctgcgccttcttcagcaagacctggatcgaggtgagcggcagcagcgccaaggacgtggccaagcagctgaaggagcagcagatggtgatgagaggccacagagacaccagcatggtgcacgagctgaacagcgccagagcctag

SEQ ID NO: 21850 - DNA, 975 bp, Artificial Sequence
  Description of Artificial Sequence: Synthetic coding sequence
atgctgaagagctgcagcagagccagcttcagccccagcgtgagaaagccccccctgatcctgagaagactgctgagcgaggacgtgggcatggacatccccttcgaggagggcgtgctgagccccagcgccgccgacatgagacccgagccccccaacagcctggacctgaacgacacccaccccagaagaatcaagctgaccgcccccaacatcaacctgagcctggaccagagcgagggcagcatcctgagcgacgacaacctggacagccccgacgagatcgacatcaacgtggacgagctggacacccccgacgaggccgacagcttcgagtacaccggccacgaggaccccaccgccaacaaggacagcggccaggagagcgagagcatccccgagtacaccgccgaggaggagagagaggacaacagactgtggagaaccgtggtgatcggcgagcaggagcagagaatcgacatgaaggtgatcgagccctacagaagagtgatcagccacggcggctactacggcgacggcctgaacgccatcatcgtgttcgccgcctgcttcctgcccgacagcagcagagccgactaccactacgtgatggagaacctgttcctgtacgtgatcagcaccctggagctgatggtggccgaggactacatgatcgtgtacctgaacggcgccacccccagaagaagaatgcccggcctgggctggatgaagaagtgctaccagatgatcgacagaagactgagaaagaacctgaagagcttcatcatcgtgcaccccagctggttcatcagaaccatcctggccgtgaccagacccttcatcagcagcaagttcagcagcaagatcaagtacgtgaacagcctgagcgagctgagcggcctgatccccatggactgcatccacatccccgagagcatcatcaacatcgacctgaagctgaaggagaagccctag

SEQ ID NO: 21851 - DNA, 207 bp, Artificial Sequence
  Description of Artificial Sequence: Synthetic coding sequence
atggaccaggtgatgcagttcgtggagcccagcagacagttcgtgaaggacagcatcagactggtgaagagatgcaccaagcccgacagaaaggagttccagaagatcgccatggccaccgccatcggcttcgccatcatgggcttcatcggcttcttcgtgaagctgatccacatccccatcaacaacatcatcgtgggcggctag

SEQ ID NO: 21852 - DNA, 207 bp, Artificial Sequence; identical to SEQ ID NO: 21851
  Description of Artificial Sequence: Synthetic coding sequence

SEQ ID NO: 21853 - DNA, 207 bp, Artificial Sequence; identical to SEQ ID NO: 21851
  Description of Artificial Sequence: Synthetic coding sequence

SEQ ID NO: 21854 - DNA, 207 bp, Artificial Sequence; identical to SEQ ID NO: 21851
  Description of Artificial Sequence: Synthetic coding sequence

SEQ ID NO: 21855 - DNA, 2610 bp, Artificial Sequence
  Description of Artificial Sequence: Synthetic coding sequence
atggccgccgtgcccacccagccccagagcaaggagggcccctggagccccgagagcgagagccccatgctgagaatcaccgcccccctgccccccggccccagcatggccgtgcccaccctgggccccggcgagatcgccagcaccaccccccccagcagagcctggacccccacccaggagggccccggcgacatgggcagaccctgggtggccgaggtggtgagccagggcgccggcatcggcatccagggcaccatcaccagcagcaccgccagcggcgacgacgaggagaccaccaccaccaccaccatcatcaccaccaccatcaccaccgtgcagacccccggcccctgcagctggaacttcagcggccccgagggcagcctggacagccccaccgacctgagcagccccaccgacgtgggcctggactgcttcttctacatcagcgtgtaccccggctacggcgtggagatcaaggtgcagaacatcagcctgagagagggcgagaccgtgaccgtggagggcctgggcggccccgaccccctgcccctggccaaccagagcttcctgctgagaggccaggtgatcagaagccccacccaccaggccgccctgagattccagagcctgcccccccccgccggccccggcaccttccacttccactaccaggcctacctgctgagctgccacttccccagaagacccgcctacggcgacgtgaccgtgaccagcctgcaccccggcggcagcgccagattccactgcgccaccggctaccagctgaagggcgccagacacctgacctgcctgaacgccacccagcccttctgggacagcaaggagcccgtgtgcatcgccgcctgcggcggcgtgatcagaaacgccaccaccggcagaatcgtgagccccggcttccccggcaactacagcaacaacctgacctgccactggctgctggaggcccccgagggccagagactgcacctgcacttcgagaaggtgagcctggccgaggacgacgacagactgatcatcagaaacggcgacaacgtggaggccccccccgtgtacgacagctacgaggtggagtacctgcccatcgagggcctgctgagcagcggcaagcacttcttcgtggagctgagcaccgacagcagcggcgccgccgccggcatggccctgagatacgaggccttccagcagggccactgctacgagcccttcgtgaagtacggcaacttcagcagcagcacccccacctaccccgtgggcaccaccgtggagttcagctgcgaccccggctacaccctggagcagggcagcatcatcatcgagtgcgtggacccccacgacccccagtggaacgagaccgagcccgcctgcagagccgtgtgcagcggcgagatcaccgacagcgccggcgtggtgctgagccccaactggcccgagccctacggcagaggccaggactgcatctggggcgtgcacgtggaggaggacaagagaatcatgctggacatcagagtgctgagaatcggccccggcgacgtgctgaccttctacgacggcgacgacctgaccgccagagtgctgggccagtacagcggccccagaagccacttcaagctgttcaccagcatggccgacgtgaccatccagttccagagcgaccccggcaccagcgtgctgggctaccagcagggcttcgtgatccacttcttcgaggtgcccagaaacgacacctgccccgagctgcccgagatccccaacggctggaagagccccagccagcccgagctggtgcacggcaccgtggtgacctaccagtgctaccccggctaccaggtggtgggcagcagcgtgctgatgtgccagtgggacctgacctggagcgaggacctgcccagctgccagagagtgaccagctgccacgaccccggcgacgtggagcacagcagaagactgatcagcagccccaagttccccgtgggcgccaccgtgcagtacatctgcgaccagggcttcgtgctgatgggcagcagcatcctgacctgccacgacagacaggccggcagccccaagtggagcgacagagcccccaagtgcctgctggagcagctgaagccctgccacggcctgagcgcccccgagaacggcgccagaagccccgagaagcagctgcaccccgccggcgccaccatccacttcagctgcgcccccggctacgtgctgaagggccaggccagcatcaagtgcgtgcccggccaccccagccactggagcgaccccccccccatctgcagagccgccagcctggacggcttctacaacagcagaagcctggacgtggccaaggcccccgccgccagcagcaccctggacgccgcccacatcgccgccgccatcttcctgcccctggtggccatggtgctgctggtgggcggcgtgtacttctacttcagcagactgcagggcaagagcagcctgcagctgcccagacccagacccagaccctacaacagaatcaccatcgagagcgccttcgacaaccccacctacgagaccggcagcctgagcttcgccggcgacgagagaatctag

SEQ ID NO: 21856 - DNA, 1527 bp, Artificial Sequence
  Description of Artificial Sequence: Synthetic coding sequence
atgagacccgtggccctgctgctgctgcccagcctgctggccctgctggcccacggcctgagcctggaggcccccaccgtgggcaagggccaggcccccggcatcgaggagaccgacggcgagctgaccgccgcccccacccccgagcagcccgagagaggcgtgcacttcgtgaccaccgcccccaccctgaagctgctgaaccaccaccccctgctggaggagttcctgcaggagggcctggagaagggcgacgaggagctgagacccgccctgcccttccagcccgacccccccgcccccttcacccccagccccctgcccagactggccaaccaggacagcagacccgtgttcaccagccccacccccgccatggccgccgtgcccacccagccccagagcaaggagggcccctggagccccgagagcgagagccccatgctgagaatcaccgcccccctgccccccggccccagcatggccgtgcccaccctgggccccggcgagatcgccagcaccaccccccccagcagagcctggacccccacccaggagggccccggcgacatgggcagaccctgggtggccgaggtggtgagccagggcgccggcatcggcatccagggcaccatcaccagcagcaccgccagcggcgacgacgaggagaccaccaccaccaccaccatcatcaccaccaccatcaccaccgtgcagacccccggcccctgcagctggaacttcagcggccccgagggcagcctggacagccccaccgacctgagcagccccaccgacgtgggcctggactgcttcttctacatcagcgtgtaccccggctacggcgtggagatcaaggtgcagaacatcagcctgagagagggcgagaccgtgaccgtggagggcctgggcggccccgaccccctgcccctggccaaccagagcttcctgctgagaggccaggtgatcagaagccccacccaccaggccgccctgagattccagagcctgcccccccccgccggccccggcaccttccacttccactaccaggcctacctgctgagctgccacttccccagaagacccgcctacggcgacgtgaccgtgaccagcctgcaccccggcggcagcgccagattccactgcgccaccggctaccagctgaagggcgccagacacctgacctgcctgaacgccacccagcccttctgggacagcaaggagcccgtgtgcatcgccgcctgcggcggcgtgatcagaaacgccaccaccggcagaatcgtgagccccggcttccccggcaactacagcaacaacctgacctgccactggctgctggaggcccccgagggccagagactgcacctgcacttcgagaaggtgagcctggccgaggacgacgacagactgatcatcagaaacggcgacaacgtggaggccccccccgtgtacgacagctacgaggtgaccgccccccccccccccccccccctgcagccccactaccacagagtgagcgtgtag

SEQ ID NO: 21857 - DNA, 2985 bp, Artificial Sequence
  Description of Artificial Sequence: Synthetic coding sequence
atgagacccgtggccctgctgctgctgcccagcctgctggccctgctggcccacggcctgagcctggaggcccccaccgtgggcaagggccaggcccccggcatcgaggagaccgacggcgagctgaccgccgcccccacccccgagcagcccgagagaggcgtgcacttcgtgaccaccgcccccaccctgaagctgctgaaccaccaccccctgctggaggagttcctgcaggagggcctggagaagggcgacgaggagctgagacccgccctgcccttccagcccgacccccccgcccccttcacccccagccccctgcccagactggccaaccaggacagcagacccgtgttcaccagccccacccccgccatggccgccgtgcccacccagccccagagcaaggagggcccctggagccccgagagcgagagccccatgctgagaatcaccgcccccctgccccccggccccagcatggccgtgcccaccctgggccccggcgagatcgccagcaccaccccccccagcagagcctggacccccacccaggagggccccggcgacatgggcagaccctgggtggccgaggtggtgagccagggcgccggcatcggcatccagggcaccatcaccagcagcaccgccagcggcgacgacgaggagaccaccaccaccaccaccatcatcaccaccaccatcaccaccgtgcagacccccggcccctgcagctggaacttcagcggccccgagggcagcctggacagccccaccgacctgagcagccccaccgacgtgggcctggactgcttcttctacatcagcgtgtaccccggctacggcgtggagatcaaggtgcagaacatcagcctgagagagggcgagaccgtgaccgtggagggcctgggcggccccgaccccctgcccctggccaaccagagcttcctgctgagaggccaggtgatcagaagccccacccaccaggccgccctgagattccagagcctgcccccccccgccggccccggcaccttccacttccactaccaggcctacctgctgagctgccacttccccagaagacccgcctacggcgacgtgaccgtgaccagcctgcaccccggcggcagcgccagattccactgcgccaccggctaccagctgaagggcgccagacacctgacctgcctgaacgccacccagcccttctgggacagcaaggagcccgtgtgcatcgccgcctgcggcggcgtgatcagaaacgccaccaccggcagaatcgtgagccccggcttccccggcaactacagcaacaacctgacctgccactggctgctggaggcccccgagggccagagactgcacctgcacttcgagaaggtgagcctggccgaggacgacgacagactgatcatcagaaacggcgacaacgtggaggccccccccgtgtacgacagctacgaggtggagtacctgcccatcgagggcctgctgagcagcggcaagcacttcttcgtggagctgagcaccgacagcagcggcgccgccgccggcatggccctgagatacgaggccttccagcagggccactgctacgagcccttcgtgaagtacggcaacttcagcagcagcacccccacctaccccgtgggcaccaccgtggagttcagctgcgaccccggctacaccctggagcagggcagcatcatcatcgagtgcgtggacccccacgacccccagtggaacgagaccgagcccgcctgcagagccgtgtgcagcggcgagatcaccgacagcgccggcgtggtgctgagccccaactggcccgagccctacggcagaggccaggactgcatctggggcgtgcacgtggaggaggacaagagaatcatgctggacatcagagtgctgagaatcggccccggcgacgtgctgaccttctacgacggcgacgacctgaccgccagagtgctgggccagtacagcggccccagaagccacttcaagctgttcaccagcatggccgacgtgaccatccagttccagagcgaccccggcaccagcgtgctgggctaccagcagggcttcgtgatccacttcttcgaggtgcccagaaacgacacctgccccgagctgcccgagatccccaacggctggaagagccccagccagcccgagctggtgcacggcaccgtggtgacctaccagtgctaccccggctaccaggtggtgggcagcagcgtgctgatgtgccagtgggacctgacctggagcgaggacctgcccagctgccagagagtgaccagctgccacgaccccggcgacgtggagcacagcagaagactgatcagcagccccaagttccccgtgggcgccaccgtgcagtacatctgcgaccagggcttcgtgctgatgggcagcagcatcctgacctgccacgacagacaggccggcagccccaagtggagcgacagagcccccaagtgcctgctggagcagctgaagccctgccacggcctgagcgcccccgagaacggcgccagaagccccgagaagcagctgcaccccgccggcgccaccatccacttcagctgcgcccccggctacgtgctgaagggccaggccagcatcaagtgcgtgcccggccaccccagccactggagcgaccccccccccatctgcagagccgccagcctggacggcttctacaacagcagaagcctggacgtggccaaggcccccgccgccagcagcaccctggacgccgcccacatcgccgccgccatcttcctgcccctggtggccatggtgctgctggtgggcggcgtgtacttctacttcagcagactgcagggcaagagcagcctgcagctgcccagacccagacccagaccctacaacagaatcaccatcgagagcgccttcgacaaccccacctacgagaccggcagcctgagcttcgccggcgacgagagaatctag

SEQ ID NO: 21858 - DNA, 2982 bp, Artificial Sequence
  Description of Artificial Sequence: Synthetic coding sequence
atgagacccgtggccctgctgctgctgcccagcctgctggccctgctggcccacggcctgagcctggaggcccccaccgtgggcaagggccaggcccccggcatcgaggagaccgacggcgagctgaccgccgcccccacccccgagcagcccgagagaggcgtgcacttcgtgaccaccgcccccaccctgaagctgctgaaccaccaccccctgctggaggagttcctgcaggagggcctggagaagggcgacgaggagctgagacccgccctgcccttccagcccgacccccccgcccccttcacccccagccccctgcccagactggccaaccaggacagcagacccgtgttcaccagccccacccccgccatggccgccgtgcccacccagccccagagcaaggagggcccctggagccccgagagcgagagccccatgctgagaatcaccgcccccctgccccccggccccagcatggccgtgcccaccctgggccccggcgagatcgccagcaccaccccccccagcagagcctggacccccacccaggagggccccggcgacatgggcagaccctgggtggccgaggtggtgagccagggcgccggcatcggcatccagggcaccatcaccagcagcaccgccagcggcgacgacgaggagaccaccaccaccaccaccatcatcaccaccaccatcaccaccgtgcagacccccggcccctgcagctggaacttcagcggccccgagggcagcctggacagccccaccgacctgagcagccccaccgacgtgggcctggactgcttcttctacatcagcgtgtaccccggctacggcgtggagatcaaggtgcagaacatcagcctgagagagggcgagaccgtgaccgtggagggcctgggcggccccgaccccctgcccctggccaaccagagcttcctgctgagaggccaggtgatcagaagccccacccaccaggccgccctgagattccagagcctgcccccccccgccggccccggcaccttccacttccactaccaggcctacctgctgagctgccacttccccagaagacccgcctacggcgacgtgaccgtgaccagcctgcaccccggcggcagcgccagattccactgcgccaccggctaccagctgaagggcgccagacacctgacctgcctgaacgccacccagcccttctgggacagcaaggagcccgtgtgcatcgccgcctgcggcggcgtgatcagaaacgccaccaccggcagaatcgtgagccccggcttccccggcaactacagcaacaacctgacctgccactggctgctggaggcccccgagggccagagactgcacctgcacttcgagaaggtgagcctggccgaggacgacgacagactgatcatcagaaacggcgacaacgtggaggccccccccgtgtacgacagctacgaggtggagtacctgcccatcgagggcctgctgagcagcggcaagcacttcttcgtggagctgagcaccgacagcagcggcgccgccgccggcatggccctgagatacgaggccttccagcagggccactgctacgagcccttcgtgaagtacggcaacttcagcagcagcacccccacctaccccgtgggcaccaccgtggagttcagctgcgaccccggctacaccctggagcagggcagcatcatcatcgagtgcgtggacccccacgacccccagtggaacgagaccgagcccgcctgcagagccgtgtgcagcggcgagatcaccgacagcgccggcgtggtgctgagccccaactggcccgagccctacggcagaggccaggactgcatctggggcgtgcacgtggaggaggacaagagaatcatgctggacatcagagtgctgagaatcggccccggcgacgtgctgaccttctacgacggcgacgacctgaccgccagagtgctgggccagtacagcggccccagaagccacttcaagctgttcaccagcatggccgacgtgaccatccagttccagagcgaccccggcaccagcgtgctgggctaccagcagggcttcgtgatccacttcttcgaggtgcccagaaacgacacctgccccgagctgcccgagatccccaacggctggaagagccccagccagcccgagctggtgcacggcaccgtggtgacctaccagtgctaccccggctaccaggtggtgggcagcagcgtgctgatgtgccagtgggacctgacctggagcgaggacctgcccagctgccagagagtgaccagctgccacgaccccggcgacgtggagcacagcagaagactgatcagcagccccaagttccccgtgggcgccaccgtgcagtacatctgcgaccagggcttcgtgctgatgggcagcagcatcctgacctgccacgacagacaggccggcagccccaagtggagcgacagagcccccaagtgcctgctggagcagctgaagccctgccacggcctgagcgcccccgagaacggcgccagaagccccgagaagcagctgcaccccgccggcgccaccatccacttcagctgcgcccccggctacgtgctgaagggccaggccagcatcaagtgcgtgcccggccaccccagccactggagcgaccccccccccatctgcagagccgccagcctggacggcttctacaacagcagaagcctggacgtggccaaggcccccgccgccagcagcaccctggacgccgcccacatcgccgccgccatcttcctgcccctggtggccatggtgctgctggtgggcggcgtgtacttctacttcagcagactgcagggcaagagcagcctgcagctgcccagacccagacccagaccctacaacagaatcaccatcgagagcgccttcgacaaccccacctacgagaccggcgagaccagagagtacgaggtgagcatctag

SEQ ID NO: 21859 - DNA, 2733 bp, Artificial Sequence
  Description of Artificial Sequence: Synthetic coding sequence
atgggcacccccagagcccagcaccccccccccccccagctgctgttcctgatcctgctgagctgcccctggatccagggcctgcccctgaaggaggaggagatcctgcccgagcccggcagcgagacccccaccgtggccagcgaggccctggccgagctgctgcacggcgccctgctgagaagaggccccgagatgggctacctgcccggcagcgacagagaccccaccctggccaccccccccgccggccagaccctggccgtgcccagcctgcccagagccaccgagcccggcaccggccccctgaccaccgccgtgacccccaacggcgtgagaggcgccggccccaccgcccccgagctgctgacccccccccccggcaccaccgccccccccccccccagccccgccagccccggcccccccctgggccccgagggcggcgaggaggagaccaccaccaccatcatcaccaccaccaccgtgaccaccaccgtgaccagccccgtgctgtgcaacaacaacatcagcgagggcgagggctacgtggagagccccgacctgggcagccccgtgagcagaaccctgggcctgctggactgcacctacagcatccacgtgtaccccggctacggcatcgagatccaggtgcagaccctgaacctgagccaggaggaggagctgctggtgctggccggcggcggcagccccggcctggcccccagactgctggccaacagcagcatgctgggcgagggccaggtgctgagaagccccaccaacagactgctgctgcacttccagagccccagagtgcccagaggcggcggcttcagaatccactaccaggcctacctgctgagctgcggcttcccccccagacccgcccacggcgacgtgagcgtgaccgacctgcaccccggcggcaccgccaccttccactgcgacagcggctaccagctgcagggcgaggagaccctgatctgcctgaacggcaccagacccagctggaacggcgagacccccagctgcatggccagctgcggcggcaccatccacaacgccaccctgggcagaatcgtgagccccgagcccggcggcgccgtgggccccaacctgacctgcagatgggtgatcgaggccgccgagggcagaagactgcacctgcacttcgagagagtgagcctggacgaggacaacgacagactgatggtgagaagcggcggcagccccctgagccccgtgatctacgacagcgacatggacgacgtgcccgagagaggcctgatcagcgacgcccagagcctgtacgtggagctgctgagcgagacccccgccaaccccctgctgctgagcctgagattcgaggccttcgaggaggacagatgcttcgcccccttcctggcccacggcaacgtgaccaccaccgaccccgagtacagacccggcgccctggccaccttcagctgcctgcccggctacgccctggagccccccggcccccccaacgccatcgagtgcgtggaccccaccgagccccactggaacgacaccgagcccgcctgcaaggccatgtgcggcggcgagctgagcgagcccgccggcgtggtgctgagccccgactggccccagagctacagccccggccaggactgcgtgtggggcgtgcacgtgcaggaggagaagagaatcctgctgcaggtggagatcctgaacgtgagagagggcgacatgctgaccctgttcgacggcgacggccccagcgccagagtgctggcccagctgagaggcccccagcccagaagaagactgctgagcagcggccccgacctgaccctgcagttccaggccccccccggcccccccaaccccggcctgggccagggcttcgtgctgcacttcaaggaggtgcccagaaacgacacctgccccgagctgcccccccccgagtggggctggagaaccgccagccacggcgacctgatcagaggcaccgtgctgacctaccagtgcgagcccggctacgagctgctgggcagcgacatcctgacctgccagtgggacctgagctggagcgccgccccccccgcctgccagaagatcatgacctgcgccgaccccggcgagatcgccaacggccacagaaccgccagcgacgccggcttccccgtgggcagccacgtgcagtacagatgcctgcccggctacagcctggagggcgccgccatgctgacctgctacagcagagacaccggcacccccaagtggagcgacagagtgcccaagtgcgccctgaagtacgagccctgcctgaaccccggcgtgcccgagaacggctaccagaccctgtacaagcaccactaccaggccggcgagagcctgagattcttctgctacgagggcttcgagctgatcggcgaggtgaccatcacctgcgtgcccggccaccccagccagtggaccagccagccccccctgtgcaaggtgacccagaccaccgaccccagcagacagctggagggcggcaacctggccctggccatcctgctgcccctgggcctggtgatcgtgctgggcagcggcgtgtacatctactacaccaagctgcagggcaagagcctgttcggcttcagcggcagccacagctacagccccatcaccgtggagagcgacttcagcaaccccctgtacgaggccggcgacaccagagagtacgaggtgagcatctag

SEQ ID NO: 21860 - DNA, 2430 bp, Artificial Sequence
  Description of Artificial Sequence: Synthetic coding sequence
atgggcacccccagagcccagcaccccccccccccccagctgctgttcctgatcctgctgagctgcccctggatccagggcctgcccctgaaggaggaggagatcctgcccgagcccggcagcgagacccccaccgtggccagcgaggccctggccgagctgctgcacggcgccctgctgagaagaggccccgagatgggctacctgcccggcagcgacagagaccccaccctggccaccccccccgccggccagaccctggccgtgcccagcctgcccagagccaccgagcccggcaccggccccctgaccaccgccgtgacccccaacggcgtgagaggcgccggccccaccgcccccgagctgctgacccccccccccggcaccaccgccccccccccccccagccccgccagccccggcccccccctgggccccgagggcggcgaggaggagaccaccaccaccatcatcaccaccaccaccgtgaccaccaccgtgaccagccccgcctacctgctgagctgcggcttcccccccagacccgcccacggcgacgtgagcgtgaccgacctgcaccccggcggcaccgccaccttccactgcgacagcggctaccagctgcagggcgaggagaccctgatctgcctgaacggcaccagacccagctggaacggcgagacccccagctgcatggccagctgcggcggcaccatccacaacgccaccctgggcagaatcgtgagccccgagcccggcggcgccgtgggccccaacctgacctgcagatgggtgatcgaggccgccgagggcagaagactgcacctgcacttcgagagagtgagcctggacgaggacaacgacagactgatggtgagaagcggcggcagccccctgagccccgtgatctacgacagcgacatggacgacgtgcccgagagaggcctgatcagcgacgcccagagcctgtacgtggagctgctgagcgagacccccgccaaccccctgctgctgagcctgagattcgaggccttcgaggaggacagatgcttcgcccccttcctggcccacggcaacgtgaccaccaccgaccccgagtacagacccggcgccctggccaccttcagctgcctgcccggctacgccctggagccccccggcccccccaacgccatcgagtgcgtggaccccaccgagccccactggaacgacaccgagcccgcctgcaaggccatgtgcggcggcgagctgagcgagcccgccggcgtggtgctgagccccgactggccccagagctacagccccggccaggactgcgtgtggggcgtgcacgtgcaggaggagaagagaatcctgctgcaggtggagatcctgaacgtgagagagggcgacatgctgaccctgttcgacggcgacggccccagcgccagagtgctggcccagctgagaggcccccagcccagaagaagactgctgagcagcggccccgacctgaccctgcagttccaggccccccccggcccccccaaccccggcctgggccagggcttcgtgctgcacttcaaggaggtgcccagaaacgacacctgccccgagctgcccccccccgagtggggctggagaaccgccagccacggcgacctgatcagaggcaccgtgctgacctaccagtgcgagcccggctacgagctgctgggcagcgacatcctgacctgccagtgggacctgagctggagcgccgccccccccgcctgccagaagatcatgacctgcgccgaccccggcgagatcgccaacggccacagaaccgccagcgacgccggcttccccgtgggcagccacgtgcagtacagatgcctgcccggctacagcctggagggcgccgccatgctgacctgctacagcagagacaccggcacccccaagtggagcgacagagtgcccaagtgcgccctgaagtacgagccctgcctgaaccccggcgtgcccgagaacggctaccagaccctgtacaagcaccactaccaggccggcgagagcctgagattcttctgctacgagggcttcgagctgatcggcgaggtgaccatcacctgcgtgcccggccaccccagccagtggaccagccagccccccctgtgcaaggtggcctacgaggagctgctggacaacagaaagctggaggtgacccagaccaccgaccccagcagacagctggagggcggcaacctggccctggccatcctgctgcccctgggcctggtgatcgtgctgggcagcggcgtgtacatctactacaccaagctgcagggcaagagcctgttcggcttcagcggcagccacagctacagccccatcaccgtggagagcgacttcagcaaccccctgtacgaggccggcgacaccagagagtacgaggtgagcatctag

SEQ ID NO: 21861 - DNA, 2562 bp, Artificial Sequence
  Description of Artificial Sequence: Synthetic coding sequence
atgggcacccccagagcccagcaccccccccccccccagctgctgttcctgatcctgctgagctgcccctggatccagggcctgcccctgaaggaggaggagatcctgcccgagcccggcagcgagacccccaccgtggccagcgaggccctggccgagctgctgcacggcgccctgctgagaagaggccccgagatgggctacctgcccggcccccccctgggccccgagggcggcgaggaggagaccaccaccaccatcatcaccaccaccaccgtgaccaccaccgtgaccagccccgtgctgtgcaacaacaacatcagcgagggcgagggctacgtggagagccccgacctgggcagccccgtgagcagaaccctgggcctgctggactgcacctacagcatccacgtgtaccccggctacggcatcgagatccaggtgcagaccctgaacctgagccaggaggaggagctgctggtgctggccggcggcggcagccccggcctggcccccagactgctggccaacagcagcatgctgggcgagggccaggtgctgagaagccccaccaacagactgctgctgcacttccagagccccagagtgcccagaggcggcggcttcagaatccactaccaggcctacctgctgagctgcggcttcccccccagacccgcccacggcgacgtgagcgtgaccgacctgcaccccggcggcaccgccaccttccactgcgacagcggctaccagctgcagggcgaggagaccctgatctgcctgaacggcaccagacccagctggaacggcgagacccccagctgcatggccagctgcggcggcaccatccacaacgccaccctgggcagaatcgtgagccccgagcccggcggcgccgtgggccccaacctgacctgcagatgggtgatcgaggccgccgagggcagaagactgcacctgcacttcgagagagtgagcctggacgaggacaacgacagactgatggtgagaagcggcggcagccccctgagccccgtgatctacgacagcgacatggacgacgtgcccgagagaggcctgatcagcgacgcccagagcctgtacgtggagctgctgagcgagacccccgccaaccccctgctgctgagcctgagattcgaggccttcgaggaggacagatgcttcgcccccttcctggcccacggcaacgtgaccaccaccgaccccgagtacagacccggcgccctggccaccttcagctgcctgcccggctacgccctggagccccccggcccccccaacgccatcgagtgcgtggaccccaccgagccccactggaacgacaccgagcccgcctgcaaggccatgtgcggcggcgagctgagcgagcccgccggcgtggtgctgagccccgactggccccagagctacagccccggccaggactgcgtgtggggcgtgcacgtgcaggaggagaagagaatcctgctgcaggtggagatcctgaacgtgagagagggcgacatgctgaccctgttcgacggcgacggccccagcgccagagtgctggcccagctgagaggcccccagcccagaagaagactgctgagcagcggccccgacctgaccctgcagttccaggccccccccggcccccccaaccccggcctgggccagggcttcgtgctgcacttcaaggaggtgcccagaaacgacacctgccccgagctgcccccccccgagtggggctggagaaccgccagccacggcgacctgatcagaggcaccgtgctgacctaccagtgcgagcccggctacgagctgctgggcagcgacatcctgacctgccagtgggacctgagctggagcgccgccccccccgcctgccagaagatcatgacctgcgccgaccccggcgagatcgccaacggccacagaaccgccagcgacgccggcttccccgtgggcagccacgtgcagtacagatgcctgcccggctacagcctggagggcgccgccatgctgacctgctacagcagagacaccggcacccccaagtggagcgacagagtgcccaagtgcgccctgaagtacgagccctgcctgaaccccggcgtgcccgagaacggctaccagaccctgtacaagcaccactaccaggccggcgagagcctgagattcttctgctacgagggcttcgagctgatcggcgaggtgaccatcacctgcgtgcccggccaccccagccagtggaccagccagccccccctgtgcaaggtggcctacgaggagctgctggacaacagaaagctggaggtgacccagaccaccgaccccagcagacagctggagggcggcaacctggccctggccatcctgctgcccctgggcctggtgatcgtgctgggcagcggcgtgtacatctactacaccaagctgcagggcaagagcctgttcggcttcagcggcagccacagctacagccccatcaccgtggagagcgacttcagcaaccccctgtacgaggccggcgacaccagagagtacgaggtgagcatctag

SEQ ID NO: 21862 - DNA, 2640 bp, Artificial Sequence
  Description of Artificial Sequence: Synthetic coding sequence
atgggcacccccagagcccagcaccccccccccccccagctgctgttcctgatcctgctgagctgcccctggatccagggcagcgacagagaccccaccctggccaccccccccgccggccagaccctggccgtgcccagcctgcccagagccaccgagcccggcaccggccccctgaccaccgccgtgacccccaacggcgtgagaggcgccggccccaccgcccccgagctgctgacccccccccccggcaccaccgccccccccccccccagccccgccagccccggcccccccctgggccccgagggcggcgaggaggagaccaccaccaccatcatcaccaccaccaccgtgaccaccaccgtgaccagccccgtgctgtgcaacaacaacatcagcgagggcgagggctacgtggagagccccgacctgggcagccccgtgagcagaaccctgggcctgctggactgcacctacagcatccacgtgtaccccggctacggcatcgagatccaggtgcagaccctgaacctgagccaggaggaggagctgctggtgctggccggcggcggcagccccggcctggcccccagactgctggccaacagcagcatgctgggcgagggccaggtgctgagaagccccaccaacagactgctgctgcacttccagagccccagagtgcccagaggcggcggcttcagaatccactaccaggcctacctgctgagctgcggcttcccccccagacccgcccacggcgacgtgagcgtgaccgacctgcaccccggcggcaccgccaccttccactgcgacagcggctaccagctgcagggcgaggagaccctgatctgcctgaacggcaccagacccagctggaacggcgagacccccagctgcatggccagctgcggcggcaccatccacaacgccaccctgggcagaatcgtgagccccgagcccggcggcgccgtgggccccaacctgacctgcagatgggtgatcgaggccgccgagggcagaagactgcacctgcacttcgagagagtgagcctggacgaggacaacgacagactgatggtgagaagcggcggcagccccctgagccccgtgatctacgacagcgacatggacgacgtgcccgagagaggcctgatcagcgacgcccagagcctgtacgtggagctgctgagcgagacccccgccaaccccctgctgctgagcctgagattcgaggccttcgaggaggacagatgcttcgcccccttcctggcccacggcaacgtgaccaccaccgaccccgagtacagacccggcgccctggccaccttcagctgcctgcccggctacgccctggagccccccggcccccccaacgccatcgagtgcgtggaccccaccgagccccactggaacgacaccgagcccgcctgcaaggccatgtgcggcggcgagctgagcgagcccgccggcgtggtgctgagccccgactggccccagagctacagccccggccaggactgcgtgtggggcgtgcacgtgcaggaggagaagagaatcctgctgcaggtggagatcctgaacgtgagagagggcgacatgctgaccctgttcgacggcgacggccccagcgccagagtgctggcccagctgagaggcccccagcccagaagaagactgctgagcagcggccccgacctgaccctgcagttccaggccccccccggcccccccaaccccggcctgggccagggcttcgtgctgcacttcaaggaggtgcccagaaacgacacctgccccgagctgcccccccccgagtggggctggagaaccgccagccacggcgacctgatcagaggcaccgtgctgacctaccagtgcgagcccggctacgagctgctgggcagcgacatcctgacctgccagtgggacctgagctggagcgccgccccccccgcctgccagaagatcatgacctgcgccgaccccggcgagatcgccaacggccacagaaccgccagcgacgccggcttccccgtgggcagccacgtgcagtacagatgcctgcccggctacagcctggagggcgccgccatgctgacctgctacagcagagacaccggcacccccaagtggagcgacagagtgcccaagtgcgccctgaagtacgagccctgcctgaaccccggcgtgcccgagaacggctaccagaccctgtacaagcaccactaccaggccggcgagagcctgagattcttctgctacgagggcttcgagctgatcggcgaggtgaccatcacctgcgtgcccggccaccccagccagtggaccagccagccccccctgtgcaaggtggcctacgaggagctgctggacaacagaaagctggaggtgacccagaccaccgaccccagcagacagctggagggcggcaacctggccctggccatcctgctgcccctgggcctggtgatcgtgctgggcagcggcgtgtacatctactacaccaagctgcagggcaagagcctgttcggcttcagcggcagccacagctacagccccatcaccgtggagagcgacttcagcaaccccctgtacgaggccggcgacaccagagagtacgaggtgagcatctag

SEQ ID NO: 21863 - DNA, 3294 bp, Artificial Sequence
  Description of Artificial Sequence: Synthetic coding sequence
atggcccccagacccaagaagcagcccgacaagaaccccctgcacggcagagagctgaacgtggtgcccagcctgggcagacagaccagcctgaccaccagcgtgatccccaaggccgagcagagcgtggcctacaaggacttcatctacttcaccgtgttcgagggcaacgtgagaaacgtgagcgaggtgagcgtggagtacctgtgcagccagccctgcgtggtgaacctggaggccgtggtgagcagcgagttcagaagcagcatccccgtgtacaagaagagatggaagaacgagaagcacctgcacaccagcagaacccagatcgtgcacgtgaagttccccagcatcatggtgtacagagacgactacttcatcagacacagcatcagcgtgagcgccgtgatcgtgagagcctggatcacccacaagtacagcggcagagactggaacgtgaagtgggaggagaacctgctgcacgccgtggccaagaactacaccctgctgcagaccatcccccccttcgagagacccttcaaggaccaccaggtgtgcctggagtggaacatgggctacatctggaacctgagagccaacagaatcccccagtgccccctggagaacgacgtggtggccctgctgggcttcccctacgccagcagcggcgagaacaccggcatcgtgaagaagttccccagattcagaaacagagagctggaggccaccagaagacagagaatggactaccccgtgttcaccgtgagcctgtggctgtacctgctgcactactgcaaggccaacctgtgcggcatcctgtacttcgtggacagcaacgagatgtacggcacccccagcgtgttcctgaccgaggagggctacctgcacatccagatgcacctggtgaagggcgaggacctggccgtgaagaccaagttcatcatccccctgaaggagtggttcagactggacatcagcttcaacggcggccagatcgtggtgaccaccagcatcggccaggacctgaagagctaccacaaccagaccatcagcttcagagaggacttccactacaacgacaccgccggctacttcatcatcggcggcagcagatacgtggccggcatcgagggcttcttcggccccctgaagtactacagactgagaagcctgcaccccgcccagatcttcaaccccctgctggagaagcagctggccgagcagatcaagctgtactacgagagatgcgccgaggtgcaggagatcgtgagcgtgtacgccagcgccgccaagcacggcggcgagagacaggaggcctgccacctgcacaacagctacctggacctgcagagaagatacggcagacccagcatgtgcagagccttcccctgggagaaggagctgaaggacaagcaccccagcctgttccaggccctgctggagatggacctgctgaccgtgcccagaaaccagaacgagagcgtgagcgagatcggcggcaagatcttcgagaaggccgtgaagagactgagcagcatcgacggcctgcaccagatcagcagcatcgtgcccttcctgaccgacagcagctgctgcggctaccacaaggccagctactacctggccgtgttctacgagaccggcctgaacgtgcccagagaccagctgcagggcatgctgtacagcctggtgggcggccagggcagcgagagactgagcagcatgaacctgggctacaagcactaccagggcatcgacaactaccccctggactgggagctgagctacgcctactacagcaacatcgccaccaagacccccctggaccagcacaccctgcagggcgaccaggcctacgtggagaccatcagactgaaggacgacgagatcctgaaggtgcagaccaaggaggacggcgacgtgttcatgtggctgaagcacgaggccaccagaggcaacgccgccgcccagcagagactggcccagatgctgttctggggccagcagggcgtggccaagaaccccgaggccgccatcgagtggtacgccaagggcgccctggagaccgaggaccccgccctgatctacgactacgccatcgtgctgttcaagggccagggcgtgaagaagaacagaagactggccctggagctgatgaagaaggccgccagcaagggcctgcaccaggccgtgaacggcctgggctggtactaccacaagttcaagaagaactacgccaaggccgccaagtactggctgaaggccgaggagatgggcaaccccgacgccagctacaacctgggcgtgctgcacctggacggcatcttccccggcgtgcccggcagaaaccagaccctggccggcgagtacttccacaaggccgcccagggcggccacatggagggcaccctgtggtgcagcctgtactacatcaccggcaacctggagaccttccccagagaccccgagaaggccgtggtgtgggccaagcacgtggccgagaagaacggctacctgggccacgtgatcagaaagggcctgaacgcctacctggagggcagctggcacgaggccctgctgtactacgtgctggccgccgagaccggcatcgaggtgagccagaccaacctggcccacatctgcgaggagagacccgacctggccagaagatacctgggcgtgaactgcgtgtggagatactacaacttcagcgtgttccagatcgacgcccccagcttcgcctacctgaagatgggcgacctgtactactacggccaccagaaccagagccaggacctggagctgagcgtgcagatgtacgcccaggccgccctggacggcgacagccagggcttcttcaacctggccctgctgatcgaggagggcaccatcatcccccaccacatcctggacttcctggagatcgacagcaccctgcacagcaacaacatcagcatcctgcaggagctgtacgagagatgctggagccacagcaacgaggagagcttcagcccctgcagcctggcctggctgtacctgcacctgagactgctgtggggcgccatcctgcacagcgccctgatctacttcctgggcaccttcctgctgagcatcctgatcgcctggaccgtgcagtacttccagagcgtgagcgccagcgaccccccccccagacccagccaggccagccccgacaccgccaccagcaccgccagccccgccgtgacccccgccgccgacgccagcgaccaggaccagcccaccgtgaccaacaaccccgagcccagaggctag

SEQ ID NO: 21864 - DNA, 3399 bp, Artificial Sequence
  Description of Artificial Sequence: Synthetic coding sequence
atgcagagaagaggcgccggcctgggctggcccagacagcagcagcagcagcccccccccctggccgtgggccccagagccgccgccatggtgcccagcggcggcgtgccccagggcctgggcggcagaagcgcctgcgccctgctgctgctgtgctacctgaacgtggtgcccagcctgggcagacagaccagcctgaccaccagcgtgatccccaaggccgagcagagcgtggcctacaaggacttcatctacttcaccgtgttcgagggcaacgtgagaaacgtgagcgaggtgagcgtggagtacctgtgcagccagccctgcgtggtgaacctggaggccgtggtgagcagcgagttcagaagcagcatccccgtgtacaagaagagatggaagaacgagaagcacctgcacaccagcagaacccagatcgtgcacgtgaagttccccagcatcatggtgtacagagacgactacttcatcagacacagcatcagcgtgagcgccgtgatcgtgagagcctggatcacccacaagtacagcggcagagactggaacgtgaagtgggaggagaacctgctgcacgccgtggccaagaactacaccctgctgcagaccatcccccccttcgagagacccttcaaggaccaccaggtgtgcctggagtggaacatgggctacatctggaacctgagagccaacagaatcccccagtgccccctggagaacgacgtggtggccctgctgggcttcccctacgccagcagcggcgagaacaccggcatcgtgaagaagttccccagattcagaaacagagagctggaggccaccagaagacagagaatggactaccccgtgttcaccgtgagcctgtggctgtacctgctgcactactgcaaggccaacctgtgcggcatcctgtacttcgtggacagcaacgagatgtacggcacccccagcgtgttcctgaccgaggagggctacctgcacatccagatgcacctggtgaagggcgaggacctggccgtgaagaccaagttcatcatccccctgaaggagtggttcagactggacatcagcttcaacggcggccagatcgtggtgaccaccagcatcggccaggacctgaagagctaccacaaccagaccatcagcttcagagaggacttccactacaacgacaccgccggctacttcatcatcggcggcagcagatacgtggccggcatcgagggcttcttcggccccctgaagtactacagactgagaagcctgcaccccgcccagatcttcaaccccctgctggagaagcagctggccgagcagatcaagctgtactacgagagatgcgccgaggtgcaggagatcgtgagcgtgtacgccagcgccgccaagcacggcggcgagagacaggaggcctgccacctgcacaacagctacctggacctgcagagaagatacggcagacccagcatgtgcagagccttcccctgggagaaggagctgaaggacaagcaccccagcctgttccaggccctgctggagatggacctgctgaccgtgcccagaaaccagaacgagagcgtgagcgagatcggcggcaagatcttcgagaaggccgtgaagagactgagcagcatcgacggcctgcaccagatcagcagcatcgtgcccttcctgaccgacagcagctgctgcggctaccacaaggccagctactacctggccgtgttctacgagaccggcctgaacgtgcccagagaccagctgcagggcatgctgtacagcctggtgggcggccagggcagcgagagactgagcagcatgaacctgggctacaagcactaccagggcatcgacaactaccccctggactgggagctgagctacgcctactacagcaacatcgccaccaagacccccctggaccagcacaccctgcagggcgaccaggcctacgtggagaccatcagactgaaggacgacgagatcctgaaggtgcagaccaaggaggacggcgacgtgttcatgtggctgaagcacgaggccaccagaggcaacgccgccgcccagcagagactggcccagatgctgttctggggccagcagggcgtggccaagaaccccgaggccgccatcgagtggtacgccaagggcgccctggagaccgaggaccccgccctgatctacgactacgccatcgtgctgttcaagggccagggcgtgaagaagaacagaagactggccctggagctgatgaagaaggccgccagcaagggcctgcaccaggccgtgaacggcctgggctggtactaccacaagttcaagaagaactacgccaaggccgccaagtactggctgaaggccgaggagatgggcaaccccgacgccagctacaacctgggcgtgctgcacctggacggcatcttccccggcgtgcccggcagaaaccagaccctggccggcgagtacttccacaaggccgcccagggcggccacatggagggcaccctgtggtgcagcctgtactacatcaccggcaacctggagaccttccccagagaccccgagaaggccgtggtgtgggccaagcacgtggccgagaagaacggctacctgggccacgtgatcagaaagggcctgaacgcctacctggagggcagctggcacgaggccctgctgtactacgtgctggccgccgagaccggcatcgaggtgagccagaccaacctggcccacatctgcgaggagagacccgacctggccagaagatacctgggcgtgaactgcgtgtggagatactacaacttcagcgtgttccagatcgacgcccccagcttcgcctacctgaagatgggcgacctgtactactacggccaccagaaccagagccaggacctggagctgagcgtgcagatgtacgcccaggccgccctggacggcgacagccagggcttcttcaacctggccctgctgatcgaggagggcaccatcatcccccaccacatcctggacttcctggagatcgacagcaccctgcacagcaacaacatcagcatcctgcaggagctgtacgagagatgctggagccacagcaacgaggagagcttcagcccctgcagcctggcctggctgtacctgcacctgagactgctgtggggcgccatcctgcacagcgccctgatctacttcctgggcaccttcctgctgagcatcctgatcgcctggaccgtgcagtacttccagagcgtgagcgccagcgaccccccccccagacccagccaggccagccccgacaccgccaccagcaccgccagccccgccgtgacccccgccgccgacgccagcgaccaggaccagcccaccgtgaccaacaaccccgagcccagaggctag

SEQ ID NO: 21865 - DNA, 2940 bp, Artificial Sequence
  Description of Artificial Sequence: Synthetic coding sequence
atggtgtacagagacgactacttcatcagacacagcatcagcgtgagcgccgtgatcgtgagagcctggatcacccacaagtacagcggcagagactggaacgtgaagtgggaggagaacctgctgcacgccgtggccaagaactacaccctgctgcagaccatcccccccttcgagagacccttcaaggaccaccaggtgtgcctggagtggaacatgggctacatctggaacctgagagccaacagaatcccccagtgccccctggagaacgacgtggtggccctgctgggcttcccctacgccagcagcggcgagaacaccggcatcgtgaagaagttccccagattcagaaacagagagctggaggccaccagaagacagagaatggactaccccgtgttcaccgtgagcctgtggctgtacctgctgcactactgcaaggccaacctgtgcggcatcctgtacttcgtggacagcaacgagatgtacggcacccccagcgtgttcctgaccgaggagggctacctgcacatccagatgcacctggtgaagggcgaggacctggccgtgaagaccaagttcatcatccccctgaaggagtggttcagactggacatcagcttcaacggcggccagatcgtggtgaccaccagcatcggccaggacctgaagagctaccacaaccagaccatcagcttcagagaggacttccactacaacgacaccgccggctacttcatcatcggcggcagcagatacgtggccggcatcgagggcttcttcggccccctgaagtactacagactgagaagcctgcaccccgcccagatcttcaaccccctgctggagaagcagctggccgagcagatcaagctgtactacgagagatgcgccgaggtgcaggagatcgtgagcgtgtacgccagcgccgccaagcacggcggcgagagacaggaggcctgccacctgcacaacagctacctggacctgcagagaagatacggcagacccagcatgtgcagagccttcccctgggagaaggagctgaaggacaagcaccccagcctgttccaggccctgctggagatggacctgctgaccgtgcccagaaaccagaacgagagcgtgagcgagatcggcggcaagatcttcgagaaggccgtgaagagactgagcagcatcgacggcctgcaccagatcagcagcatcgtgcccttcctgaccgacagcagctgctgcggctaccacaaggccagctactacctggccgtgttctacgagaccggcctgaacgtgcccagagaccagctgcagggcatgctgtacagcctggtgggcggccagggcagcgagagactgagcagcatgaacctgggctacaagcactaccagggcatcgacaactaccccctggactgggagctgagctacgcctactacagcaacatcgccaccaagacccccctggaccagcacaccctgcagggcgaccaggcctacgtggagaccatcagactgaaggacgacgagatcctgaaggtgcagaccaaggaggacggcgacgtgttcatgtggctgaagcacgaggccaccagaggcaacgccgccgcccagcagagactggcccagatgctgttctggggccagcagggcgtggccaagaaccccgaggccgccatcgagtggtacgccaagggcgccctggagaccgaggaccccgccctgatctacgactacgccatcgtgctgttcaagggccagggcgtgaagaagaacagaagactggccctggagctgatgaagaaggccgccagcaagggcctgcaccaggccgtgaacggcctgggctggtactaccacaagttcaagaagaactacgccaaggccgccaagtactggctgaaggccgaggagatgggcaaccccgacgccagctacaacctgggcgtgctgcacctggacggcatcttccccggcgtgcccggcagaaaccagaccctggccggcgagtacttccacaaggccgcccagggcggccacatggagggcaccctgtggtgcagcctgtactacatcaccggcaacctggagaccttccccagagaccccgagaaggccgtggtgtgggccaagcacgtggccgagaagaacggctacctgggccacgtgatcagaaagggcctgaacgcctacctggagggcagctggcacgaggccctgctgtactacgtgctggccgccgagaccggcatcgaggtgagccagaccaacctggcccacatctgcgaggagagacccgacctggccagaagatacctgggcgtgaactgcgtgtggagatactacaacttcagcgtgttccagatcgacgcccccagcttcgcctacctgaagatgggcgacctgtactactacggccaccagaaccagagccaggacctggagctgagcgtgcagatgtacgcccaggccgccctggacggcgacagccagggcttcttcaacctggccctgctgatcgaggagggcaccatcatcccccaccacatcctggacttcctggagatcgacagcaccctgcacagcaacaacatcagcatcctgcaggagctgtacgagagatgctggagccacagcaacgaggagagcttcagcccctgcagcctggcctggctgtacctgcacctgagactgctgtggggcgccatcctgcacagcgccctgatctacttcctgggcaccttcctgctgagcatcctgatcgcctggaccgtgcagtacttccagagcgtgagcgccagcgaccccccccccagacccagccaggccagccccgacaccgccaccagcaccgccagccccgccgtgacccccgccgccgacgccagcgaccaggaccagcccaccgtgaccaacaaccccgagcccagaggctag

SEQ ID NO: 21866 - DNA, 228 bp, Artificial Sequence
  Description of Artificial Sequence: Synthetic coding sequence
atggtgtacagagacgactacttcatcagacacagcatcagcgtgagcgccgtgatcgtgagagcctggatcacccacaagtacagcggcagagactggaacgtgaagtgggaggagaacctgctgcacgccgtggccaagaactacaccctgctgcagaccatcccccccttcgagagacccttcaaggaccaccaggtgtgcctggagtggaacatgggctactag

SEQ ID NO: 21867 - DNA, 189 bp, Artificial Sequence
  Description of Artificial Sequence: Synthetic coding sequence
atggtgtacagagacgactacttcatcagacacagcatcagcgtgagcgccgtgatcgtgagagcctggatcacccacaagtacagcggcagagactggaacgtgaagtgggaggagaacctgctgcacgccgtggccaagaactacaccctgctgcagaccatcccccccttcgagagacccttctag

SEQ ID NO: 21868 - DNA, 108 bp, Artificial Sequence
  Description of Artificial Sequence: Synthetic coding sequence
atggtgtacagagacgactacttcatcagacacagcatcagcgtgagcgccgtgatcgtgagagcctggatcacccacaagtacagcggcagagactggaacgtgtag

SEQ ID NO: 21869 - DNA, 570 bp, Artificial Sequence
  Description of Artificial Sequence: Synthetic coding sequence
  Description of Combined DNA/RNA Molecule: Synthetic coding sequence
atggagagacaggaggagagcctgagcgccagacccgccctggagaccgagggcctgagattcctgcacaccaccgtgggcagcctgctggccacctacggctggtacatcgtgttcagctgcatcctgctgtacgtggtgttccagaagctgagcgccagactgagagccctgagacagagacagctggacagagccgccgccgccgtggagcccgacgtggtggtgaagagacaggaggccctggccgccgccagactgaagatgcaggaggagctgaacgcccaggtggagaagcacaaggagaagctgaagcagctggaggaggagaagagaagacagaagatcgagatgtgggacagcatgcaggagggcaagagctacaagggcaacgccaagaagccccaggaggaggacagccccggccccagcaccagcagcgtgctgaagagaaagagcgacagaaagcccctgagaggcggcggctacaaccccctgagcggcgagggcggcggcgcctgcagctggagacccggcagaagaggccccagcagcggcggcugaggctag

SEQ ID NO: 21870 - DNA, 570 bp, Artificial Sequence; identical to SEQ ID NO: 21869
  Description of Artificial Sequence: Synthetic coding sequence
  Description of Combined DNA/RNA Molecule: Synthetic coding sequence

SEQ ID NO: 21871 - DNA, 564 bp, Artificial Sequence
  Description of Artificial Sequence: Synthetic coding sequence
atggagagacaggaggagagcctgagcgccagacccgccctggagaccgagggcctgagattcctgcacaccaccgtgggcagcctgctggccacctacggctggtacatcgtgttcagctgcatcctgctgtacgtggtgttccagaagctgagcgccagactgagagccctgagacagagacagctggacagagccgccgccgccgtggagcccgacgtggtggtgaagagacaggaggccctggccgccgccagactgaagatgcaggaggagctgaacgcccaggtggagaagcacaaggagaagctgaagcagctggaggaggagaagagaagacagaagatcgagatgtgggacagcatgcaggagggcaagagctacaagggcaacgccaagaagccccaggaggaggacagccccggccccagcaccagcagcgtgctgaagagaaagagcgacagaaagcccctgagaggcggcggctacaaccccctgagcggcgagggcggcggcgcctgcagctggagacccggcagaagaggccccagcagcggcggctag

SEQ ID NO: 21872 - DNA, 2667 bp, Artificial Sequence
  Description of Artificial Sequence: Synthetic coding sequence
atgcagacccccagagccagcccccccagacccgccctgctgctgctgctgctgctgctgggcggcgcccacggcctgttccccgaggagcccccccccctgagcgtggcccccagagactacctgaaccactaccccgtgttcgtgggcagcggccccggcagactgacccccgccgagggcgccgacgacctgaacatccagagagtgctgagagtgaacagaaccctgttcatcggcgacagagacaacctgtacagagtggagctggagccccccaccagcaccgagctgagataccagagaaagctgacctggagaagcaaccccagcgacatcaacgtgtgcagaatgaagggcaagcaggagggcgagtgcagaaacttcgtgaaggtgctgctgctgagagacgagagcaccctgttcgtgtgcggcagcaacgccttcaaccccgtgtgcgccaactacagcatcgacaccctgcagcccgtgggcgacaacatcagcggcatggccagatgcccctacgaccccaagcacgccaacgtggccctgttcagcgacggcatgctgttcaccgccaccgtgaccgacttcctggccatcgacgccgtgatctacagaagcctgggcgacagacccaccctgagaaccgtgaagcacgacagcaagtggttcaaggagccctacttcgtgcacgccgtggagtggggcagccacgtgtacttcttcttcagagagatcgccatggagttcaactacctggagaaggtggtggtgagcagagtggccagagtgtgcaagaacgacgtgggcggcagccccagagtgctggagaagcagtggaccagcttcctgaaggccagactgaactgcagcgtgcccggcgacagccacttctacttcaacgtgctgcaggccgtgaccggcgtggtgagcctgggcggcagacccgtggtgctggccgtgttcagcacccccagcaacagcatccccggcagcgccgtgtgcgccttcgacctgacccaggtggccgccgtgttcgagggcagattcagagagcagaagagccccgagagcatctggacccccgtgcccgaggaccaggtgcccagacccagacccggctgctgcgccgcccccggcatgcagtacaacgccagcagcgccctgcccgacgacatcctgaacttcgtgaagacccaccccctgatggacgaggccgtgcccagcctgggccacgccccctggatcctgagaaccctgatgagacaccagctgaccagagtggccgtggacgtgggcgccggcccctggggcaaccagaccgtggtgttcctgggcagcgaggccggcaccgtgctgaagttcctggtgagacccaacgccagcaccagcggcaccagcggcctgagcgtgttcctggaggagttcgagacctacagacccgacagatgcggcagacccggcggcggcgagaccggccagagactgctgagcctggagctggacgccgccagcggcggcctgctggccgccttccccagatgcgtggtgagagtgcccgtggccagatgccagcagtacagcggctgcatgaagaactgcatcggcagccaggacccctactgcggctgggcccccgacggcagctgcatcttcctgagccccggcaccagagccgccttcgagcaggacgtgagcggcgccagcaccagcggcctgggcgactgcaccggcctgctgagagccagcctgagcgaggacagagccggcctggtgagcgtgaacctgctggtgaccagcagcgtggccgccttcgtggtgggcgccgtggtgagcggcttcagcgtgggctggttcgtgggcctgagagagagaagagagctggccagaagaaaggacaaggaggccatcctggcccacggcgccggcgaggccgtgctgagcgtgagcagactgggcgagagaagagcccagggccccggcggcagaggcggcggcggcggcggcggcgccggcgtgccccccgaggccctgctggcccccctgatgcagaacggctgggccaaggccaccctgctgcagggcggcccccacgacctggacagcggcctgctgcccacccccgagcagacccccctgccccagaagagactgcccaccccccacccccacccccacgccctgggccccagagcctgggaccacggccaccccctgctgcccgccagcgccagcagcagcctgctgctgctggcccccgccagagcccccgagcagccccccgcccccggcgagcccacccccgacggcagactgtacgccgccagacccggcagagccagccacggcgacttccccctgaccccccacgccagccccgacagaagaagagtggtgagcgcccccaccggccccctggaccccgccagcgccgccgacggcctgcccagaccctggagccccccccccaccggcagcctgagaagacccctgggcccccacgccccccccgccgccaccctgagaagaacccacaccttcaacagcggcgaggccagacccggcgacagacacagaggctgccacgccagacccggcaccgacctggcccacctgctgccctacggcggcgccgacagaaccgccccccccgtgccctag

SEQ ID NO: 21873 - DNA, 2358 bp, Artificial Sequence
  Description of Artificial Sequence: Synthetic coding sequence
atgctggtggccggcctgctgctgtgggccagcctgctgaccggcgcctggcccagcttccccacccaggaccacctgcccgccacccccagagtgagactgagcttcaaggagctgaaggccaccggcaccgcccacttcttcaacttcctgctgaacaccaccgactacagaatcctgctgaaggacgaggaccacgacagaatgtacgtgggcagcaaggactacgtgctgagcctggacctgcacgacatcaacagagagcccctgatcatccactgggccgccagcccccagagaatcgaggagtgcgtgctgagcggcaaggacgtgaacggcgagtgcggcaacttcgtgagactgatccagccctggaacagaacccacctgtacgtgtgcggcaccggcgcctacaaccccatgtgcacctacgtgaacagaggcagaagagcccaggccaccccctggacccagacccaggccgtgagaggcagaggcagcagagccaccgacggcgccctgagacccatgcccaccgcccccagacaggactacatcttctacctggagcccgagagactggagagcggcaagggcaagtgcccctacgaccccaagctggacaccgccagcgccctgatcaacgaggagctgtacgccggcgtgtacatcgacttcatgggcaccgacgccgccatcttcagaaccctgggcaagcagaccgccatgagaaccgaccagtacaacagcagatggctgaacgaccccagcttcatccacgccgagctgatccccgacagcgccgagagaaacgacgacaagctgtacttcttcttcagagagagaagcgccgaggccccccagagccccgccgtgtacgccagaatcggcagaatctgcctgaacgacgacggcggccactgctgcctggtgaacaagtggagcaccttcctgaaggccagactggtgtgcagcgtgcccggcgaggacggcatcgagacccacttcgacgagctgcaggacgtgttcgtgcagcagacccaggacgtgagaaaccccgtgatctacgccgtgttcaccagcagcggcagcgtgttcagaggcagcgccgtgtgcgtgtacagcatggccgacatcagaatggtgttcaacggccccttcgcccacaaggagggccccaactaccagtggatgcccttcagcggcaagatgccctaccccagacccggcacctgccccggcggcaccttcacccccagcatgaagagcaccaaggactaccccgacgaggtgatcaacttcatgagaagccaccccctgatgtaccaggccgtgtaccccctgcagagaagacccctggtggtgagaaccggcgccccctacagactgaccaccatcgccgtggaccaggtggacgccgccgacggcagatacgaggtgctgttcctgggcaccgacagaggcaccgtgcagaaggtgatcgtgctgcccaaggacgaccaggagctggaggagctgatgctggaggaggtggaggtgttcaaggaccccgcccccgtgaagaccatgaccatcagcagcaagagacagcagctgtacgtggccagcgccgtgggcgtgacccacctgagcctgcacagatgccaggcctacggcgccgcctgcgccgactgctgcctggccagagacccctactgcgcctgggacggccaggcctgcagcagatacaccgccagcagcaagagaagaagcagaagacaggacgtgagacacggcaaccccatcagacagtgcagaggcttcaacagcaacgccaacaagaacgccgtggagagcgtgcagtacggcgtggccggcagcgccgccttcctggagtgccagcccagaagcccccaggccaccgtgaagtggctgttccagagagaccccggcgacagaagaagagagatcagagccgaggacagattcctgagaaccgagcagggcctgctgctgagagccctgcagctgagcgacagaggcctgtacagctgcaccgccaccgagaacaacttcaagcacgtggtgaccagagtgcagctgcacgtgctgggcagagacgccgtgcacgccgccctgttcccccccctgagcatgagcgccccccccccccccggcgccggcccccccacccccccctaccaggagctggcccagctgctggcccagcccgaggtgggcctgatccaccagtactgccagggctactggagacacgtgccccccagccccagagaggcccccggcgcccccagaagccccgagccccaggaccagaagaagcccagaaacagaagacaccacccccccgacacctag

SEQ ID NO: 21874 - DNA, 795 bp, Artificial Sequence
  Description of Artificial Sequence: Synthetic coding sequence
atgctggtggccggcctgctgctgtgggccagcctgctgaccggcgcctggcccagcttccccacccaggaccacctgcccgccacccccagagtgagactgagcttcaaggagctgaaggccaccggcaccgcccacttcttcaacttcctgctgaacaccaccgactacagaatcctgctgaaggacgaggaccacgacagaatgtacgtgggcagcaaggactacgtgctgagcctggacctgcacgacatcaacagagagcccctgatcatccactgggccgccagcccccagagaatcgaggagtgcgtgctgagcggcaaggacgtgaacggcgagtgcggcaacttcgtgagactgatccagccctggaacagaacccacctgtacgtgtgcggcaccggcgcctacaaccccatgtgcacctacgtgaacagaggcagaagagcccaggactacatcttctacctggagcccgagagactggagagcggcaagggcaagtgcccctacgaccccaagctggacaccgccagcgccctgatcaacgaggagctgtacgccggcgtgtacatcgacttcatgggcaccgacgccgccatcttcagaaccctgggcaagcagaccgccatgagaaccgaccagtacaacagcagatggctgaacgaccccagcttcatccacgccgagctgatccccgacagcgccgagagaaacgacgacaagctgtacttcttcttcagagagagaagcgccgaggccccccagagccccgccgtgtacgccagatag

SEQ ID NO: 21875 - DNA, 279 bp, Artificial Sequence
  Description of Artificial Sequence: Synthetic coding sequence
atgctggtggccggcctgctgctgtgggccagcctgctgaccggcgcctggcccagcttccccacccaggaccacctgcccgccacccccagagtgagactgagcttcaaggagctgaaggccaccggcaccgcccacttcttcaacttcctgctgaacaccaccgactacagaatcctgctgaaggacgaggaccacgacagaatgtacgtgggcagcaaggactacgtgctgagcctggacctgcacgacatcaacagagagcccctgatcgtgtag

SEQ ID NO: 21876 - DNA, 2265 bp, Artificial Sequence
  Description of Artificial Sequence: Synthetic coding sequence
atgctggtggccggcctgctgctgtgggccagcctgctgaccggcgcctggcccagcttccccacccaggaccacctgcccgccacccccagagtgagactgagcttcaaggagctgaaggccaccggcaccgcccacttcttcaacttcctgctgaacaccaccgactacagaatcctgctgaaggacgaggaccacgacagaatgtacgtgggcagcaaggactacgtgctgagcctggacctgcacgacatcaacagagagcccctgatcatccactgggccgccagcccccagagaatcgaggagtgcgtgctgagcggcaaggacgtgaacggcgagtgcggcaacttcgtgagactgatccagccctggaacagaacccacctgtacgtgtgcggcaccggcgcctacaaccccatgtgcacctacgtgaacagaggcagaagagcccaggactacatcttctacctggagcccgagagactggagagcggcaagggcaagtgcccctacgaccccaagctggacaccgccagcgccctgatcaacgaggagctgtacgccggcgtgtacatcgacttcatgggcaccgacgccgccatcttcagaaccctgggcaagcagaccgccatgagaaccgaccagtacaacagcagatggctgaacgaccccagcttcatccacgccgagctgatccccgacagcgccgagagaaacgacgacaagctgtacttcttcttcagagagagaagcgccgaggccccccagagccccgccgtgtacgccagaatcggcagaatctgcctgaacgacgacggcggccactgctgcctggtgaacaagtggagcaccttcctgaaggccagactggtgtgcagcgtgcccggcgaggacggcatcgagacccacttcgacgagctgcaggacgtgttcgtgcagcagacccaggacgtgagaaaccccgtgatctacgccgtgttcaccagcagcggcagcgtgttcagaggcagcgccgtgtgcgtgtacagcatggccgacatcagaatggtgttcaacggccccttcgcccacaaggagggccccaactaccagtggatgcccttcagcggcaagatgccctaccccagacccggcacctgccccggcggcaccttcacccccagcatgaagagcaccaaggactaccccgacgaggtgatcaacttcatgagaagccaccccctgatgtaccaggccgtgtaccccctgcagagaagacccctggtggtgagaaccggcgccccctacagactgaccaccatcgccgtggaccaggtggacgccgccgacggcagatacgaggtgctgttcctgggcaccgacagaggcaccgtgcagaaggtgatcgtgctgcccaaggacgaccaggagctggaggagctgatgctggaggaggtggaggtgttcaaggaccccgcccccgtgaagaccatgaccatcagcagcaagagacagcagctgtacgtggccagcgccgtgggcgtgacccacctgagcctgcacagatgccaggcctacggcgccgcctgcgccgactgctgcctggccagagacccctactgcgcctgggacggccaggcctgcagcagatacaccgccagcagcaagagaagaagcagaagacaggacgtgagacacggcaaccccatcagacagtgcagaggcttcaacagcaacgccaacaagaacgccgtggagagcgtgcagtacggcgtggccggcagcgccgccttcctggagtgccagcccagaagcccccaggccaccgtgaagtggctgttccagagagaccccggcgacagaagaagagagatcagagccgaggacagattcctgagaaccgagcagggcctgctgctgagagccctgcagctgagcgacagaggcctgtacagctgcaccgccaccgagaacaacttcaagcacgtggtgaccagagtgcagctgcacgtgctgggcagagacgccgtgcacgccgccctgttcccccccctgagcatgagcgccccccccccccccggcgccggcccccccacccccccctaccaggagctggcccagctgctggcccagcccgaggtgggcctgatccaccagtactgccagggctactggagacacgtgccccccagccccagagaggcccccggcgcccccagaagccccgagccccaggaccagaagaagcccagaaacagaagacaccacccccccgacacctag

SEQ ID NO: 21877 - DNA, 1143 bp, Artificial Sequence
  Description of Artificial Sequence: Synthetic coding sequence
atgctggtggccggcctgctgctgtgggccagcctgctgaccggcgcctggcccagcttccccacccaggaccacctgcccgccacccccagagtgagactgagcttcaaggagctgaaggccaccggcaccgcccacttcttcaacttcctgctgaacaccaccgactacagaatcctgctgaaggacgaggaccacgacagaatgtacgtgggcagcaaggactacgtgctgagcctggacctgcacgacatcaacagagagcccctgatcatccactgggccgccagcccccagagaatcgaggagtgcgtgctgagcggcaaggacgtgaacggcgagtgcggcaacttcgtgagactgatccagccctggaacagaacccacctgtacgtgtgcggcaccggcgcctacaaccccatgtgcacctacgtgaacagaggcagaagagcccaggactacatcttctacctggagcccgagagactggagagcggcaagggcaagtgcccctacgaccccaagctggacaccgccagcgccctgatcaacgaggagctgtacgccggcgtgtacatcgacttcatgggcaccgacgccgccatcttcagaaccctgggcaagcagaccgccatgagaaccgaccagtacaacagcagatggctgaacgaccccagcttcatccacgccgagctgatccccgacagcgccgagagaaacgacgacaagctgtacttcttcttcagagagagaagcgccgaggccccccagagccccgccgtgtacgccagaatcggcagaatctgcctgaacgacgacggcggccactgctgcctggtgaacaagtggagcaccttcctgaaggccagactggtgtgcagcgtgcccggcgaggacggcatcgagacccacttcgacgagctgcaggacgtgttcgtgcagcagacccaggacgtgagaaaccccgtgatctacgccgtgttcaccagcagcggcagcgtgttcagaggcagcgccgtgtgcgtgtacagcatggccgacatcagaatggtgttcaacggccccttcgcccacaaggagggccccaactaccagtggatgcccttcagcggcaagatgccctaccccagacccggcacctag

SEQ ID NO: 21878 - DNA, 2514 bp, Artificial Sequence
  Description of Artificial Sequence: Synthetic coding sequence
atgctgagaaccgccatgggcctgagaagctggctggccgccccctggggcgccctgccccccagaccccccctgctgctgctgctgctgctgctgctgctgctgcagccccccccccccacctgggccctgagccccagaatcagcctgcccctgggcagcgaggagagacccttcctgagattcgaggccgagcacatcagcaactacaccgccctgctgctgagcagagacggcagaaccctgtacgtgggcgccagagaggccctgttcgccctgagcagcaacctgagcttcctgcccggcggcgagtaccaggagctgctgtggggcgccgacgccgagaagaagcagcagtgcagcttcaagggcaaggacccccagagagactgccagaactacatcaagatcctgctgcccctgagcggcagccacctgttcacctgcggcaccgccgccttcagccccatgtgcacctacatcaacatggagaacttcaccctggccagagacgagaagggcaacgtgctgctggaggacggcaagggcagatgccccttcgaccccaacttcaagagcaccgccctggtggtggacggcgagctgtacaccggcaccgtgagcagcttccagggcaacgaccccgccatcagcagaagccagagcctgagacccaccaagaccgagagcagcctgaactggctgcaggaccccgccttcgtggccagcgcctacatccccgagagcctgggcagcctgcagggcgacgacgacaagatctacttcttcttcagcgagaccggccaggagttcgagttcttcgagaacaccatcgtgagcagaatcgccagaatctgcaagggcgacgagggcggcgagagagtgctgcagcagagatggaccagcttcctgaaggcccagctgctgtgcagcagacccgacgacggcttccccttcaacgtgctgcaggacgtgttcaccctgagccccagcccccaggactggagagacaccctgttctacggcgtgttcaccagccagtggcacagaggcaccaccgagggcagcgccgtgtgcgtgttcaccatgaaggacgtgcagagagtgttcagcggcctgtacaaggaggtgaacagagagacccagcagtggtacaccgtgacccaccccgtgcccacccccagacccggcgcctgcatcaccaacagcgccagagagagaaagatcaacagcagcctgcagctgcccgacagagtgctgaacttcctgaaggaccacttcctgatggacggccaggtgagaagcagaatgctgctgctgcagccccaggccagataccagagagtggccgtgcacagagtgcccggcctgcaccacacctacgacgtgctgttcctgggcaccggcgacggcagactgcacaaggccgtgagcgtgggccccagagtgcacatcatcgaggagctgcagatcttcagcagcggccagcccgtgcagaacctgctgctggacacccacagaggcctgctgtacgccgccagccacagcggcgtggtgcaggtgcccatggccaactgcagcctgtacagaagctgcggcgactgcctgctggccagagacccctactgcgcctggagcggcagcagctgcaagcacgtgagcctgtaccagccccagctggccaccagaccctggatccaggacatcgagggcgccagcgccaaggacctgtgcagcgccagcagcgtggtgagccccagcttcgtgcccaccggcgagaagccctgcgagcaggtgcagttccagcccaacaccgtgaacaccctggcctgccccctgctgagcaacctggccaccagactgtggctgagaaacggcgcccccgtgaacgccagcgccagctgccacgtgctgcccaccggcgacctgctgctggtgggcacccagcagctgggcgagttccagtgctggagcctggaggagggcttccagcagctggtggccagctactgccccgaggtggtggaggacggcgtggccgaccagaccgacgagggcggcagcgtgcccgtgatcatcagcaccagcagagtgagcgcccccgccggcggcaaggccagctggggcgccgacagaagctactggaaggagttcctggtgatgtgcaccctgttcgtgctggccgtgctgctgcccgtgctgttcctgctgtacagacacagaaacagcatgaaggtgttcctgaagcagggcgagtgcgccagcgtgcaccccaagacctgccccgtggtgctgccccccgagaccagacccctgaacggcctgggcccccccagcacccccctggaccacagaggctaccagagcctgagcgacagcccccccggcagcagagtgttcaccgagagcgagaagagacccctgagcatccaggacagcttcgtggaggtgagccccgtgtgccccagacccagagtgagactgggcagcgagatcagagacagcgtggtgtag

SEQ ID NO: 21879 - DNA, 2214 bp, Artificial Sequence
  Description of Artificial Sequence: Synthetic coding sequence
atgggcctgagaagctggctggccgccccctggggcgccctgccccccagaccccccctgctgctgctgctgctgctgctgctgctgctgcagccccccccccccacctgggccctgagccccagaatcagcctgcccctgggcagcgaggagagacccttcctgagattcgaggccgagcacatcagcaactacaccgccctgctgctgagcagagacggcagaaccctgtacgtgggcgccagagaggccctgttcgccctgagcagcaacctgagcttcctgcccggcggcgagtaccaggagctgctgtggggcgccgacgccgagaagaagcagcagtgcagcttcaagggcaaggacccccagagagactgccagaactacatcaagatcctgctgcccctgagcggcagccacctgttcacctgcggcaccgccgccttcagccccatgtgcacctacatcaacatggagaacttcaccctggccagagacgagaagggcaacgtgctgctggaggacggcaagggcagatgccccttcgaccccaacttcaagagcaccgccctggtggtggacggcgagctgtacaccggcaccgtgagcagcttccagggcaacgaccccgccatcagcagaagccagagcctgagacccaccaagaccgagagcagcctgaactggctgcaggaccccgccttcgtggccagcgcctacatccccgagagcctgggcagcctgcagggcgacgacgacaagatctacttcttcttcagcgagaccggccaggagttcgagttcttcgagaacaccatcgtgagcagaatcgccagaatctgcaagggcgacgagggcggcgagagagtgctgcagcagagatggaccagcttcctgaaggcccagctgctgtgcagcagacccgacgacggcttccccttcaacgtgctgcaggacgtgttcaccctgagccccagcccccaggactggagagacaccctgttctacggcgtgttcaccagccagtggcacagaggcaccaccgagggcagcgccgtgtgcgtgttcaccatgaaggacgtgcagagagtgttcagcggcctgtacaaggaggtgaacagagagacccagcagtggtacaccgtgacccaccccgtgcccacccccagacccggcgcctgcatcaccaacagcgccagagagagaaagatcaacagcagcctgcagctgcccgacagagtgctgaacttcctgaaggaccacttcctgatggacggccaggtgagaagcagaatgctgctgctgcagccccaggccagataccagagagtggccgtgcacagagtgcccggcctgcaccacacctacgacgtgctgttcctgggcaccggcgacggcagactgcacaaggccgtgagcgtgggccccagagtgcacatcatcgaggagctgcagatcttcagcagcggccagcccgtgcagaacctgctgctggacacccacagaggcctgctgtacgccgccagccacagcggcgtggtgcaggtgcccatggccaactgcagcctgtacagaagctgcggcgactgcctgctggccagagacccctactgcgcctggagcggcagcagctgcaagcacgtgagcctgtaccagccccagctggccaccagaccctggatccaggacatcgagggcgccagcgccaaggacctgtgcagcgccagcagcgtggtgagccccagcttcgtgcccaccggcgagaagccctgcgagcaggtgcagttccagcccaacaccgtgaacaccctggcctgccccctgctgagcaacctggccaccagactgtggctgagaaacggcgcccccgtgaacgccagcgccagctgccacgtgctgcccaccggcgacctgctgctggtgggcacccagcagctgggcgagttccagtgctggagcctggaggagggcttccagcagctggtggccagctactgccccgaggtggtggaggacggcgtggccgaccagaccgacgagggcggcagcgtgcccgtgatcatcagcaccagcagagtgagcgcccccgccggcggcaaggccagctggggcgccgacagaagctgggccagaacccagctgctggacctgagcagcctgtaccaggccgtggccaccagagaggacagcgccagcagcggcgagatcagctag

SEQ ID NO: 21880 - DNA, 2514 bp, Artificial Sequence; identical to SEQ ID NO: 21878
  Description of Artificial Sequence: Synthetic coding sequence

SEQ ID NO: 21881 - DNA, 276 bp, Artificial Sequence
  Description of Artificial Sequence: Synthetic coding sequence
atgctgagaaccgccatgggcctgagaagctggctggccgccccctggggcgccctgccccccagaccccccctgctgctgctgctgctgctgctgctgctgctgcagccccccccccccacctgggccctgagccccagaatcagcctgcccctgggcagcgaggagagacccttcctgagattcgaggccgagcacatcagcaactacaccgccctgctgctgagcagagacggcagaaccctgtacgtgggcgccagagaggccctgttctag

SEQ ID NO: 21882 - DNA, 345 bp, Artificial Sequence
  Description of Artificial Sequence: Synthetic coding sequence
atgctgagaaccgccatgggcctgagaagctggctggccgccccctggggcgccctgccccccagaccccccctgctgctgctgctgctgctgctgctgctgctgcagccccccccccccacctgggccctgagccccagaatcagcctgcccctgggcagcgaggagagacccttcctgagattcgaggccgagcacatcagcaactacaccgccctgctgctgagcagagacggcagaaccctgtacgtgggcgccagagaggccctgttcgccctgagcagcaacctgagcttcctgcccggcggcgagtaccaggagctgctgtggggcgccgacgcctag

SEQ ID NO: 21883 - DNA, 366 bp, Artificial Sequence
  Description of Artificial Sequence: Synthetic coding sequence
atgctgagaaccgccatgggcctgagaagctggctggccgccccctggggcgccctgccccccagaccccccctgctgctgctgctgctgctgctgctgctgctgcagccccccccccccacctgggccctgagccccagaatcagcctgcccctgggcagcgaggagagacccttcctgagattcgaggccgagcacatcagcaactacaccgccctgctgctgagcagagacggcagaaccctgtacgtgggcgccagagaggccctgttcgccctgagcagcaacctgagcttcctgcccggcggcgagtaccaggagctgctgtggggcgccgacgccgagaagaagcagcagtgcagctag

SEQ ID NO: 21884 - DNA, 2502 bp, Artificial Sequence
  Description of Artificial Sequence: Synthetic coding sequence
atggccccccactgggccgtgtggctgctggccgccagactgtggggcctgggcatcggcgccgaggtgtggtggaacctggtgcccagaaagaccgtgagcagcggcgagctggccaccgtggtgagaagattcagccagaccggcatccaggacttcctgaccctgaccctgaccgagcccaccggcctgctgtacgtgggcgccagagaggccctgttcgccttcagcatggaggccctggagctgcagggcgccatcagctgggaggcccccgtggagaagaagaccgagtgcatccagaagggcaagaacaaccagaccgagtgcttcaacttcatcagattcctgcagccctacaacgccagccacctgtacgtgtgcggcacctacgccttccagcccaagtgcacctacgtgaacatgctgaccttcaccctggagcacggcgagttcgaggacggcaagggcaagtgcccctacgaccccgccaagggccacgccggcctgctggtggacggcgagctgtacagcgccaccctgaacaacttcctgggcaccgagcccatcatcctgagaaacatgggcccccaccacagcatgaagaccgagtacctggccttctggctgaacgagccccacttcgtgggcagcgcctacgtgcccgagagcgtgggcagcttcaccggcgacgacgacaaggtgtacttcttcttcagagagagagccgtggagagcgactgctacgccgagcaggtggtggccagagtggccagagtgtgcaagggcgacatgggcggcgccagaaccctgcagagaaagtggaccaccttcctgaaggccagactggcctgcagcgcccccaactggcagctgtacttcaaccagctgcaggccatgcacaccctgcaggacaccagctggcacaacaccaccttcttcggcgtgttccaggcccagtggggcgacatgtacctgagcgccatctgcgagtaccagctggaggagatccagagagtgttcgagggcccctacaaggagtaccacgaggaggcccagaagtgggacagatacaccgaccccgtgcccagccccagacccggcagctgcatcaacaactggcacagaagacacggctacaccagcagcctggagctgcccgacaacatcctgaacttcgtgaagaagcaccccctgatggaggagcaggtgggccccagatggagcagacccctgctggtgaagaagggcaccaacttcacccacctggtggccgacagagtgaccggcctggacggcgccacctacaccgtgctgttcatcggcaccggcgacggctggctgctgaaggccgtgagcctgggcccctgggtgcacctgatcgaggagctgcagctgttcgaccaggagcccatgagaagcctggtgctgagccagagcaagaagctgctgttcgccggcagcagaagccagctggtgcagctgcccgtggccgactgcatgaagtacagaagctgcgccgactgcgtgctggccagagacccctactgcgcctggagcgtgaacaccagcagatgcgtggccgtgggcggccacagcggcagcctgctgatccagcacgtgatgaccagcgacaccagcggcatctgcaacctgagaggcagcaagaaggtgagacccacccccaagaacatcaccgtggtggccggcaccgacctggtgctgccctgccacctgagcagcaacctggcccacgccagatggaccttcggcggcagagacctgcccgccgagcagcccggcagcttcctgtacgacgccagactgcaggccctggtggtgatggccgcccagcccagacacgccggcgcctaccactgcttcagcgaggagcagggcgccagactggccgccgagggctacctggtggccgtggtggccggccccagcgtgaccctggaggccagagcccccctggagaacctgggcctggtgtggctggccgtggtggccctgggcgccgtgtgcctggtgctgctgctgctggtgctgagcctgagaagaagactgagagaggagctggagaagggcgccaaggccaccgagagaaccctggtgtaccccctggagctgcccaaggagcccaccagcccccccttcagaccctgccccgagcccgacgagaagctgtgggaccccgtgggctactactacagcgacggcagcctgaagatcgtgcccggccacgccagatgccagcccggcggcggcccccccagccccccccccggcatccccggccagcccctgcccagccccaccagactgcacctgggcggcggcagaaacagcaacgccaacggctacgtgagactgcagctgggcggcgaggacagaggcggcctgggccaccccctgcccgagctggccgacgagctgagaagaaagctgcagcagagacagcccctgcccgacagcaaccccgaggagagcagcgtgtag

SEQ ID NO: 21885 - DNA, 606 bp, Artificial Sequence
  Description of Artificial Sequence: Synthetic coding sequence
atggccccccactgggccgtgtggctgctggccgccagactgtggggcctgggcatcggcgccgaggtgtggtggaacctggtgcccagaaagaccgtgagcagcggcgagctggccaccgtggtgagaagattcagccagaccggcatccaggacttcctgaccctgaccctgaccgagcccaccggcctgctgtacgtgggcgccagagaggccctgttcgccttcagcatggaggccctggagctgcagggcgccatcagctgggaggcccccgtggagaagaagaccgagtgcatccagaagggcaagaacaaccagaccgagtgcttcaacttcatcagattcctgcagccctacaacgccagccacctgtacgtgtgcggcacctacgccttccagcccaagtgcacctacgtgaacatgctgaccttcaccctggagcacggcgagttcgaggacggcaagggcaagtgcccctacgaccccgccaagggccacgccggcctgctggtggacggcgagctgtacagcgccaccctgaacaacttcctgggcaccgagcccatcatcctgagaaacatgggcccccaccacagcatgtag

SEQ ID NO: 21886 - DNA, 423 bp, Artificial Sequence
  Description of Artificial Sequence: Synthetic coding sequence
atggccccccactgggccgtgtggctgctggccgccagactgtggggcctgggcatcggcgccgaggtgtggtggaacctggtgcccagaaagaccgtgagcagcggcgagctggccaccgtggtgagaagattcagccagaccggcatccaggacttcctgaccctgaccctgaccgagcccaccggcctgctgtacgtgggcgccagagaggccctgttcgccttcagcatggaggccctggagctgcagggcgccatcagctgggaggcccccgtggagaagaagaccgagtgcatccagaagggcaagaacaaccagaccgagtgcttcaacttcatcagattcctgcagccctacaacgccagccacctgtacgtgtgcggcacctacgccttccagcccaagtgcacctacgtgtag

SEQ ID NO: 21887 - DNA, 2217 bp, Artificial Sequence
  Description of Artificial Sequence: Synthetic coding sequence
atgagaatgtgcacccccatcagaggcctgctgatggccctggccgtgatgttcggcaccgccatggccttcgcccccatccccagaatcacctgggagcacagagaggtgcacctggtgcagttccacgagcccgacatctacaactacagcgccctgctgctgagcgaggacaaggacaccctgtacatcggcgccagagaggccgtgttcgccgtgaacgccctgaacatcagcgagaagcagcacgaggtgtactggaaggtgagcgaggacaagaaggccaagtgcgccgagaagggcaagagcaagcagaccgagtgcctgaactacatcagagtgctgcagcccctgagcgccaccagcctgtacgtgtgcggcaccaacgccttccagcccgcctgcgaccacctgaacctgaccagcttcaagttcctgggcaagaacgaggacggcaagggcagatgccccttcgaccccgcccacagctacaccagcgtgatggtggacggcgagctgtacagcggcaccagctacaacttcctgggcagcgagcccatcatcagcagaaacagcagccacagccccctgagaaccgagtacgccatcccctggctgaacgagcccagcttcgtgttcgccgacgtgatcagaaagagccccgacagccccgacggcgaggacgacagagtgtacttcttcttcaccgaggtgagcgtggagtacgagttcgtgttcagagtgctgatccccagaatcgccagagtgtgcaagggcgaccagggcggcctgagaaccctgcagaagaagtggaccagcttcctgaaggccagactgatctgcagcagacccgacagcggcctggtgttcaacgtgctgagagacgtgttcgtgctgagaagccccggcctgaaggtgcccgtgttctacgccctgttcaccccccagctgaacaacgtgggcctgagcgccgtgtgcgcctacaacctgagcaccgccgaggaggtgttcagccacggcaagtacatgcagagcaccaccgtggagcagagccacaccaagtgggtgagatacaacggccccgtgcccaagcccagacccggcgcctgcatcgacagcgaggccagagccgccaactacaccagcagcctgaacctgcccgacaagaccctgcagttcgtgaaggaccaccccctgatggacgacagcgtgacccccatcgacaacagacccagactgatcaagaaggacgtgaactacacccagatcgtggtggacagaacccaggccctggacggcaccgtgtacgacgtgatgttcgtgagcaccgacagaggcgccctgcacaaggccatcagcctggagcacgccgtgcacatcatcgaggagacccagctgttccaggacttcgagcccgtgcagaccctgctgctgagcagcaagaagggcaacagattcgtgtacgccggcagcaacagcggcgtggtgcaggcccccctggccttctgcggcaagcacggcacctgcgaggactgcgtgctggccagagacccctactgcgcctggagcccccccaccgccacctgcgtggccctgcaccagaccgagagccccagcagaggcctgatccaggagatgagcggcgacgccagcgtgtgccccgccagcagccccaagcccctgcccccccccggcagcagcagcctgagctgcctgggccacgtgggcgacagaagactgagcagcccctggaccccctggcccgccagcggcgccggccccgacagcagcagcagagtgagcctgctgccccccttcctgagcgaccaggcccagcacgtgcacgccctgggcaacttctacctgttctgccaggccaccggccccgccgacatcagattcgtgtgggagaagaacggcagagccctggagacctgcgtgcccgtgcagacccacgccctgcccgacggcagagcccacgccctgagctggctgcaggacgccatcagagagagcgccgagtacagatgcagcgtgctgagcagcgccggcaacaagaccagcaaggtgcaggtggccgtgatgagacccgaggtgacccaccaggagagatggaccagagagctgagcgcctggagagccgtggccggcgagcacgacagaatgatgcagagctggagaaaggcctgggagagctgcagcaaggacaccctgtag

SEQ ID NO: 21888 - DNA, 2589 bp, Artificial Sequence
  Description of Artificial Sequence: Synthetic coding sequence
atgagaatgtgcacccccatcagaggcctgctgatggccctggccgtgatgttcggcaccgccatggccttcgcccccatccccagaatcacctgggagcacagagaggtgcacctggtgcagttccacgagcccgacatctacaactacagcgccctgctgctgagcgaggacaaggacaccctgtacatcggcgccagagaggccgtgttcgccgtgaacgccctgaacatcagcgagaagcagcacgaggtgtactggaaggtgagcgaggacaagaaggccaagtgcgccgagaagggcaagagcaagcagaccgagtgcctgaactacatcagagtgctgcagcccctgagcgccaccagcctgtacgtgtgcggcaccaacgccttccagcccgcctgcgaccacctgaacctgaccagcttcaagttcctgggcaagaacgaggacggcaagggcagatgccccttcgaccccgcccacagctacaccagcgtgatggtggacggcgagctgtacagcggcaccagctacaacttcctgggcagcgagcccatcatcagcagaaacagcagccacagccccctgagaaccgagtacgccatcccctggctgaacgagcccagcttcgtgttcgccgacgtgatcagaaagagccccgacagccccgacggcgaggacgacagagtgtacttcttcttcaccgaggtgagcgtggagtacgagttcgtgttcagagtgctgatccccagaatcgccagagtgtgcaagggcgaccagggcggcctgagaaccctgcagaagaagtggaccagcttcctgaaggccagactgatctgcagcagacccgacagcggcctggtgttcaacgtgctgagagacgtgttcgtgctgagaagccccggcctgaaggtgcccgtgttctacgccctgttcaccccccagctgaacaacgtgggcctgagcgccgtgtgcgcctacaacctgagcaccgccgaggaggtgttcagccacggcaagtacatgcagagcaccaccgtggagcagagccacaccaagtgggtgagatacaacggccccgtgcccaagcccagacccggcgcctgcatcgacagcgaggccagagccgccaactacaccagcagcctgaacctgcccgacaagaccctgcagttcgtgaaggaccaccccctgatggacgacagcgtgacccccatcgacaacagacccagactgatcaagaaggacgtgaactacacccagatcgtggtggacagaacccaggccctggacggcaccgtgtacgacgtgatgttcgtgagcaccgacagaggcgccctgcacaaggccatcagcctggagcacgccgtgcacatcatcgaggagacccagctgttccaggacttcgagcccgtgcagaccctgctgctgagcagcaagaagggcaacagattcgtgtacgccggcagcaacagcggcgtggtgcaggcccccctggccttctgcggcaagcacggcacctgcgaggactgcgtgctggccagagacccctactgcgcctggagcccccccaccgccacctgcgtggccctgcaccagaccgagagccccagcagaggcctgatccaggagatgagcggcgacgccagcgtgtgccccgacaagagcaagggcagctacagacagcacttcttcaagcacggcggcaccgccgagctgaagtgcagccagaagagcaacctggccagagtgttctggaagttccagaacggcgtgctgaaggccgagagccccaagtacggcctgatgggcagaaagaacctgctgatcttcaacctgagcgagggcgacagcggcgtgtaccagtgcctgagcgaggagagagtgaagaacaagaccgtgttccaggtggtggccaagcacgtgctggaggtgaaggtggtgcccaagcccgtggtggcccccaccctgagcgtggtgcagaccgagggcagcagaatcgccaccaaggtgctggtggccagcacccagggcagcagcccccccacccccgccgtgcaggccaccagcagcggcgccatcaccctgccccccaagcccgcccccaccggcaccagctgcgagcccaagatcgtgatcaacaccgtgccccagctgcacagcgagaagaccatgtacctgaagagcagcgacaacagactgctgatgagcctgttcctgttcttcttcgtgctgttcctgtgcctgttcttctacaactgctacaagggctacctgcccagacagtgcctgaagttcagaagcgccctgctgatcggcaagaagaagcccaagagcgacttctgcgacagagagcagagcctgaaggagaccctggtggagcccggcagcttcagccagcagaacggcgagcaccccaagcccgccctggacaccggctacgagaccgagcaggacaccatcaccagcaaggtgcccaccgacagagaggacagccagagaatcgacgacctgagcgccagagacaagcccttcgacgtgaagtgcgagctgaagttcgccgacagcgacgccgacggcgactag

SEQ ID NO: 21889 - DNA, 180 bp, Artificial Sequence
  Description of Artificial Sequence: Synthetic coding sequence
atgagaatgtgcacccccatcagaggcctgctgatggccctggccgtgatgttcggcaccgccatggccttcgcccccatccccagaatcacctgggagcacagagaggtgcacctggtgcagttccacgagcccgacatctacaactacagcgccctgctgctgagcgaggacaagtag

SEQ ID NO: 21890 - DNA, 372 bp, Artificial Sequence
  Description of Artificial Sequence: Synthetic coding sequence
atgtggacccagagatggaagagaagcgtgagccccggccccgccgacatcagattcgtgtgggagaagaacggcagagccctggagacctgcgtgcccgtgcagacccacgccctgcccgacggcagagcccacgccctgagctggctgcaggacgccatcagagagagcgccgagtacagatgcagcgtgctgagcagcgccggcaacaagaccagcaaggtgcaggtggccgtgatgagacccgaggtgacccaccaggagagatggaccagagagctgagcgcctggagagccgtggccggcgagcacgacagaatgatgcagagctggagaaaggcctgggagagctgcagcaaggacaccctgtag

SEQ ID NO: 21891 - DNA, 6 bp, Artificial Sequence
  Description of Artificial Sequence: Synthetic coding sequence
atgtag

SEQ ID NO: 21892 - DNA, 441 bp, Artificial Sequence
  Description of Artificial Sequence: Synthetic coding sequence
atgagaatgtgcacccccatcagaggcctgctgatggccctggccgtgatgttcggcaccgccatggccttcgcccccatccccagaatcacctgggagcacagagaggtgcacctggtgcagttccacgagcccgacatctacaactacagcgccctgctgctgagcgaggacaaggacaccctgtacatcggcgccagagaggccgtgttcgccgtgaacgccctgaacatcagcgagaagcagcacgaggtgtactggaaggtgagcgaggacaagaaggccaagtgcgccgagaagggcaagagcaagcagaccgagtgcctgaactacatcagagtgctgcagcccctgagcgccaccagcctgtacgtgtgcggcaccaacgccttccagcccgcctgcgaccacctgaacctgaccagcttcaagttcctgtag

SEQ ID NO: 21893 - DNA, 2217 bp, Artificial Sequence; identical to SEQ ID NO: 21887
  Description of Artificial Sequence: Synthetic coding sequence

SEQ ID NO: 21894 - DNA, 2589 bp, Artificial Sequence; identical to SEQ ID NO: 21888
  Description of Artificial Sequence: Synthetic coding sequence

SEQ ID NO: 21895 - DNA, 231 bp, Artificial Sequence
  Description of Artificial Sequence: Synthetic coding sequence
atgagaatgtgcacccccatcagaggcctgctgatggccctggccgtgatgttcggcaccgccatggccttcgcccccatccccagaatcacctgggagcacagagaggtgcacctggtgcagttccacgagcccgacatctacaactacagcgccctgctgctgagcgaggacaaggacaccctgtacatcggcgccagagaggccgtgttcgccgtgaacgccctgtag

SEQ ID NO: 21896 - DNA, 2589 bp, Artificial Sequence; identical to SEQ ID NO: 21888
  Description of Artificial Sequence: Synthetic coding sequence

SEQ ID NO: 21897 - DNA, 2589 bp, Artificial Sequence; identical to SEQ ID NO: 21888
  Description of Artificial Sequence: Synthetic coding sequence

SEQ ID NO: 21898 - DNA, 201 bp, Artificial Sequence
  Description of Artificial Sequence: Synthetic coding sequence
atgagaatgtgcacccccatcagaggcctgctgatggccctggccgtgatgttcggcaccgccatggccttcgcccccatccccagaatcacctgggagcacagagaggtgcacctggtgcagttccacgagcccgacatctacaactacagcgccctgctgctgagcgaggacaaggacaccctgtacatcggcgcctag

SEQ ID NO: 21899 - DNA, 2313 bp, Artificial Sequence
  Description of Artificial Sequence: Synthetic coding sequence
atgcccgccagcgccgccagacccagacccggccccggccagcccaccgccagccccttccccctgctgctgctggccgtgctgagcggccccgtgagcggcagagtgcccagaagcgtgcccagaaccagcctgcccatcagcgaggccgacagctgcctgaccagattcgccgtgccccacacctacaactacagcgtgctgctggtggaccccgccagccacaccctgtacgtgggcgccagagacaccatcttcgccctgagcctgcccttcagcggcgagagacccagaagaatcgactggatggtgcccgaggcccacagacagaactgcagaaagaagggcaagaaggaggacgagtgccacaacttcgtgcagatcctggccatcgccaacgccagccacctgctgacctgcggcaccttcgccttcgaccccaagtgcggcgtgatcgacgtgagcagattccagcaggtggagagactggagagcggcagaggcaagtgccccttcgagcccgcccagagaagcgccgccgtgatggccggcggcgtgctgtacgccgccaccgtgaagaactacctgggcaccgagcccatcatcaccagagccgtgggcagagccgaggactggatcagaaccgacaccctgcccagctggctgaacgcccccgccttcgtggccgccgtggccctgagccccgccgagtggggcgacgaggacggcgacgacgagatctacttcttcttcaccgagaccagcagagccttcgacagctacgagagaatcaaggtgcccagagtggccagagtgtgcgccggcgacctgggcggcagaaagaccctgcagcagagatggaccaccttcctgaaggccgacctgctgtgccccggccccgagcacggcagagccagcagcgtgctgcaggacgtggccgtgctgagacccgagctgggcgccggcacccccatcttctacggcatcttcagcagccagtgggagggcgccaccatcagcgccgtgtgcgccttcagaccccaggacatcagaaccgtgctgaacggccccttcagagagctgaagcacgactgcaacagaggcctgcccgtggtggacaacgacgtgccccagcccagacccggcgagtgcatcaccaacaacatgaagctgagacacttcggcagcagcctgagcctgcccgacagagtgctgaccttcatcagagaccaccccctgatggacagacccgtgttccccgccgacggccaccccctgctggtgaccaccgacaccgcctacctgagagtggtggcccacagagtgaccagcctgagcggcaaggagtacgacgtgctgtacctgggcaccgaggacggccacctgcacagagccgtgagaatcggcgcccagctgagcgtgctggaggacctggccctgttccccgagccccagcccgtggagaacatgaagctgtaccacagctggctgctggtgggcagcagaaccgaggtgacccaggtgaacaccaccaactgcggcagactgcagagctgcagcgagtgcatcctggcccaggaccccgtgtgcgcctggagcttcagactggacgagtgcgtggcccacgccggcgagcacagaggcctggtgcaggacatcgagagcgccgacgtgagcagcctgtgccccaaggagcccggcgagagacccgtggtgttcgaggtgcccgtggccaccgccgcccacgtggtgctgccctgcagccccagcagcgcctgggccagctgcgtgtggcaccagcccagcggcgtgaccgccctgacccccagaagagacggcctggaggtggtggtgacccccggcgccatgggcgcctacgcctgcgagtgccaggagggcggcgccgcccacgtggtggccgcctacagcctggtgtggggcagccagagagacgcccccagcagagcccacaccgtgggcgccggcctggccggcttcttcctgggcatcctggccgccagcctgaccctgatcctgatcggcagaagacagcagagaagaagacagagagagctgctggccagagacaaggtgggcctggacctgggcgccccccccagcggcaccaccagctacagccaggacccccccagccccagccccgaggacgagagactgcccctggccctggccaagagaggcagcggcttcggcggcttcagcccccccttcctgctggacccctgccccagccccgcccacatcagactgaccggcgcccccctggccacctgcgacgagaccagcatctag

SEQ ID NO: 21900 - DNA, 384 bp, Artificial Sequence
  Description of Artificial Sequence: Synthetic coding sequence
atgcccgccagcgccgccagacccagacccggccccggccagcccaccgccagccccttccccctgctgctgctggccgtgctgagcggccccgtgagcggcagagtgcccagaagcgtgcccagaaccagcctgcccatcagcgaggccgacagctgcctgaccagattcgccgtgccccacacctacaactacagcgtgctgctggtggaccccgccagccacaccctgtacgtgggcgccagagacaccatcttcgccctgagcctgcccttcagcggcgagagacccagaagaatcgactggatggtgcccgaggcccacagacagaactgcagaaagaagggcaagaaggagggcggcagcagcatgctgcccctgtag

SEQ ID NO: 21901 - DNA, 1080 bp, Artificial Sequence
  Description of Artificial Sequence: Synthetic coding sequence
atgcccctggagctggagctgtgccccggcagatgggtgggcggccagcacccctgcttcatcatcgccgagatcggccagaaccaccagggcgacctggacgtggccaagagaatgatcagaatggccaaggagtgcggcgccgactgcgccaagttccagaagagcgagctggagttcaagttcaacagaaaggccctggagagaccctacaccagcaagcacagctggggcaagacctacggcgagcacaagagacacctggagttcagccacgaccagtacagagagctgcagagatacgccgaggaggtgggcatcttcttcaccgccagcggcatggacgagatggccgtggagttcctgcacgagctgaacgtgcccttcttcaaggtgggcagcggcgacaccaacaacttcccctacctggagaagaccgccaagaagggcagacccatggtgatcagcagcggcatgcagagcatggacaccatgaagcaggtgtaccagatcgtgaagcccctgaaccccaacttctgcttcctgcagtgcaccagcgcctaccccctgcagcccgaggacgtgaacctgagagtgatcagcgagtaccagaagctgttccccgacatccccatcggctacagcggccacgagaccggcatcgccatcagcgtggccgccgtggccctgggcgccaaggtgctggagagacacatcaccctggacaagacctggaagggcagcgaccacagcgccagcctggagcccggcgagctggccgagctggtgagaagcgtgagactggtggagagagccctgggcagccccaccaagcagctgctgccctgcgagatggcctgcaacgagaagctgggcaagagcgtggtggccaaggtgaagatccccgagggcaccatcctgaccatggacatgctgaccgtgaaggtgggcgagcccaagggctacccccccgaggacatcttcaacctggtgggcaagaaggtgctggtgaccgtggaggaggacgacaccatcatggaggagctggtggacaaccacggcaagaagatcaagagctag

SEQ ID NO: 21902 - DNA, 2517 bp, Artificial Sequence
  Description of Artificial Sequence: Synthetic coding sequence
atgtggggcagactgtggcccctgctgctgagcatcctgaccgccaccgccgtgcccggccccagcctgagaagacccagcagagagctggacgccacccccagaatgaccatcccctacgaggagctgagcggcaccagacacttcaagggccaggcccagaactacagcaccctgctgctggaggaggccagcgccagactgctggtgggcgccagaggcgccctgttcagcctgagcgccaacgacatcggcgacggcgcccacaaggagatccactgggaggccagccccgagatgcagagcaagtgccaccagaagggcaagaacaaccagaccgagtgcttcaaccacgtgagattcctgcagagactgaacagcacccacctgtacgcctgcggcacccacgccttccagcccctgtgcgccgccatcgacgccgaggccttcaccctgcccaccagcttcgaggagggcaaggagaagtgcccctacgaccccgccagaggcttcaccggcctgatcatcgacggcggcctgtacaccgccaccagatacgagttcagaagcatccccgacatcagaagaagcagacacccccacagcctgagaaccgaggagacccccatgcactggctgaacgacgccgagttcgtgttcagcgtgctggtgagagagagcaaggccagcgccgtgggcgacgacgacaaggtgtactacttcttcaccgagagagccaccgaggagggcagcggcagcttcacccagagcagaagcagccacagagtggccagagtggccagagtgtgcaagggcgacctgggcggcaagaagatcctgcagaagaagtggaccagcttcctgaaggccagactgatctgccacatccccctgtacgagaccctgagaggcgtgtgcagcctggacgccgagaccagcagcagaacccacttctacgccgccttcaccctgagcacccagtggaagaccctggaggccagcgccatctgcagatacgacctggccgagatccaggccgtgttcgccggcccctacatggagtaccaggacggcagcagaagatggggcagatacgagggcggcgtgcccgagcccagacccggcagctgcatcaccgacagcctgagaagccagggctacaacagcagccaggacctgcccagcctggtgctggacttcgtgaagctgcaccccctgatggccagacccgtggtgcccaccagaggcagacccctgctgctgaagagaaacatcagatacacccacctgaccggcacccccgtgaccacccccgccggccccacctacgacctgctgttcctgggcaccgccgacggctggatccacaaggccgtggtgctgggcagcggcatgcacatcatcgaggagacccaggtgttcagagagagccagagcgtggagaacctggtgatcagcctgctgcagcacagcctgtacgtgggcgcccccagcggcgtgatccagctgcccctgagcagctgcagcagatacagaagctgctacgactgcatcctggccagagacccctactgcggctgggaccccggcacccacgcctgcgccgccgccaccaccatcgccaacagaaccgccctgatccaggacatcgagagaggcaacagaggctgcgagagcagcagagacaccggcccccccccccccctgaagaccagaagcgtgctgagaggcgacgacgtgctgctgccctgcgaccagcccagcaacctggccagagccctgtggctgctgaacggcagcatgggcctgagcgacggccagggcggctacagagtgggcgtggacggcctgctggtgaccgacgcccagcccgagcacagcggcaactacggctgctacgccgaggagaacggcctgagaaccctgctggccagctacagcctgaccgtgagacccgccacccccgcccccgcccccaaggcccccgccacccccggcgcccagctggcccccgacgtgagactgctgtacgtgctggccatcgccgccctgggcggcctgtgcctgatcctggccagcagcctgctgtacgtggcctgcctgagagagggcagaagaggcagaagaagaaagtacagcctgggcagagccagcagagccggcggcagcgccgtgcagctgcagaccgtgagcggccagtgccccggcgaggaggacgagggcgacgacgagggcgccggcggcctggagggcagctgcctgcagatcatccccggcgagggcgcccccgccccccccccccccccccccccccccccccccgccgagctgaccaacggcctggtggccctgcccagcagactgagaagaatgaacggcaacagctacgtgctgctgagacagagcaacaacggcgtgcccgccggcccctgcagcttcgccgaggagctgagcagaatcctggagaagagaaagcacacccagctggtggagcagctggacgagagcagcgtgtag

SEQ ID NO: 21903 - DNA, 1659 bp, Artificial Sequence
  Description of Artificial Sequence: Synthetic coding sequence
atgtggggcagactgtggcccctgctgctgagcatcctgaccgccaccgccgtgcccggccccagcctgagaagacccagcagagagctggacgccacccccagaatgaccatcccctacgaggagctgagcggcaccagacacttcaagggccaggcccagaactacagcaccctgctgctggaggaggccagcgccagactgctggtgggcgccagaggcgccctgttcagcctgagcgccaacgacatcggcgacggcgcccacaaggagatccactgggaggccagccccgagatgcagagcaagtgccaccagaagggcaagaacaaccagaccgagtgcttcaaccacgtgagattcctgcagagactgaacagcacccacctgtacgcctgcggcacccacgccttccagcccctgtgcgccgccatcgacgccgaggccttcaccctgcccaccagcttcgaggagggcaaggagaagtgcccctacgaccccgccagaggcttcaccggcctgatcatcgacggcggcctgtacaccgccaccagatacgagttcagaagcatccccgacatcagaagaagcagacacccccacagcctgagaaccgaggagacccccatgcactggctgaacgacgccgagttcgtgttcagcgtgctggtgagagagagcaaggccagcgccgtgggcgacgacgacaaggtgtactacttcttcaccgagagagccaccgaggagggcagcggcagcttcacccagagcagaagcagccacagagtggccagagtggccagagtgtgcaagggcgacctgggcggcaagaagatcctgcagaagaagtggaccagcttcctgaaggccagactgatctgccacatccccctgtacgagaccctgagaggcgtgtgcagcctggacgccgagaccagcagcagaacccacttctacgccgccttcaccctgagcacccagtggaagaccctggaggccagcgccatctgcagatacgacctggccgagatccaggccgtgttcgccggcccctacatggagtaccaggacggcagcagaagatggggcagatacgagggcggcgtgcccgagcccagacccggcagctgcatcaccgacagcctgagaagccagggctacaacagcagccaggacctgcccagcctggtgctggacttcgtgaagctgcaccccctgatggccagacccgtggtgcccaccagaggcagacccctgctgctgaagagaaacatcagatacacccacctgaccggcacccccgtgaccacccccgccggccccacctacgacctgctgttcctgggcaccgccgacggctggatccacaaggccgtggtgctgggcagcggcatgcacatcatcgaggagacccaggtgttcagagagagccagagcgtggagaacctggtgatcagcctgctgcagcacagcctgtacgtgggcgcccccagcggcgtgatccagctgcccctgagcagctgcagcagatacagaagctgctacgactgcatcctggccagagacccctactgccacatcctgagcggccccctgccccagccccacgtggtgaccagcctgagcagagcctgggagagagccagcctgggcagatag

SEQ ID NO: 21904 - DNA, 2109 bp, Artificial Sequence
  Description of Artificial Sequence: Synthetic coding sequence
atgtggggcagactgtggcccctgctgctgagcatcctgaccgccaccgccgtgcccggccccagcctgagaagacccagcagagagctggacgccacccccagaatgaccatcccctacgaggagctgagcggcaccagacacttcaagggccaggcccagaactacagcaccctgctgctggaggaggccagcgccagactgctggtgggcgccagaggcgccctgttcagcctgagcgccaacgacatcggcgacggcgcccacaaggagatccactgggaggccagccccgagatgcagagcaagtgccaccagaagggcaagaacaaccagaccgagtgcttcaaccacgtgagattcctgcagagactgaacagcacccacctgtacgcctgcggcacccacgccttccagcccctgtgcgccgccatcgacgccgaggccttcaccctgcccaccagcttcgaggagggcaaggagaagtgcccctacgaccccgccagaggcttcaccggcctgatcatcgacggcggcctgtacaccgccaccagatacgagttcagaagcatccccgacatcagaagaagcagacacccccacagcctgagaaccgaggagacccccatgcactggctgaacgacgccgagttcgtgttcagcgtgctggtgagagagagcaaggccagcgccgtgggcgacgacgacaaggtgtactacttcttcaccgagagagccaccgaggagggcagcggcagcttcacccagagcagaagcagccacagagtggccagagtggccagagtgtgcaagggcgacctgggcggcaagaagatcctgcagaagaagtggaccagcttcctgaaggccagactgatctgccacatccccctgtacgagaccctgagaggcgtgtgcagcctggacgccgagaccagcagcagaacccacttctacgccgccttcaccctgagcacccagtggaagaccctggaggccagcgccatctgcagatacgacctggccgagatccaggccgtgttcgccggcccctacatggagtaccaggacggcagcagaagatggggcagatacgagggcggcgtgcccgagcccagacccggcagctgcatcaccgacagcctgagaagccagggctacaacagcagccaggacctgcccagcctggtgctggacttcgtgaagctgcaccccctgatggccagacccgtggtgcccaccagaggcagacccctgctgctgaagagaaacatcagatacacccacctgaccggcacccccgtgaccacccccgccggccccacctacgacctgctgttcctgggcaccgccgacggctggatccacaaggccgtggtgctgggcagcggcatgcacatcatcgaggagacccaggtgttcagagagagccagagcgtggagaacctggtgatcagcctgctgcagcacagcctgtacgtgggcgcccccagcggcgtgatccagctgcccctgagcagctgcagcagatacagaagctgctacgactgcatcctggccagagacccctactgcggctgggaccccggcacccacgcctgcgccgccgccaccaccatcgccaacagaagccagggcagcagaaccgccctgatccaggacatcgagagaggcaacagaggctgcgagagcagcagagacaccggcagagccctgcaggtgcacatgggcagcatgagcccccccagcgcctggccctgcgtgctggacggccccgagaccagacaggacctgtgccagccccccaagccctgcgtgcacagccacgcccacatggaggagtgcctgagcgccggcctgcagtgcccccacccccacctgctgctggtgcacagctgcttcatccccgccagcggcctgggcgtgcccagccagctgccccaccccatctggagcagcagccccgccccctgcggcgacctgttcgtgaagagcctgggcaccggccagcccggcgaggtgagactgcaccacagcccccccctgcccagctgcgtggccctggtgaaccagcccccccacagcccctggagcttcagcagagtgtag

SEQ ID NO: 21905 - DNA, 513 bp, Artificial Sequence
  Description of Artificial Sequence: Synthetic coding sequence
atgtggggcagactgtggcccctgctgctgagcatcctgaccgccaccgccgtgcccggccccagcctgagaagacccagcagagagctggacgccacccccagaatgaccatcccctacgaggagctgagcggcaccagacacttcaagggccaggcccagaactacagcaccctgctgctggaggaggccagcgccagactgctggtgggcgccagaggcgccctgttcagcctgagcgccaacgacatcggcgacggcgcccacaaggagatccactgggaggccagccccgagatgcagagcaagtgccaccagaagggcaagaacaaccagaccgagtgcttcaaccacgtgagattcctgcagagactgaacagcacccacctgtacgcctgcggcacccacgccttccagcccctgtgcgccgccatcgacgccgaggccttcaccctgcccaccagcttcgaggagggcaaggagaagtgcccctacgaccccgccagaggctag

SEQ ID NO: 21906 - DNA, 1569 bp, Artificial Sequence
  Description of Artificial Sequence: Synthetic coding sequence
atgtggggcagactgtggcccctgctgctgagcatcctgaccgccaccgccgtgcccggccccagcctgagaagacccagcagagagctggacgccacccccagaatgaccatcccctacgaggagctgagcggcaccagacacttcaagggccaggcccagaactacagcaccctgctgctggaggaggccagcgccagactgctggtgggcgccagaggcgccctgttcagcctgagcgccaacgacatcggcgacggcgcccacaaggagatccactgggaggccagccccgagatgcagagcaagtgccaccagaagggcaagaacaaccagaccgagtgcttcaaccacgtgagattcctgcagagactgaacagcacccacctgtacgcctgcggcacccacgccttccagcccctgtgcgccgccatcgacgccgaggccttcaccctgcccaccagcttcgaggagggcaaggagaagtgcccctacgaccccgccagaggcttcaccggcctgatcatcgacggcggcctgtacaccgccaccagatacgagttcagaagcatccccgacatcagaagaagcagacacccccacagcctgagaaccgaggagacccccatgcactggctgaacgacgccgagttcgtgttcagcgtgctggtgagagagagcaaggccagcgccgtgggcgacgacgacaaggtgtactacttcttcaccgagagagccaccgaggagggcagcggcagcttcacccagagcagaagcagccacagagtggccagagtggccagagtgtgcaagggcgacctgggcggcaagaagatcctgcagaagaagtggaccagcttcctgaaggccagactgatctgccacatccccctgtacgagaccctgagaggcgtgtgcagcctggacgccgagaccagcagcagaacccacttctacgccgccttcaccctgagcacccagtggaagaccctggaggccagcgccatctgcagatacgacctggccgagatccaggccgtgttcgccggcccctacatggagtaccaggacggcagcagaagatggggcagatacgagggcggcgtgcccgagcccagacccggcagctgcatcaccgacagcctgagaagccagggctacaacagcagccaggacctgcccagcctggtgctggacttcgtgaagctgcaccccctgatggccagacccgtggtgcccaccagaggcagacccctgctgctgaagagaaacatcagatacacccacctgaccggcacccccgtgaccacccccgccggccccacctacgacctgctgttcctgggcaccgccgacggctggatccacaaggccgtggtgctgggcagcggcatgcacatcatcgaggagacccaggtgttcagagagagccagagcgtggagaacctggtgatcagcctgctgcagcacagcctgtacgtgggcgcccccagcggcgtgatccagctgcccctgagcagctgcagcagatacagaagctgctacgactgcatcctggccagagactag

SEQ ID NO: 21907 - DNA, 2517 bp, Artificial Sequence; identical to SEQ ID NO: 21902
  Description of Artificial Sequence: Synthetic coding sequence

SEQ ID NO: 21908 - DNA, 3279 bp, Artificial Sequence
  Description of Artificial Sequence: Synthetic coding sequence
atgccctgcggcttcagccccagccccgtggcccaccacctggtgcccggcccccccgacacccccgcccagcagctgagatgcggctggaccgtgggcggctggctgctgagcctggtgagaggcctgctgccctgcctgccccccggcgccagaaccgccgagggccccatcatggtgctggccggccccctggccgtgagcctgctgctgcccagcctgaccctgctggtgagccacctgagcagcagccaggacgtgagcagcgagcccagcagcgagcagcagctgtgcgccctgagcaagcaccccaccgtggccttcgaggacctgcagccctgggtgagcaacttcacctaccccggcgccagagacttcagccagctggccctggaccccagcggcaaccagctgatcgtgggcgccagaaactacctgttcagactgagcctggccaacgtgagcctgctgcaggccaccgagtgggccagcagcgaggacaccagaagaagctgccagagcaagggcaagaccgaggaggagtgccagaactacgtgagagtgctgatcgtggccggcagaaaggtgttcatgtgcggcaccaacgccttcagccccatgtgcaccagcagacaggtgggcaacctgagcagaaccatcgagaagatcaacggcgtggccagatgcccctacgaccccagacacaacagcaccgccgtgatcagcagccagggcgagctgtacgccgccaccgtgatcgacttcagcggcagagaccccgccatctacagaagcctgggcagcggcccccccctgagaaccgcccagtacaacagcaagtggctgaacgagcccaacttcgtggccgcctacgacatcggcctgttcgcctacttcttcctgagagagaacgccgtggagcacgactgcggcagaaccgtgtacagcagagtggccagagtgtgcaagaacgacgtgggcggcagattcctgctggaggacacctggaccaccttcatgaaggccagactgaactgcagcagacccggcgaggtgcccttctactacaacgagctgcagagcgccttccacctgcccgagcaggacctgatctacggcgtgttcaccaccaacgtgaacagcatcgccgccagcgccgtgtgcgccttcaacctgagcgccatcagccaggccttcaacggccccttcagataccaggagaaccccagagccgcctggctgcccatcgccaaccccatccccaacttccagtgcggcaccctgcccgagaccggccccaacgagaacctgaccgagagaagcctgcaggacgcccagagactgttcctgatgagcgaggccgtgcagcccgtgacccccgagccctgcgtgacccaggacagcgtgagattcagccacctggtggtggacctggtgcaggccaaggacaccctgtaccacgtgctgtacatcggcaccgagagcggcaccatcctgaaggccctgagcaccgccagcagaagcctgcacggctgctacctggaggagctgcacgtgctgccccccggcagaagagagcccctgagaagcctgagaatcctgcacagcgccagagccctgttcgtgggcctgagagacggcgtgctgagagtgcccctggagagatgcgccgcctacagaagccagggcgcctgcctgggcgccagagacccctactgcggctgggacggcaagcagcagagatgcagcaccctggaggacagcagcaacatgagcctgtggacccagaacatcaccgcctgccccgtgagaaacgtgaccagagacggcggcttcggcccctggagcccctggcagccctgcgagcacctggacggcgacaacagcggcagctgcctgtgcagagccagaagctgcgacagccccagacccagatgcggcggcctggactgcctgggccccgccatccacatcgccaactgcagcagaaacggcgcctggaccccctggagcagctgggccctgtgcagcaccagctgcggcatcggcttccaggtgagacagagaagctgcagcaaccccgcccccagacacggcggcagaatctgcgtgggcaagagcagagaggagagattctgcaacgagaacaccccctgccccgtgcccatcttctgggccagctggggcagctggagcaagtgcagcagcaactgcggcggcggcatgcagagcagaagaagagcctgcgagaacggcaacagctgcctgggctgcggcgagttcaagacctgcaaccccgagggctgccccgaggtgagaagaaacaccccctggaccccctggctgcccgtgaacgtgacccagggcggcgccagacaggagcagagattcagattcacctgcagagcccccctggccgacccccacggcctgcagttcggcagaagaagaaccgagaccagaacctgccccgccgacggcagcggcagctgcgacaccgacgccctggtggaggtgctgctgagaagcggcagcaccagcccccacaccgtgagcggcggctgggccgcctggggcccctggagcagctgcagcagagactgcgagctgggcttcagagtgagaaagagaacctgcaccaaccccgagcccagaaacggcggcctgccctgcgtgggcgacgccgccgagtaccaggactgcaacccccaggcctgccccgtgagaggcgcctggagctgctggaccagctggagcccctgcagcgccagctgcggcggcggccactaccagagaaccagaagctgcaccagccccgcccccagccccggcgaggacatctgcctgggcctgcacaccgaggaggccctgtgcgccacccaggcctgccccggctggagcccctggagcgagtggagcaagtgcaccgacgacggcgcccagagcagaagcagacactgcgaggagctgctgcccggcagcagcgcctgcgccggcaacagcagccagagcagaccctgcccctacagcgagatccccgtgatcctgcccgccagcagcatggaggaggccaccgactgcgccggcaagagaaacagaacctacctgatgctgagaagcagccagcccagcggcacccccctgcagagcctggacagcttccacatcctgctgcagaccgccaagctgtgctggggcccccactgcttcgagatgggcagcatcagcagcacctggtggcccagagccagccccgccagctgggccctgggcagctag

SEQ ID NO: 21909 - DNA, 3456 bp, Artificial Sequence
  Description of Artificial Sequence: Synthetic coding sequence
atgccctgcggcttcagccccagccccgtggcccaccacctggtgcccggcccccccgacacccccgcccagcagctgagatgcggctggaccgtgggcggctggctgctgagcctggtgagaggcctgctgccctgcctgccccccggcgccagaaccgccgagggccccatcatggtgctggccggccccctggccgtgagcctgctgctgcccagcctgaccctgctggtgagccacctgagcagcagccaggacgtgagcagcgagcccagcagcgagcagcagctgtgcgccctgagcaagcaccccaccgtggccttcgaggacctgcagccctgggtgagcaacttcacctaccccggcgccagagacttcagccagctggccctggaccccagcggcaaccagctgatcgtgggcgccagaaactacctgttcagactgagcctggccaacgtgagcctgctgcaggccaccgagtgggccagcagcgaggacaccagaagaagctgccagagcaagggcaagaccgaggaggagtgccagaactacgtgagagtgctgatcgtggccggcagaaaggtgttcatgtgcggcaccaacgccttcagccccatgtgcaccagcagacaggtgggcaacctgagcagaaccatcgagaagatcaacggcgtggccagatgcccctacgaccccagacacaacagcaccgccgtgatcagcagccagggcgagctgtacgccgccaccgtgatcgacttcagcggcagagaccccgccatctacagaagcctgggcagcggcccccccctgagaaccgcccagtacaacagcaagtggctgaacgagcccaacttcgtggccgcctacgacatcggcctgttcgcctacttcttcctgagagagaacgccgtggagcacgactgcggcagaaccgtgtacagcagagtggccagagtgtgcaagaacgacgtgggcggcagattcctgctggaggacacctggaccaccttcatgaaggccagactgaactgcagcagacccggcgaggtgcccttctactacaacgagctgcagagcgccttccacctgcccgagcaggacctgatctacggcgtgttcaccaccaacgtgaacagcatcgccgccagcgccgtgtgcgccttcaacctgagcgccatcagccaggccttcaacggccccttcagataccaggagaaccccagagccgcctggctgcccatcgccaaccccatccccaacttccagtgcggcaccctgcccgagaccggccccaacgagaacctgaccgagagaagcctgcaggacgcccagagactgttcctgatgagcgaggccgtgcagcccgtgacccccgagccctgcgtgacccaggacagcgtgagattcagccacctggtggtggacctggtgcaggccaaggacaccctgtaccacgtgctgtacatcggcaccgagagcggcaccatcctgaaggccctgagcaccgccagcagaagcctgcacggctgctacctggaggagctgcacgtgctgccccccggcagaagagagcccctgagaagcctgagaatcctgcacagcgccagagccctgttcgtgggcctgagagacggcgtgctgagagtgcccctggagagatgcgccgcctacagaagccagggcgcctgcctgggcgccagagacccctactgcggctgggacggcaagcagcagagatgcagcaccctggaggacagcagcaacatgagcctgtggacccagaacatcaccgcctgccccgtgagaaacgtgaccagagacggcggcttcggcccctggagcccctggcagccctgcgagcacctggacggcgacaacagcggcagctgcctgtgcagagccagaagctgcgacagccccagacccagatgcggcggcctggactgcctgggccccgccatccacatcgccaactgcagcagaaacggcgcctggaccccctggagcagctgggccctgtgcagcaccagctgcggcatcggcttccaggtgagacagagaagctgcagcaaccccgcccccagacacggcggcagaatctgcgtgggcaagagcagagaggagagattctgcaacgagaacaccccctgccccgtgcccatcttctgggccagctggggcagctggagcaagtgcagcagcaactgcggcggcggcatgcagagcagaagaagagcctgcgagaacggcaacagctgcctgggctgcggcgtggagttcaagacctgcaaccccgagggctgccccgaggtgagaagaaacaccccctggaccccctggctgcccgtgaacgtgacccagggcggcgccagacaggagcagagattcagattcacctgcagagcccccctggccgacccccacggcctgcagttcggcagaagaagaaccgagaccagaacctgccccgccgacggcagcggcagctgcgacaccgacgccctggtggaggtgctgctgagaagcggcagcaccagcccccacaccgtgagcggcggctgggccgcctggggcccctggagcagctgcagcagagactgcgagctgggcttcagagtgagaaagagaacctgcaccaaccccgagcccagaaacggcggcctgccctgcgtgggcgacgccgccgagtaccaggactgcaacccccaggcctgccccgtgagaggcgcctggagctgctggaccagctggagcccctgcagcgccagctgcggcggcggccactaccagagaaccagaagctgcaccagccccgcccccagccccggcgaggacatctgcctgggcctgcacaccgaggaggccctgtgcgccacccaggcctgccccgagggctggagcccctggagcgagtggagcaagtgcaccgacgacggcgcccagagcagaagcagacactgcgaggagctgctgcccggcagcagcgcctgcgccggcaacagcagccagagcagaccctgcccctacagcgagatccccgtgatcctgcccgccagcagcatggaggaggccaccgactgcgccggcttcaacctgatccacctggtggccaccggcatcagctgcttcctgggcagcggcctgctgaccctggccgtgtacctgagctgccagcactgccagagacagagccaggagagcaccctggtgcaccccgccacccccaaccacctgcactacaagggcggcggcacccccaagaacgagaagtacacccccatggagttcaagaccctgaacaagaacaacctgatccccgacgacagagccaacttctaccccctgcagcagaccaacgtgtacaccaccacctactaccccagccccctgaacaagcacagcttcagacccgaggccagccccggccagagatgcttccccaacagctag

SEQ ID NO: 21910 - DNA, 3267 bp, Artificial Sequence
  Description of Artificial Sequence: Synthetic coding sequence
atgccctgcggcttcagccccagccccgtggcccaccacctggtgcccggcccccccgacacccccgcccagcagctgagatgcggctggaccgtgggcggctggctgctgagcctggtgagaggcctgctgccctgcctgccccccggcgccagaaccgccgagggccccatcatggtgctggccggccccctggccgtgagcctgctgctgcccagcctgaccctgctggtgagccacctgagcagcagccaggacgtgagcagcgagcccagcagcgagcagcagctgtgcgccctgagcaagcaccccaccgtggccttcgaggacctgcagccctgggtgagcaacttcacctaccccggcgccagagacttcagccagctggccctggaccccagcggcaaccagctgatcgtgggcgccagaaactacctgttcagactgagcctggccaacgtgagcctgctgcaggccaccgagtgggccagcagcgaggacaccagaagaagctgccagagcaagggcaagaccgaggaggagtgccagaactacgtgagagtgctgatcgtggccggcagaaaggtgttcatgtgcggcaccaacgccttcagccccatgtgcaccagcagacaggtgggcaacctgagcagaaccatcgagaagatcaacggcgtggccagatgcccctacgaccccagacacaacagcaccgccgtgatcagcagccagggcgagctgtacgccgccaccgtgatcgacttcagcggcagagaccccgccatctacagaagcctgggcagcggcccccccctgagaaccgcccagtacaacagcaagtggctgaacgagcccaacttcgtggccgcctacgacatcggcctgttcgcctacttcttcctgagagagaacgccgtggagcacgactgcggcagaaccgtgtacagcagagtggccagagtgtgcaagaacgacgtgggcggcagattcctgctggaggacacctggaccaccttcatgaaggccagactgaactgcagcagacccggcgaggtgcccttctactacaacgagctgcagagcgccttccacctgcccgagcaggacctgatctacggcgtgttcaccaccaacgtgaacagcatcgccgccagcgccgtgtgcgccttcaacctgagcgccatcagccaggccttcaacggccccttcagataccaggagaaccccagagccgcctggctgcccatcgccaaccccatccccaacttccagtgcggcaccctgcccgagaccggccccaacgagaacctgaccgagagaagcctgcaggacgcccagagactgttcctgatgagcgaggccgtgcagcccgtgacccccgagccctgcgtgacccaggacagcgtgagattcagccacctggtggtggacctggtgcaggccaaggacaccctgtaccacgtgctgtacatcggcaccgagagcggcaccatcctgaaggccctgagcaccgccagcagaagcctgcacggctgctacctggaggagctgcacgtgctgccccccggcagaagagagcccctgagaagcctgagaatcctgcacagcgccagagccctgttcgtgggcctgagagacggcgtgctgagagtgcccctggagagatgcgccgcctacagaagccagggcgcctgcctgggcgccagagacccctactgcggctgggacggcaagcagcagagatgcagcaccctggaggacagcagcaacatgagcctgtggacccagaacatcaccgcctgccccgtgagaaacgtgaccagagacggcggcttcggcccctggagcccctggcagccctgcgagcacctggacggcgacaacagcggcagctgcctgtgcagagccagaagctgcgacagccccagacccagatgcggcggcctggactgcctgggccccgccatccacatcgccaactgcagcagaaacggcgcctggaccccctggagcagctgggccctgtgcagcaccagctgcggcatcggcttccaggtgagacagagaagctgcagcaaccccgcccccagacacggcggcagaatctgcgtgggcaagagcagagaggagagattctgcaacgagaacaccccctgccccgtgcccatcttctgggccagctggggcagctggagcaagtgcagcagcaactgcggcggcggcatgcagagcagaagaagagcctgcgagaacggcaacagctgcctgggctgcggcgtggagttcaagacctgcaaccccgagggctgccccgaggtgagaagaaacaccccctggaccccctggctgcccgtgaacgtgacccagggcggcgccagacaggagcagagattcagattcacctgcagagcccccctggccgacccccacggcctgcagttcggcagaagaagaaccgagaccagaacctgccccgccgacggcagcggcagctgcgacaccgacgccctggtggaggtgctgctgagaagcggcagcaccagcccccacaccgtgagcggcggctgggccgcctggggcccctggagcagctgcagcagagactgcgagctgggcttcagagtgagaaagagaacctgcaccaaccccgagcccagaaacggcggcctgccctgcgtgggcgacgccgccgagtaccaggactgcaacccccaggcctgccccgtgagaggcgcctggagctgctggaccagctggagcccctgcagcgccagctgcggcggcggccactaccagagaaccagaagctgcaccagccccgcccccagccccggcgaggacatctgcctgggcctgcacaccgaggaggccctgtgcgccacccaggcctgccccgagggctggagcccctggagcgagtggagcaagtgcaccgacgacggcgcccagagcagaagcagacactgcgaggagctgctgcccggcagcagcgcctgcgccggcaacagcagccagagcagaccctgcccctacagcgagatccccgtgatcctgcccgccagcagcatggaggaggccaccgactgcgccggcttcaacctgatccacctggtggccaccggcatcagctgcttcctgggcagcggcctgctgaccctggccgtgtacctgagctgccagcactgccagagacagagccaggagagcaccctggtgcaccccgccacccccaaccacctgcactacaagggcggcggcaccccctag

SEQ ID NO: 21911 - DNA, 3174 bp, Artificial Sequence
  Description of Artificial Sequence: Synthetic coding sequence
atggtgctggccggccccctggccgtgagcctgctgctgcccagcctgaccctgctggtgagccacctgagcagcagccaggacgtgagcagcgagcccagcagcgagcagcagctgtgcgccctgagcaagcaccccaccgtggccttcgaggacctgcagccctgggtgagcaacttcacctaccccggcgccagagacttcagccagctggccctggaccccagcggcaaccagctgatcgtgggcgccagaaactacctgttcagactgagcctggccaacgtgagcctgctgcaggccaccgagtgggccagcagcgaggacaccagaagaagctgccagagcaagggcaagaccgaggaggagtgccagaactacgtgagagtgctgatcgtggccggcagaaaggtgttcatgtgcggcaccaacgccttcagccccatgtgcaccagcagacaggtgggcaacctgagcagaaccatcgagaagatcaacggcgtggccagatgcccctacgaccccagacacaacagcaccgccgtgatcagcagccagggcgagctgtacgccgccaccgtgatcgacttcagcggcagagaccccgccatctacagaagcctgggcagcggcccccccctgagaaccgcccagtacaacagcaagtggctgaacgagcccaacttcgtggccgcctacgacatcggcctgttcgcctacttcttcctgagagagaacgccgtggagcacgactgcggcagaaccgtgtacagcagagtggccagagtgtgcaagaacgacgtgggcggcagattcctgctggaggacacctggaccaccttcatgaaggccagactgaactgcagcagacccggcgaggtgcccttctactacaacgagctgcagagcgccttccacctgcccgagcaggacctgatctacggcgtgttcaccaccaacgtgaacagcatcgccgccagcgccgtgtgcgccttcaacctgagcgccatcagccaggccttcaacggccccttcagataccaggagaaccccagagccgcctggctgcccatcgccaaccccatccccaacttccagtgcggcaccctgcccgagaccggccccaacgagaacctgaccgagagaagcctgcaggacgcccagagactgttcctgatgagcgaggccgtgcagcccgtgacccccgagccctgcgtgacccaggacagcgtgagattcagccacctggtggtggacctggtgcaggccaaggacaccctgtaccacgtgctgtacatcggcaccgagagcggcaccatcctgaaggccctgagcaccgccagcagaagcctgcacggctgctacctggaggagctgcacgtgctgccccccggcagaagagagcccctgagaagcctgagaatcctgcacagcgccagagccctgttcgtgggcctgagagacggcgtgctgagagtgcccctggagagatgcgccgcctacagaagccagggcgcctgcctgggcgccagagacccctactgcggctgggacggcaagcagcagagatgcagcaccctggaggacagcagcaacatgagcctgtggacccagaacatcaccgcctgccccgtgagaaacgtgaccagagacggcggcttcggcccctggagcccctggcagccctgcgagcacctggacggcgacaacagcggcagctgcctgtgcagagccagaagctgcgacagccccagacccagatgcggcggcctggactgcctgggccccgccatccacatcgccaactgcagcagaaacggcgcctggaccccctggagcagctgggccctgtgcagcaccagctgcggcatcggcttccaggtgagacagagaagctgcagcaaccccgcccccagacacggcggcagaatctgcgtgggcaagagcagagaggagagattctgcaacgagaacaccccctgccccgtgcccatcttctgggccagctggggcagctggagcaagtgcagcagcaactgcggcggcggcatgcagagcagaagaagagcctgcgagaacggcaacagctgcctgggctgcggcgtggagttcaagacctgcaaccccgagggctgccccgaggtgagaagaaacaccccctggaccccctggctgcccgtgaacgtgacccagggcggcgccagacaggagcagagattcagattcacctgcagagcccccctggccgacccccacggcctgcagttcggcagaagaagaaccgagaccagaacctgccccgccgacggcagcggcagctgcgacaccgacgccctggtggaggtgctgctgagaagcggcagcaccagcccccacaccgtgagcggcggctgggccgcctggggcccctggagcagctgcagcagagactgcgagctgggcttcagagtgagaaagagaacctgcaccaaccccgagcccagaaacggcggcctgccctgcgtgggcgacgccgccgagtaccaggactgcaacccccaggcctgccccggcgaggacatctgcctgggcctgcacaccgaggaggccctgtgcgccacccaggcctgccccgagggctggagcccctggagcgagtggagcaagtgcaccgacgacggcgcccagagcagaagcagacactgcgaggagctgctgcccggcagcagcgcctgcgccggcaacagcagccagagcagaccctgcccctacagcgagatccccgtgatcctgcccgccagcagcatggaggaggccaccgactgcgccggcttcaacctgatccacctggtggccaccggcatcagctgcttcctgggcagcggcctgctgaccctggccgtgtacctgagctgccagcactgccagagacagagccaggagagcaccctggtgcaccccgccacccccaaccacctgcactacaagggcggcggcacccccaagaacgagaagtacacccccatggagttcaagaccctgaacaagaacaacctgatccccgacgacagagccaacttctaccccctgcagcagaccaacgtgtacaccaccacctactaccccagccccctgaacaagcacagcttcagacccgaggccagccccggccagagatgcttccccaacagctag

SEQ ID NO: 21912 - DNA, 429 bp, Artificial Sequence
  Description of Artificial Sequence: Synthetic coding sequence
atgccctgcggcttcagccccagccccgtggcccaccacctggtgcccggcccccccgacacccccgcccagcagctgagatgcggctggaccgtgggcggctggctgctgagcctggtgagaggcctgctgccctgcctgccccccggcgccagaaccgccgagggccccatcatggtgctggccggccccctggccgtgagcctgctgctgcccagcctgaccctgctggtgagccacctgagcagcagccaggacgtgagcagcgagcccagcagcgagcagcagctgtgcgccctgagcaagcaccccaccgtggccttcgaggacctgcagccctgggtgagcaacttcacctaccccggcgccagagacttcagccagctggccctggaccccagcggcaaccagctgatcgtgggcgcctag

SEQ ID NO: 21913 - DNA, 255 bp, Artificial Sequence
  Description of Artificial Sequence: Synthetic coding sequence
atgccctgcggcttcagccccagccccgtggcccaccacctggtgcccggcccccccgacacccccgcccagcagctgagatgcggctggaccgtgggcggctggctgctgagcctggtgagaggcctgctgccctgcctgccccccggcgccagaaccgccgagggccccatcatggtgctggccggccccctggccgtgagcctgctgctgcccagcctgaccctgctggtgagccacctgagcagcagctag

SEQ ID NO: 21914 - DNA, 3618 bp, Artificial Sequence
  Description of Artificial Sequence: Synthetic coding sequence
atgctgcacctgagcgccgaggaggccatcggctgcgtgagagtgagaagaagcttcatcgacgagctggccttcggcagaggccacagcaccggcaccggcaagcagaagagaagagacagagtgagcggcagcagctggtgcctggcctgcgtgagctggatgccctgcggcttcagccccagccccgtggcccaccacctggtgcccggcccccccgacacccccgcccagcagctgagatgcggctggaccgtgggcggctggctgctgagcctggtgagaggcctgctgccctgcctgccccccggcgccagaaccgccgagggccccatcatggtgctggccggccccctggccgtgagcctgctgctgcccagcctgaccctgctggtgagccacctgagcagcagccaggacgtgagcagcgagcccagcagcgagcagcagctgtgcgccctgagcaagcaccccaccgtggccttcgaggacctgcagccctgggtgagcaacttcacctaccccggcgccagagacttcagccagctggccctggaccccagcggcaaccagctgatcgtgggcgccagaaactacctgttcagactgagcctggccaacgtgagcctgctgcaggccaccgagtgggccagcagcgaggacaccagaagaagctgccagagcaagggcaagaccgaggaggagtgccagaactacgtgagagtgctgatcgtggccggcagaaaggtgttcatgtgcggcaccaacgccttcagccccatgtgcaccagcagacaggtgggcaacctgagcagaaccatcgagaagatcaacggcgtggccagatgcccctacgaccccagacacaacagcaccgccgtgatcagcagccagggcgagctgtacgccgccaccgtgatcgacttcagcggcagagaccccgccatctacagaagcctgggcagcggcccccccctgagaaccgcccagtacaacagcaagtggctgaacgagcccaacttcgtggccgcctacgacatcggcctgttcgcctacttcttcctgagagagaacgccgtggagcacgactgcggcagaaccgtgtacagcagagtggccagagtgtgcaagaacgacgtgggcggcagattcctgctggaggacacctggaccaccttcatgaaggccagactgaactgcagcagacccggcgaggtgcccttctactacaacgagctgcagagcgccttccacctgcccgagcaggacctgatctacggcgtgttcaccaccaacgtgaacagcatcgccgccagcgccgtgtgcgccttcaacctgagcgccatcagccaggccttcaacggccccttcagataccaggagaaccccagagccgcctggctgcccatcgccaaccccatccccaacttccagtgcggcaccctgcccgagaccggccccaacgagaacctgaccgagagaagcctgcaggacgcccagagactgttcctgatgagcgaggccgtgcagcccgtgacccccgagccctgcgtgacccaggacagcgtgagattcagccacctggtggtggacctggtgcaggccaaggacaccctgtaccacgtgctgtacatcggcaccgagagcggcaccatcctgaaggccctgagcaccgccagcagaagcctgcacggctgctacctggaggagctgcacgtgctgccccccggcagaagagagcccctgagaagcctgagaatcctgcacagcgccagagccctgttcgtgggcctgagagacggcgtgctgagagtgcccctggagagatgcgccgcctacagaagccagggcgcctgcctgggcgccagagacccctactgcggctgggacggcaagcagcagagatgcagcaccctggaggacagcagcaacatgagcctgtggacccagaacatcaccgcctgccccgtgagaaacgtgaccagagacggcggcttcggcccctggagcccctggcagccctgcgagcacctggacggcgacaacagcggcagctgcctgtgcagagccagaagctgcgacagccccagacccagatgcggcggcctggactgcctgggccccgccatccacatcgccaactgcagcagaaacggcgcctggaccccctggagcagctgggccctgtgcagcaccagctgcggcatcggcttccaggtgagacagagaagctgcagcaaccccgcccccagacacggcggcagaatctgcgtgggcaagagcagagaggagagattctgcaacgagaacaccccctgccccgtgcccatcttctgggccagctggggcagctggagcaagtgcagcagcaactgcggcggcggcatgcagagcagaagaagagcctgcgagaacggcaacagctgcctgggctgcggcgtggagttcaagacctgcaaccccgagggctgccccgaggtgagaagaaacaccccctggaccccctggctgcccgtgaacgtgacccagggcggcgccagacaggagcagagattcagattcacctgcagagcccccctggccgacccccacggcctgcagttcggcagaagaagaaccgagaccagaacctgccccgccgacggcagcggcagctgcgacaccgacgccctggtggaggtgctgctgagaagcggcagcaccagcccccacaccgtgagcggcggctgggccgcctggggcccctggagcagctgcagcagagactgcgagctgggcttcagagtgagaaagagaacctgcaccaaccccgagcccagaaacggcggcctgccctgcgtgggcgacgccgccgagtaccaggactgcaacccccaggcctgccccgtgagaggcgcctggagctgctggaccagctggagcccctgcagcgccagctgcggcggcggccactaccagagaaccagaagctgcaccagccccgcccccagccccggcgaggacatctgcctgggcctgcacaccgaggaggccctgtgcgccacccaggcctgccccgagggctggagcccctggagcgagtggagcaagtgcaccgacgacggcgcccagagcagaagcagacactgcgaggagctgctgcccggcagcagcgcctgcgccggcaacagcagccagagcagaccctgcccctacagcgagatccccgtgatcctgcccgccagcagcatggaggaggccaccgactgcgccggcttcaacctgatccacctggtggccaccggcatcagctgcttcctgggcagcggcctgctgaccctggccgtgtacctgagctgccagcactgccagagacagagccaggagagcaccctggtgcaccccgccacccccaaccacctgcactacaagggcggcggcacccccaagaacgagaagtacacccccatggagttcaagaccctgaacaagaacaacctgatccccgacgacagagccaacttctaccccctgcagcagaccaacgtgtacaccaccacctactaccccagccccctgaacaagcacagcttcagacccgaggccagccccggccagagatgcttccccaacagctag

SEQ ID NO: 21915 - DNA, 3144 bp, Artificial Sequence
  Description of Artificial Sequence: Synthetic coding sequence
atgagaagcgaggccctgctgctgtacttcaccctgctgcacttcgccggcgccggcttccccgaggacagcgagcccatcagcatcagccacggcaactacaccaagcagtaccccgtgttcgtgggccacaagcccggcagaaacaccacccagagacacagactggacatccagatgatcatgatcatgaacggcaccctgtacatcgccgccagagaccacatctacaccgtggacatcgacaccagccacaccgaggagatctactgcagcaagaagctgacctggaagagcagacaggccgacgtggacacctgcagaatgaagggcaagcacaaggacgagtgccacaacttcatcaaggtgctgctgaagaagaacgacgacgccctgttcgtgtgcggcaccaacgccttcaaccccagctgcagaaactacaagatggacaccctggagcccttcggcgacgagttcagcggcatggccagatgcccctacgacgccaagcacgccaacgtggccctgttcgccgacggcaagctgtacagcgccaccgtgaccgacttcctggccatcgacgccgtgatctacagaagcctgggcgagagccccaccctgagaaccgtgaagcacgacagcaagtggctgaaggagccctacttcgtgcaggccgtggactacggcgactacatctacttcttcttcagagagatcgccgtggagtacaacaccatgggcaaggtggtgttccccagagtggcccaggtgtgcaagaacgacatgggcggcagccagagagtgctggagaagcagtggaccagcttcctgaaggccagactgaactgcagcgtgcccggcgacagccacttctacttcaacatcctgcaggccgtgaccgacgtgatcagaatcaacggcagagacgtggtgctggccaccttcagcaccccctacaacagcatccccggcagcgccgtgtgcgcctacgacatgctggacatcgccagcgtgttcaccggcagattcaaggagcagaagagccccgacagcacctggacccccgtgcccgacgagagagtgcccaagcccagacccggctgctgcgccggcagcagcagcctggagagatacgccaccagcaacgagttccccgacgacaccctgaacttcatcaagacccaccccctgatggacgaggccgtgcccagcatcttcaacagaccctggttcctgagaaccatggtgagatacagactgaccaagatcgccgtggacaccgccgccggcccctaccagaaccacaccgtggtgttcctgggcagcgagaagggcatcatcctgaagttcctggccagaatcggcaacagcggcttcctgaacgacagcctgttcctggaggagatgagcgtgtacaacagcgagaagtgcagctacgacggcgtggaggacaagagaatcatgggcatgcagctggacagagccagcagcagcctgtacgtggccttcagcacctgcgtgatcaaggtgcccctgggcagatgcgagagatacggcaagtgcaagaagacctgcatcgccagcagagacccctactgcggctggatcaaggagggcggcgcctgcagccacctgagccccaacagcagactgaccttcgagcaggacatcgagagaggcaacaccgacggcctgggcgactgccacaacagcttcgtggccctgaacgacatcagcacccccctgcccgacaacgagatgagctacaacaccgtgtacggccacagcagcagcctgctgcccagcaccaccaccagcgacagcaccgcccaggagggctacgagagcagaggcggcatgctggactggaagcacctgctggacagccccgacagcaccgaccccctgggcgccgtgagcagccacaaccaccaggacaagaagggcgtgatcagagagagctacctgaagggccacgaccagctggtgcccgtgaccctgctggccatcgccgtgatcctggccttcgtgatgggcgccgtgttcagcggcatcaccgtgtactgcgtgtgcgaccacagaagaaaggacgtggccgtggtgcagagaaaggagaaggagctgacccacagcagaagaggcagcatgagcagcgtgaccaagctgagcggcctgttcggcgacacccagagcaaggaccccaagcccgaggccatcctgacccccctgatgcacaacggcaagctggccacccccggcaacaccgccaagatgctgatcaaggccgaccagcaccacctggacctgaccgccctgcccacccccgagagcacccccaccctgcagcagaagagaaagcccagcagaggcagcagagagtgggagagaaaccagaacctgatcaacgcctgcaccaaggacatgccccccatgggcagccccgtgatccccaccgacctgcccctgagagccagccccagccacatccccagcgtggtggtgctgcccatcacccagcagggctaccagcacgagtacgtggaccagcccaagatgagcgaggtggcccagatggccctggaggaccaggccgccaccctggagtacaagaccatcaaggagcacctgagcagcaagagccccaaccacggcgtgaacctggtggagaacctggacagcctgccccccaaggtgccccagagagaggccagcctgggcccccccggcgccagcctgagccagaccggcctgagcaagagactggagatgcaccacagcagcagctacggcgtggactacaagagaagctaccccaccaacagcctgaccagaagccaccaggccaccaccctgaagagaaacaacaccaacagcagcaacagcagccacctgagcagaaaccagagcttcggcagaggcgacaaccccccccccgccccccagagagtggacagcatccaggtgcacagcagccagcccagcggccaggccgtgaccgtgagcagacagcccagcctgaacgcctacaacagcctgaccagaagcggcctgaagagaacccccagcctgaagcccgacgtgccccccaagcccagcttcgcccccctgagcaccagcatgaagcccaacgacgcctgcacctag

SEQ ID NO: 21916 - DNA, 1524 bp, Artificial Sequence
  Description of Artificial Sequence: Synthetic coding sequence
atgagcgtgtacaacagcgagaagtgcagctacgacggcgtggaggacaagagaatcatgggcatgcagctggacagagccagcagcagcctgtacgtggccttcagcacctgcgtgatcaaggtgcccctgggcagatgcgagagatacggcaagtgcaagaagacctgcatcgccagcagagacccctactgcggctggatcaaggagggcggcgcctgcagccacctgagccccaacagcagactgaccttcgagcaggacatcgagagaggcaacaccgacggcctgggcgactgccacaacagcttcgtggccctgaacggcgtgatcagagagagctacctgaagggccacgaccagctggtgcccgtgaccctgctggccatcgccgtgatcctggccttcgtgatgggcgccgtgttcagcggcatcaccgtgtactgcgtgtgcgaccacagaagaaaggacgtggccgtggtgcagagaaaggagaaggagctgacccacagcagaagaggcagcatgagcagcgtgaccaagctgagcggcctgttcggcgacacccagagcaaggaccccaagcccgaggccatcctgacccccctgatgcacaacggcaagctggccacccccggcaacaccgccaagatgctgatcaaggccgaccagcaccacctggacctgaccgccctgcccacccccgagagcacccccaccctgcagcagaagagaaagcccagcagaggcagcagagagtgggagagaaaccagaacctgatcaacgcctgcaccaaggacatgccccccatgggcagccccgtgatccccaccgacctgcccctgagagccagccccagccacatccccagcgtggtggtgctgcccatcacccagcagggctaccagcacgagtacgtggaccagcccaagatgagcgaggtggcccagatggccctggaggaccaggccgccaccctggagtacaagaccatcaaggagcacctgagcagcaagagccccaaccacggcgtgaacctggtggagaacctggacagcctgccccccaaggtgccccagagagaggccagcctgggcccccccggcgccagcctgagccagaccggcctgagcaagagactggagatgcaccacagcagcagctacggcgtggactacaagagaagctaccccaccaacagcctgaccagaagccaccaggccaccaccctgaagagaaacaacaccaacagcagcaacagcagccacctgagcagaaaccagagcttcggcagaggcgacaaccccccccccgccccccagagagtggacagcatccaggtgcacagcagccagcccagcggccaggccgtgaccgtgagcagacagcccagcctgaacgcctacaacagcctgaccagaagcggcctgaagagaacccccagcctgaagcccgacgtgccccccaagcccagcttcgcccccctgagcaccagcatgaagcccaacgacgcctgcacctag

SEQ ID NO: 21917 - DNA, 3093 bp, Artificial Sequence
  Description of Artificial Sequence: Synthetic coding sequence
atgagaagcgaggccctgctgctgtacttcaccctgctgcacttcgccggcgccggcttccccgaggacagcgagcccatcagcatcagccacggcaactacaccaagcagtaccccgtgttcgtgggccacaagcccggcagaaacaccacccagagacacagactggacatccagatgatcatgatcatgaacggcaccctgtacatcgccgccagagaccacatctacaccgtggacatcgacaccagccacaccgaggagatctactgcagcaagaagctgacctggaagagcagacaggccgacgtggacacctgcagaatgaagggcaagcacaaggacgagtgccacaacttcatcaaggtgctgctgaagaagaacgacgacgccctgttcgtgtgcggcaccaacgccttcaaccccagctgcagaaactacaagatggacaccctggagcccttcggcgacgagttcagcggcatggccagatgcccctacgacgccaagcacgccaacgtggccctgttcgccgacggcaagctgtacagcgccaccgtgaccgacttcctggccatcgacgccgtgatctacagaagcctgggcgagagccccaccctgagaaccgtgaagcacgacagcaagtggctgaaggagccctacttcgtgcaggccgtggactacggcgactacatctacttcttcttcagagagatcgccgtggagtacaacaccatgggcaaggtggtgttccccagagtggcccaggtgtgcaagaacgacatgggcggcagccagagagtgctggagaagcagtggaccagcttcctgaaggccagactgaactgcagcgtgcccggcgacagccacttctacttcaacatcctgcaggccgtgaccgacgtgatcagaatcaacggcagagacgtggtgctggccaccttcagcaccccctacaacagcatccccggcagcgccgtgtgcgcctacgacatgctggacatcgccagcgtgttcaccggcagattcaaggagcagaagagccccgacagcacctggacccccgtgcccgacgagagagtgcccaagcccagacccggctgctgcgccggcagcagcagcctggagagatacgccaccagcaacgagttccccgacgacaccctgaacttcatcaagacccaccccctgatggacgaggccgtgcccagcatcttcaacagaccctggttcctgagaaccatggtgagatacagactgaccaagatcgccgtggacaccgccgccggcccctaccagaaccacaccgtggtgttcctgggcagcgagaagggcatcatcctgaagttcctggccagaatcggcaacagcggcttcctgaacgacagcctgttcctggaggagatgagcgtgtacaacagcgagaagtgcagctacgacggcgtggaggacaagagaatcatgggcatgcagctggacagagccagcagcagcctgtacgtggccttcagcacctgcgtgatcaaggtgcccctgggcagatgcgagagatacggcaagtgcaagaagacctgcatcgccagcagagacccctactgcggctggatcaaggagggcggcgcctgcagccacctgagccccaacagcagactgaccttcgagcaggacatcgagagaggcaacaccgacggcctgggcgactgccacaacagcttcgtggccctgaacggccacagcagcagcctgctgcccagcaccaccaccagcgacagcaccgcccaggagggctacgagagcagaggcggcatgctggactggaagcacctgctggacagccccgacagcaccgaccccctgggcgccgtgagcagccacaaccaccaggacaagaagggcgtgatcagagagagctacctgaagggccacgaccagctggtgcccgtgaccctgctggccatcgccgtgatcctggccttcgtgatgggcgccgtgttcagcggcatcaccgtgtactgcgtgtgcgaccacagaagaaaggacgtggccgtggtgcagagaaaggagaaggagctgacccacagcagaagaggcagcatgagcagcgtgaccaagctgagcggcctgttcggcgacacccagagcaaggaccccaagcccgaggccatcctgacccccctgatgcacaacggcaagctggccacccccggcaacaccgccaagatgctgatcaaggccgaccagcaccacctggacctgaccgccctgcccacccccgagagcacccccaccctgcagcagaagagaaagcccagcagaggcagcagagagtgggagagaaaccagaacctgatcaacgcctgcaccaaggacatgccccccatgggcagccccgtgatccccaccgacctgcccctgagagccagccccagccacatccccagcgtggtggtgctgcccatcacccagcagggctaccagcacgagtacgtggaccagcccaagatgagcgaggtggcccagatggccctggaggaccaggccgccaccctggagtacaagaccatcaaggagcacctgagcagcaagagccccaaccacggcgtgaacctggtggagaacctggacagcctgccccccaaggtgccccagagagaggccagcctgggcccccccggcgccagcctgagccagaccggcctgagcaagagactggagatgcaccacagcagcagctacggcgtggactacaagagaagctaccccaccaacagcctgaccagaagccaccaggccaccaccctgaagagaaacaacaccaacagcagcaacagcagccacctgagcagaaaccagagcttcggcagaggcgacaaccccccccccgccccccagagagtggacagcatccaggtgcacagcagccagcccagcggccaggccgtgaccgtgagcagacagcccagcctgaacgcctacaacagcctgaccagaagcggcctgaagagaacccccagcctgaagcccgacgtgccccccaagcccagcttcgcccccctgagcaccagcatgaagcccaacgacgcctgcacctag

SEQ ID NO: 21918 - DNA, 1230 bp, Artificial Sequence
  Description of Artificial Sequence: Synthetic coding sequence
atgaagaacgccagccccgagaccagagagggcgtgatcagagagagctacctgaagggccacgaccagctggtgcccgtgaccctgctggccatcgccgtgatcctggccttcgtgatgggcgccgtgttcagcggcatcaccgtgtactgcgtgtgcgaccacagaagaaaggacgtggccgtggtgcagagaaaggagaaggagctgacccacagcagaagaggcagcatgagcagcgtgaccaagctgagcggcctgttcggcgacacccagagcaaggaccccaagcccgaggccatcctgacccccctgatgcacaacggcaagctggccacccccggcaacaccgccaagatgctgatcaaggccgaccagcaccacctggacctgaccgccctgcccacccccgagagcacccccaccctgcagcagaagagaaagcccagcagaggcagcagagagtgggagagaaaccagaacctgatcaacgcctgcaccaaggacatgccccccatgggcagccccgtgatccccaccgacctgcccctgagagccagccccagccacatccccagcgtggtggtgctgcccatcacccagcagggctaccagcacgagtacgtggaccagcccaagatgagcgaggtggcccagatggccctggaggaccaggccgccaccctggagtacaagaccatcaaggagcacctgagcagcaagagccccaaccacggcgtgaacctggtggagaacctggacagcctgccccccaaggtgccccagagagaggccagcctgggcccccccggcgccagcctgagccagaccggcctgagcaagagactggagatgcaccacagcagcagctacggcgtggactacaagagaagctaccccaccaacagcctgaccagaagccaccaggccaccaccctgaagagaaacaacaccaacagcagcaacagcagccacctgagcagaaaccagagcttcggcagaggcgacaaccccccccccgccccccagagagtggacagcatccaggtgcacagcagccagcccagcggccaggccgtgaccgtgagcagacagcccagcctgaacgcctacaacagcctgaccagaagcggcctgaagagaacccccagcctgaagcccgacgtgccccccaagcccagcttcgcccccctgagcaccagcatgaagcccaacgacgcctgcacctag

SEQ ID NO: 21919 - DNA, 345 bp, Artificial Sequence
  Description of Artificial Sequence: Synthetic coding sequence
atgagaagcgaggccctgctgctgtacttcaccctgctgcacttcgccggcgccggcttccccgaggacagcgagcccatcagcatcagccacggcaactacaccaagcagtaccccgtgttcgtgggccacaagcccggcagaaacaccacccagagacacagactggacatccagatgatcatgatcatgaacggcaccctgtacatcgccgccagagaccacatctacaccgtggacatcgacaccagccacaccgaggagatctactgcagcaagaagctgacctggaagagcagacaggccgacgtggacacctgcagaatgaagggcaagcacaagtag

SEQ ID NO: 21920 - DNA, 3093 bp, Artificial Sequence; identical to SEQ ID NO: 21917
  Description of Artificial Sequence: Synthetic coding sequence

SEQ ID NO: 21921 - DNA, 1374 bp, Artificial Sequence
  Description of Artificial Sequence: Synthetic coding sequence
atgaagaccggccacagcagcagcctgctgcccagcaccaccaccagcgacagcaccgcccaggagggctacgagagcagaggcggcatgctggactggaagcacctgctggacagccccgacagcaccgaccccctgggcgccgtgagcagccacaaccaccaggacaagaagggcgtgatcagagagagctacctgaagggccacgaccagctggtgcccgtgaccctgctggccatcgccgtgatcctggccttcgtgatgggcgccgtgttcagcggcatcaccgtgtactgcgtgtgcgaccacagaagaaaggacgtggccgtggtgcagagaaaggagaaggagctgacccacagcagaagaggcagcatgagcagcgtgaccaagctgagcggcctgttcggcgacacccagagcaaggaccccaagcccgaggccatcctgacccccctgatgcacaacggcaagctggccacccccggcaacaccgccaagatgctgatcaaggccgaccagcaccacctggacctgaccgccctgcccacccccgagagcacccccaccctgcagcagaagagaaagcccagcagaggcagcagagagtgggagagaaaccagaacctgatcaacgcctgcaccaaggacatgccccccatgggcagccccgtgatccccaccgacctgcccctgagagccagccccagccacatccccagcgtggtggtgctgcccatcacccagcagggctaccagcacgagtacgtggaccagcccaagatgagcgaggtggcccagatggccctggaggaccaggccgccaccctggagtacaagaccatcaaggagcacctgagcagcaagagccccaaccacggcgtgaacctggtggagaacctggacagcctgccccccaaggtgccccagagagaggccagcctgggcccccccggcgccagcctgagccagaccggcctgagcaagagactggagatgcaccacagcagcagctacggcgtggactacaagagaagctaccccaccaacagcctgaccagaagccaccaggccaccaccctgaagagaaacaacaccaacagcagcaacagcagccacctgagcagaaaccagagcttcggcagaggcgacaaccccccccccgccccccagagagtggacagcatccaggtgcacagcagccagcccagcggccaggccgtgaccgtgagcagacagcccagcctgaacgcctacaacagcctgaccagaagcggcctgaagagaacccccagcctgaagcccgacgtgccccccaagcccagcttcgcccccctgagcaccagcatgaagcccaacgacgcctgcacctag

SEQ ID NO: 21922 - DNA, 480 bp, Artificial Sequence
  Description of Artificial Sequence: Synthetic coding sequence
atgagaagcgaggccctgctgctgtacttcaccctgctgcacttcgccggcgccggcttccccgaggacagcgagcccatcagcatcagccacggcaactacaccaagcagtaccccgtgttcgtgggccacaagcccggcagaaacaccacccagagacacagactggacatccagatgatcatgatcatgaacggcaccctgtacatcgccgccagagaccacatctacaccgtggacatcgacaccagccacaccgaggagatctactgcagcaagaagctgacctggaagagcagacaggccgacgtggacacctgcagaatgaagggcaagcacaaggacgagtgccacaacttcatcaaggtgctgctgaagaagaacgacgacgccctgttcgtgtgcggcaccaacgccttcaaccccagctgcagaaactacaagatggacaccctggagcccttcggcgacgagttctag

SEQ ID NO: 21923 - DNA, 2049 bp, Artificial Sequence
  Description of Artificial Sequence: Synthetic coding sequence
atgcagacccccagagccagcccccccagacccgccctgctgctgctgctgctgctgctgggcggcgcccacggcctgttccccgaggagcccccccccctgagcgtggcccccagagactacctgaaccactaccccgtgttcgtgggcagcggccccggcagactgacccccgccgagggcgccgacgacctgaacatccagagagtgctgagagtgaacagaaccctgttcatcggcgacagagacaacctgtacagagtggagctggagccccccaccagcaccgagctgagataccagagaaagctgacctggagaagcaaccccagcgacatcaacgtgtgcagaatgaagggcaagcaggagggcgagtgcagaaacttcgtgaaggtgctgctgctgagagacgagagcaccctgttcgtgtgcggcagcaacgccttcaaccccgtgtgcgccaactacagcatcgacaccctgcagcccgtgggcgacaacatcagcggcatggccagatgcccctacgaccccaagcacgccaacgtggccctgttcagcgacggcatgctgttcaccgccaccgtgaccgacttcctggccatcgacgccgtgatctacagaagcctgggcgacagacccaccctgagaaccgtgaagcacgacagcaagtggttcaaggagccctacttcgtgcacgccgtggagtggggcagccacgtgtacttcttcttcagagagatcgccatggagttcaactacctggagaaggtggtggtgagcagagtggccagagtgtgcaagaacgacgtgggcggcagccccagagtgctggagaagcagtggaccagcttcctgaaggccagactgaactgcagcgtgcccggcgacagccacttctacttcaacgtgctgcaggccgtgaccggcgtggtgagcctgggcggcagacccgtggtgctggccgtgttcagcacccccagcaacagcatccccggcagcgccgtgtgcgccttcgacctgacccaggtggccgccgtgttcgagggcagattcagagagcagaagagccccgagagcatctggacccccgtgcccgaggaccaggtgcccagacccagacccggctgctgcgccgcccccggcatgcagtacaacgccagcagcgccctgcccgacgacatcctgaacttcgtgaagacccaccccctgatggacgaggccgtgcccagcctgggccacgccccctggatcctgagaaccctgatgagacaccagctgaccagagtggccgtggacgtgggcgccggcccctggggcaaccagaccgtggtgttcctgggcagcgaggccggcaccgtgctgaagttcctggtgagacccaacgccagcaccagcggcaccagcggcctgagcgtgttcctggaggagttcgagacctacagacccgacagatgcggcagacccggcggcggcgagaccggccagagactgctgagcctggagctggacgccgccagcggcggcctgctggccgccttccccagatgcgtggtgagagtgcccgtggccagatgccagcagtacagcggctgcatgaagaactgcatcggcagccaggacccctactgcggctgggcccccgacggcagctgcatcttcctgagccccggcaccagagccgccttcgagcaggacgtgagcggcgccagcaccagcggcctgggcgactgcaccggcctgctgagagccagcctgagcgaggacagagccggcctggtgagcgtgaacctgctggtgaccagcagcgtggccgccttcgtggtgggcgccgtggtgagcggcttcagcgtgggctggttcgtgggcctgagagagagaagagagctggccagaagaaaggacaaggaggccatcctggcccacggcgccggcgaggccgtgctgagcgtgagcagactgggcgagagaagagcccagggccccggcagcagaagatggggcttccagaaggccagaggcagccccagatgcagactgggcgtgtag

SEQ ID NO: 21924 - DNA, 2667 bp, Artificial Sequence; identical to SEQ ID NO: 21872
  Description of Artificial Sequence: Synthetic coding sequence

SEQ ID NO: 21925 - DNA, 2793 bp, Artificial Sequence
  Description of Artificial Sequence: Synthetic coding sequence
atgcccagagccccccacttcatgcccctgctgctgctgctgctgctgctgagcctgccccacacccaggccgccttcccccaggaccccctgcccctgctgatcagcgacctgcagggcaccagccccctgagctggttcagaggcctggaggacgacgccgtggccgccgagctgggcctggacttccagagattcctgaccctgaacagaaccctgctggtggccgccagagaccacgtgttcagcttcgacctgcaggccgaggaggagggcgagggcctggtgcccaacaagtacctgacctggagaagccaggacgtggagaactgcgccgtgagaggcaagctgaccgacgagtgctacaactacatcagagtgctggtgccctgggacagccagaccctgctggcctgcggcaccaacagcttcagccccgtgtgcagaagctacggcatcaccagcctgcagcaggagggcgaggagctgagcggccaggccagatgccccttcgacgccacccagagcaacgtggccatcttcgccgagggcagcctgtacagcgccaccgccgccgacttccaggccagcgacgccgtggtgtacagaagcctgggcccccagccccccctgagaagcgccaagtacgacagcaagtggctgagagagccccacttcgtgcaggccctggagcacggcgaccacgtgtacttcttcttcagagaggtgagcgtggaggacgccagactgggcagagtgcagttcagcagagtggccagagtgtgcaagagagacatgggcggcagccccagagccctggacagacactggaccagcttcctgaagctgagactgaactgcagcgtgcccggcgacagcaccttctacttcgacgtgctgcaggccctgaccggccccgtgaacctgcacggcagaagcgccctgttcggcgtgttcaccacccagaccaacagcatccccggcagcgccgtgtgcgccttctacctggacgagatcgagagaggcttcgagggcaagttcaaggagcagagaagcctggacggcgcctggacccccgtgagcgaggacagagtgcccagccccagacccggcagctgcgccggcgtgggcggcgccgccctgttcagcagcagcagagacctgcccgacgacgtgctgaccttcatcaaggcccaccccctgctggaccccgccgtgccccccgtgacccaccagcccctgctgaccctgaccagcagagccctgctgacccaggtggccgtggacggcatggccggcccccacagcaacatcaccgtgatgttcctgggcagcaacgacggcaccgtgctgaaggtgctgacccccggcggcagaagcggcggccccgagcccatcctgctggaggagatcgacgcctacagccccgccagatgcagcggcaagagaaccgcccagaccgccagaagaatcatcggcctggagctggacaccgagggccacagactgttcgtggccttcagcggctgcatcgtgtacctgcccctgagcagatgcgccagacacggcgcctgccagagaagctgcctggccagccaggacccctactgcggctggcacagcagcagaggctgcgtggacatcagaggcagcggcggcaccgacgtggaccaggccggcaaccaggagagcatggagcacggcgactgccaggacggcgccaccggcagccagagcggccccggcgacagcgcctacggcgtgagaagagacctgccccccgccagcgccagcagaagcgtgcccatccccctgctgctggccagcgtggccgccgccttcgccctgggcgccagcgtgagcggcctgctggtgagctgcgcctgcagaagagcccacagaagaagaggcaaggacatcgagacccccggcctgcccagacccctgagcctgagaagcctggccagactgcacggcggcggccccgagccccccccccccagcaaggacggcgacgccgtgcagaccccccagctgtacaccaccttcctgcccccccccgagggcgtgcccccccccgagctggcctgcctgcccacccccgagagcacccccgagctgcccgtgaagcacctgagagccgccggcgacccctgggagtggaaccagaacagaaacaacgccaaggagggccccggcagaagcagaggcggccacgccgccggcggccccgcccccagagtgctggtgagaccccccccccccggctgccccggccaggccgtggaggtgaccaccctggaggagctgctgagatacctgcacggcccccagccccccagaaagggcgccgagccccccgcccccctgaccagcagagccctgccccccgagcccgcccccgccctgctgggcggccccagccccagaccccacgagtgcgccagccccctgagactggacgtgccccccgagggcagatgcgccagcgcccccgccagacccgccctgagcgcccccgcccccagactgggcgtgggcggcggcagaagactgcccttcagcggccacagagccccccccgccctgctgaccagagtgcccagcggcggccccagcagatacagcggcggccccggcaagcacctgctgtacctgggcagacccgagggctacagaggcagagccctgaagagagtggacgtggagaagccccagctgagcctgaagccccccctggtgggccccagcagcagacaggccgtgcccaacggcggcagattcaacttctag

SEQ ID NO: 21926 - DNA, 2769 bp, Artificial Sequence
  Description of Artificial Sequence: Synthetic coding sequence
atgcccagagccccccacttcatgcccctgctgctgctgctgctgctgctgagcctgccccacacccaggccgccttcccccaggaccccctgcccctgctgatcagcgacctgcagggcaccagccccctgagctggttcagaggcctggaggacgacgccgtggccgccgagctgggcctggacttccagagattcctgaccctgaacagaaccctgctggtggccgccagagaccacgtgttcagcttcgacctgcaggccgaggaggagggcgagggcctggtgcccaacaagtacctgacctggagaagccaggacgtggagaactgcgccgtgagaggcaagctgaccgacgagtgctacaactacatcagagtgctggtgccctgggacagccagaccctgctggcctgcggcaccaacagcttcagccccgtgtgcagaagctacggcatcaccagcctgcagcaggagggcgaggagctgagcggccaggccagatgccccttcgacgccacccagagcaacgtggccatcttcgccgagccccacttcgtgcaggccctggagcacggcgaccacgtgtacttcttcttcagagaggtgagcgtggaggacgccagactgggcagagtgcagttcagcagagtggccagagtgtgcaagagagacatgggcggcagccccagagccctggacagacactggaccagcttcctgaagctgagactgaactgcagcgtgcccggcgacagcaccttctacttcgacgtgctgcaggccctgaccggccccgtgaacctgcacggcagaagcgccctgttcggcgtgttcaccacccagaccaacagcatccccggcagcgccgtgtgcgccttctacctggacgagatcgagagaggcttcgagggcaagttcaaggagcagagaagcctggacggcgcctggacccccgtgagcgaggacagagtgcccagccccagacccggcagctgcgccggcgtgggcggcgccgccctgttcagcagcagcagagacctgcccgacgacgtgctgaccttcatcaaggcccaccccctgctggaccccgccgtgccccccgtgacccaccagcccctgctgaccctgaccagcagagccctgctgacccaggtggccgtggacggcatggccggcccccacagcaacatcaccgtgatgttcctgggcagcaacgacggcaccgtgctgaaggtgctgacccccggcggcagaagcggcggccccgagcccatcctgctggaggagatcgacgcctacagccccgccagatgcagcggcaagagaaccgcccagaccgccagaagaatcatcggcctggagctggacaccgagggccacagactgttcgtggccttcagcggctgcatcgtgtacctgcccctgagcagatgcgccagacacggcgcctgccagagaagctgcctggccagccaggacccctactgcggctggcacagcagcagaggctgcgtggacatcagaggcagcggcggcaccgacgtggaccaggccggcaaccaggagagcatggagcacggcgactgccaggacggcgccaccggcagccagagcggccccggcgacagcgcctacgtgctgcccggccccggccccagccccggcacccccagcccccccagcgacgcccaccccagaccccagagcagcaccctgggcgtgcacaccagaggcgtgagaagagacctgccccccgccagcgccagcagaagcgtgcccatccccctgctgctggccagcgtggccgccgccttcgccctgggcgccagcgtgagcggcctgctggtgagctgcgcctgcagaagagcccacagaagaagaggcaaggacatcgagacccccggcctgcccagacccctgagcctgagaagcctggccagactgcacggcggcggccccgagccccccccccccagcaaggacggcgacgccgtgcagaccccccagctgtacaccaccttcctgcccccccccgagggcgtgcccccccccgagctggcctgcctgcccacccccgagagcacccccgagctgcccgtgaagcacctgagagccgccggcgacccctgggagtggaaccagaacagaaacaacgccaaggagggccccggcagaagcagaggcggccacgccgccggcggccccgcccccagagtgctggtgagaccccccccccccggctgccccggccaggccgtggaggtgaccaccctggaggagctgctgagatacctgcacggcccccagccccccagaaagggcgccgagccccccgcccccctgaccagcagagccctgccccccgagcccgcccccgccctgctgggcggccccagccccagaccccacgagtgcgccagccccctgagactggacgtgccccccgagggcagatgcgccagcgcccccgccagacccgccctgagcgcccccgcccccagactgggcgtgggcggcggcagaagactgcccttcagcggccacagagccccccccgccctgctgaccagagtgcccagcggcggccccagcagatacagcggcggccccggcaagcacctgctgtacctgggcagacccgagggctacagaggcagagccctgaagagagtggacgtggagaagccccagctgagcctgaagccccccctggtgggccccagcagcagacaggccgtgcccaacggcggcagattcaacttctag

SEQ ID NO: 21927 - DNA, 2889 bp, Artificial Sequence
  Description of Artificial Sequence: Synthetic coding sequence
atgcccagagccccccacttcatgcccctgctgctgctgctgctgctgctgagcctgccccacacccaggccgccttcccccaggaccccctgcccctgctgatcagcgacctgcagggcaccagccccctgagctggttcagaggcctggaggacgacgccgtggccgccgagctgggcctggacttccagagattcctgaccctgaacagaaccctgctggtggccgccagagaccacgtgttcagcttcgacctgcaggccgaggaggagggcgagggcctggtgcccaacaagtacctgacctggagaagccaggacgtggagaactgcgccgtgagaggcaagctgaccgacgagtgctacaactacatcagagtgctggtgccctgggacagccagaccctgctggcctgcggcaccaacagcttcagccccgtgtgcagaagctacggcatcaccagcctgcagcaggagggcgaggagctgagcggccaggccagatgccccttcgacgccacccagagcaacgtggccatcttcgccgagggcagcctgtacagcgccaccgccgccgacttccaggccagcgacgccgtggtgtacagaagcctgggcccccagccccccctgagaagcgccaagtacgacagcaagtggctgagagagccccacttcgtgcaggccctggagcacggcgaccacgtgtacttcttcttcagagaggtgagcgtggaggacgccagactgggcagagtgcagttcagcagagtggccagagtgtgcaagagagacatgggcggcagccccagagccctggacagacactggaccagcttcctgaagctgagactgaactgcagcgtgcccggcgacagcaccttctacttcgacgtgctgcaggccctgaccggccccgtgaacctgcacggcagaagcgccctgttcggcgtgttcaccacccagaccaacagcatccccggcagcgccgtgtgcgccttctacctggacgagatcgagagaggcttcgagggcaagttcaaggagcagagaagcctggacggcgcctggacccccgtgagcgaggacagagtgcccagccccagacccggcagctgcgccggcgtgggcggcgccgccctgttcagcagcagcagagacctgcccgacgacgtgctgaccttcatcaaggcccaccccctgctggaccccgccgtgccccccgtgacccaccagcccctgctgaccctgaccagcagagccctgctgacccaggtggccgtggacggcatggccggcccccacagcaacatcaccgtgatgttcctgggcagcaacgacggcaccgtgctgaaggtgctgacccccggcggcagaagcggcggccccgagcccatcctgctggaggagatcgacgcctacagccccgccagatgcagcggcaagagaaccgcccagaccgccagaagaatcatcggcctggagctggacaccgagggccacagactgttcgtggccttcagcggctgcatcgtgtacctgcccctgagcagatgcgccagacacggcgcctgccagagaagctgcctggccagccaggacccctactgcggctggcacagcagcagaggctgcgtggacatcagaggcagcggcggcaccgacgtggaccaggccggcaaccaggagagcatggagcacggcgactgccaggacggcgccaccggcagccagagcggccccggcgacagcgcctacgtgctgcccggccccggccccagccccggcacccccagcccccccagcgacgcccaccccagaccccagagcagcaccctgggcgtgcacaccagaggcgtgagaagagacctgccccccgccagcgccagcagaagcgtgcccatccccctgctgctggccagcgtggccgccgccttcgccctgggcgccagcgtgagcggcctgctggtgagctgcgcctgcagaagagcccacagaagaagaggcaaggacatcgagacccccggcctgcccagacccctgagcctgagaagcctggccagactgcacggcggcggccccgagccccccccccccagcaaggacggcgacgccgtgcagaccccccagctgtacaccaccttcctgcccccccccgagggcgtgcccccccccgagctggcctgcctgcccacccccgagagcacccccgagctgcccgtgaagcacctgagagccgccggcgacccctgggagtggaaccagaacagaaacaacgccaaggagggccccggcagaagcagaggcggccacgccgccggcggccccgcccccagagtgctggtgagaccccccccccccggctgccccggccaggccgtggaggtgaccaccctggaggagctgctgagatacctgcacggcccccagccccccagaaagggcgccgagccccccgcccccctgaccagcagagccctgccccccgagcccgcccccgccctgctgggcggccccagccccagaccccacgagtgcgccagccccctgagactggacgtgccccccgagggcagatgcgccagcgcccccgccagacccgccctgagcgcccccgcccccagactgggcgtgggcggcggcagaagactgcccttcagcggccacagagccccccccgccctgctgaccagagtgcccagcggcggccccagcagatacagcggcggccccggcaagcacctgctgtacctgggcagacccgagggctacagaggcagagccctgaagagagtggacgtggagaagccccagctgagcctgaagccccccctggtgggccccagcagcagacaggccgtgcccaacggcggcagattcaacttctag

SEQ ID NO: 21928 - DNA, 2793 bp, Artificial Sequence; identical to SEQ ID NO: 21925
  Description of Artificial Sequence: Synthetic coding sequence

SEQ ID NO: 21929 - DNA, 1614 bp, Artificial Sequence
  Description of Artificial Sequence: Synthetic coding sequence
atgcccagagccccccacttcatgcccctgctgctgctgctgctgctgctgagcctgccccacacccaggccgccttcccccaggaccccctgcccctgctgatcagcgacctgcagggcaccagccccctgagctggttcagaggcctggaggacgacgccgtggccgccgagctgggcctggacttccagagattcctgaccctgaacagaaccctgctggtggccgccagagaccacgtgttcagcttcgacctgcaggccgaggaggagggcgagggcctggtgcccaacaagtacctgacctggagaagccaggacgtggagaactgcgccgtgagaggcaagctgaccgacgagtgctacaactacatcagagtgctggtgccctgggacagccagaccctgctggcctgcggcaccaacagcttcagccccgtgtgcagaagctacggcatcaccagcctgcagcaggagggcgaggagctgagcggccaggccagatgccccttcgacgccacccagagcaacgtggccatcttcgccgagggcagcctgtacagcgccaccgccgccgacttccaggccagcgacgccgtggtgtacagaagcctgggcccccagccccccctgagaagcgccaagtacgacagcaagtggctgagagagccccacttcgtgcaggccctggagcacggcgaccacgtgtacttcttcttcagagaggtgagcgtggaggacgccagactgggcagagtgcagttcagcagagtggccagagtgtgcaagagagacatgggcggcagccccagagccctggacagacactggaccagcttcctgaagctgagactgaactgcagcgtgcccggcgacagcaccttctacttcgacgtgctgcaggccctgaccggccccgtgaacctgcacggcagaagcgccctgttcggcgtgttcaccacccagaccaacagcatccccggcagcgccgtgtgcgccttctacctggacgagatcgagagaggcttcgagggcaagttcaaggagcagagaagcctggacggcgcctggacccccgtgagcgaggacagagtgcccagccccagacccggcagctgccccgcccacagcagccccctgggcagaagcctgcaggtgctgagaggcagcagagaggccccccccgtgcccggccccgccagaggcctgcccggccccagacccgagaagggcggcagaagagaggcccccgtggtgcccgaggccagccccagaagagccctgctgccccccggcagacccgagagaagacccttccagctgctgaagggcgccgcccacggcctgcagagaggcgagagacccagccccctgggccacgagctggacgccctgcaggacgtgagccccccccccagacccgccccccccgccttccccaccagaagagtgagcagaggccccttcagccccagagtgtacctgctgaccgtgttcccccccgtgctggacagaagagtgggcggcgagaagcccgtgagcagcgtgagccagcacttcagaggcagctggagaacccccacccccagaagcctgcccgccaagctgccctag

SEQ ID NO: 21930 - DNA, 3222 bp, Artificial Sequence
  Description of Artificial Sequence: Synthetic coding sequence
atgagagtgttcctgctgtgcgcctacatcctgctgctgatggtgagccagctgagagccgtgagcttccccgaggacgacgagcccctgaacaccgtggactaccactacagcagacagtaccccgtgttcagaggcagacccagcggcaacgagagccagcacagactggacttccagctgatgctgaagatcagagacaccctgtacatcgccggcagagaccaggtgtacaccgtgaacctgaacgagatgcccaagaccgaggtgatccccaacaagaagctgacctggagaagcagacagcaggacagagagaactgcgccatgaagggcaagcacaaggacgagtgccacaacttcatcaaggtgttcgtgcccagaaacgacgagatggtgttcgtgtgcggcaccaacgccttcaaccccatgtgcagatactacagactgagcaccctggagtacgacggcgaggagatcagcggcctggccagatgccccttcgacgccagacagaccaacgtggccctgttcgccgacggcaagctgtacagcgccaccgtggccgacttcctggccagcgacgccgtgatctacagaagcatgggcgacggcagcgccctgagaaccatcaagtacgacagcaagtggatcaaggagccccacttcctgcacgccatcgagtacggcaactacgtgtacttcttcttcagagagatcgccgtggagcacaacaacctgggcaaggccgtgtacagcagagtggccagaatctgcaagaacgacatgggcggcagccagagagtgctggagaagcactggaccagcttcctgaaggccagactgaactgcagcgtgcccggcgacagcttcttctacttcgacgtgctgcagagcatcaccgacatcatccagatcaacggcatccccaccgtggtgggcgtgttcaccacccagctgaacagcatccccggcagcgccgtgtgcgccttcagcatggacgacatcgagaaggtgttcaagggcagattcaaggagcagaagacccccgacagcgtgtggaccgccgtgcccgaggacaaggtgcccaagcccagacccggctgctgcgccaagcacggcctggccgaggcctacaagaccagcatcgacttccccgacgagaccctgagcttcatcaagagccaccccctgatggacagcgccgtgccccccatcgccgacgagccctggttcaccaagaccagagtgagatacagactgaccgccatcagcgtggaccacagcgccggcccctaccagaactacaccgtgatcttcgtgggcagcgaggccggcatggtgctgaaggtgctggccaagaccagccccttcagcctgaacgacagcgtgctgctggaggagatcgaggcctacaaccacgccaagtgcagcgccgagaacgaggaggacaagaaggtgatcagcctgcagctggacaaggaccaccacgccctgtacgtggccttcagcagctgcatcatcagaatccccctgagcagatgcgagagatacggcagctgcaagaagagctgcatcgccagcagagacccctactgcggctggctgagccagggcagctgcggcagagtgacccccggcatgctggccgagggctacgagcaggacaccgagttcggcaacaccgcccacctgggcgactgccacgagatcctgcccaccagcaccacccccgactacaagatcttcggcggccccaccagcgacatggaggtgagcagcagcagcgtgaccaccatggccagcatccccgagatcacccccaaggtgatcgacacctggagacccaagctgaccagcagcagaaagttcgtggtgcaggacgaccccaacaccagcgacttcaccgaccccctgagcggcatccccaagggcgtgagatgggaggtgcagagcggcgagagcaaccagatggtgcacatgaacgtgctgatcacctgcgtgttcgccgccttcgtgctgggcgccttcatcgccggcgtggccgtgtactgctacagagacatgttcgtgagaaagaacagaaagatccacaaggacgccgagagcgcccagagctgcaccgacagcagcggcagcttcgccaagctgaacggcctgttcgacagccccgtgaaggagtaccagcagaacatcgacagccccaagctgtacagcaacctgctgaccagcagaaaggagctgccccccaacggcgacaccaagagcatggtgatggaccacagaggccagccccccgagctggccgccctgcccacccccgagagcacccccgtgctgcaccagaagaccctgcaggccatgaagagccacagcgagaaggcccacggccacggcgccagcagaaaggagaccccccagttcttccccagcagcccccccccccacagccccctgagccacggccacatccccagcgccatcgtgctgcccaacgccacccacgactacaacaccagcttcagcaacagcaacgcccacaaggccgagaagaagctgcagaacatcgaccaccccctgaccaagagcagcagcaagagagaccacagaagaagcgtggacagcagaaacaccctgaacgacctgctgaagcacctgaacgaccccaacagcaaccccaaggccatcatgggcgacatccagatggcccaccagaacctgatgctggaccccatgggcagcatgagcgaggtgccccccaaggtgcccaacagagaggccagcctgtacagcccccccagcaccctgcccagaaacagccccaccaagagagtggacgtgcccaccacccccggcgtgcccatgaccagcctggagagacagagaggctaccacaagaacagcagccagagacacagcatcagcgccatgcccaagaacctgaacagccccaacggcgtgctgctgagcagacagcccagcatgaacagaggcggctacatgcccacccccaccggcgccaaggtggactacatccagggcacccccgtgagcgtgcacctgcagcccagcctgagcagacagagcagctacaccagcaacggcaccctgcccagaaccggcctgaagagaacccccagcctgaagcccgacgtgccccccaagcccagcttcgtgccccagacccccagcgtgagacccctgaacaagtacacctactag

SEQ ID NO: 21931 - DNA, 3054 bp, Artificial Sequence
  Description of Artificial Sequence: Synthetic coding sequence
atgagagtgttcctgctgtgcgcctacatcctgctgctgatggtgagccagctgagagccgtgagcttccccgaggacgacgagcccctgaacaccgtggactaccactacagcagacagtaccccgtgttcagaggcagacccagcggcaacgagagccagcacagactggacttccagctgatgctgaagatcagagacaccctgtacatcgccggcagagaccaggtgtacaccgtgaacctgaacgagatgcccaagaccgaggtgatccccaacaagaagctgacctggagaagcagacagcaggacagagagaactgcgccatgaagggcaagcacaaggacgagtgccacaacttcatcaaggtgttcgtgcccagaaacgacgagatggtgttcgtgtgcggcaccaacgccttcaaccccatgtgcagatactacagactgagcaccctggagtacgacggcgaggagatcagcggcctggccagatgccccttcgacgccagacagaccaacgtggccctgttcgccgacggcaagctgtacagcgccaccgtggccgacttcctggccagcgacgccgtgatctacagaagcatgggcgacggcagcgccctgagaaccatcaagtacgacagcaagtggatcaaggagccccacttcctgcacgccatcgagtacggcaactacgtgtacttcttcttcagagagatcgccgtggagcacaacaacctgggcaaggccgtgtacagcagagtggccagaatctgcaagaacgacatgggcggcagccagagagtgctggagaagcactggaccagcttcctgaaggccagactgaactgcagcgtgcccggcgacagcttcttctacttcgacgtgctgcagagcatcaccgacatcatccagatcaacggcatccccaccgtggtgggcgtgttcaccacccagctgaacagcatccccggcagcgccgtgtgcgccttcagcatggacgacatcgagaaggtgttcaagggcagattcaaggagcagaagacccccgacagcgtgtggaccgccgtgcccgaggacaaggtgcccaagcccagacccggctgctgcgccaagcacggcctggccgaggcctacaagaccagcatcgacttccccgacgagaccctgagcttcatcaagagccaccccctgatggacagcgccgtgccccccatcgccgacgagccctggttcaccaagaccagagtgagatacagactgaccgccatcagcgtggaccacagcgccggcccctaccagaactacaccgtgatcttcgtgggcagcgaggccggcatggtgctgaaggtgctggccaagaccagccccttcagcctgaacgacagcgtgctgctggaggagatcgaggcctacaaccacgccaagtgcagcgccgagaacgaggaggacaagaaggtgatcagcctgcagctggacaaggaccaccacgccctgtacgtggccttcagcagctgcatcatcagaatccccctgagcagatgcgagagatacggcagctgcaagaagagctgcatcgccagcagagacccctactgcggctggctgagccagggcagctgcggcagagtgacccccggcatgctggccgagggctacgagcaggacaccgagttcggcaacaccgcccacctgggcgactgccacgagatcctgcccaccagcaccacccccgactacaagatcttcggcggccccaccagcggcgtgagatgggaggtgcagagcggcgagagcaaccagatggtgcacatgaacgtgctgatcacctgcgtgttcgccgccttcgtgctgggcgccttcatcgccggcgtggccgtgtactgctacagagacatgttcgtgagaaagaacagaaagatccacaaggacgccgagagcgcccagagctgcaccgacagcagcggcagcttcgccaagctgaacggcctgttcgacagccccgtgaaggagtaccagcagaacatcgacagccccaagctgtacagcaacctgctgaccagcagaaaggagctgccccccaacggcgacaccaagagcatggtgatggaccacagaggccagccccccgagctggccgccctgcccacccccgagagcacccccgtgctgcaccagaagaccctgcaggccatgaagagccacagcgagaaggcccacggccacggcgccagcagaaaggagaccccccagttcttccccagcagcccccccccccacagccccctgagccacggccacatccccagcgccatcgtgctgcccaacgccacccacgactacaacaccagcttcagcaacagcaacgcccacaaggccgagaagaagctgcagaacatcgaccaccccctgaccaagagcagcagcaagagagaccacagaagaagcgtggacagcagaaacaccctgaacgacctgctgaagcacctgaacgaccccaacagcaaccccaaggccatcatgggcgacatccagatggcccaccagaacctgatgctggaccccatgggcagcatgagcgaggtgccccccaaggtgcccaacagagaggccagcctgtacagcccccccagcaccctgcccagaaacagccccaccaagagagtggacgtgcccaccacccccggcgtgcccatgaccagcctggagagacagagaggctaccacaagaacagcagccagagacacagcatcagcgccatgcccaagaacctgaacagccccaacggcgtgctgctgagcagacagcccagcatgaacagaggcggctacatgcccacccccaccggcgccaaggtggactacatccagggcacccccgtgagcgtgcacctgcagcccagcctgagcagacagagcagctacaccagcaacggcaccctgcccagaaccggcctgaagagaacccccagcctgaagcccgacgtgccccccaagcccagcttcgtgccccagacccccagcgtgagacccctgaacaagtacacctactag

SEQ ID NO: 21932 - DNA, 1794 bp, Artificial Sequence
  Description of Artificial Sequence: Synthetic coding sequence
atgagagtgttcctgctgtgcgcctacatcctgctgctgatggtgagccagctgagagccgtgagcttccccgaggacgacgagcccctgaacaccgtggactaccactacagcagacagtaccccgtgttcagaggcagacccagcggcaacgagagccagcacagactggacttccagctgatgctgaagatcagagacaccctgtacatcgccggcagagaccaggtgtacaccgtgaacctgaacgagatgcccaagaccgaggtgatccccaacaagaagctgacctggagaagcagacagcaggacagagagaactgcgccatgaagggcaagcacaaggacgagtgccacaacttcatcaaggtgttcgtgcccagaaacgacgagatggtgttcgtgtgcggcaccaacgccttcaaccccatgtgcagatactacagactgagcaccctggagtacgacggcgaggagatcagcggcctggccagatgccccttcgacgccagacagaccaacgtggccctgttcgccgacggcaagctgtacagcgccaccgtggccgacttcctggccagcgacgccgtgatctacagaagcatgggcgacggcagcgccctgagaaccatcaagtacgacagcaagtggatcaaggagccccacttcctgcacgccatcgagtacggcaactacgtgtacttcttcttcagagagatcgccgtggagcacaacaacctgggcaaggccgtgtacagcagagtggccagaatctgcaagaacgacatgggcggcagccagagagtgctggagaagcactggaccagcttcctgaaggccagactgaactgcagcgtgcccggcgacagcttcttctacttcgacgtgctgcagagcatcaccgacatcatccagatcaacggcatccccaccgtggtgggcgtgttcaccacccagctgaacagcatccccggcagcgccgtgtgcgccttcagcatggacgacatcgagaaggtgttcaagggcagattcaaggagcagaagacccccgacagcgtgtggaccgccgtgcccgaggacaaggtgcccaagcccagacccggctgctgcgccaagcacggcctggccgaggcctacaagaccagcatcgacttccccgacgagaccctgagcttcatcaagagccaccccctgatggacagcgccgtgccccccatcgccgacgagccctggttcaccaagaccagagtgagatacagactgaccgccatcagcgtggaccacagcgccggcccctaccagaactacaccgtgatcttcgtgggcagcgaggccggcatggtgctgaaggtgctggccaagaccagccccttcagcctgaacgacagcgtgctgctggaggagatcgaggcctacaaccacgccaagtgcagcgccgagaacgaggaggacaagaaggtgatcagcctgcagctggacaaggaccaccacgccctgtacgtggccttcagcagctgcatcatcagaatccccctgagcagatgcgagagatacggcagctgcaagaagagctgcatcgccagcagagacccctactgcggctggctgagccagggcagctgcggcagagtgacccccggcatgctggccgagggctacgagcaggacaccgagttcggcaacaccgcccacctgggcgactgccacgacatggaggtgagcagcagcagcgtgaccaccatggtgtacgacggcaagagcagcctggagagccccaccagatggagcacctag

SEQ ID NO: 21933 - DNA, 3036 bp, Artificial Sequence
  Description of Artificial Sequence: Synthetic coding sequence
atgagagtgttcctgctgtgcgcctacatcctgctgctgatggtgagccagctgagagccgtgagcttccccgaggacgacgagcccctgaacaccgtggactaccactacagcagacagtaccccgtgttcagaggcagacccagcggcaacgagagccagcacagactggacttccagctgatgctgaagatcagagacaccctgtacatcgccggcagagaccaggtgtacaccgtgaacctgaacgagatgcccaagaccgaggtgatccccaacaagaagctgacctggagaagcagacagcaggacagagagaactgcgccatgaagggcaagcacaaggacgagtgccacaacttcatcaaggtgttcgtgcccagaaacgacgagatggtgttcgtgtgcggcaccaacgccttcaaccccatgtgcagatactacagactgagcaccctggagtacgacggcgaggagatcagcggcctggccagatgccccttcgacgccagacagaccaacgtggccctgttcgccgacggcaagctgtacagcgccaccgtggccgacttcctggccagcgacgccgtgatctacagaagcatgggcgacggcagcgccctgagaaccatcaagtacgacagcaagtggatcaaggagccccacttcctgcacgccatcgagtacggcaactacgtgtacttcttcttcagagagatcgccgtggagcacaacaacctgggcaaggccgtgtacagcagagtggccagaatctgcaagaacgacatgggcggcagccagagagtgctggagaagcactggaccagcttcctgaaggccagactgaactgcagcgtgcccggcgacagcttcttctacttcgacgtgctgcagagcatcaccgacatcatccagatcaacggcatccccaccgtggtgggcgtgttcaccacccagctgaacagcatccccggcagcgccgtgtgcgccttcagcatggacgacatcgagaaggtgttcaagggcagattcaaggagcagaagacccccgacagcgtgtggaccgccgtgcccgaggacaaggtgcccaagcccagacccggctgctgcgccaagcacggcctggccgaggcctacaagaccagcatcgacttccccgacgagaccctgagcttcatcaagagccaccccctgatggacagcgccgtgccccccatcgccgacgagccctggttcaccaagaccagagtgagatacagactgaccgccatcagcgtggaccacagcgccggcccctaccagaactacaccgtgatcttcgtgggcagcgaggccggcatggtgctgaaggtgctggccaagaccagccccttcagcctgaacgacagcgtgctgctggaggagatcgaggcctacaaccacgccaagtgcagcgccgagaacgaggaggacaagaaggtgatcagcctgcagctggacaaggaccaccacgccctgtacgtggccttcagcagctgcatcatcagaatccccctgagcagatgcgagagatacggcagctgcaagaagagctgcatcgccagcagagacccctactgcggctggctgagccagggcagctgcggcagagtgacccccggcatgctgctgctgaccgaggacttcttcgccttccacaaccacagcgccgagggctacgagcaggacaccgagttcggcaacaccgcccacctgggcgactgccacggcgtgagatgggaggtgcagagcggcgagagcaaccagatggtgcacatgaacgtgctgatcacctgcgtgttcgccgccttcgtgctgggcgccttcatcgccggcgtggccgtgtactgctacagagacatgttcgtgagaaagaacagaaagatccacaaggacgccgagagcgcccagagctgcaccgacagcagcggcagcttcgccaagctgaacggcctgttcgacagccccgtgaaggagtaccagcagaacatcgacagccccaagctgtacagcaacctgctgaccagcagaaaggagctgccccccaacggcgacaccaagagcatggtgatggaccacagaggccagccccccgagctggccgccctgcccacccccgagagcacccccgtgctgcaccagaagaccctgcaggccatgaagagccacagcgagaaggcccacggccacggcgccagcagaaaggagaccccccagttcttccccagcagcccccccccccacagccccctgagccacggccacatccccagcgccatcgtgctgcccaacgccacccacgactacaacaccagcttcagcaacagcaacgcccacaaggccgagaagaagctgcagaacatcgaccaccccctgaccaagagcagcagcaagagagaccacagaagaagcgtggacagcagaaacaccctgaacgacctgctgaagcacctgaacgaccccaacagcaaccccaaggccatcatgggcgacatccagatggcccaccagaacctgatgctggaccccatgggcagcatgagcgaggtgccccccaaggtgcccaacagagaggccagcctgtacagcccccccagcaccctgcccagaaacagccccaccaagagagtggacgtgcccaccacccccggcgtgcccatgaccagcctggagagacagagaggctaccacaagaacagcagccagagacacagcatcagcgccatgcccaagaacctgaacagccccaacggcgtgctgctgagcagacagcccagcatgaacagaggcggctacatgcccacccccaccggcgccaaggtggactacatccagggcacccccgtgagcgtgcacctgcagcccagcctgagcagacagagcagctacaccagcaacggcaccctgcccagaaccggcctgaagagaacccccagcctgaagcccgacgtgccccccaagcccagcttcgtgccccagacccccagcgtgagacccctgaacaagtacacctactag

SEQ ID NO: 21934 - DNA, 1431 bp, Artificial Sequence
  Description of Artificial Sequence: Synthetic coding sequence
atgagagtgttcctgctgtgcgcctacatcctgctgctgatggtgagccagctgagagccgtgagcttccccgaggacgacgagcccctgaacaccgtggactaccactacagcagacagtaccccgtgttcagaggcagacccagcggcaacgagagccagcacagactggacttccagctgatgctgaagatcagagacaccctgtacatcgccggcagagaccaggtgtacaccgtgaacctgaacgagatgcccaagaccgaggtgatccccaacaagaagctgacctggagaagcagacagcaggacagagagaactgcgccatgaagggcaagcacaaggacgagtgccacaacttcatcaaggtgttcgtgcccagaaacgacgagatggtgttcgtgtgcggcaccaacgccttcaaccccatgtgcagatactacagactgagcaccctggagtacgacggcgaggagatcagcggcctggccagatgccccttcgacgccagacagaccaacgtggccctgttcgccgacggcaagctgtacagcgccaccgtggccgacttcctggccagcgacgccgtgatctacagaagcatgggcgacggcagcgccctgagaaccatcaagtacgacagcaagtggatcaaggagccccacttcctgcacgccatcgagtacggcaactacgtgtacttcttcttcagagagatcgccgtggagcacaacaacctgggcaaggccgtgtacagcagagtggccagaatctgcaagaacgacatgggcggcagccagagagtgctggagaagcactggaccagcttcctgaaggccagactgaactgcagcgtgcccggcgacagcttcttctacttcgacgtgctgcagagcatcaccgacatcatccagatcaacggcatccccaccgtggtgggcgtgttcaccacccagctgaacagcatccccggcagcgccgtgtgcgccttcagcatggacgacatcgagaaggtgttcaagggcagattcaaggagcagaagacccccgacagcgtgtggaccgccgtgcccgaggacaaggtgcccaagcccagacccggctgctgcgccaagcacggcctggccgaggcctacaagaccagcatcgacttccccgacgagaccctgagcttcatcaagagccaccccctgatggacagcgccgtgccccccatcgccgacgagccctggttcaccaagaccagagtgagatacagactgaccgccatcagcgtggaccacagcgccggcccctaccagaactacaccgtgatcttcgtgggcagcgaggccggcatggtgctgaaggtgctggccaagaccagccccttcagcctgaacgacagcgtgctgctggaggagatcgaggcctacaaccacgccaagtag

SEQ ID NO: 21935 - DNA, 2997 bp, Artificial Sequence
  Description of Artificial Sequence: Synthetic coding sequence
atgagagtgttcctgctgtgcgcctacatcctgctgctgatggtgagccagctgagagccgtgagcttccccgaggacgacgagcccctgaacaccgtggactaccactacagcagacagtaccccgtgttcagaggcagacccagcggcaacgagagccagcacagactggacttccagctgatgctgaagatcagagacaccctgtacatcgccggcagagaccaggtgtacaccgtgaacctgaacgagatgcccaagaccgaggtgatccccaacaagaagctgacctggagaagcagacagcaggacagagagaactgcgccatgaagggcaagcacaaggacgagtgccacaacttcatcaaggtgttcgtgcccagaaacgacgagatggtgttcgtgtgcggcaccaacgccttcaaccccatgtgcagatactacagactgagcaccctggagtacgacggcgaggagatcagcggcctggccagatgccccttcgacgccagacagaccaacgtggccctgttcgccgacggcaagctgtacagcgccaccgtggccgacttcctggccagcgacgccgtgatctacagaagcatgggcgacggcagcgccctgagaaccatcaagtacgacagcaagtggatcaaggagccccacttcctgcacgccatcgagtacggcaactacgtgtacttcttcttcagagagatcgccgtggagcacaacaacctgggcaaggccgtgtacagcagagtggccagaatctgcaagaacgacatgggcggcagccagagagtgctggagaagcactggaccagcttcctgaaggccagactgaactgcagcgtgcccggcgacagcttcttctacttcgacgtgctgcagagcatcaccgacatcatccagatcaacggcatccccaccgtggtgggcgtgttcaccacccagctgaacagcatccccggcagcgccgtgtgcgccttcagcatggacgacatcgagaaggtgttcaagggcagattcaaggagcagaagacccccgacagcgtgtggaccgccgtgcccgaggacaaggtgcccaagcccagacccggctgctgcgccaagcacggcctggccgaggcctacaagaccagcatcgacttccccgacgagaccctgagcttcatcaagagccaccccctgatggacagcgccgtgccccccatcgccgacgagccctggttcaccaagaccagagtgagatacagactgaccgccatcagcgtggaccacagcgccggcccctaccagaactacaccgtgatcttcgtgggcagcgaggccggcatggtgctgaaggtgctggccaagaccagccccttcagcctgaacgacagcgtgctgctggaggagatcgaggcctacaaccacgccaagtgcagcgccgagaacgaggaggacaagaaggtgatcagcctgcagctggacaaggaccaccacgccctgtacgtggccttcagcagctgcatcatcagaatccccctgagcagatgcgagagatacggcagctgcaagaagagctgcatcgccagcagagacccctactgcggctggctgagccagggcagctgcggcagagtgacccccggcatgctggccgagggctacgagcaggacaccgagttcggcaacaccgcccacctgggcgactgccacggcgtgagatgggaggtgcagagcggcgagagcaaccagatggtgcacatgaacgtgctgatcacctgcgtgttcgccgccttcgtgctgggcgccttcatcgccggcgtggccgtgtactgctacagagacatgttcgtgagaaagaacagaaagatccacaaggacgccgagagcgcccagagctgcaccgacagcagcggcagcttcgccaagctgaacggcctgttcgacagccccgtgaaggagtaccagcagaacatcgacagccccaagctgtacagcaacctgctgaccagcagaaaggagctgccccccaacggcgacaccaagagcatggtgatggaccacagaggccagccccccgagctggccgccctgcccacccccgagagcacccccgtgctgcaccagaagaccctgcaggccatgaagagccacagcgagaaggcccacggccacggcgccagcagaaaggagaccccccagttcttccccagcagcccccccccccacagccccctgagccacggccacatccccagcgccatcgtgctgcccaacgccacccacgactacaacaccagcttcagcaacagcaacgcccacaaggccgagaagaagctgcagaacatcgaccaccccctgaccaagagcagcagcaagagagaccacagaagaagcgtggacagcagaaacaccctgaacgacctgctgaagcacctgaacgaccccaacagcaaccccaaggccatcatgggcgacatccagatggcccaccagaacctgatgctggaccccatgggcagcatgagcgaggtgccccccaaggtgcccaacagagaggccagcctgtacagcccccccagcaccctgcccagaaacagccccaccaagagagtggacgtgcccaccacccccggcgtgcccatgaccagcctggagagacagagaggctaccacaagaacagcagccagagacacagcatcagcgccatgcccaagaacctgaacagccccaacggcgtgctgctgagcagacagcccagcatgaacagaggcggctacatgcccacccccaccggcgccaaggtggactacatccagggcacccccgtgagcgtgcacctgcagcccagcctgagcagacagagcagctacaccagcaacggcaccctgcccagaaccggcctgaagagaacccccagcctgaagcccgacgtgccccccaagcccagcttcgtgccccagacccccagcgtgagacccctgaacaagtacacctactag

SEQ ID NO: 21936 - DNA, 3093 bp, Artificial Sequence
  Description of Artificial Sequence: Synthetic coding sequence
atgagagtgttcctgctgtgcgcctacatcctgctgctgatggtgagccagctgagagccgtgagcttccccgaggacgacgagcccctgaacaccgtggactaccactacagcagacagtaccccgtgttcagaggcagacccagcggcaacgagagccagcacagactggacttccagctgatgctgaagatcagagacaccctgtacatcgccggcagagaccaggtgtacaccgtgaacctgaacgagatgcccaagaccgaggtgatccccaacaagaagctgacctggagaagcagacagcaggacagagagaactgcgccatgaagggcaagcacaaggacgagtgccacaacttcatcaaggtgttcgtgcccagaaacgacgagatggtgttcgtgtgcggcaccaacgccttcaaccccatgtgcagatactacagactgagcaccctggagtacgacggcgaggagatcagcggcctggccagatgccccttcgacgccagacagaccaacgtggccctgttcgccgacggcaagctgtacagcgccaccgtggccgacttcctggccagcgacgccgtgatctacagaagcatgggcgacggcagcgccctgagaaccatcaagtacgacagcaagtggatcaaggagccccacttcctgcacgccatcgagtacggcaactacgtgtacttcttcttcagagagatcgccgtggagcacaacaacctgggcaaggccgtgtacagcagagtggccagaatctgcaagaacgacatgggcggcagccagagagtgctggagaagcactggaccagcttcctgaaggccagactgaactgcagcgtgcccggcgacagcttcttctacttcgacgtgctgcagagcatcaccgacatcatccagatcaacggcatccccaccgtggtgggcgtgttcaccacccagctgaacagcatccccggcagcgccgtgtgcgccttcagcatggacgacatcgagaaggtgttcaagggcagattcaaggagcagaagacccccgacagcgtgtggaccgccgtgcccgaggacaaggtgcccaagcccagacccggctgctgcgccaagcacggcctggccgaggcctacaagaccagcatcgacttccccgacgagaccctgagcttcatcaagagccaccccctgatggacagcgccgtgccccccatcgccgacgagccctggttcaccaagaccagagtgagatacagactgaccgccatcagcgtggaccacagcgccggcccctaccagaactacaccgtgatcttcgtgggcagcgaggccggcatggtgctgaaggtgctggccaagaccagccccttcagcctgaacgacagcgtgctgctggaggagatcgaggcctacaaccacgccaagtgcagcgccgagaacgaggaggacaagaaggtgatcagcctgcagctggacaaggaccaccacgccctgtacgtggccttcagcagctgcatcatcagaatccccctgagcagatgcgagagatacggcagctgcaagaagagctgcatcgccagcagagacccctactgcggctggctgagccagggcagctgcggcagagtgacccccggcatgctgctgctgaccgaggacttcttcgccttccacaaccacagcgccgagggctacgagcaggacaccgagttcggcaacaccgcccacctgggcgactgccacgagatcctgcccaccagcaccacccccgactacaagatcttcggcggccccaccagcggcgtgagatgggaggtgcagagcggcgagagcaaccagatggtgcacatgaacgtgctgatcacctgcgtgttcgccgccttcgtgctgggcgccttcatcgccggcgtggccgtgtactgctacagagacatgttcgtgagaaagaacagaaagatccacaaggacgccgagagcgcccagagctgcaccgacagcagcggcagcttcgccaagctgaacggcctgttcgacagccccgtgaaggagtaccagcagaacatcgacagccccaagctgtacagcaacctgctgaccagcagaaaggagctgccccccaacggcgacaccaagagcatggtgatggaccacagaggccagccccccgagctggccgccctgcccacccccgagagcacccccgtgctgcaccagaagaccctgcaggccatgaagagccacagcgagaaggcccacggccacggcgccagcagaaaggagaccccccagttcttccccagcagcccccccccccacagccccctgagccacggccacatccccagcgccatcgtgctgcccaacgccacccacgactacaacaccagcttcagcaacagcaacgcccacaaggccgagaagaagctgcagaacatcgaccaccccctgaccaagagcagcagcaagagagaccacagaagaagcgtggacagcagaaacaccctgaacgacctgctgaagcacctgaacgaccccaacagcaaccccaaggccatcatgggcgacatccagatggcccaccagaacctgatgctggaccccatgggcagcatgagcgaggtgccccccaaggtgcccaacagagaggccagcctgtacagcccccccagcaccctgcccagaaacagccccaccaagagagtggacgtgcccaccacccccggcgtgcccatgaccagcctggagagacagagaggctaccacaagaacagcagccagagacacagcatcagcgccatgcccaagaacctgaacagccccaacggcgtgctgctgagcagacagcccagcatgaacagaggcggctacatgcccacccccaccggcgccaaggtggactacatccagggcacccccgtgagcgtgcacctgcagcccagcctgagcagacagagcagctacaccagcaacggcaccctgcccagaaccggcctgaagagaacccccagcctgaagcccgacgtgccccccaagcccagcttcgtgccccagacccccagcgtgagacccctgaacaagtacacctactag

SEQ ID NO: 21937 - DNA, 3165 bp, Artificial Sequence
  Description of Artificial Sequence: Synthetic coding sequence
atgagagtgttcctgctgtgcgcctacatcctgctgctgatggtgagccagctgagagccgtgagcttccccgaggacgacgagcccctgaacaccgtggactaccactacagcagacagtaccccgtgttcagaggcagacccagcggcaacgagagccagcacagactggacttccagctgatgctgaagatcagagacaccctgtacatcgccggcagagaccaggtgtacaccgtgaacctgaacgagatgcccaagaccgaggtgatccccaacaagaagctgacctggagaagcagacagcaggacagagagaactgcgccatgaagggcaagcacaaggacgagtgccacaacttcatcaaggtgttcgtgcccagaaacgacgagatggtgttcgtgtgcggcaccaacgccttcaaccccatgtgcagatactacagactgagcaccctggagtacgacggcgaggagatcagcggcctggccagatgccccttcgacgccagacagaccaacgtggccctgttcgccgacggcaagctgtacagcgccaccgtggccgacttcctggccagcgacgccgtgatctacagaagcatgggcgacggcagcgccctgagaaccatcaagtacgacagcaagtggatcaaggagccccacttcctgcacgccatcgagtacggcaactacgtgtacttcttcttcagagagatcgccgtggagcacaacaacctgggcaaggccgtgtacagcagagtggccagaatctgcaagaacgacatgggcggcagccagagagtgctggagaagcactggaccagcttcctgaaggccagactgaactgcagcgtgcccggcgacagcttcttctacttcgacgtgctgcagagcatcaccgacatcatccagatcaacggcatccccaccgtggtgggcgtgttcaccacccagctgaacagcatccccggcagcgccgtgtgcgccttcagcatggacgacatcgagaaggtgttcaagggcagattcaaggagcagaagacccccgacagcgtgtggaccgccgtgcccgaggacaaggtgcccaagcccagacccggctgctgcgccaagcacggcctggccgaggcctacaagaccagcatcgacttccccgacgagaccctgagcttcatcaagagccaccccctgatggacagcgccgtgccccccatcgccgacgagccctggttcaccaagaccagagtgagatacagactgaccgccatcagcgtggaccacagcgccggcccctaccagaactacaccgtgatcttcgtgggcagcgaggccggcatggtgctgaaggtgctggccaagaccagccccttcagcctgaacgacagcgtgctgctggaggagatcgaggcctacaaccacgccaagtgcagcgccgagaacgaggaggacaagaaggtgatcagcctgcagctggacaaggaccaccacgccctgtacgtggccttcagcagctgcatcatcagaatccccctgagcagatgcgagagatacggcagctgcaagaagagctgcatcgccagcagagacccctactgcggctggctgagccagggcagctgcggcagagtgacccccggcatgctggccgagggctacgagcaggacaccgagttcggcaacaccgcccacctgggcgactgccacgacatggaggtgagcagcagcagcgtgaccaccatggccagcatccccgagatcacccccaaggtgatcgacacctggagacccaagctgaccagcagcagaaagttcgtggtgcaggacgaccccaacaccagcgacttcaccgaccccctgagcggcatccccaagggcgtgagatgggaggtgcagagcggcgagagcaaccagatggtgcacatgaacgtgctgatcacctgcgtgttcgccgccttcgtgctgggcgccttcatcgccggcgtggccgtgtactgctacagagacatgttcgtgagaaagaacagaaagatccacaaggacgccgagagcgcccagagctgcaccgacagcagcggcagcttcgccaagctgaacggcctgttcgacagccccgtgaaggagtaccagcagaacatcgacagccccaagctgtacagcaacctgctgaccagcagaaaggagctgccccccaacggcgacaccaagagcatggtgatggaccacagaggccagccccccgagctggccgccctgcccacccccgagagcacccccgtgctgcaccagaagaccctgcaggccatgaagagccacagcgagaaggcccacggccacggcgccagcagaaaggagaccccccagttcttccccagcagcccccccccccacagccccctgagccacggccacatccccagcgccatcgtgctgcccaacgccacccacgactacaacaccagcttcagcaacagcaacgcccacaaggccgagaagaagctgcagaacatcgaccaccccctgaccaagagcagcagcaagagagaccacagaagaagcgtggacagcagaaacaccctgaacgacctgctgaagcacctgaacgaccccaacagcaaccccaaggccatcatgggcgacatccagatggcccaccagaacctgatgctggaccccatgggcagcatgagcgaggtgccccccaaggtgcccaacagagaggccagcctgtacagcccccccagcaccctgcccagaaacagccccaccaagagagtggacgtgcccaccacccccggcgtgcccatgaccagcctggagagacagagaggctaccacaagaacagcagccagagacacagcatcagcgccatgcccaagaacctgaacagccccaacggcgtgctgctgagcagacagcccagcatgaacagaggcggctacatgcccacccccaccggcgccaaggtggactacatccagggcacccccgtgagcgtgcacctgcagcccagcctgagcagacagagcagctacaccagcaacggcaccctgcccagaaccggcctgaagagaacccccagcctgaagcccgacgtgccccccaagcccagcttcgtgccccagacccccagcgtgagacccctgaacaagtacacctactag

SEQ ID NO: 21938 - DNA, 3222 bp, Artificial Sequence; identical to SEQ ID NO: 21930
  Description of Artificial Sequence: Synthetic coding sequence

SEQ ID NO: 21939 - DNA, 3036 bp, Artificial Sequence; identical to SEQ ID NO: 21933
  Description of Artificial Sequence: Synthetic coding sequence

SEQ ID NO: 21940 - DNA, 3036 bp, Artificial Sequence; identical to SEQ ID NO: 21933
  Description of Artificial Sequence: Synthetic coding sequence

SEQ ID NO: 21941 - DNA, 1794 bp, Artificial Sequence; identical to SEQ ID NO: 21932
  Description of Artificial Sequence: Synthetic coding sequence

SEQ ID NO: 21942 - DNA, 69 bp, Artificial Sequence
  Description of Artificial Sequence: Synthetic coding sequence
atgagagtgttcctgctgtgcgcctacatcctgctgctgatggtgagccagctgagagccgtgagctag

SEQ ID NO: 21943 - DNA, 660 bp, Artificial Sequence
  Description of Artificial Sequence: Synthetic coding sequence
atgagagtgttcctgctgtgcgcctacatcctgctgctgatggtgagccagctgagagccgtgagcttccccgaggacgacgagcccctgaacaccgtggactaccactacagcagacagtaccccgtgttcagaggcagacccagcggcaacgagagccagcacagactggacttccagctgatgctgaagatcagagacaccctgtacatcgccggcagagaccaggtgtacaccgtgaacctgaacgagatgcccaagaccgaggtgatccccaacaagaagctgacctggagaagcagacagcaggacagagagaactgcgccatgaagggcaagcacaaggacgagtgccacaacttcatcaaggtgttcgtgcccagaaacgacgagatggtgttcgtgtgcggcaccaacgccttcaaccccatgtgcagatactacagactgagcaccctggagtacgacggcgaggagatcagcggcctggccagatgccccttcgacgccagacagaccaacgtggccctgttcgccgacggcaagctgtacagcgccaccgtggccgacttcctggccagcgacgccgtgatctacagaagcatgggcgacggcagcgccctgagaaccatcaagtacgacagcaagtggatcaagtag

SEQ ID NO: 21944 - DNA, 6 bp, Artificial Sequence
  Description of Artificial Sequence: Synthetic coding sequence
atgtag

SEQ ID NO: 21945 - DNA, 447 bp, Artificial Sequence
  Description of Artificial Sequence: Synthetic coding sequence
atgagagtgttcctgctgtgcgcctacatcctgctgctgatggtgagccagctgagagccgtgagcttccccgaggacgacgagcccctgaacaccgtggactaccactacagcagacagtaccccgtgttcagaggcagacccagcggcaacgagagccagcacagactggacttccagctgatgctgaagatcagagacaccctgtacatcgccggcagagaccaggtgtacaccgtgaacctgaacgagatgcccaagaccgaggtgatccccaacaagaagctgacctggagaagcagacagcaggacagagagaactgcgccatgaagggcaagcacaaggacgagtgccacaacttcatcaaggtgttcgtgcccagaaacgacgagatggtgttcgtgtgcggcaccaacgccttcaaccccatgtgcagatactactag

SEQ ID NO: 21946 - DNA, 990 bp, Artificial Sequence
  Description of Artificial Sequence: Synthetic coding sequence
atggacggccccgtggccgagcacgccaagcaggagcccttccacgtggtgacccccctgctggagagctgggccctgagccaggtggccggcatgcccgtgttcctgaagtgcgagaacgtgcagcccagcggcagcttcaagatcagaggcatcggccacttctgccaggagatggccaagaagggctgcagacacctggtgtgcagcagcggcggcaacgccggcatcgccgccgcctacgccgccagaaagctgggcatccccgccaccatcgtgctgcccgagagcaccagcctgcaggtggtgcagagactgcagggcgagggcgccgaggtgcagctgaccggcaaggtgtgggacgaggccaacctgagagcccaggagctggccaagagagacggctgggagaacgtgccccccttcgaccaccccctgatctggaagggccacgccagcctggtgcaggagctgaaggccgtgctgagaaccccccccggcgccctggtgctggccgtgggcggcggcggcctgctggccggcgtggtggccggcctgctggaggtgggctggcagcacgtgcccatcatcgccatggagacccacggcgcccactgcttcaacgccgccatcaccgccggcaagctggtgaccctgcccgacatcaccagcgtggccaagagcctgggcgccaagaccgtggccgccagagccctggagtgcatgcaggtgtgcaagatccacagcgaggtggtggaggacaccgaggccgtgagcgccgtgcagcagctgctggacgacgagagaatgctggtggagcccgcctgcggcgccgccctggccgccatctacagcggcctgctgagaagactgcaggccgagggctgcctgccccccagcctgaccagcgtggtggtgatcgtgtgcggcggcaacaacatcaacagcagagagctgcaggccctgaagacccacctgggccaggtgtag

SEQ ID NO: 21947 - DNA, 990 bp, Artificial Sequence; identical to SEQ ID NO: 21946
  Description of Artificial Sequence: Synthetic coding sequence

SEQ ID NO: 21948 - DNA, 90 bp, Artificial Sequence
  Description of Artificial Sequence: Synthetic coding sequence
atggacggccccgtggccgagcacgccaagcaggagcccttccacgtggtgacccccctgctggagagctgggccctgagccaggtgtag

SEQ ID NO: 21949 - DNA, 1362 bp, Artificial Sequence
  Description of Artificial Sequence: Synthetic coding sequence
atgggcagcgtgctgggcctgtgcagcatggccagctggatcccctgcctgtgcggcagcgccccctgcctgctgtgcagatgctgccccagcggcaacaacagcaccgtgaccagactgatctacgccctgttcctgctggtgggcgtgtgcgtggcctgcgtgatgctgatccccggcatggaggagcagctgaacaagatccccggcttctgcgagaacgagaagggcgtggtgccctgcaacatcctggtgggctacaaggccgtgtacagactgtgcttcggcctggccatgttctacctgctgctgagcctgctgatgatcaaggtgaagagcagcagcgaccccagagccgccgtgcacaacggcttctggttcttcaagttcgccgccgccatcgccatcatcatcggcgccttcttcatccccgagggcaccttcaccaccgtgtggttctacgtgggcatggccggcgccttctgcttcatcctgatccagctggtgctgctgatcgacttcgcccacagctggaacgagagctgggtggagaagatggaggagggcaacagcagatgctggtacgccgccctgctgagcgccaccgccctgaactacctgctgagcctggtggccatcgtgctgttcttcgtgtactacacccaccccgccagctgcagcgagaacaaggccttcatcagcgtgaacatgctgctgtgcgtgggcgccagcgtgatgagcatcctgcccaagatccaggagagccagcccagaagcggcctgctgcagagcagcgtgatcaccgtgtacaccatgtacctgacctggagcgccatgaccaacgagcccgagaccaactgcaaccccagcctgctgagcatcatcggctacaacaccaccagcaccgtgcccaaggagggccagagcgtgcagtggtggcacgcccagggcatcatcggcctgatcctgttcctgctgtgcgtgttctacagcagcatcagaaccagcaacaacagccaggtgaacaagctgaccctgaccagcgacgagagcaccctgatcgaggacggcggcgccagaagcgacggcagcctggaggacggcgacgacgtgcacagagccgtggacaacgagagagacggcgtgacctacagctacagcttcttccacttcatgctgttcctggccagcctgtacatcatgatgaccctgaccaactggtacagatacgagcccagcagagagatgaagagccagtggaccgccgtgtgggtgaagatcagcagcagctggatcggcatcgtgctgtacgtgtggaccctggtggcccccctggtgctgaccaacagagacttcgactag

SEQ ID NO: 21950 - DNA, 1362 bp, Artificial Sequence; identical to SEQ ID NO: 21949
  Description of Artificial Sequence: Synthetic coding sequence

SEQ ID NO: 21951 - DNA, 1368 bp, Artificial Sequence
  Description of Artificial Sequence: Synthetic coding sequence
atgggcgcctgcctgggcgcctgcagcctgctgagctgcgccagctgcctgtgcggcagcgccccctgcatcctgtgcagctgctgccccgccagcagaaacagcaccgtgagcagactgatcttcaccttcttcctgttcctgggcgtgctggtgagcatcatcatgctgagccccggcgtggagagccagctgtacaagctgccctgggtgtgcgaggagggcgccggcatccccaccgtgctgcagggccacatcgactgcggcagcctgctgggctacagagccgtgtacagaatgtgcttcgccaccgccgccttcttcttcttcttcaccctgctgatgctgtgcgtgagcagcagcagagaccccagagccgccatccagaacggcttctggttcttcaagttcctgatcctggtgggcctgaccgtgggcgccttctacatccccgacggcagcttcaccaacatctggttctacttcggcgtggtgggcagcttcctgttcatcctgatccagctggtgctgctgatcgacttcgcccacagctggaaccagagatggctgggcaaggccgaggagtgcgacagcagagcctggtacgccggcctgttcttcttcaccctgctgttctacctgctgagcatcgccgccgtggccctgatgttcatgtactacaccgagcccagcggctgccacgagggcaaggtgttcatcagcctgaacctgaccttctgcgtgtgcgtgagcatcgccgccgtgctgcccaaggtgcaggacgcccagcccaacagcggcctgctgcaggccagcgtgatcaccctgtacaccatgttcgtgacctggagcgccctgagcagcatccccgagcagaagtgcaacccccacctgcccacccagctgggcaacgagaccgtggtggccggccccgagggctacgagacccagtggtgggacgcccccagcatcgtgggcctgatcatcttcctgctgtgcaccctgttcatcagcctgagaagcagcgaccacagacaggtgaacagcctgatgcagaccgaggagtgcccccccatgctggacgccacccagcagcagcagcaggtggccgcctgcgagggcagagccttcgacaacgagcaggacggcgtgacctacagctacagcttcttccacttctgcctggtgctggccagcctgcacgtgatgatgaccctgaccaactggtacaagcccggcgagaccagaaagatgatcagcacctggaccgccgtgtgggtgaagatctgcgccagctgggccggcctgctgctgtacctgtggaccctggtggcccccctgctgctgagaaacagagacttcagctag

SEQ ID NO: 21952 - DNA, 1395 bp, Artificial Sequence
  Description of Artificial Sequence: Synthetic coding sequence
atggacggcagaatgatgagaagcatgagactgagagaggaggagagccccggccccagccacaccgccagctgcctgtgcggcagcgccccctgcatcctgtgcagctgctgccccgccagcagaaacagcaccgtgagcagactgatcttcaccttcttcctgttcctgggcgtgctggtgagcatcatcatgctgagccccggcgtggagagccagctgtacaagctgccctgggtgtgcgaggagggcgccggcatccccaccgtgctgcagggccacatcgactgcggcagcctgctgggctacagagccgtgtacagaatgtgcttcgccaccgccgccttcttcttcttcttcaccctgctgatgctgtgcgtgagcagcagcagagaccccagagccgccatccagaacggcttctggttcttcaagttcctgatcctggtgggcctgaccgtgggcgccttctacatccccgacggcagcttcaccaacatctggttctacttcggcgtggtgggcagcttcctgttcatcctgatccagctggtgctgctgatcgacttcgcccacagctggaaccagagatggctgggcaaggccgaggagtgcgacagcagagcctggtacgccggcctgttcttcttcaccctgctgttctacctgctgagcatcgccgccgtggccctgatgttcatgtactacaccgagcccagcggctgccacgagggcaaggtgttcatcagcctgaacctgaccttctgcgtgtgcgtgagcatcgccgccgtgctgcccaaggtgcaggacgcccagcccaacagcggcctgctgcaggccagcgtgatcaccctgtacaccatgttcgtgacctggagcgccctgagcagcatccccgagcagaagtgcaacccccacctgcccacccagctgggcaacgagaccgtggtggccggccccgagggctacgagacccagtggtgggacgcccccagcatcgtgggcctgatcatcttcctgctgtgcaccctgttcatcagcctgagaagcagcgaccacagacaggtgaacagcctgatgcagaccgaggagtgcccccccatgctggacgccacccagcagcagcagcaggtggccgcctgcgagggcagagccttcgacaacgagcaggacggcgtgacctacagctacagcttcttccacttctgcctggtgctggccagcctgcacgtgatgatgaccctgaccaactggtacaagcccggcgagaccagaaagatgatcagcacctggaccgccgtgtgggtgaagatctgcgccagctgggccggcctgctgctgtacctgtggaccctggtggcccccctgctgctgagaaacagagacttcagctag

SEQ ID NO: 21953 - DNA, 1380 bp, Artificial Sequence
  Description of Artificial Sequence: Synthetic coding sequence
atgggcgccgagggcgcccccgacttcctgagctgccccagagtgagaagagccagctgcctgtgcggcagcgccccctgcatcctgtgcagctgctgccccgccagcagaaacagcaccgtgagcagactgatcttcaccttcttcctgttcctgggcgtgctggtgagcatcatcatgctgagccccggcgtggagagccagctgtacaagctgccctgggtgtgcgaggagggcgccggcatccccaccgtgctgcagggccacatcgactgcggcagcctgctgggctacagagccgtgtacagaatgtgcttcgccaccgccgccttcttcttcttcttcaccctgctgatgctgtgcgtgagcagcagcagagaccccagagccgccatccagaacggcttctggttcttcaagttcctgatcctggtgggcctgaccgtgggcgccttctacatccccgacggcagcttcaccaacatctggttctacttcggcgtggtgggcagcttcctgttcatcctgatccagctggtgctgctgatcgacttcgcccacagctggaaccagagatggctgggcaaggccgaggagtgcgacagcagagcctggtacgccggcctgttcttcttcaccctgctgttctacctgctgagcatcgccgccgtggccctgatgttcatgtactacaccgagcccagcggctgccacgagggcaaggtgttcatcagcctgaacctgaccttctgcgtgtgcgtgagcatcgccgccgtgctgcccaaggtgcaggacgcccagcccaacagcggcctgctgcaggccagcgtgatcaccctgtacaccatgttcgtgacctggagcgccctgagcagcatccccgagcagaagtgcaacccccacctgcccacccagctgggcaacgagaccgtggtggccggccccgagggctacgagacccagtggtgggacgcccccagcatcgtgggcctgatcatcttcctgctgtgcaccctgttcatcagcctgagaagcagcgaccacagacaggtgaacagcctgatgcagaccgaggagtgcccccccatgctggacgccacccagcagcagcagcaggtggccgcctgcgagggcagagccttcgacaacgagcaggacggcgtgacctacagctacagcttcttccacttctgcctggtgctggccagcctgcacgtgatgatgaccctgaccaactggtacaagcccggcgagaccagaaagatgatcagcacctggaccgccgtgtgggtgaagatctgcgccagctgggccggcctgctgctgtacctgtggaccctggtggcccccctgctgctgagaaacagagacttcagctag

SEQ ID NO: 21954 - DNA, 1380 bp, Artificial Sequence
  Description of Artificial Sequence: Synthetic coding sequence
atgagaagcatgagactgagagaggaggagagccccggccccagccacaccgccagctgcctgtgcggcagcgccccctgcatcctgtgcagctgctgccccgccagcagaaacagcaccgtgagcagactgatcttcaccttcttcctgttcctgggcgtgctggtgagcatcatcatgctgagccccggcgtggagagccagctgtacaagctgccctgggtgtgcgaggagggcgccggcatccccaccgtgctgcagggccacatcgactgcggcagcctgctgggctacagagccgtgtacagaatgtgcttcgccaccgccgccttcttcttcttcttcaccctgctgatgctgtgcgtgagcagcagcagagaccccagagccgccatccagaacggcttctggttcttcaagttcctgatcctggtgggcctgaccgtgggcgccttctacatccccgacggcagcttcaccaacatctggttctacttcggcgtggtgggcagcttcctgttcatcctgatccagctggtgctgctgatcgacttcgcccacagctggaaccagagatggctgggcaaggccgaggagtgcgacagcagagcctggtacgccggcctgttcttcttcaccctgctgttctacctgctgagcatcgccgccgtggccctgatgttcatgtactacaccgagcccagcggctgccacgagggcaaggtgttcatcagcctgaacctgaccttctgcgtgtgcgtgagcatcgccgccgtgctgcccaaggtgcaggacgcccagcccaacagcggcctgctgcaggccagcgtgatcaccctgtacaccatgttcgtgacctggagcgccctgagcagcatccccgagcagaagtgcaacccccacctgcccacccagctgggcaacgagaccgtggtggccggccccgagggctacgagacccagtggtgggacgcccccagcatcgtgggcctgatcatcttcctgctgtgcaccctgttcatcagcctgagaagcagcgaccacagacaggtgaacagcctgatgcagaccgaggagtgcccccccatgctggacgccacccagcagcagcagcaggtggccgcctgcgagggcagagccttcgacaacgagcaggacggcgtgacctacagctacagcttcttccacttctgcctggtgctggccagcctgcacgtgatgatgaccctgaccaactggtacaagcccggcgagaccagaaagatgatcagcacctggaccgccgtgtgggtgaagatctgcgccagctgggccggcctgctgctgtacctgtggaccctggtggcccccctgctgctgagaaacagagacttcagctag

SEQ ID NO: 21955 - DNA, 825 bp, Artificial Sequence
  Description of Artificial Sequence: Synthetic coding sequence
atgagcatcagcagccagcacggcatcaccctggccagcgtggaggccctgcacagcagctactgcagctggtgcctgctgcagctgctgcccatccccggcaccagaaccgagcagcccagaagcggcctgctgcaggccagcgtgatcagctgctacatcatgtacctgaccttcagcgccctgagcagcagaccccccgagagagtgatcctgcagggccagaaccacaccctgtgcctgcccggcctgagcaagatggagccccagacccccgacatcagcctggccatgctgagcgccagcatcatgtacgcctgcgtgctgttcgcctgcaacgaggccagctacctggccgaggtgttcggccccctgtggatcgtgaaggtgtacagctacgagttccagaagcccagcctgtgcttctgctgccccgagaccgtggaggccgacaagggccagagaggcggcgccgccagacccgccgaccaggagaccccccccgccccccccgtgcaggtgcagcacctgagctacaactacagcgccttccacttcgtgttcttcctggccagcctgtacgtgatggtgaccctgaccaactggttcagctacgagggcgccgagctggagaagaccttcatcaagggcagctgggccaccttctgggtgaaggtggccagctgctgggcctgcgtgctgctgtacctgggcctgctgctggcccccctgtgctggccccccacccagaagccccagcccctgatcctgagaagaagaagacacagaatcatcagccccgacaacaagtacccccccgtgtag

SEQ ID NO: 21956 - DNA, 1557 bp, Artificial Sequence
  Description of Artificial Sequence: Synthetic coding sequence
atggtgggcgccaaggccggccccagccccggcaccagcctgggcctggcccagcagcacagcggcggcagcagcgtgctggtgaagagccccttctgccaggtgtgctgctgcggccccgccccctgcgccagctgctgccacagcagatggcccagcctgaccgccagcacctgcagcagactgttctacatcctgctgcacgtgggcgccagcgccatctgctgcctgctgctgagcagaaccgtggtggagagagtgtggggcaagacccacagaatccagatgcccagcggcctgtgcgcccacctgttcggcctgagcgactgccccgtgctgagcggcagcggcgccgtgtacagagtgtgcgccggcaccgccaccttccacctgctgcaggccgtgctgctggtgcacctgcacagccccaccagccccagagcccagctgcacaacagcttctggctgctgaagctgctgttcctgctgggcctgtgcgccatcgccttctgcatccccgacgagcacctgttccccgcctggcactacatcggcatctgcggcggcttcgccttcatcctgctgcagctggtgctgatcaccgccttcgcccacagctggaacaagaactggcagaccggcgccgcccaggactgcagctggttcctggccgtgctgctggccaccctgggcttctacagcatggccggcgtgggcgccgtgctgctgttccactactacacccaccccgccggctgcctgctgaacaagatgctgctgagcctgcacctgtgcttctgcggcctgatcagcttcctgagcatcgccccctgcatcagactgaagcagcccagaagcggcctgctgcaggccagcgtgatcagctgctacatcatgtacctgaccttcagcgccctgagcagcagaccccccgagagagtgatcctgcagggccagaaccacaccctgtgcctgcccggcctgagcaagatggagccccagacccccgacatcagcctggccatgctgagcgccagcatcatgtacgcctgcgtgctgttcgcctgcaacgaggccagctacctggccgaggtgttcggccccctgtggatcgtgaaggtgtacagctacgagttccagaagcccagcctgtgcttctgctgccccgagaccgtggaggccgacaagggccagagaggcggcgccgccagacccgccgaccaggagaccccccccgccccccccgtgcaggtgcagcacctgagctacaactacagcgccttccacttcgtgttcttcctggccagcctgtacgtgatggtgaccctgaccaactggttcagctacgagggcgccgagctggagaagaccttcatcaagggcagctgggccaccttctgggtgaaggtggccagctgctgggcctgcgtgctgctgtacctgggcctgctgctggcccccctgtgctggccccccacccagaagccccagcccctgatcctgagaagaagaagacacagaatcatcagccccgacaacaagtacccccccgtgtag

SEQ ID NO: 21957 - DNA, 291 bp, Artificial Sequence
  Description of Artificial Sequence: Synthetic coding sequence
atggtgggcgccaaggccggccccagccccggcaccagcctgggcctggcccagcagcacagcggcggcagcagcgtgctggtgaagagccccttctgccagcaggtgagcaccagcctgccctgcatctgcagcacccccagatgcgccgccgtgggcctgctgctggtgcccgccgccgccaccctgggcggccccctgagcccccaccccctggccgccgcctgcagcaccagcagcagcatgtggggcccccagcagagcgccgccagctgctgccagggccagtag

SEQ ID NO: 21958 - DNA, 1269 bp, Artificial Sequence
  Description of Artificial Sequence: Synthetic coding sequence
accggcagctgctgcgtggaccagctggcctgctgctgcggcagcgccggctgcagcctgtgctgcgactgctgccccagaatcagacagagcctgagcaccagattcatgtacgccctgtacttcatcctggtggtggtgctgtgctgcatcatgatgagcaccaccgtggcccacaagatgaaggagcacatccccttcttcgaggacatgtgcaagggcatcaaggccggcgacacctgcgagaagctggtgggctacagcgccgtgtacagagtgtgcttcggcatggcctgcttcttcttcatcttctgcctgctgaccctgaagatcaacaacagcaagagctgcagagcccacatccacaacggcttctggttcttcaagctgctgctgctgggcgccatgtgcagcggcgccttcttcatccccgaccaggacaccttcctgaacgcctggagatacgtgggcgccgtgggcggcttcctgttcatcggcatccagctgctgctgctggtggagttcgcccacaagtggaacaagaactggaccgccggcaccgccagcaacaagctgtggtacgccagcctggccctggtgaccctgatcatgtacagcatcgccaccggcggcctggtgctgatggccgtgttctacacccagaaggacagctgcatggagaacaagatcctgctgggcgtgaacggcggcctgtgcctgctgatcagcctggtggccatcagcccctgggtgcagaacagacagccccacagcggcctgctgcagagcggcgtgatcagctgctacgtgacctacctgaccttcagcgccctgagcagcaagcccgccgaggtggtgctggacgagcacggcaagaacgtgaccatctgcgtgcccgacttcggccaggacctgtacagagacgagaacctggtgaccatcctgggcaccagcctgctgatcggctgcatcctgtacagctgcctgaccagcaccaccagaagcagcagcgacgccctgcagggcagatacgccgcccccgagctggagatcgccagatgctgcttctgcttcagccccggcggcgaggacaccgaggagcagcagcccggcaaggagggccccagagtgatctacgacgagaagaagggcaccgtgtacatctacagctacttccacttcgtgttcttcctggccagcctgtacgtgatgatgaccgtgaccaactggttcaaccacgtgagaagcgccttccacctgctgccctag

SEQ ID NO: 21959 - DNA, 1272 bp, Artificial Sequence
  Description of Artificial Sequence: Synthetic coding sequence
atgagcgcccagtgctgcgccggccagctggcctgctgctgcggcagcgccggctgcagcctgtgctgcgactgctgccccagaatcagacagagcctgagcaccagattcatgtacgccctgtacttcatcctggtggtggtgctgtgctgcatcatgatgagcaccaccgtggcccacaagatgaaggagcacatccccttcttcgaggacatgtgcaagggcatcaaggccggcgacacctgcgagaagctggtgggctacagcgccgtgtacagagtgtgcttcggcatggcctgcttcttcttcatcttctgcctgctgaccctgaagatcaacaacagcaagagctgcagagcccacatccacaacggcttctggttcttcaagctgctgctgctgggcgccatgtgcagcggcgccttcttcatccccgaccaggacaccttcctgaacgcctggagatacgtgggcgccgtgggcggcttcctgttcatcggcatccagctgctgctgctggtggagttcgcccacaagtggaacaagaactggaccgccggcaccgccagcaacaagctgtggtacgccagcctggccctggtgaccctgatcatgtacagcatcgccaccggcggcctggtgctgatggccgtgttctacacccagaaggacagctgcatggagaacaagatcctgctgggcgtgaacggcggcctgtgcctgctgatcagcctggtggccatcagcccctgggtgcagaacagacagccccacagcggcctgctgcagagcggcgtgatcagctgctacgtgacctacctgaccttcagcgccctgagcagcaagcccgccgaggtggtgctggacgagcacggcaagaacgtgaccatctgcgtgcccgacttcggccaggacctgtacagagacgagaacctggtgaccatcctgggcaccagcctgctgatcggctgcatcctgtacagctgcctgaccagcaccaccagaagcagcagcgacgccctgcagggcagatacgccgcccccgagctggagatcgccagatgctgcttctgcttcagccccggcggcgaggacaccgaggagcagcagcccggcaaggagggccccagagtgatctacgacgagaagaagggcaccgtgtacatctacagctacttccacttcgtgttcttcctggccagcctgtacgtgatgatgaccgtgaccaactggttcaaccacgtgagaagcgccttccacctgctgccctag

SEQ ID NO: 21960 - DNA, 1371 bp, Artificial Sequence
  Description of Artificial Sequence: Synthetic coding sequence
atgagcgcccagtgctgcgccggccagctggcctgctgctgcggcagcgccggctgcagcctgtgctgcgactgctgccccagaatcagacagagcctgagcaccagattcatgtacgccctgtacttcatcctggtggtggtgctgtgctgcatcatgatgagcaccaccgtggcccacaagatgaaggagcacatccccttcttcgaggacatgtgcaagggcatcaaggccggcgacacctgcgagaagctggtgggctacagcgccgtgtacagagtgtgcttcggcatggcctgcttcttcttcatcttctgcctgctgaccctgaagatcaacaacagcaagagctgcagagcccacatccacaacggcttctggttcttcaagctgctgctgctgggcgccatgtgcagcggcgccttcttcatccccgaccaggacaccttcctgaacgcctggagatacgtgggcgccgtgggcggcttcctgttcatcggcatccagctgctgctgctggtggagttcgcccacaagtggaacaagaactggaccgccggcaccgccagcaacaagctgtggtacgccagcctggccctggtgaccctgatcatgtacagcatcgccaccggcggcctggtgctgatggccgtgttctacacccagaaggacagctgcatggagaacaagatcctgctgggcgtgaacggcggcctgtgcctgctgatcagcctggtggccatcagcccctgggtgcagaacagacagccccacagcggcctgctgcagagcggcgtgatcagctgctacgtgacctacctgaccttcagcgccctgagcagcaagcccgccgaggtggacgagcacggcaagaacgtgaccatctgcgtgcccgacttcggccaggacctgtacagagacgagaacctggtgaccatcctgggcaccagcctgctgatcggctgcatcctgtacagctgcctgaccagcaccaccagaagcagcagcgacgccctgcagggcagatacgccgcccccgagctggagatcgccagatgctgcttctgcttcagccccggcggcgaggacaccgaggagcagcagcccggcaaggagggccccagagtgatctacgacgagaagaagggcaccgtgtacatctacagctacttccacttcgtgttcttcctggccagcctgtacgtgatgatgaccgtgaccaactggttcaagtggagccccaccctgctgcccagactggagtacagcggcatgatcctggcccactgcaacctgcacctgcccgacgtgaagagattcagctgcctgagcctgcccagcagctggggctacagacacgtgcccccctag

SEQ ID NO: 21961 - DNA, 1386 bp, Artificial Sequence
  Description of Artificial Sequence: Synthetic coding sequence
atgagcgcccagtgctgcgccggccagctggcctgctgctgcggcagcgccggctgcagcctgtgctgcgactgctgccccagaatcagacagagcctgagcaccagattcatgtacgccctgtacttcatcctggtggtggtgctgtgctgcatcatgatgagcaccaccgtggcccacaagatgaaggagcacatccccttcttcgaggacatgtgcaagggcatcaaggccggcgacacctgcgagaagctggtgggctacagcgccgtgtacagagtgtgcttcggcatggcctgcttcttcttcatcttctgcctgctgaccctgaagatcaacaacagcaagagctgcagagcccacatccacaacggcttctggttcttcaagctgctgctgctgggcgccatgtgcagcggcgccttcttcatccccgaccaggacaccttcctgaacgcctggagatacgtgggcgccgtgggcggcttcctgttcatcggcatccagctgctgctgctggtggagttcgcccacaagtggaacaagaactggaccgccggcaccgccagcaacaagctgtggtacgccagcctggccctggtgaccctgatcatgtacagcatcgccaccggcggcctggtgctgatggccgtgttctacacccagaaggacagctgcatggagaacaagatcctgctgggcgtgaacggcggcctgtgcctgctgatcagcctggtggccatcagcccctgggtgcagaacagacagccccacagcggcctgctgcagagcggcgtgatcagctgctacgtgacctacctgaccttcagcgccctgagcagcaagcccgccgaggtggtgctggacgagcacggcaagaacgtgaccatctgcgtgcccgacttcggccaggacctgtacagagacgagaacctggtgaccatcctgggcaccagcctgctgatcggctgcatcctgtacagctgcctgaccagcaccaccagaagcagcagcgacgccctgcagggcagatacgccgcccccgagctggagatcgccagatgctgcttctgcttcagccccggcggcgaggacaccgaggagcagcagcccggcaaggagggccccagagtgatctacgacgagaagaagggcaccgtgtacatctacagctacttccacttcgtgttcttcctggccagcctgtacgtgatgatgaccgtgaccaactggttcaactacgagagcgccaacatcgagagcttcttcagcggcagctggagcatcttctgggtgaagatggccagctgctggatctgcgtgctgctgtacctgtgcaccctggtggcccccctgtgctgccccaccagagagttcagcgtgtag

SEQ ID NO: 21962 - DNA, 216 bp, Artificial Sequence
  Description of Artificial Sequence: Synthetic coding sequence
atggccggcatggccctggccagagcctggaagcagatgagctggttctactaccagtacctgctggtgaccgccctgtacatgctggagccctgggagagaaccgtgttcaacagcatgctggtgagcatcgtgggcatggccctgtacaccggctacgtgttcatgccccagcacatcatggccatcctgcactacttcgagatcgtgcagtag

SEQ ID NO: 21963 - DNA, 231 bp, Artificial Sequence
  Description of Artificial Sequence: Synthetic coding sequence
atggacctgagaagagtgaaggagtacttcagctggctgtactaccagtaccagatcatcagctgctgcgccgtgctggagccctgggagagaagcatgttcaacaccatcctgctgaccatcatcgccatggtggtgtacaccgcctacgtgttcatccccatccacatcagactggcctgggagttcttcagcaagatctgcggctaccacagcaccatcagcaactag

SEQ ID NO: 21964 - DNA, 231 bp, Artificial Sequence; identical to SEQ ID NO: 21963
  Description of Artificial Sequence: Synthetic coding sequence

SEQ ID NO: 21965 - DNA, 918 bp, Artificial Sequence
  Description of Artificial Sequence: Synthetic coding sequence
atgggccacgccctgtgcgtgtgcagcagaggcaccgtgatcatcgacaacaagagatacctgttcatccagaagctgggcgagggcggcttcagctacgtggacctggtggagggcctgcacgacggccacttctacgccctgaagagaatcctgtgccacgagcagcaggacagagaggaggcccagagagaggccgacatgcacagactgttcaaccaccccaacatcctgagactggtggcctactgcctgagagagagaggcgccaagcacgaggcctggctgctgctgcccttcttcaagagaggcaccctgtggaacgagatcgagagactgaaggacaagggcaacttcctgaccgaggaccagatcctgtggctgctgctgggcatctgcagaggcctggaggccatccacgccaagggctacgcccacagagacctgaagcccaccaacatcctgctgggcgacgagggccagcccgtgctgatggacctgggcagcatgaaccaggcctgcatccacgtggagggcagcagacaggccctgaccctgcaggactgggccgcccagagatgcaccatcagctacagagcccccgagctgttcagcgtgcagagccactgcgtgatcgacgagagaaccgacgtgtggagcctgggctgcgtgctgtacgccatgatgttcggcgagggcccctacgacatggtgttccagaagggcgacagcgtggccctggccgtgcagaaccagctgagcatcccccagagccccagacacagcagcgccctgagacagctgctgaacagcatgatgaccgtggacccccaccagagaccccacatccccctgctgctgagccagctggaggccctgcagccccccgcccccggccagcacaccacccagatctag

SEQ ID NO: 21966 - DNA, 918 bp, Artificial Sequence; identical to SEQ ID NO: 21965
  Description of Artificial Sequence: Synthetic coding sequence

SEQ ID NO: 21967 - DNA, 1269 bp, Artificial Sequence
  Description of Artificial Sequence: Synthetic coding sequence
atgggcatgaccagaatgctgctggagtgcagcctgagcgacaagctgtgcgtgatccaggagaagcagtacgaggtgatcatcgtgcccaccctgctggtgaccatcttcctgatcctgctgggcgtgatcctgtggctgttcatcagagagcagagaacccagcagcagagaagcggcccccagggcatcgcccccgtgcccccccccagagacctgagctgggaggccggccacggcggcaacgtggccctgcccctgaaggagaccagcgtggagaacttcctgggcgccaccacccccgccctggccaagctgcaggtgcccagagagcagctgagcgaggtgctggagcagatctgcagcggcagctgcggccccatcttcagagccaacatgaacaccggcgaccccagcaagcccaagagcgtgatcctgaaggccctgaaggagcccgccggcctgcacgaggtgcaggacttcctgggcagaatccagttccaccagtacctgggcaagcacaagaacctggtgcagctggagggctgctgcaccgagaagctgcccctgtacatggtgctggaggacgtggcccagggcgacctgctgagcttcctgtggacctgcagaagagacgtgatgaccatggacggcctgctgtacgacctgaccgagaagcaggtgtaccacatcggcaagcaggtgctgctggccctggagttcctgcaggagaagcacctgttccacggcgacgtggccgccagaaacatcctgatgcagagcgacctgaccgccaagctgtgcggcctgggcctggcctacgaggtgtacaccagaggcgccatcagcagcacccagaccatccccctgaagtggctggcccccgagagactgctgctgagacccgccagcatcagagccgacgtgtggagcttcggcatcctgctgtacgagatggtgaccctgggcgcccccccctaccccgaggtgccccccaccagcatcctggagcacctgcagagaagaaagatcatgaagagacccagcagctgcacccacaccatgtacagcatcatgaagagctgctggagatggagagaggccgacagacccagccccagagagctgagactgagactggaggccgccatcaagaccgccgacgacgaggccgtgctgcaggtgcccgagctggtggtgcccgagctgtacgccgccgtggccggcatcagagtggagagcctgttctacaactacagcatgctgtag

SEQ ID NO: 21968 - DNA, 198 bp, Artificial Sequence
  Description of Artificial Sequence: Synthetic coding sequence
atgggcatgaccagaatgctgctggagtgcagcctgagcgacaagctgtgcgtgatccaggagaagcagtacgaggtgatcatcgtgcccaccctgctggtgaccatcttcctgatcctgctgggcgtgatcctgtggctgttcatcagagagcagagaacccagcagcagagaagcggcccccagggcaaggcctag

SEQ ID NO: 21969 - DNA, 252 bp, Artificial Sequence
  Description of Artificial Sequence: Synthetic coding sequence
atgggcatgaccagaatgctgctggagtgcagcctgagcgacaagctgtgcgtgatccaggagaagcagtacgaggtgatcatcgtgcccaccctgctggtgaccatcttcctgatcctgctgggcgtgatcctgtggctgttcatcagagagcagagaacccagcagcagagaagcggcccccagggcatcgcccccgtgcccccccccagagacctgagctgggaggccggccacggcggcaacgtgtag

SEQ ID NO: 21970 - DNA, 126 bp, Artificial Sequence
  Description of Artificial Sequence: Synthetic coding sequence
atgggcatgaccagaatgctgctggagtgcagcctgagcgacaagctgtgcgtgatccaggagaagcagtacgaggtgatcatcgtgcccaccctgctggtgaccatcttcctgatcctgctgtag

SEQ ID NO: 21971 - DNA, 264 bp, Artificial Sequence
  Description of Artificial Sequence: Synthetic coding sequence
atgggcatgaccagaatgctgctggagtgcagcctgagcgacaagctgtgcgtgatccaggagaagcagtacgaggtgatcatcgtgcccaccctgctggtgaccatcttcctgatcctgctgggcgtgatcctgtggctgttcatcagagagcagagaacccagcagcagagaagcggcccccagggcatcgcccccgtgcccccccccagagacctgagctgggaggccggccacggcggcaacgtggccctgcccctgtag

SEQ ID NO: 21972 - DNA, 324 bp, Artificial Sequence
  Description of Artificial Sequence: Synthetic coding sequence
atgagcgagcccgacaccagcagcggcttcagcggcagcgtggagaacggcaccttcctggagctgttccccaccagcctgagcaccagcgtggaccccagcagcggccacctgagcaacgtgtacatctacgtgagcatcttcctgagcctgctggccttcctgctgctgctgctgatcatcgccctgcagagactgaagaacatcatcagcagcagcagcagctaccccgagtaccccagcgacgccggcagcagcttcaccaacctggaggtgtgcagcatcagcagccagagaagcaccttcagcaacctgagcagctag

SEQ ID NO: 21973 - DNA, 1182 bp, Artificial Sequence
  Description of Artificial Sequence: Synthetic coding sequence
atgcccggccacctgcaggagggcttcggctgcgtggtgaccaacagattcgaccagctgttcgacgacgagagcgaccccttcgaggtgctgaaggccgccgagaacaagaagaaggaggccggcggcggcggcgtgggcggccccggcgccaagagcgccgcccaggccgccgcccagaccaacagcaacgccgccggcaagcagctgagaaaggagagccagaaggacagaaagaaccccctgccccccagcgtgggcgtggtggacaagaaggaggagacccagccccccgtggccctgaagaaggagggcatcagaagagtgggcagaagacccgaccagcagctgcagggcgagggcaagatcatcgacagaagacccgagagaagaccccccagagagagaagattcgagaagcccctggaggagaagggcgagggcggcgagttcagcgtggacagacccatcatcgacagacccatcagaggcagaggcggcctgggcagaggcagaggcggcagaggcagaggcatgggcagaggcgacggcttcgacagcagaggcaagagagagttcgacagacacagcggcagcgacagaagcagcttcagccactacagcggcctgaagcacgaggacaagagaggcggcagcggcagccacaactggggcaccgtgaaggacgagctgaccgacctggaccagagcaacgtgaccgaggagacccccgagggcgaggagcaccaccccgtggccgacaccgagaacaaggagaacgaggtggaggaggtgaaggaggagggccccaaggagatgaccctggacgagtggaaggccatccagaacaaggacagagccaaggtggagttcaacatcagaaagcccaacgagggcgccgacggccagtggaagaagggcttcgtgctgcacaagagcaagagcgaggaggcccacgccgaggacagcgtgatggaccaccacttcagaaagcccgccaacgacatcaccagccagctggagatcaacttcggcgacctgggcagacccggcagaggcggcagaggcggcagaggcggcagaggcagaggcggcagacccaacagaggcagcagaaccgacaagagcagcgccagcgcccccgacgtggacgaccccgaggccttccccgccctggcctag

SEQ ID NO: 21974 - DNA, 1209 bp, Artificial Sequence
  Description of Artificial Sequence: Synthetic coding sequence
atgcccggccacctgcaggagggcttcggctgcgtggtgaccaacagattcgaccagctgttcgacgacgagagcgaccccttcgaggtgctgaaggccgccgagaacaagaagaaggaggccggcggcggcggcgtgggcggccccggcgccaagagcgccgcccaggccgccgcccagaccaacagcaacgccgccggcaagcagctgagaaaggagagccagaaggacagaaagaaccccctgccccccagcgtgggcgtggtggacaagaaggaggagacccagccccccgtggccctgaagaaggagggcatcagaagagtgggcagaagacccgaccagcagctgcagggcgagggcaagatcatcgacagaagacccgagagaagaccccccagagagagaagattcgagaagcccctggaggagaagggcgagggcggcgagttcagcgtggacagacccatcatcgacagacccatcagaggcagaggcggcctgggcagaggcagaggcggcagaggcagaggcatgggcagaggcgacggcttcgacagcagaggcaagagagagttcgacagacacagcggcagcgacagaagcggcctgaagcacgaggacaagagaggcggcagcggcagccacaactggggcaccgtgaaggacgagctgaccgagagccccaagtacatccagaagcagatcagctacaactacagcgacctggaccagagcaacgtgaccgaggagacccccgagggcgaggagcaccaccccgtggccgacaccgagaacaaggagaacgaggtggaggaggtgaaggaggagggccccaaggagatgaccctggacgagtggaaggccatccagaacaaggacagagccaaggtggagttcaacatcagaaagcccaacgagggcgccgacggccagtggaagaagggcttcgtgctgcacaagagcaagagcgaggaggcccacgccgaggacagcgtgatggaccaccacttcagaaagcccgccaacgacatcaccagccagctggagatcaacttcggcgacctgggcagacccggcagaggcggcagaggcggcagaggcggcagaggcagaggcggcagacccaacagaggcagcagaaccgacaagagcagcgccagcgcccccgacgtggacgaccccgaggccttccccgccctggcctag

SEQ ID NO: 21975 - DNA, 1164 bp, Artificial Sequence
  Description of Artificial Sequence: Synthetic coding sequence
atgcccggccacctgcaggagggcttcggctgcgtggtgaccaacagattcgaccagctgttcgacgacgagagcgaccccttcgaggtgctgaaggccgccgagaacaagaagaaggaggccggcggcggcggcgtgggcggccccggcgccaagagcgccgcccaggccgccgcccagaccaacagcaacgccgccggcaagcagctgagaaaggagagccagaaggacagaaagaaccccctgccccccagcgtgggcgtggtggacaagaaggaggagacccagccccccgtggccctgaagaaggagggcatcagaagagtgggcagaagacccgaccagcagctgcagggcgagggcaagatcatcgacagaagacccgagagaagaccccccagagagagaagattcgagaagcccctggaggagaagggcgagggcggcgagttcagcgtggacagacccatcatcgacagacccatcagaggcagaggcggcctgggcagaggcagaggcggcagaggcagaggcatgggcagaggcgacggcttcgacagcagaggcaagagagagttcgacagacacagcggcagcgacagaagcggcctgaagcacgaggacaagagaggcggcagcggcagccacaactggggcaccgtgaaggacgagctgaccgacctggaccagagcaacgtgaccgaggagacccccgagggcgaggagcaccaccccgtggccgacaccgagaacaaggagaacgaggtggaggaggtgaaggaggagggccccaaggagatgaccctggacgagtggaaggccatccagaacaaggacagagccaaggtggagttcaacatcagaaagcccaacgagggcgccgacggccagtggaagaagggcttcgtgctgcacaagagcaagagcgaggaggcccacgccgaggacagcgtgatggaccaccacttcagaaagcccgccaacgacatcaccagccagctggagatcaacttcggcgacctgggcagacccggcagaggcggcagaggcggcagaggcggcagaggcagaggcggcagacccaacagaggcagcagaaccgacaagagcagcgccagcgcccccgacgtggacgaccccgaggccttccccgccctggcctag

SEQ ID NO: 21976 - DNA, 1227 bp, Artificial Sequence
  Description of Artificial Sequence: Synthetic coding sequence
atgcccggccacctgcaggagggcttcggctgcgtggtgaccaacagattcgaccagctgttcgacgacgagagcgaccccttcgaggtgctgaaggccgccgagaacaagaagaaggaggccggcggcggcggcgtgggcggccccggcgccaagagcgccgcccaggccgccgcccagaccaacagcaacgccgccggcaagcagctgagaaaggagagccagaaggacagaaagaaccccctgccccccagcgtgggcgtggtggacaagaaggaggagacccagccccccgtggccctgaagaaggagggcatcagaagagtgggcagaagacccgaccagcagctgcagggcgagggcaagatcatcgacagaagacccgagagaagaccccccagagagagaagattcgagaagcccctggaggagaagggcgagggcggcgagttcagcgtggacagacccatcatcgacagacccatcagaggcagaggcggcctgggcagaggcagaggcggcagaggcagaggcatgggcagaggcgacggcttcgacagcagaggcaagagagagttcgacagacacagcggcagcgacagaagcagcttcagccactacagcggcctgaagcacgaggacaagagaggcggcagcggcagccacaactggggcaccgtgaaggacgagctgaccgagagccccaagtacatccagaagcagatcagctacaactacagcgacctggaccagagcaacgtgaccgaggagacccccgagggcgaggagcaccaccccgtggccgacaccgagaacaaggagaacgaggtggaggaggtgaaggaggagggccccaaggagatgaccctggacgagtggaaggccatccagaacaaggacagagccaaggtggagttcaacatcagaaagcccaacgagggcgccgacggccagtggaagaagggcttcgtgctgcacaagagcaagagcgaggaggcccacgccgaggacagcgtgatggaccaccacttcagaaagcccgccaacgacatcaccagccagctggagatcaacttcggcgacctgggcagacccggcagaggcggcagaggcggcagaggcggcagaggcagaggcggcagacccaacagaggcagcagaaccgacaagagcagcgccagcgcccccgacgtggacgaccccgaggccttccccgccctggcctag

SEQ ID NO: 21977 - DNA, 813 bp, Artificial Sequence
  Description of Artificial Sequence: Synthetic coding sequence
atgttcttcagcctgcacagagagacccccaaggagggcatgttcggcgccaacctgaccaccttccaccccaccctgttcatcctgctgggcatccccggcctggagcagtaccacatctggctgagcatccccttctacctgatgtacatcaccgccgtgctgggcaacggcgccctgatcctggtggtgctgagcgagcacaccctgcacgtgttcctgagcatgctggccggcaccgacatcctgctgagcaccaccaccgtgcccaaggccctggccatcttctgggtgcacgccggcgagatcgccttcgacgcctgcatcacccagatgttcttcatccacgtggccttcgtggccgagagcggcatcctgctggccatggccttcgacagctacgtggccatctgcacccccctgagatacaccaccatcctgaccagcatggtgaacggcaagatgaccctgaccatctggggccagagcatcggcaccatcttccccgtgatcttcctgctgaagagactgccctactgccagaccaacatcatcccccacagctactgcgagcacatcggcgtggcccagctggcctgcgccgacatcaccgtgaacatctggtacggcttcagcgtgcccatggccagcgtgctggtggacgtggccttcatcggcttcagctacaccctgatcctgcaggccgtgttcagactgcccagccaggagagccagcacaaggccctgaacacctgcggcagcaccctggagctgttcagcagcagcagcagccaccacttcctgctgagctag

SEQ ID NO: 21978 - DNA, 678 bp, Artificial Sequence
  Description of Artificial Sequence: Synthetic coding sequence
atgttcgccggcatggacaccttcctgctggccgtgatcgcctacgacagattcgtggccatctgccaccccctgcagtacatggtgatcatcaacccccacctgtgcggcctgctggtgctggccagctggttcatcatcttctggttcagcctggtgcacatcctgctgatgaagagactgaccttcagcaccggcaccgagatcccccacttcttctgcgagctggcccaggtgctgaaggtggccagaagcgacgccctgctgatcaacatcgtgctgtacgtggccatggccctgctgggcgtgttccccgtggccggcatcctgttcagctacagccagatcgtgagcagcctgatgagaatgagcagcaccgagggcaagtacaaggccttcagcacctgcggcagccacctgtgcgtggtgagcctgttctacggcaccggcctgggcgtgtacctgagcagcgccgtgacccacagcagccagagcagcagcatggccagcgtgatgtacgccatggtgacccccatgctgaaccccttcatctacagcctgagaaacaaggacgtgaagggcgccctgggcagactgctgagcagagccgccagctgcctgctgagatacaccaccagcgagctgagaggctgctacggcagcctgaagcagatgtag

SEQ ID NO: 21979 - DNA, 480 bp, Artificial Sequence
  Description of Artificial Sequence: Synthetic coding sequence
atggagaagctgagaagagtgctgagcggccaggacgacgaggagcagggcctgaccgcccaggtgctggacgccagcagcctgagcttcaacaccagactgaagtggttcgccatctgcttcgtgtgcggcgtgttcttcagcatcctgggcaccggcctgctgtggctgcccggcggcatcaagctgttcgccgtgttctacaccctgggcaacctggccgccctggccagcacctgcttcctgatgggccccgtgaagcagctgaagaagatgttcgaggccaccagactgctggccaccatcgtgatgctgctgtgcttcatcttcaccctgtgcgccgccctgtggtggcacaagaagggcctggccgtgctgttctgcatcctgcagttcctgagcatgacctggtacagcctgagctacatcccctacgccagagacgccgtgatcaagtgctgcagcagcctgctgagctag

SEQ ID NO: 21980 - DNA, 483 bp, Artificial Sequence
  Description of Artificial Sequence: Synthetic coding sequence
atggacaagctgaagaaggtgctgagcggccaggacaccgaggacagaagcggcctgagcgaggtggtggaggccagcagcctgagctggagcaccagaatcaagggcttcatcgcctgcttcgccatcggcatcctgtgcagcctgctgggcaccgtgctgctgtgggtgcccagaaagggcctgcacctgttcgccgtgttctacaccttcggcaacatcgccagcatcggcagcaccatcttcctgatgggccccgtgaagcagctgaagagaatgttcgagcccaccagactgatcgccaccatcatggtgctgctgtgcttcgccctgaccctgtgcagcgccttctggtggcacaacaagggcctggccctgatcttctgcatcctgcagagcctggccctgacctggtacagcctgagcttcatccccttcgccagagacgccgtgaagaagtgcttcgccgtgtgcctggcctag

SEQ ID NO: 21981 - DNA, 327 bp, Artificial Sequence
  Description of Artificial Sequence: Synthetic coding sequence
atggacaagctgaagaaggtgctgagcggccaggacaccgaggacagaagcggcctgagcgaggtggtggaggccagcagcctgagctggagcaccagaatcaagggcttcatcgcctgcttcgccatcggcatcctgtgcagcctgctgggcaccgtgctgctgtgggtgcccagaaagggcctgcacctgttcgccgtgttctacaccttcggcaacatcgccagcatcggcagctgcgtgctgcacctgccctgcgtgctgcccttcggcggcatcaccagagacctgcacctgagcagcgccttctgcagcctgtggcactag

SEQ ID NO: 21982 - DNA, 327 bp, Artificial Sequence; identical to SEQ ID NO: 21981
  Description of Artificial Sequence: Synthetic coding sequence

SEQ ID NO: 21983 - DNA, 648 bp, Artificial Sequence
  Description of Artificial Sequence: Synthetic coding sequence
atggccgacctgcacagacagctgcaggagtacctggcccagggcaaggccggcggccccgccgccgccgagcccctgctggccgccgagaaggccgaggagcccggcgacagacccgccgaggagtggctgggcagagccggcctgagatggacctgggccagaagccccgccgagagcgccgccgccggcctgacctgcctgcccagcgtgaccagaggccagagactggccgccggcggcggctgcctgctgctggccgccctgtgcttcggcctggccgccctgtacgcccccgtgctgctgctgagagccagaaagttcgccctgctgtggagcctgggcagcgccctggccctggccggcagcgccctgctgagaggcggcgccgcctgcggcagactgctgagatgcgaggaggcccccagcagacccgccctgctgtacatggccgccctgggcgccaccctgttcgccgccctgggcctgagaagcaccctgctgaccgtgctgggcgccggcgcccaggtggccgccctgctggccgccctggtgggcctgctgccctggggcggcggcaccgccctgagactggccctgggcagactgggcagaggcgccggcctggccaaggtgctgcccgtgtag

SEQ ID NO: 21984 - DNA, 6486 bp, Artificial Sequence
  Description of Artificial Sequence: Synthetic coding sequence
atgacccacagccccgccaccagcgaggacgaggagagacacagcgccagcgagtgccccgagggcggcagcgagagcgacagcagccccgacggccccggcagaggccccagaggcaccagaggccagggcagcggcgcccccggcagcctggccagcgtgagaggcctgcagggcagaagcatgagcgtgcccgacgacgcccacttcagcatgatggtgttcagaatcggcatccccgacctgcaccagaccaagtgcctgagattcaaccccgacgccaccatctggaccgccaagcagcaggtgctgtgcgccctgagcgagagcctgcaggacgtgctgaactacggcctgttccagcccgccaccagcggcagagacgccaacttcctggaggaggagagactgctgagagagtacccccagagcttcgagaagggcgtgccctacctggagttcagatacaagaccagagtgtacaagcagaccaacctggacgagaagcagctggccaagctgcacaccaagaccggcctgaagaagttcctggagtacgtgcagctgggcaccagcgacaaggtggccagactgctggacaagggcctggaccccaactaccacgacagcgacagcggcgagacccccctgaccctggccgcccagaccgagggcagcgtggaggtgatcagaaccctgtgcctgggcggcgcccacatcgacttcagagccagagacggcatgaccgccctgcacaaggccgcctgcgccagacactgcctggccctgaccgccctgctggacctgggcggcagccccaactacaaggacagaagaggcctgacccccctgttccacaccgccatggtgggcggcgaccccagatgctgcgagctgctgctgttcaacagagcccagctgggcatcgccgacgagaacggctggcaggagatccaccaggcctgccagagaggccacagccagcacctggagcacctgctgttctacggcgccgagcccggcgcccagaacgccagcggcaacaccgccctgcacatctgcgccctgtacaacaaggagacctgcgccagaatcctgctgtacagaggcgccgacaaggacgtgaagaacaacaacggccagacccccttccaggtggccgtgatcgccggcaacttcgagctgggcgagctgatcagaaaccacagagagcaggacgtggtgcccttccaggagagccccaagtacgccgccagaagaagaggcccccccggcaccggcctgaccgtgccccccgccctgctgagagccaacagcgacaccagcatggccctgcccgactggatggtgttcagcgcccccggcgccgccagcagcggcgcccccggccccaccagcggcagccagggccagagccagcccagcgcccccaccaccaagctgagcagcggcaccctgagaagcgccagcagccccagaggcgccagagccagaagccccagcagaggcagacaccccgaggacgccaagagacagcccagaggcagacccagcagcagcggcacccccagagagggccccgccggcggcaccggcggcagcggcggccccggcggcagcctgggcagcagaggcagaagaagaaagctgtacagcgccgtgcccggcagaagcttcatggccgtgaagagctaccaggcccaggccgagggcgagatcagcctgagcaagggcgagaagatcaaggtgctgagcatcggcgagggcggcttctgggagggccaggtgaagggcagagtgggctggttccccagcgactgcctggaggaggtggccaacagaagccaggagagcaagcaggagagcagaagcgacaaggccaagagactgttcagacactacaccgtgggcagctacgacagcttcgacgcccccagcctgatggacggcatcggccccggcagcgactacatcatcaaggagaagaccgtgctgctgcagaagaaggacagcgagggcttcggcttcgtgctgagaggcgccaaggcccagacccccatcgaggagttcacccccacccccgccttccccgccctgcagtacctggagagcgtggacgagggcggcgtggcctggagagccggcctgagaatgggcgacttcctgatcgaggtgaacggccagaacgtggtgaaggtgggccacagacaggtggtgaacatgatcagacagggcggcaacaccctgatggtgaaggtggtgatggtgaccagacaccccgacatggacgaggccgtgcacaagaaggccccccagcaggccaagagactgcccccccccaccatcagcctgagaagcaagagcatgaccagcgagctggaggagatggagtacgagcagcagcccgcccccgtgcccagcatggagaagaagagaaccgtgtaccagatggccctgaacaagctggacgagatcctggccgccgcccagcagaccatcagcgccagcgagagccccggccccggcggcctggccagcctgggcaagcacagacccaagggcttcttcgccaccgagagcagcttcgacccccaccacagagcccagcccagctacgagagacccagcttcctgccccccggccccggcctgatgctgagacagaagagcatcggcgccgccgaggacgacagaccctacctggccccccccgccatgaagttcagcagaagcctgagcgtgcccggcagcgaggacatcccccccccccccaccaccagcccccccgagcccccctacagcaccccccccgtgcccagcagcagcggcagactgacccccagccccagaggcggccccttcaaccccggcagcggcggccccctgcccgccagcagccccgccagcttcgacggccccagcccccccgacaccagagtgggcagcagagagaagagcctgtaccacagcggccccctgccccccgcccaccaccaccccccccaccaccaccaccaccacgccccccccccccagccccaccaccaccacgcccaccccccccacccccccgagatggagaccggcggcagccccgacgaccccccccccagactggccctgggcccccagcccagcctgagaggctggagaggcggcggccccagccccacccccggcgcccccagccccagccaccacggcagcgccggcggcggcggcggcagcagccagggccccgccctgagatacttccagctgccccccagagccgccagcgccgccatgtacgtgcccgccagaagcggcagaggcagaaagggccccctggtgaagcagaccaaggtggagggcgagccccagaagggcggcggcctgccccccgcccccagccccaccagccccgccagcccccagcccccccccgccgtggccgcccccagcgagaagaacagcatccccatccccaccatcatcatcaaggcccccagcaccagcagcagcggcagaagcagccagggcagcagcaccgaggccgagccccccacccagcccgagcccaccggcggcggcggcggcggcggcagcagccccagccccgcccccgccatgagccccgtgccccccagccccagccccgtgcccacccccgccagccccagcggccccgccaccctggacttcaccagccagttcggcgccgccctggtgggcgccgccagaagagagggcggctggcagaacgaggccagaagaagaagcaccctgttcctgagcaccgacgccggcgacgaggacggcggcgacggcggcctgggcaccggcgccgcccccggccccagactgagacacagcaagagcatcgacgagggcatgttcagcgccgagccctacctgagactggagagcgccggcagcggcgccggctacggcggctacggcgccggcagcagagcctacggcggcggcggcggcagcagcgccttcaccagcttcctgccccccagacccctggtgcaccccctgaccggcaaggccctggaccccgccagccccctgggcctggccctggccgccagagagagagccctgaaggagagcagcgagggcggcggcgccccccagcccccccccagaccccccagccccagatacgaggcccccccccccaccccccaccaccacagcccccacgcccaccacgagcccgtgctgagactgtggggcgccagcccccccgaccccgccagaagagagctgggctacagagccggcctgggcagccaggagaagagcctgcccgccagcccccccgccgccagaagaagcctgctgcacagactgccccccaccgcccccggcgtgggccccctgctgctgcagctgggcaccgagccccccgccccccaccccggcgtgagcaagccctggagaagcgccgcccccgaggagcccgagagactgcccctgcacgtgagattcctggagaactgccagcccagagcccccgtgaccagcggcagaggcccccccagcgaggacggccccggcgtgcccccccccagccccagaagaagcgtgccccccagccccaccagccccagagccagcgaggagaacggcctgcccctgctggtgctgcccccccccgcccccagcgtggacgtggaggacggcgagttcctgttcgtggagcccctgcccccccccctggagttcagcaacagcttcgagaagcccgagagccccctgacccccggccccccccaccccctgcccgacacccccgcccccgccacccccctgccccccgtgcccccccccgccgtggccgccgccccccccaccctggacagcaccgccagcagcctgaccagctacgacagcgaggtggccaccctgacccagggcgccagcgccgcccccggcgacccccacccccccggcccccccgcccccgccgcccccgcccccgccgccccccagcccggccccgaccccccccccggcaccgacagcggcatcgaggaggtggacagcagaagcagcagcgaccaccccctggagaccatcagcagcgccagcaccctgagcagcctgagcgccgagggcggcggcagcgccggcggcggcggcggcgccggcgccggcgtggccagcggccccgagctgctggacacctacgtggcctacctggacggccaggccttcggcggcagcagcacccccggccccccctaccccccccagctgatgacccccagcaagctgagaggcagagccctgggcgccagcggcggcctgagacccggccccagcggcggcctgagagaccccgtgacccccaccagccccaccgtgagcgtgaccggcgccggcaccgacggcctgctggccctgagagcctgcagcggcccccccaccgccggcgtggccggcggccccgtggccgtggagcccgaggtgccccccgtgcccctgcccaccgccagcagcctgcccagaaagctgctgccctgggaggagggccccggccccccccccccccccctgcccggccccctggcccagccccaggccagcgccctggccaccgtgaaggccagcatcatcagcgagctgagcagcaagctgcagcagttcggcggcagcagcgccgccggcggcgccctgccctgggccagaggcggcagcggcggcggcggcgacagccaccacggcggcgccagctacgtgcccgagagaaccagcagcctgcagagacagagactgagcgacgacagccagagcagcctgctgagcaagcccgtgagcagcctgttccagaactggcccaagccccccctgccccccctgcccaccggcaccggcgtgagccccaccgccgccgccgcccccggcgccaccagccccagcgccagcagcagcagcaccagcaccagacacctgcagggcgtggagttcgagatgagaccccccctgctgagaagagcccccagccccagcctgctgcccgccagcgagcacaaggtgagccccgcccccagacccagcagcctgcccatcctgcccagcggccccctgtaccccggcctgttcgacatcagaggcagccccaccggcggcgccggcggcagcgccgaccccttcgcccccgtgttcgtgcccccccaccccggcatcagcggcggcctgggcggcgccctgagcggcgccagcagaagcctgagccccaccagactgctgagcctgccccccgacaagcccttcggcgccaagcccctgggcttctggaccaagttcgacgtggccgactggctggagtggctgggcctggccgagcacagagcccagttcctggaccacgagatcgacggcagccacctgcccgccctgaccaaggaggactacgtggacctgggcgtgaccagagtgggccacagaatgaacatcgacagagccctgaagttcttcctggagagatag

SEQ ID NO: 21985 - DNA, 6459 bp, Artificial Sequence
  Description of Artificial Sequence: Synthetic coding sequence
atgacccacagccccgccaccagcgaggacgaggagagacacagcgccagcgagtgccccgagggcggcagcgagagcgacagcagccccgacggccccggcagaggccccagaggcaccagaggccagggcagcggcgcccccggcagcctggccagcgtgagaggcctgcagggcagaagcatgagcgtgcccgacgacgcccacttcagcatgatggtgttcagaatcggcatccccgacctgcaccagaccaagtgcctgagattcaaccccgacgccaccatctggaccgccaagcagcaggtgctgtgcgccctgagcgagagcctgcaggacgtgctgaactacggcctgttccagcccgccaccagcggcagagacgccaacttcctggaggaggagagactgctgagagagtacccccagagcttcgagaagggcgtgccctacctggagttcagatacaagaccagagtgtacaagcagaccaacctggacgagaagcagctggccaagctgcacaccaagaccggcctgaagaagttcctggagtacgtgcagctgggcaccagcgacaaggtggccagactgctggacaagggcctggaccccaactaccacgacagcgacagcggcgagacccccctgaccctggccgcccagaccgagggcagcgtggaggtgatcagaaccctgtgcctgggcggcgcccacatcgacttcagagccagagacggcatgaccgccctgcacaaggccgcctgcgccagacactgcctggccctgaccgccctgctggacctgggcggcagccccaactacaaggacagaagaggcctgacccccctgttccacaccgccatggtgggcggcgaccccagatgctgcgagctgctgctgttcaacagagcccagctgggcatcgccgacgagaacggctggcaggagatccaccaggcctgccagagaggccacagccagcacctggagcacctgctgttctacggcgccgagcccggcgcccagaacgccagcggcaacaccgccctgcacatctgcgccctgtacaacaaggagacctgcgccagaatcctgctgtacagaggcgccgacaaggacgtgaagaacaacaacggccagacccccttccaggtggccgtgatcgccggcaacttcgagctgggcgagctgatcagaaaccacagagagcaggacgtggtgcccttccaggagagccccaagtacgccgccagaagaagaggcccccccggcaccggcctgaccgtgccccccgccctgctgagagccaacagcgacaccagcatggccctgcccgactggatggtgttcagcgcccccggcgccgccagcagcggcgcccccggccccaccagcggcagccagggccagagccagcccagcgcccccaccaccaagctgagcagcggcaccctgagaagcgccagcagccccagaggcgccagagccagaagccccagcagaggcagacaccccgaggacgccaagagacagcccagaggcagacccagcagcagcggcacccccagagagggccccgccggcggcaccggcggcagcggcggccccggcggcagcctgggcagcagaggcagaagaagaaagctgtacagcgccgtgcccggcagaagcttcatggccgtgaagagctaccaggcccaggccgagggcgagatcagcctgagcaagggcgagaagatcaaggtgctgagcatcggcgagggcggcttctgggagggccaggtgaagggcagagtgggctggttccccagcgactgcctggaggaggtggccaacagaagccaggagagcaagcaggagagcagaagcgacaaggccaagagactgttcagacactacaccgtgggcagctacgacagcttcgacgcccccagcgactacatcatcaaggagaagaccgtgctgctgcagaagaaggacagcgagggcttcggcttcgtgctgagaggcgccaaggcccagacccccatcgaggagttcacccccacccccgccttccccgccctgcagtacctggagagcgtggacgagggcggcgtggcctggagagccggcctgagaatgggcgacttcctgatcgaggtgaacggccagaacgtggtgaaggtgggccacagacaggtggtgaacatgatcagacagggcggcaacaccctgatggtgaaggtggtgatggtgaccagacaccccgacatggacgaggccgtgcacaagaaggccccccagcaggccaagagactgcccccccccaccatcagcctgagaagcaagagcatgaccagcgagctggaggagatggagtacgagcagcagcccgcccccgtgcccagcatggagaagaagagaaccgtgtaccagatggccctgaacaagctggacgagatcctggccgccgcccagcagaccatcagcgccagcgagagccccggccccggcggcctggccagcctgggcaagcacagacccaagggcttcttcgccaccgagagcagcttcgacccccaccacagagcccagcccagctacgagagacccagcttcctgccccccggccccggcctgatgctgagacagaagagcatcggcgccgccgaggacgacagaccctacctggccccccccgccatgaagttcagcagaagcctgagcgtgcccggcagcgaggacatcccccccccccccaccaccagcccccccgagcccccctacagcaccccccccgtgcccagcagcagcggcagactgacccccagccccagaggcggccccttcaaccccggcagcggcggccccctgcccgccagcagccccgccagcttcgacggccccagcccccccgacaccagagtgggcagcagagagaagagcctgtaccacagcggccccctgccccccgcccaccaccaccccccccaccaccaccaccaccacgccccccccccccagccccaccaccaccacgcccaccccccccacccccccgagatggagaccggcggcagccccgacgaccccccccccagactggccctgggcccccagcccagcctgagaggctggagaggcggcggccccagccccacccccggcgcccccagccccagccaccacggcagcgccggcggcggcggcggcagcagccagggccccgccctgagatacttccagctgccccccagagccgccagcgccgccatgtacgtgcccgccagaagcggcagaggcagaaagggccccctggtgaagcagaccaaggtggagggcgagccccagaagggcggcggcctgccccccgcccccagccccaccagccccgccagcccccagcccccccccgccgtggccgcccccagcgagaagaacagcatccccatccccaccatcatcatcaaggcccccagcaccagcagcagcggcagaagcagccagggcagcagcaccgaggccgagccccccacccagcccgagcccaccggcggcggcggcggcggcggcagcagccccagccccgcccccgccatgagccccgtgccccccagccccagccccgtgcccacccccgccagccccagcggccccgccaccctggacttcaccagccagttcggcgccgccctggtgggcgccgccagaagagagggcggctggcagaacgaggccagaagaagaagcaccctgttcctgagcaccgacgccggcgacgaggacggcggcgacggcggcctgggcaccggcgccgcccccggccccagactgagacacagcaagagcatcgacgagggcatgttcagcgccgagccctacctgagactggagagcgccggcagcggcgccggctacggcggctacggcgccggcagcagagcctacggcggcggcggcggcagcagcgccttcaccagcttcctgccccccagacccctggtgcaccccctgaccggcaaggccctggaccccgccagccccctgggcctggccctggccgccagagagagagccctgaaggagagcagcgagggcggcggcgccccccagcccccccccagaccccccagccccagatacgaggcccccccccccaccccccaccaccacagcccccacgcccaccacgagcccgtgctgagactgtggggcgccagcccccccgaccccgccagaagagagctgggctacagagccggcctgggcagccaggagaagagcctgcccgccagcccccccgccgccagaagaagcctgctgcacagactgccccccaccgcccccggcgtgggccccctgctgctgcagctgggcaccgagccccccgccccccaccccggcgtgagcaagccctggagaagcgccgcccccgaggagcccgagagactgcccctgcacgtgagattcctggagaactgccagcccagagcccccgtgaccagcggcagaggcccccccagcgaggacggccccggcgtgcccccccccagccccagaagaagcgtgccccccagccccaccagccccagagccagcgaggagaacggcctgcccctgctggtgctgcccccccccgcccccagcgtggacgtggaggacggcgagttcctgttcgtggagcccctgcccccccccctggagttcagcaacagcttcgagaagcccgagagccccctgacccccggccccccccaccccctgcccgacacccccgcccccgccacccccctgccccccgtgcccccccccgccgtggccgccgccccccccaccctggacagcaccgccagcagcctgaccagctacgacagcgaggtggccaccctgacccagggcgccagcgccgcccccggcgacccccacccccccggcccccccgcccccgccgcccccgcccccgccgccccccagcccggccccgaccccccccccggcaccgacagcggcatcgaggaggtggacagcagaagcagcagcgaccaccccctggagaccatcagcagcgccagcaccctgagcagcctgagcgccgagggcggcggcagcgccggcggcggcggcggcgccggcgccggcgtggccagcggccccgagctgctggacacctacgtggcctacctggacggccaggccttcggcggcagcagcacccccggccccccctaccccccccagctgatgacccccagcaagctgagaggcagagccctgggcgccagcggcggcctgagacccggccccagcggcggcctgagagaccccgtgacccccaccagccccaccgtgagcgtgaccggcgccggcaccgacggcctgctggccctgagagcctgcagcggcccccccaccgccggcgtggccggcggccccgtggccgtggagcccgaggtgccccccgtgcccctgcccaccgccagcagcctgcccagaaagctgctgccctgggaggagggccccggccccccccccccccccctgcccggccccctggcccagccccaggccagcgccctggccaccgtgaaggccagcatcatcagcgagctgagcagcaagctgcagcagttcggcggcagcagcgccgccggcggcgccctgccctgggccagaggcggcagcggcggcggcggcgacagccaccacggcggcgccagctacgtgcccgagagaaccagcagcctgcagagacagagactgagcgacgacagccagagcagcctgctgagcaagcccgtgagcagcctgttccagaactggcccaagccccccctgccccccctgcccaccggcaccggcgtgagccccaccgccgccgccgcccccggcgccaccagccccagcgccagcagcagcagcaccagcaccagacacctgcagggcgtggagttcgagatgagaccccccctgctgagaagagcccccagccccagcctgctgcccgccagcgagcacaaggtgagccccgcccccagacccagcagcctgcccatcctgcccagcggccccctgtaccccggcctgttcgacatcagaggcagccccaccggcggcgccggcggcagcgccgaccccttcgcccccgtgttcgtgcccccccaccccggcatcagcggcggcctgggcggcgccctgagcggcgccagcagaagcctgagccccaccagactgctgagcctgccccccgacaagcccttcggcgccaagcccctgggcttctggaccaagttcgacgtggccgactggctggagtggctgggcctggccgagcacagagcccagttcctggaccacgagatcgacggcagccacctgcccgccctgaccaaggaggactacgtggacctgggcgtgaccagagtgggccacagaatgaacatcgacagagccctgaagttcttcctggagagatag

SEQ ID NO: 21986 - DNA, 4647 bp, Artificial Sequence
  Description of Artificial Sequence: Synthetic coding sequence
atgcagctgatggccctggagcagagattcggcagcggcctgcccggcggcggccagcccctgtgcctgatgatgagcagccccctgccccccccccccccccacttcagctgcctgcccgccagcgactacatcatcaaggagaagaccgtgctgctgcagaagaaggacagcgagggcttcggcttcgtgctgagaggcgccaaggcccagacccccatcgaggagttcacccccacccccgccttccccgccctgcagtacctggagagcgtggacgagggcggcgtggcctggagagccggcctgagaatgggcgacttcctgatcgaggtgaacggccagaacgtggtgaaggtgggccacagacaggtggtgaacatgatcagacagggcggcaacaccctgatggtgaaggtggtgatggtgaccagacaccccgacatggacgaggccgtgcacaagaaggccccccagcaggccaagagactgcccccccccaccatcagcctgagaagcaagagcatgaccagcgagctggaggagatggagtacgagcagcagcccgcccccgtgcccagcatggagaagaagagaaccgtgtaccagatggccctgaacaagctggacgagatcctggccgccgcccagcagaccatcagcgccagcgagagccccggccccggcggcctggccagcctgggcaagcacagacccaagggcttcttcgccaccgagagcagcttcgacccccaccacagagcccagcccagctacgagagacccagcttcctgccccccggccccggcctgatgctgagacagaagagcatcggcgccgccgaggacgacagaccctacctggccccccccgccatgaagttcagcagaagcctgagcgtgcccggcagcgaggacatcccccccccccccaccaccagcccccccgagcccccctacagcaccccccccgtgcccagcagcagcggcagactgacccccagccccagaggcggccccttcaaccccggcagcggcggccccctgcccgccagcagccccgccagcttcgacggccccagcccccccgacaccagagtgggcagcagagagaagagcctgtaccacagcggccccctgccccccgcccaccaccaccccccccaccaccaccaccaccacgccccccccccccagccccaccaccaccacgcccaccccccccacccccccgagatggagaccggcggcagccccgacgaccccccccccagactggccctgggcccccagcccagcctgagaggctggagaggcggcggccccagccccacccccggcgcccccagccccagccaccacggcagcgccggcggcggcggcggcagcagccagggccccgccctgagatacttccagctgccccccagagccgccagcgccgccatgtacgtgcccgccagaagcggcagaggcagaaagggccccctggtgaagcagaccaaggtggagggcgagccccagaagggcggcggcctgccccccgcccccagccccaccagccccgccagcccccagcccccccccgccgtggccgcccccagcgagaagaacagcatccccatccccaccatcatcatcaaggcccccagcaccagcagcagcggcagaagcagccagggcagcagcaccgaggccgagccccccacccagcccgagcccaccggcggcggcggcggcggcggcagcagccccagccccgcccccgccatgagccccgtgccccccagccccagccccgtgcccacccccgccagccccagcggccccgccaccctggacttcaccagccagttcggcgccgccctggtgggcgccgccagaagagagggcggctggcagaacgaggccagaagaagaagcaccctgttcctgagcaccgacgccggcgacgaggacggcggcgacggcggcctgggcaccggcgccgcccccggccccagactgagacacagcaagagcatcgacgagggcatgttcagcgccgagccctacctgagactggagagcgccggcagcggcgccggctacggcggctacggcgccggcagcagagcctacggcggcggcggcggcagcagcgccttcaccagcttcctgccccccagacccctggtgcaccccctgaccggcaaggccctggaccccgccagccccctgggcctggccctggccgccagagagagagccctgaaggagagcagcgagggcggcggcgccccccagcccccccccagaccccccagccccagatacgaggcccccccccccaccccccaccaccacagcccccacgcccaccacgagcccgtgctgagactgtggggcgccagcccccccgaccccgccagaagagagctgggctacagagccggcctgggcagccaggagaagagcctgcccgccagcccccccgccgccagaagaagcctgctgcacagactgccccccaccgcccccggcgtgggccccctgctgctgcagctgggcaccgagccccccgccccccaccccggcgtgagcaagccctggagaagcgccgcccccgaggagcccgagagactgcccctgcacgtgagattcctggagaactgccagcccagagcccccgtgaccagcggcagaggcccccccagcgaggacggccccggcgtgcccccccccagccccagaagaagcgtgccccccagccccaccagccccagagccagcgaggagaacggcctgcccctgctggtgctgcccccccccgcccccagcgtggacgtggaggacggcgagttcctgttcgtggagcccctgcccccccccctggagttcagcaacagcttcgagaagcccgagagccccctgacccccggccccccccaccccctgcccgacacccccgcccccgccacccccctgccccccgtgcccccccccgccgtggccgccgccccccccaccctggacagcaccgccagcagcctgaccagctacgacagcgaggtggccaccctgacccagggcgccagcgccgcccccggcgacccccacccccccggcccccccgcccccgccgcccccgcccccgccgccccccagcccggccccgaccccccccccggcaccgacagcggcatcgaggaggtggacagcagaagcagcagcgaccaccccctggagaccatcagcagcgccagcaccctgagcagcctgagcgccgagggcggcggcagcgccggcggcggcggcggcgccggcgccggcgtggccagcggccccgagctgctggacacctacgtggcctacctggacggccaggccttcggcggcagcagcacccccggccccccctaccccccccagctgatgacccccagcaagctgagaggcagagccctgggcgccagcggcggcctgagacccggccccagcggcggcctgagagaccccgtgacccccaccagccccaccgtgagcgtgaccggcgccggcaccgacggcctgctggccctgagagcctgcagcggcccccccaccgccggcgtggccggcggccccgtggccgtggagcccgaggtgccccccgtgcccctgcccaccgccagcagcctgcccagaaagctgctgccctgggaggagggccccggccccccccccccccccctgcccggccccctggcccagccccaggccagcgccctggccaccgtgaaggccagcatcatcagcgagctgagcagcaagctgcagcagttcggcggcagcagcgccgccggcggcgccctgccctgggccagaggcggcagcggcggcggcggcgacagccaccacggcggcgccagctacgtgcccgagagaaccagcagcctgcagagacagagactgagcgacgacagccagagcagcctgctgagcaagcccgtgagcagcctgttccagaactggcccaagccccccctgccccccctgcccaccggcaccggcgtgagccccaccgccgccgccgcccccggcgccaccagccccagcgccagcagcagcagcaccagcaccagacacctgcagggcgtggagttcgagatgagaccccccctgctgagaagagcccccagccccagcctgctgcccgccagcgagcacaaggtgagccccgcccccagacccagcagcctgcccatcctgcccagcggccccctgtaccccggcctgttcgacatcagaggcagccccaccggcggcgccggcggcagcgccgaccccttcgcccccgtgttcgtgcccccccaccccggcatcagcggcggcctgggcggcgccctgagcggcgccagcagaagcctgagccccaccagactgctgagcctgccccccgacaagcccttcggcgccaagcccctgggcttctggaccaagttcgacgtggccgactggctggagtggctgggcctggccgagcacagagcccagttcctggaccacgagatcgacggcagccacctgcccgccctgaccaaggaggactacgtggacctgggcgtgaccagagtgggccacagaatgaacatcgacagagccctgaagttcttcctggagagatag

SEQ ID NO: 21987 - DNA, 6510 bp, Artificial Sequence
  Description of Artificial Sequence: Synthetic coding sequence
atgacccacagccccgccaccagcgaggacgaggagagacacagcgccagcgagtgccccgagggcggcagcgagagcgacagcagccccgacggccccggcagaggccccagaggcaccagaggccagggcagcggcgcccccggcagcctggccagcgtgagaggcctgcagggcagaagcatgagcgtgcccgacgacgcccacttcagcatgatggtgttcagaatcggcatccccgacctgcaccagaccaagtgcctgagattcaaccccgacgccaccatctggaccgccaagcagcaggtgctgtgcgccctgagcgagagcctgcaggacgtgctgaactacggcctgttccagcccgccaccagcggcagagacgccaacttcctggaggaggagagactgctgagagagtacccccagagcttcgagaagggcgtgccctacctggagttcagatacaagaccagagtgtacaagcagaccaacctggacgagaagcagctggccaagctgcacaccaagaccggcctgaagaagttcctggagtacgtgcagctgggcaccagcgacaaggtggccagactgctggacaagggcctggaccccaactaccacgacagcgacagcggcgagacccccctgaccctggccgcccagaccgagggcagcgtggaggtgatcagaaccctgtgcctgggcggcgcccacatcgacttcagagccagagacggcatgaccgccctgcacaaggccgcctgcgccagacactgcctggccctgaccgccctgctggacctgggcggcagccccaactacaaggacagaagaggcctgacccccctgttccacaccgccatggtgggcggcgaccccagatgctgcgagctgctgctgttcaacagagcccagctgggcatcgccgacgagaacggctggcaggagatccaccaggcctgccagagaggccacagccagcacctggagcacctgctgttctacggcgccgagcccggcgcccagaacgccagcggcaacaccgccctgcacatctgcgccctgtacaacaaggagacctgcgccagaatcctgctgtacagaggcgccgacaaggacgtgaagaacaacaacggccagacccccttccaggtggccgtgatcgccggcaacttcgagctgggcgagctgatcagaaaccacagagagcaggacgtggtgcccttccaggagagccccaagtacgccgccagaagaagaggcccccccggcaccggcctgaccgtgccccccgccctgctgagagccaacagcgacaccagcatggccctgcccgactggatggtgttcagcgcccccggcgccgccagcagcggcgcccccggccccaccagcggcagccagggccagagccagcccagcgcccccaccaccaagctgagcagcggcaccctgagaagcgccagcagccccagaggcgccagagccagaagccccagcagaggcagacaccccgaggacgccaagagacagcccagaggcagacccagcagcagcggcacccccagagagggccccgccggcggcaccggcggcagcggcggccccggcggcagcctgggcagcagaggcagaagaagaaagctgtacagcgccgtgcccggcagaagcttcatggccgtgaagagctaccaggcccaggccgagggcgagatcagcctgagcaagggcgagaagatcaaggtgctgagcatcggcgagggcggcttctgggagggccaggtgaagggcagagtgggctggttccccagcgactgcctggaggaggtggccaacagaagccaggagagcaagcaggagagcagaagcgacaaggccaagagactgttcagacactacaccgtgggcagctacgacagcttcgacgcccccagcctgatggacggcatcggccccggcagcgactacatcatcaaggagaagaccgtgctgctgcagaagaaggacagcgagggcttcggcttcgtgctgagaggcgccaaggcccagacccccatcgaggagttcacccccacccccgccttccccgccctgcagtacctggagagcgtggacgagggcggcgtggcctggagagccggcctgagaatgggcgacttcctgatcgaggtgaacggccagaacgtggtgaaggtgggccacagacaggtggtgaacatgatcagacagggcggcaacaccctgatggtgaaggtggtgatggtgaccagacaccccgacatggacgaggccgtgcacaagaaggccccccagcaggccaagagactgcccccccccaccatcagcctgagaagcaagagcatgaccagcgagctggaggagatggtgagcccctggaagaagaagagcgagtacgagcagcagcccgcccccgtgcccagcatggagaagaagagaaccgtgtaccagatggccctgaacaagctggacgagatcctggccgccgcccagcagaccatcagcgccagcgagagccccggccccggcggcctggccagcctgggcaagcacagacccaagggcttcttcgccaccgagagcagcttcgacccccaccacagagcccagcccagctacgagagacccagcttcctgccccccggccccggcctgatgctgagacagaagagcatcggcgccgccgaggacgacagaccctacctggccccccccgccatgaagttcagcagaagcctgagcgtgcccggcagcgaggacatcccccccccccccaccaccagcccccccgagcccccctacagcaccccccccgtgcccagcagcagcggcagactgacccccagccccagaggcggccccttcaaccccggcagcggcggccccctgcccgccagcagccccgccagcttcgacggccccagcccccccgacaccagagtgggcagcagagagaagagcctgtaccacagcggccccctgccccccgcccaccaccaccccccccaccaccaccaccaccacgccccccccccccagccccaccaccaccacgcccaccccccccacccccccgagatggagaccggcggcagccccgacgaccccccccccagactggccctgggcccccagcccagcctgagaggctggagaggcggcggccccagccccacccccggcgcccccagccccagccaccacggcagcgccggcggcggcggcggcagcagccagggccccgccctgagatacttccagctgccccccagagccgccagcgccgccatgtacgtgcccgccagaagcggcagaggcagaaagggccccctggtgaagcagaccaaggtggagggcgagccccagaagggcggcggcctgccccccgcccccagccccaccagccccgccagcccccagcccccccccgccgtggccgcccccagcgagaagaacagcatccccatccccaccatcatcatcaaggcccccagcaccagcagcagcggcagaagcagccagggcagcagcaccgaggccgagccccccacccagcccgagcccaccggcggcggcggcggcggcggcagcagccccagccccgcccccgccatgagccccgtgccccccagccccagccccgtgcccacccccgccagccccagcggccccgccaccctggacttcaccagccagttcggcgccgccctggtgggcgccgccagaagagagggcggctggcagaacgaggccagaagaagaagcaccctgttcctgagcaccgacgccggcgacgaggacggcggcgacggcggcctgggcaccggcgccgcccccggccccagactgagacacagcaagagcatcgacgagggcatgttcagcgccgagccctacctgagactggagagcgccggcagcggcgccggctacggcggctacggcgccggcagcagagcctacggcggcggcggcggcagcagcgccttcaccagcttcctgccccccagacccctggtgcaccccctgaccggcaaggccctggaccccgccagccccctgggcctggccctggccgccagagagagagccctgaaggagagcagcgagggcggcggcgccccccagcccccccccagaccccccagccccagatacgaggcccccccccccaccccccaccaccacagcccccacgcccaccacgagcccgtgctgagactgtggggcgccagcccccccgaccccgccagaagagagctgggctacagagccggcctgggcagccaggagaagagcctgcccgccagcccccccgccgccagaagaagcctgctgcacagactgccccccaccgcccccggcgtgggccccctgctgctgcagctgggcaccgagccccccgccccccaccccggcgtgagcaagccctggagaagcgccgcccccgaggagcccgagagactgcccctgcacgtgagattcctggagaactgccagcccagagcccccgtgaccagcggcagaggcccccccagcgaggacggccccggcgtgcccccccccagccccagaagaagcgtgccccccagccccaccagccccagagccagcgaggagaacggcctgcccctgctggtgctgcccccccccgcccccagcgtggacgtggaggacggcgagttcctgttcgtggagcccctgcccccccccctggagttcagcaacagcttcgagaagcccgagagccccctgacccccggccccccccaccccctgcccgacacccccgcccccgccacccccctgccccccgtgcccccccccgccgtggccgccgccccccccaccctggacagcaccgccagcagcctgaccagctacgacagcgaggtggccaccctgacccagggcgccagcgccgcccccggcgacccccacccccccggcccccccgcccccgccgcccccgcccccgccgccccccagcccggccccgaccccccccccggcaccgacagcggcatcgaggaggtggacagcagaagcagcagcgaccaccccctggagaccatcagcagcgccagcaccctgagcagcctgagcgccgagggcggcggcagcgccggcggcggcggcggcgccggcgccggcgtggccagcggccccgagctgctggacacctacgtggcctacctggacggccaggccttcggcggcagcagcacccccggccccccctaccccccccagctgatgacccccagcaagctgagaggcagagccctgggcgccagcggcggcctgagacccggccccagcggcggcctgagagaccccgtgacccccaccagccccaccgtgagcgtgaccggcgccggcaccgacggcctgctggccctgagagcctgcagcggcccccccaccgccggcgtggccggcggccccgtggccgtggagcccgaggtgccccccgtgcccctgcccaccgccagcagcctgcccagaaagctgctgccctgggaggagggccccggccccccccccccccccctgcccggccccctggcccagccccaggccagcgccctggccaccgtgaaggccagcatcatcagcgagctgagcagcaagctgcagcagttcggcggcagcagcgccgccggcggcgccctgccctgggccagaggcggcagcggcggcggcggcgacagccaccacggcggcgccagctacgtgcccgagagaaccagcagcctgcagagacagagactgagcgacgacagccagagcagcctgctgagcaagcccgtgagcagcctgttccagaactggcccaagccccccctgccccccctgcccaccggcaccggcgtgagccccaccgccgccgccgcccccggcgccaccagccccagcgccagcagcagcagcaccagcaccagacacctgcagggcgtggagttcgagatgagaccccccctgctgagaagagcccccagccccagcctgctgcccgccagcgagcacaaggtgagccccgcccccagacccagcagcctgcccatcctgcccagcggccccctgtaccccggcctgttcgacatcagaggcagccccaccggcggcgccggcggcagcgccgaccccttcgcccccgtgttcgtgcccccccaccccggcatcagcggcggcctgggcggcgccctgagcggcgccagcagaagcctgagccccaccagactgctgagcctgccccccgacaagcccttcggcgccaagcccctgggcttctggaccaagttcgacgtggccgactggctggagtggctgggcctggccgagcacagagcccagttcctggaccacgagatcgacggcagccacctgcccgccctgaccaaggaggactacgtggacctgggcgtgaccagagtgggccacagaatgaacatcgacagagccctgaagttcttcctggagagatag

SEQ ID NO: 21988 - DNA, 2556 bp, Artificial Sequence
  Description of Artificial Sequence: Synthetic coding sequence
atgaccagccactacgtgatcgccatcttcgccctgatgagcagctgcctggccaccgccggccccgagcccggcgccctgtgcgagctgagccccgtgagcgccagccaccccgtgcaggccctgatggagagcttcaccgtgctgagcggctgcgccagcagaggcaccaccggcctgccccaggaggtgcacgtgctgaacctgagaaccgccggccagggccccggccagctgcagagagaggtgaccctgcacctgaaccccatcagcagcgtgcacatccaccacaagagcgtggtgttcctgctgaacagcccccaccccctggtgtggcacctgaagaccgagagactggccaccggcgtgagcagactgttcctggtgagcgagggcagcgtggtgcagttcagcagcgccaacttcagcctgaccgccgagaccgaggagagaaacttcccccacggcaacgagcacctgctgaactgggccagaaaggagtacggcgccgtgaccagcttcaccgagctgaagatcgccagaaacatctacatcaaggtgggcgaggaccaggtgttcccccccaagtgcaacatcggcaagaacttcctgagcctgaactacctggccgagtacctgcagcccaaggccgccgagggctgcgtgatgagcagccagccccagaacgaggaggtgcacatcatcgagctgatcacccccaacagcaacccctacagcgccttccaggtggacatcaccatcgacatcagacccagccaggaggacctggaggtggtgaagaacctgatcctgatcctgaagtgcaagaagagcgtgaactgggtgatcaagagcttcgacgtgaagggcagcctgaagatcatcgcccccaacagcatcggcttcggcaaggagagcgagagaagcatgaccatgaccaagagcatcagagacgacatccccagcacccagggcaacctggtgaagtgggccctggacaacggctacagccccatcaccagctacaccatggcccccgtggccaacagattccacctgagactggagaacaacgccgaggagatgggcgacgaggaggtgcacaccatcccccccgagctgagaatcctgctggaccccggcgccctgcccgccctgcagaacccccccatcagaggcggcgagggccagaacggcggcctgcccttccccttccccgacatcagcagaagagtgtggaacgaggagggcgaggacggcctgcccagacccaaggaccccgtgatccccagcatccagctgttccccggcctgagagagcccgaggaggtgcagggcagcgtggacatcgccctgagcgtgaagtgcgacaacgagaagatgatcgtggccgtggagaaggacagcttccaggccagcggctacagcggcatggacgtgaccctgctggaccccacctgcaaggccaagatgaacggcacccacttcgtgctggagagccccctgaacggctgcggcaccagacccagatggagcgccctggacggcgtggtgtactacaacagcatcgtgatccaggtgcccgccctgggcgacagcagcggctggcccgacggctacgaggacctggagagcggcgacaacggcttccccggcgacatggacgagggcgacgccagcctgttcaccagacccgagatcgtggtgttcaactgcagcctgcagcaggtgagaaaccccagcagcttccaggagcagccccacggcaacatcaccttcaacatggagctgtacaacaccgacctgttcctggtgcccagccagggcgtgttcagcgtgcccgagaacggccacgtgtacgtggaggtgagcgtgaccaaggccgagcaggagctgggcttcgccatccagacctgcttcatcagcccctacagcaaccccgacagaatgagccactacaccatcatcgagaacatctgccccaaggacgagagcgtgaagttctacagccccaagagagtgcacttccccatcccccaggccgacatggacaagaagagattcagcttcgtgttcaagcccgtgttcaacaccagcctgctgttcctgcagtgcgagctgaccctgtgcaccaagatggagaagcacccccagaagctgcccaagtgcgtgccccccgacgaggcctgcaccagcctggacgccagcatcatctgggccatgatgcagaacaagaagaccttcaccaagcccctggccgtgatccaccacgaggccgagagcaaggagaagggccccagcatgaaggagcccaaccccatcagcccccccatcttccacggcctggacaccctgaccgtgatgggcatcgccttcgccgccttcgtgatcggcgccctgctgaccggcgccctgtggtacatctacagccacaccggcgagaccgccggcagacagcaggtgcccaccagcccccccgccagcgagaacagcagcgccgcccacagcatcggcagcacccagagcaccccctgcagcagcagcagcaccgcctag

SEQ ID NO: 21989 - DNA, 1161 bp, Artificial Sequence
  Description of Artificial Sequence: Synthetic coding sequence
atgaacatcatggacttcaacgtgaagaagctggccgccgacgccggcaccttcctgagcagagccgtgcagttcaccgaggagaagctgggccaggccgagaagaccgagctggacgcccacctggagaacctgctgagcaaggccgagtgcaccaagatctggaccgagaagatcatgaagcagaccgaggtgctgctgcagcccaaccccaacgccagaatcgaggagttcgtgtacgagaagctggacagaaaggcccccagcagaatcaacaaccccgagctgctgggccagtacatgatcgacgccggcaccgagttcggccccggcaccgcctacggcaacgccctgatcaagtgcggcgagacccagaagagaatcggcaccgccgacagagagctgatccagaccagcgccctgaacttcctgacccccctgagaaacttcatcgagggcgactacaagaccatcgccaaggagagaaagctgctgcagaacaagagactggacctggacgccgccaagaccagactgaagaaggccaaggccgccgagaccagaaacagccagctgaacagcgccagactggagggcgacaacatcatgatctgggccgaggaggtgaccaagagcgagcaggagctgagaatcacccagagcgagttcgacagacaggccgagatcaccagactgctgctggagggcatcagcagcacccacgcccaccacctgagatgcctgaacgacttcgtggaggcccagatgacctactacgcccagtgctaccagtacatgctggacctgcagaagcagctgggcagcttccccagcaactacctgagcaacaacaaccagaccagcgtgacccccgtgcccagcgtgctgcccaacgccatcggcagcagcgccatggccagcaccagcggcctggtgatcaccagccccagcaacctgagcgacctgaaggagtgcagcggcagcagaaaggccagagtgctgtacgactacgacgccgccaacagcaccgagctgagcctgctggccgacgaggtgatcaccgtgttcagcgtggtgggcatggacagcgactggctgatgggcgagagaggcaaccagaagggcaaggtgcccatcacctacctggagctgctgaactag

SEQ ID NO: 21990 - DNA, 798 bp, Artificial Sequence
  Description of Artificial Sequence: Synthetic coding sequence
atgatcgacgccggcaccgagttcggccccggcaccgcctacggcaacgccctgatcaagtgcggcgagacccagaagagaatcggcaccgccgacagagagctgatccagaccagcgccctgaacttcctgacccccctgagaaacttcatcgagggcgactacaagaccatcgccaaggagagaaagctgctgcagaacaagagactggacctggacgccgccaagaccagactgaagaaggccaaggccgccgagaccagaaacagcagcgagcaggagctgagaatcacccagagcgagttcgacagacaggccgagatcaccagactgctgctggagggcatcagcagcacccacgcccaccacctgagatgcctgaacgacttcgtggaggcccagatgacctactacgcccagtgctaccagtacatgctggacctgcagaagcagctgggcagcttccccagcaactacctgagcaacaacaaccagaccagcgtgacccccgtgcccagcgtgctgcccaacgccatcggcagcagcgccatggccagcaccagcggcctggtgatcaccagccccagcaacctgagcgacctgaaggagtgcagcggcagcagaaaggccagagtgctgtacgactacgacgccgccaacagcaccgagctgagcctgctggccgacgaggtgatcaccgtgttcagcgtggtgggcatggacagcgactggctgatgggcgagagaggcaaccagaagggcaaggtgcccatcacctacctggagctgctgaactag

SEQ ID NO: 21991 - DNA, 2124 bp, Artificial Sequence
  Description of Artificial Sequence: Synthetic coding sequence
atggccgccgccgccaccgccgccgagggcgtgcccagcagaggcccccccggcgaggtgatccacctgaacgtgggcggcaagagattcagcaccagcagacagaccctgacctggatccccgacagcttcttcagcagcctgctgagcggcagaatcagcaccctgaaggacgagaccggcgccatcttcatcgacagagaccccaccgtgttcgcccccatcctgaacttcctgagaaccaaggagctggaccccagaggcgtgcacggcagcagcctgctgcacgaggcccagttctacggcctgacccccctggtgagaagactgcagctgagagaggagctggacagaagcagctgcggcaacgtgctgttcaacggctacctgcccccccccgtgttccccgtgaagagaagaaacagacacagcctggtgggcccccagcagctgggcggcagacccgcccccgtgagaagaagcaacaccatgccccccaacctgggcaacgccggcctgctgggcagaatgctggacgagaagaccccccccagccccagcggccagcccgaggagcccggcatggtgagactggtgtgcggccaccacaactggatcgccgtggcctacacccagttcctggtgtgctacagactgaaggaggccagcggctggcagctggtgttcagcagccccagactggactggcccatcgagagactggccctgaccgccagagtgcacggcggcgccctgggcgagcacgacaagatggtggccgccgccaccggcagcgagatcctgctgtgggccctgcaggccgagggcggcggcagcgagatcggcgtgttccacctgggcgtgcccgtggaggccctgttcttcgtgggcaaccagctgatcgccaccagccacaccggcagaatcggcgtgtggaacgccgtgaccaagcactggcaggtgcaggaggtgcagcccatcaccagctacgacgccgccggcagcttcctgctgctgggctgcaacaacggcagcatctactacgtggacgtgcagaagttccccctgagaatgaaggacaacgacctgctggtgagcgagctgtacagagaccccgccgaggacggcgtgaccgccctgagcgtgtacctgacccccaagaccagcgacagcggcaactggatcgagatcgcctacggcaccagcagcggcggcgtgagagtgatcgtgcagcaccccgagaccgtgggcagcggcccccagctgttccagaccttcaccgtgcacagaagccccgtgaccaagatcatgctgagcgagaagcacctgatcagcgtgtgcgccgacaacaaccacgtgagaacctggagcgtgaccagattcagaggcatgatcagcacccagcccggcagcacccccctggccagcttcaagatcctggccctggagagcgccgacggccacggcggctgcagcgccggcaacgacatcggcccctacggcgagagagacgaccagcaggtgttcatccagaaggtggtgcccagcgccagccagctgttcgtgagactgagcagcaccggccagagagtgtgcagcgtgagaagcgtggacggcagccccaccaccgccttcaccgtgctggagtgcgagggcagcagaagactgggcagcagacccagaagatacctgctgaccggccaggccaacggcagcctggccatgtgggacctgaccaccgccatggacggcctgggccaggcccccgccggcggcctgaccgagcaggagctgatggagcagctggagcactgcgagctggccccccccgcccccagcgcccccagctggggctgcctgcccagccccagccccagaatcagcctgaccagcctgcacagcgccagcagcaacaccagcctgagcggccacagaggcagccccagccccccccaggccgaggccagaagaagaggcggcggcagcttcgtggagagatgccaggagctggtgagaagcggccccgacctgagaagaccccccacccccgccccctggcccagcagcggcctgggcacccccctgaccccccccaagatgaagctgaacgagaccagcttctag

SEQ ID NO: 21992 - DNA, 1464 bp, Artificial Sequence
  Description of Artificial Sequence: Synthetic coding sequence
atgccccccaacctgggcaacgccggcctgctgggcagaatgctggacgagaagaccccccccagccccagcggccagcccgaggagcccggcatggtgagactggtgtgcggccaccacaactggatcgccgtggcctacacccagttcctggtgtgctacagactgaaggaggccagcggctggcagctggtgttcagcagccccagactggactggcccatcgagagactggccctgaccgccagagtgcacggcggcgccctgggcgagcacgacaagatggtggccgccgccaccggcagcgagatcctgctgtgggccctgcaggccgagggcggcggcagcgagatcggcgtgttccacctgggcgtgcccgtggaggccctgttcttcgtgggcaaccagctgatcgccaccagccacaccggcagaatcggcgtgtggaacgccgtgaccaagcactggcaggtgcaggaggtgcagcccatcaccagctacgacgccgccggcagcttcctgctgctgggctgcaacaacggcagcatctactacgtggacgtgcagaagttccccctgagaatgaaggacaacgacctgctggtgagcgagctgtacagagaccccgccgaggacggcgtgaccgccctgagcgtgtacctgacccccaagaccatctgcgccgacaacaaccacgtgagaacctggagcgtgaccagattcagaggcatgatcagcacccagcccggcagcacccccctggccagcttcaagatcctggccctggagagcgccgacggccacggcggctgcagcgccggcaacgacatcggcccctacggcgagagagacgaccagcaggtgttcatccagaaggtggtgcccagcgccagccagctgttcgtgagactgagcagcaccggccagagagtgtgcagcgtgagaagcgtggacggcagccccaccaccgccttcaccgtgctggagtgcgagggcagcagaagactgggcagcagacccagaagatacctgctgaccggccaggccaacggcagcctggccatgtgggacctgaccaccgccatggacggcctgggccaggcccccgccggcggcctgaccgagcaggagctgatggagcagctggagcactgcgagctggccccccccgcccccagcgcccccagctggggctgcctgcccagccccagccccagaatcagcctgaccagcctgcacagcgccagcagcaacaccagcctgagcggccacagaggcagccccagccccccccaggccgaggccagaagaagaggcggcggcagcttcgtggagagatgccaggagctggtgagaagcggccccgacctgagaagaccccccacccccgccccctggcccagcagcggcctgggcacccccctgaccccccccaagatgaagctgaacgagaccagcttctag

SEQ ID NO: 21993 - DNA, 1893 bp, Artificial Sequence
  Description of Artificial Sequence: Synthetic coding sequence
atgagagagagaggccaggacagcctggccggcctggtgctgtacgtgggcctgttcggccaccccggcatgctgcacagagccaagtacagcagattcagaaacgagagcatcaccagcctggacgagggcagcagcggcggcagcgtgggcaacaagggcagcccccagcccccccaccccgccctggccccccacctgcccaccgaggacgccaccctgcccagccaggagagccccacccccctgtgcaccctgatccccagaatggccagcatgaagctggccaaccccgccaccctgctgagcctgaagaacttctgcctgggcaccaaggaggtgcccagactgaagctgcaggagagcagagaccccggcagcagcggccccagcagccccgagaccagcctgagcagaagcggcaccgccccccccccccagcaggacctggtgggccacagagccaccgccctgacccccgacagctgccccctgcccggccccggcgagcccaccctgagaagcagacaggacagacacttcctgcagcacctgctgggcatgggcatgaactactgcgtgagatacatgggctgcgtggaggtgctgcagagcatgagaagcctggacttcggcatgagaacccaggtgaccagagaggccatcagcagactgtgcgaggccgtgcccggcgccaacggcgccatcaagaagagaaagccccccgtgaagttcctgagcaccgtgctgggcaagagcaacctgcagttcagcggcatgaacatcaagctgaccatcagcacctgcagcctgaccctgatgaacctggacaaccagcagatcatcgccaaccaccacatgcagagcatcagcttcgccagcggcggcgaccccgacaccaccgactacgtggcctacgtggccaaggaccccgtgaaccagagagcctgccacatcctggagtgccacaacggcatggcccaggacgtgatcagcaccatcggccaggccttcgagctgagattcaagcagtacctgaagaaccccagcctgaacaccagctgcgagagcgaggaggtgcacatcgacagccacgccgaggagagagaggaccacgagtactacaacgagatccccggcaagcagccccccgtgggcggcgtgagcgacatgagaatcaaggtgcaggccaccgagcagatggcctactgccccatccagtgcgagaagctgtgctacctgcccggcaacagcaagtgcagcagcgtgtacgagaactgcctggagcagagcagagccatcggcaacgtgcaccccagaggcgtgcagagccagagagacaccagcctgctgaagcacacctgcagagtggacctgttcgacgacccctgctacatcaacacccaggccctgcagagcacccccggcagcgccggcaaccagagaagcgcccagcccctgggcagcccctggcactgcggcaaggcccccgagaccgtgcagcccggcgccaccgcccagcccgccagcagccacagcctgccccacatcaagcagcagctgtggagcgaggagtgctaccacggcaagctgagcagaaaggccgccgagagcctgctggtgaaggacggcgacttcctggtgagagagagcgccaccagccccggccagtacgtgctgagcggcctgcagggcggccaggccaagcacctgctgctggtggaccccgagggcaaggtgagaaccaaggaccacgtgttcgacaacgtgggccacctgatcagataccacatggacaacagcctgcccatcatcagcagcggcagcgaggtgagcctgaagcagcccgtgagaaaggacaacaaccccgccctgctgcacagcaacaagtag

SEQ ID NO: 21994 - DNA, 1164 bp, Artificial Sequence
  Description of Artificial Sequence: Synthetic coding sequence
atgctgcccgccctggagcactggatccccaagttcttcagcttcagaaccagaaccggcagccccctgagcctggcctgcagacagcccatcgtgggcccctgcgaccacatcatcgccaaccaccacatgcagagcatcagcttcgccagcggcggcgaccccgacaccaccgactacgtggcctacgtggccaaggaccccgtgaaccagagagcctgccacatcctggagtgccacaacggcatggcccaggacgtgatcagcaccatcggccaggccttcgagctgagattcaagcagtacctgaagaaccccagcctgaacaccagctgcgagagcgaggaggtgcacatcgacagccacgccgaggagagagaggaccacgagtactacaacgagatccccggcaagcagccccccgtgggcggcgtgagcgacatgagaatcaaggtgcaggccaccgagcagatggcctactgccccatccagtgcgagaagctgtgctacctgcccggcaacagcaagtgcagcagcgtgtacgagaactgcctggagcagagcagagccatcggcaacgtgcaccccagaggcgtgcagagccagagagacaccagcctgctgaagcacacctgcagagtggacctgttcgacgacccctgctacatcaacacccaggccctgcagagcacccccggcagcgccggcaaccagagaagcgcccagcccctgggcagcccctggcactgcggcaaggcccccgagaccgtgcagcccggcgccaccgcccagcccgccagcagccacagcctgccccacatcaagcagcagctgtggagcgaggagtgctaccacggcaagctgagcagaaaggccgccgagagcctgctggtgaaggacggcgacttcctggtgagagagagcgccaccagccccggccagtacgtgctgagcggcctgcagggcggccaggccaagcacctgctgctggtggaccccgagggcaaggtgagaaccaaggaccacgtgttcgacaacgtgggccacctgatcagataccacatggacaacagcctgcccatcatcagcagcggcagcgaggtgagcctgaagcagcccgtgagaaaggacaacaaccccgccctgctgcacagcaacaagtag

SEQ ID NO: 21995 - DNA, 888 bp, Artificial Sequence
  Description of Artificial Sequence: Synthetic coding sequence
atgtggggcgccagaagaagcagcgtgagcagcagctggaacgccgccagcctgctgcagctgctgctggccgccctgctggccgccggcgccagagccagcggcgagtactgccacggctggctggacgcccagggcgtgtggagaatcggcttccagtgccccgagagattcgacggcggcgacgccaccatctgctgcggcagctgcgccctgagatactgctgcagcagcgccgaggccagactggaccagggcggctgcgacaacgacagacagcagggcgccggcgagcccggcagagccgacaaggacggccccgacggcagcgccgtgcccatctacgtgcccttcctgatcgtgggcagcgtgttcgtggccttcatcatcctgggcagcctggtggccgcctgctgctgcagatgcctgagacccaagcaggacccccagcagagcagagcccccggcggcaacagactgatggagaccatccccatgatccccagcgccagcaccagcagaggcagcagcagcagacagagcagcaccgccgccagcagcagcagcagcgccaacagcggcgccagagccccccccaccagaagccagaccaactgctgcctgcccgagggcaccatgaacaacgtgtacgtgaacatgcccaccaacttcagcgtgctgaactgccagcaggccacccagatcgtgccccaccagggccagtacctgcaccccccctacgtgggctacaccgtgcagcacgacagcgtgcccatgaccgccgtgccccccttcatggacggcctgcagcccggctacagacagatccagagccccttcccccacaccaacagcgagcagaagatgtaccccgccgtgaccgtgtag

SEQ ID NO: 21996 - DNA, 717 bp, Artificial Sequence
  Description of Artificial Sequence: Synthetic coding sequence
atgagagccctgctggccctgtgcctgctgctgggctggctgagatggggccccgccggcgcccagcagagcggcgagtactgccacggctgggtggacgtgcagggcaactaccacgagggcttccagtgccccgaggacttcgacaccctggacgccaccatctgctgcggcagctgcgccctgagatactgctgcgccgccgccgacgccagactggagcagggcggctgcaccaacgacagaagagagctggagcaccccggcatcaccgcccagcccgtgtacgtgcccttcctgatcgtgggcagcatcttcatcgccttcatcatcctgggcagcgtggtggccatctactgctgcacctgcctgagacccaaggagcccagccagcagcccatcagattcagcctgagaagctaccagaccgagaccctgcccatgatcctgaccagcaccagccccagagcccccagcagacagagcagcaccgccaccagcagcagcagcaccggcggcagcatcagaagattcagcttcgccagagccgagcccggctgcctggtgcccagccccccccccccctacaccaccagccacagcatccacctggcccagcccagcggcttcctggtgagcccccagtacttcgcctaccccctgcagcaggagccccccctgcccggcaagagctgccccgacttcagcagcagctag

SEQ ID NO: 21997 - DNA, 594 bp, Artificial Sequence
  Description of Artificial Sequence: Synthetic coding sequence
atgccccccgccggcctgagaagagccgcccccctgaccgccatcgccctgctggtgctgggcgcccccctggtgctggccggcgaggactgcctgtggtacctggacagaaacggcagctggcaccccggcttcaactgcgagttcttcaccttctgctgcggcacctgctaccacagatactgctgcagagacctgaccctgctgatcaccgagagacagcagaagcactgcctggccttcagccccaagaccatcgccggcatcgccagcgccgtgatcctgttcgtggccgtggtggccaccaccatctgctgcttcctgtgcagctgctgctacctgtacagaagaagacagcagctgcagagccccttcgagggccaggagatccccatgaccggcatccccgtgcagcccgtgtacccctacccccaggaccccaaggccggccccgcccccccccagcccggcttcatctacccccccagcggccccgccccccagtaccccctgtaccccgccggcccccccgtgtacaaccccgccgccccccccccctacatgcccccccagcccagctaccccggcgcctag

SEQ ID NO: 21998 - DNA, 1503 bp, Artificial Sequence
  Description of Artificial Sequence: Synthetic coding sequence
atggccctgagaagactgctgctgctgctgctgctgagcctggagagcctggacctgctgcccagcgtgcacggcgccagaggcagagccgccaacagaaccctgagcgccggcggcgccgccgtgggcggcagaagagccggcggcgccctggccagaggcggcagagagctgaacggcaccgccagagcccccggcatccccgaggccggcagcagaagaggccagcccgccgccgccgtggccgccgccgccagcgccgccgtgacctacgagacctgctggggctactacgacgtgagcggccagtacgacaaggagttcgagtgcaacaacagcgagagcggctacctgtactgctgcggcacctgctactacagattctgctgcaagaagagacacgagaagctggaccagagacagtgcaccaactaccagagccccgtgtgggtgcagacccccagcaccaaggtggtgagccccggccccgagaacaagtacgaccccgagaaggacaagaccaacttcaccgtgtacatcacctgcggcgtgatcgccttcgtgatcgtggccggcgtgttcgccaaggtgagctacgacaaggcccacagaccccccagagagatgaacatccacagagccctggccgacatcctgagacagcagggccccatccccatcgcccactgcgagagagagaccatcagcgccatcgacaccagccccaaggagaacacccccgtgagaagcagcagcaagaaccactacacccccgtgagaaccgccaagcagacccccgagaagcccagaatgaacaacatcctgaccagcgccaccgagccctacgacctgagcttcagcagaagcttccagaacctggcccacctgccccccagctacgagagcgccgtgaagaccaaccccagcaagtacagcagcctgaagagactgaccgacaaggaggccgacgagtactacatgagaagaagacacctgcccgacctggccgccagaggcaccctgcccctgaacgtgatccagatgagccagcagaagcccctgcccagagagagacccagaagacccatcagagccatgagccaggacagagtgctgagccccgacagaggcctgcccgacgagttcagcatgccctacgacagaatcctgagcgacgagcagctgctgagcaccgagagactgcacagccaggaccccctgctgagccccgagagaaccgccttccccgagcagagcctgagcagagccatcagccacaccgacgtgttcgtgagcacccccgtgctggacagatacagaatgagcaagatgcacagccaccccagcgccagcaacaacagctacgccaccctgggccagagccagaccgccgccaagagacacgccttcgccagcagaagacacaacaccgtggagcagctgcactacatccccggccaccacacctgctacaccgccagcaagaccgaggtgaccgtgtag

SEQ ID NO: 21999 - DNA, 1599 bp, Artificial Sequence
  Description of Artificial Sequence: Synthetic coding sequence
atggccctgagaagactgctgctgctgctgctgctgagcctggagagcctggacctgctgcccagcgtgcacggcgccagaggcagagccgccaacagaaccctgagcgccggcggcgccgccgtgggcggcagaagagccggcggcgccctggccagaggcggcagagagctgaacggcaccgccagagcccccggcatccccgaggccggcagcagaagaggccagcccgccgccgccgtggccgccgccgccagcgccgccgtgacctacgagacctgctggggctactacgacgtgagcggccagtacgacaaggagttcgagtgcaacaacagcgagagcggctacctgtactgctgcggcacctgctactacagattctgctgcaagaagagacacgagaagctggaccagagacagtgcaccaactaccagagccccgtgtgggtgcagacccccagcaccaaggtggtgagccccggccccgagaacaagtacgaccccgagaaggacaagaccaacttcaccgtgtacatcacctgcggcgtgatcgccttcgtgatcgtggccggcgtgttcgccaaggtgagctacgacaaggcccacagaccccccagagagatgaacatccacagagccctggccgacatcctgagacagcagggccccatccccatcgcccactgcgagagagagaccatcagcgccatcgacaccagccccaaggagaacacccccgtgagaagcagcagcaagaaccactacacccccgtgagaaccgccaagcagacccccggccactacggcaaggacgcctacagaagcggcggccccgacctgcacaacttcatcagcagcggcttcgtgaccctgggcagaggccacaccaaggagaagcccagaatgaacaacatcctgaccagcgccaccgagccctacgacctgagcttcagcagaagcttccagaacctggcccacctgccccccagctacgagagcgccgtgaagaccaaccccagcaagtacagcagcctgaagagactgaccgacaaggaggccgacgagtactacatgagaagaagacacctgcccgacctggccgccagaggcaccctgcccctgaacgtgatccagatgagccagcagaagcccctgcccagagagagacccagaagacccatcagagccatgagccaggacagagtgctgagccccgacagaggcctgcccgacgagttcagcatgccctacgacagaatcctgagcgacgagcagctgctgagcaccgagagactgcacagccaggaccccctgctgagccccgagagaaccgccttccccgagcagagcctgagcagagccatcagccacaccgacgtgttcgtgagcacccccgtgctggacagatacagaatgagcaagatgcacagccaccccagcgccagcaacaacagctacgccaccctgggccagagccagaccgccgccaagagacacgccttcgccagcagaagacacaacaccgtggagcagctgcactacatccccggccaccacacctgctacaccgccagcaagaccgaggtgaccgtgtag

SEQ ID NO: 22000 - DNA, 1656 bp, Artificial Sequence
  Description of Artificial Sequence: Synthetic coding sequence
atggccctgagaagactgctgctgctgctgctgctgagcctggagagcctggacctgctgcccagcgtgcacggcgccagaggcagagccgccaacagaaccctgagcgccggcggcgccgccgtgggcggcagaagagccggcggcgccctggccagaggcggcagagagctgaacggcaccgccagagcccccggcatccccgaggccggcagcagaagaggccagcccgccgccgccgtggccgccgccgccagcgccgccgtgacctacgagacctgctggggctactacgacgtgagcggccagtacgacaaggagttcgagtgcaacaacagcgagagcggctacctgtactgctgcggcacctgctactacagattctgctgcaagaagagacacgagaagctggaccagagacagtgcaccaactaccagagccccgtgtgggtgcagacccccagcaccaaggtggtgagccccggccccgagaacaagtacgaccccgagaaggacaagaccaacttcaccgtgtacatcacctgcggcgtgatcgccttcgtgatcgtggccggcgtgttcgccaaggtgagctacgacaaggcccacagaccccccagagagatgaacatccacagagccctggccgacatcctgagacagcagggccccatccccatcgcccactgcgagagagagaccatcagcgccatcgacaccagccccaaggagaacacccccgtgagaagcagcagcaagaaccactacacccccgtgagaaccgccaagcagacccccggccactacggcaaggacgcctacagaagcggcggccccgacctgcacaacttcatcagcagcggcttcgtgaccctgggcagaggccacaccaagggcgaccaccagtacaaccaccccatcctgagcagcgtgacccagatccccccccacgagaagcccagaatgaacaacatcctgaccagcgccaccgagccctacgacctgagcttcagcagaagcttccagaacctggcccacctgccccccagctacgagagcgccgtgaagaccaaccccagcaagtacagcagcctgaagagactgaccgacaaggaggccgacgagtactacatgagaagaagacacctgcccgacctggccgccagaggcaccctgcccctgaacgtgatccagatgagccagcagaagcccctgcccagagagagacccagaagacccatcagagccatgagccaggacagagtgctgagccccgacagaggcctgcccgacgagttcagcatgccctacgacagaatcctgagcgacgagcagctgctgagcaccgagagactgcacagccaggaccccctgctgagccccgagagaaccgccttccccgagcagagcctgagcagagccatcagccacaccgacgtgttcgtgagcacccccgtgctggacagatacagaatgagcaagatgcacagccaccccagcgccagcaacaacagctacgccaccctgggccagagccagaccgccgccaagagacacgccttcgccagcagaagacacaacaccgtggagcagctgcactacatccccggccaccacacctgctacaccgccagcaagaccgaggtgaccgtgtag

SEQ ID NO: 22001 - DNA, 930 bp, Artificial Sequence
  Description of Artificial Sequence: Synthetic coding sequence
atgagcttcaacctgcagagcagcaagaagctgttcatcttcctgggcaagagcctgttcagcctgctggaggccatgatcttcgccctgctgcccaagcccagaaagaacgtggccggcgagatcgtgctgatcaccggcgccggcagcggcctgggcagactgctggccctgcagttcgccagactgggcagcgtgctggtgctgtgggacatcaacaaggagggcaacgaggagacctgcaagatggccagagaggccggcgccaccagagtgcacgcctacacctgcgactgcagccagaaggagggcgtgtacagagtggccgaccaggtgaagaaggaggtgggcgacgtgagcatcctgatcaacaacgccggcatcgtgaccggcaagaagttcctggactgccccgacgagctgatggagaagagcttcgacgtgaacttcaaggcccacctgtggacctacaaggccttcctgcccgccatgatcgccaacgaccacggccacctggtgtgcatcagcagcagcgccggcctgagcggcgtgaacggcctggccgactactgcgccagcaagttcgccgccttcggcttcgccgagagcgtgttcgtggagaccttcgtgcagaagcagaagggcatcaagaccaccatcgtgtgccccttcttcatcaagaccggcatgttcgagggctgcaccaccggctgccccagcctgctgcccatcctggagcccaagtacgccgtggagaagatcgtggaggccatcctgcaggagaagatgtacctgtacatgcccaagctgctgtacttcatgatgttcctgaagagcttcctgcccctgaagaccggcctgctgatcgccgactacctgggcatcctgcacgccatggacggcttcgtggaccagaagaagaagctgtag

SEQ ID NO: 22002 - DNA, 798 bp, Artificial Sequence
  Description of Artificial Sequence: Synthetic coding sequence
atgagcttcaacctgcagagcagcaagaagctgttcatcttcctgggcaagagcctgttcagcctgctggaggccatgatcttcgccctgctgcccaagcccagaaagaacgtggccggcgagatcgtgctgatcaccggcgccggcagcggcctgggcagactgctggccctgcagttcgccagactgggcagcgtgctggtgctgtgggacatcaacaaggagggcaacgaggagacctgcaagatggccagagaggccggcgccaccagagtgcacgcctacacctgcgactgcagccagaaggagggcgtgtacagagtggccgaccagacctacaaggccttcctgcccgccatgatcgccaacgaccacggccacctggtgtgcatcagcagcagcgccggcctgagcggcgtgaacggcctggccgactactgcgccagcaagttcgccgccttcggcttcgccgagagcgtgttcgtggagaccttcgtgcagaagcagaagggcatcaagaccaccatcgtgtgccccttcttcatcaagaccggcatgttcgagggctgcaccaccggctgccccagcctgctgcccatcctggagcccaagtacgccgtggagaagatcgtggaggccatcctgcaggagaagatgtacctgtacatgcccaagctgctgtacttcatgatgttcctgaagagcttcctgcccctgaagaccggcctgctgatcgccgactacctgggcatcctgcacgccatggacggcttcgtggaccagaagaagaagctgtag

SEQ ID NO: 22003 - DNA, 693 bp, Artificial Sequence
  Description of Artificial Sequence: Synthetic coding sequence
atgagcttcaacctgcagagcagcaagaagctgttcatcttcctgggcaagagcctgttcagcctgctggaggccatgatcttcgccctgctgcccaagcccagaaagaacgtggccggcgagatcgtgctgatcaccggcgccggcagcggcctgggcagactgctggccctgcagttcgccagactgggcagcgtgctggtgctgtgggacatcaacaaggagggcaacgaggagacctgcaagatggccagagaggccggcgccaccagagtgcacgcctacacctgcgactgcagccagaaggagggcgtgtacagagtggccgaccaggtgaagaaggaggtgggcgacgtgagcatcctgatcaacaacgccggcatcgtgaccggcaagaagttcctggactgccccgacgagctgatggagaagagcttcgacgtgaacttcaaggcccacctgtggacctacaaggccttcctgcccgccatgatcgccaacgaccacggccacctggtgtgcatcagcagcagcgccggcctgagcggcgtgaacggcctggccgactactgcgccagcaagttcgccgccttcggcttcgccgagagcgtgttcgtggagaccttcgtgcagaagcagaagggcatcaagaccaccatcgtgtgccccttctacaagaactggaacgtgtag

SEQ ID NO: 22004 - DNA, 1182 bp, Artificial Sequence
  Description of Artificial Sequence: Synthetic coding sequence
atggaccccaagagaagccagaaggagagcgtgctgatcaccggcggcagcggctacttcggcttcagactgggctgcgccctgaaccagaacggcgtgcacgtgatcctgttcgacatcagcagccccgcccagaccatccccgagggcatcaagttcatccagggcgacatcagacacctgagcgacgtggagaaggccttccaggacgccgacgtgacctgcgtgttccacatcgccagctacggcatgagcggcagagagcagctgaacagaaacctgatcaaggaggtgaacgtgagaggcaccgacaacatcctgcaggtgtgccagagaagaagagtgcccagactggtgtacaccagcaccttcaacgtgatcttcggcggccaggtgatcagaaacggcgacgagagcctgccctacctgcccctgcacctgcaccccgaccactacagcagaaccaagagcatcgccgagcagaaggtgctggaggccaacgccacccccctggacagaggcgacggcgtgctgagaacctgcgccctgagacccgccggcatctacggccccggcgagcagagacacctgcccagaatcgtgagctacatcgagaagggcctgttcaagttcgtgtacggcgaccccagaagcctggtggagttcgtgcacgtggacaacctggtgcaggcccacatcctggccagcgaggccctgagagccgacaagggccacatcgccagcggccagccctacttcatcagcgacggcagacccgtgaacaacttcgagttcttcagacccctggtggagggcctgggctacaccttccccagcaccagactgcccctgaccctggtgtactgcttcgccttcctgaccgagatggtgcacttcatcctgggcagactgtacaacttccagcccttcctgaccagaaccgaggtgtacaagaccggcgtgacccactacttcagcctggagaaggccaagaaggagctgggctacaaggcccagcccttcgacctgcaggaggccgtggagtggttcaaggcccacggccacggcagaagcagcggcagcagagacagcgagtgcttcgtgtgggacggcctgctggtgttcctgctgatcatcgccgtgctgatgtggctgcccagcagcgtgatcctgagcctgtag

SEQ ID NO: 22005 - DNA, 369 bp, Artificial Sequence
  Description of Artificial Sequence: Synthetic coding sequence
atggacggcagcagaaaggaggaggaggaggacagcaccttcaccaacatcagcctggccgacgacatcgaccacagcagcagaatcctgtaccccagacccaagagcctgctgcccaagatgatgaacgccgacatggacgccgtggacgccgagaaccaggtggagctggaggagaagaccagactgatcaaccaggtgctggagctgcagcacaccctggaggacctgagcgccagagtggacgccgtgaaggaggagaacctgaagctgaagagcgagaaccaggtgctgggccagtacatcgagaacctgatgagcgccagcagcgtgttccagaccaccgacaccaagagcaagagaaagtag

SEQ ID NO: 22006 - DNA, 480 bp, Artificial Sequence
  Description of Artificial Sequence: Synthetic coding sequence
atgagaagaagagtgttcagcagccaggactggagagccagcggctgggacggcatgggcttcttcagcagaagaaccttctgcggcagaagcggcagaagctgcagaggccagctggtgcaggtgagcagacccgaggtgagcgccggcagcctgctgctgcccgccccccaggccgaggaccacagcagcagaatcctgtaccccagacccaagagcctgctgcccaagatgatgaacgccgacatggacgccgtggacgccgagaaccaggtggagctggaggagaagaccagactgatcaaccaggtgctggagctgcagcacaccctggaggacctgagcgccagagtggacgccgtgaaggaggagaacctgaagctgaagagcgagaaccaggtgctgggccagtacatcgagaacctgatgagcgccagcagcgtgttccagaccaccgacaccaagagcaagagaaagtag

SEQ ID NO: 22007 - DNA, 369 bp, Artificial Sequence; identical to SEQ ID NO: 22005
  Description of Artificial Sequence: Synthetic coding sequence

SEQ ID NO: 22008 - DNA, 369 bp, Artificial Sequence; identical to SEQ ID NO: 22005
  Description of Artificial Sequence: Synthetic coding sequence

SEQ ID NO: 22009 - DNA, 396 bp, Artificial Sequence
  Description of Artificial Sequence: Synthetic coding sequence
atgagaagaagagtgttcagcagccaggactggagagccagcggctgggacggcatgggcttcttcagcagaagaaccttctgcggcagaagcggcagaagctgcagaggccagctggtgcaggtgagcagacccgaggtgagcgccggcagcctgctgctgcccgccccccaggccgaggaccacagcagcagaatcctgtaccccagacccaagagcctgctgcccaagatgatgaacgccgacatggacgacctgagcgccagagtggacgccgtgaaggaggagaacctgaagctgaagagcgagaaccaggtgctgggccagtacatcgagaacctgatgagcgccagcagcgtgttccagaccaccgacaccaagagcaagagaaagtag

SEQ ID NO: 22010 - DNA, 1191 bp, Artificial Sequence
  Description of Artificial Sequence: Synthetic coding sequence
atgctgcccctgctgctgctgcccctgctgtggggcggcagcctgcaggagaagcccgtgtacgagctgcaggtgcagaagagcgtgaccgtgcaggagggcctgtgcgtgctggtgccctgcagcttcagctacccctggagaagctggtacagcagcccccccctgtacgtgtactggttcagagacggcgagatcccctactacgccgaggtggtggccaccaacaaccccgacagaagagtgaagcccgagacccagggcagattcagactgctgggcgacgtgcagaagaagaactgcagcctgagcatcggcgacgccagaatggaggacaccggcagctacttcttcagagtggagagaggcagagacgtgaagtacagctaccagcagaacaagctgaacctggaggtgaccgccctgatcgagaagcccgacatccacttcctggagcccctggagagcggcagacccaccagactgagctgcagcctgcccggcagctgcgaggccggcccccccctgaccttcagctggaccggcaacgccctgagccccctggaccccgagaccaccagaagcagcgagctgaccctgacccccagacccgaggaccacggcaccaacctgacctgccaggtgaagagacagggcgcccaggtgaccaccgagagaaccgtgcagctgaacgtgagctacgccccccagaacctggccatcagcatcttcttcagaaacggcaccggcaccgccctgagaatcctgagcaacggcatgagcgtgcccatccaggagggccagagcctgttcctggcctgcaccgtggacagcaacccccccgccagcctgagctggttcagagagggcaaggccctgaaccccagccagaccagcatgagcggcaccctggagctgcccaacatcggcgccagagagggcggcgagttcacctgcagagtgcagcaccccctgggcagccagcacctgagcttcatcctgagcgtgcagagaagcagcagcagctgcatctgcgtgaccgagaagcagcagggcagctggcccctggtgctgaccctgatcagaggcgccctgatgggcgccggcttcctgctgacctacggcctgacctggatctactacaccagatgcggcggcccccagcagagcagagccgagagacccggctag

SEQ ID NO: 22011 - DNA, 987 bp, Artificial Sequence
  Description of Artificial Sequence: Synthetic coding sequence
atggagaagagcatctggctgctggcctgcctggcctgggtgctgcccaccggcagcttcgtgagaaccaagatcgacaccaccgagaacctgctgaacaccgaggtgcacagcagccccgcccagagatggagcatgcaggtgccccccgaggtgagcgccgaggccggcgacgccgccgtgctgccctgcaccttcacccacccccacagacactacgacggccccctgaccgccatctggagagccggcgagccctacgccggcccccaggtgttcagatgcgccgccgccagaggcagcgagctgtgccagaccgccctgagcctgcacggcagattcagactgctgggcaaccccagaagaaacgacctgagcctgagagtggagagactggccctggccgacgacagaagatacttctgcagagtggagttcgccggcgacgtgcacgacagatacgagagcagacacggcgtgagactgcacgtgaccgccgcccccagaatcgtgaacatcagcgtgctgcccagccccgcccacgccttcagagccctgtgcaccgccgagggcgagcccccccccgccctggcctggagcggccccgccctgggcaacagcctggccgccgtgagaagccccagagagggccacggccacctggtgaccgccgagctgcccgccctgacccacgacggcagatacacctgcaccgccgccaacagcctgggcagaagcgaggccagcgtgtacctgttcagattccacggcgccagcggcgccagcaccgtggccctgctgctgggcgccctgggcttcaaggccctgctgctgctgggcgtgctggccgccagagccgccagaagaagacccgagcacctggacacccccgacaccccccccagaagccaggcccaggagagcaactacgagaacctgagccagatgaaccccagaagcccccccgccaccatgtgcagcccctag

SEQ ID NO: 22012 - DNA, 525 bp, Artificial Sequence
  Description of Artificial Sequence: Synthetic coding sequence
atgaccgccaccagagccgccaccgccagcggcagcgcccccagaatcgtgaacatcagcgtgctgcccagccccgcccacgccttcagagccctgtgcaccgccgagggcgagcccccccccgccctggcctggagcggccccgccctgggcaacagcctggccgccgtgagaagccccagagagggccacggccacctggtgaccgccgagctgcccgccctgacccacgacggcagatacacctgcaccgccgccaacagcctgggcagaagcgaggccagcgtgtacctgttcagattccacggcgccagcggcgccagcaccgtggccctgctgctgggcgccctgggcttcaaggccctgctgctgctgggcgtgctggccgccagagccgccagaagaagacccgagcacctggacacccccgacaccccccccagaagccaggcccaggagagcaactacgagaacctgagccagatgaaccccagaagcccccccgccaccatgtgcagcccctag

SEQ ID NO: 22013 - DNA, 1494 bp, Artificial Sequence
  Description of Artificial Sequence: Synthetic coding sequence
atgatgagcagcgccgccttccccagatggctgcagagcatgggcgtgcccagaacccccagcagaaccgtgctgttcgagagagagagaaccggcctgacctacagagtgcccagcctgctgcccgtgccccccggccccaccctgctggccttcgtggagcagagactgagccccgacgacagccacgcccacagactggtgctgagaagaggcaccctggccggcggcagcgtgagatggggcgccctgcacgtgctgggcaccgccgccctggccgagcacagaagcatgaacccctgccccgtgcacgacgccggcaccggcaccgtgttcctgttcttcatcgccgtgctgggccacacccccgaggccgtgcagatcgccaccggcagaaacgccgccagactgtgctgcgtggccagcagagacgccggcctgagctggggcagcgccagagacctgaccgaggaggccatcggcggcgccgtgcaggactgggccaccttcgccgtgggccccggccacggcgtgcagctgcccagcggcagactgctggtgcccgcctacacctacagagtggacagaagagagtgcttcggcaagatctgcagaaccagcccccacagcttcgccttctacagcgacgaccacggcagaacctggagatgcggcggcctggtgcccaacctgagaagcggcgagtgccagctggccgccgtggacggcggccaggccggcagcttcctgtactgcaacgccagaagccccctgggcagcagagtgcaggccctgagcaccgacgagggcaccagcttcctgcccgccgagagagtggccagcctgcccgagaccgcctggggctgccagggcagcatcgtgggcttccccgcccccgcccccaacagacccagagacgacagctggagcgtgggccccggcagccccctgcagccccccctgctgggccccggcgtgcacgagccccccgaggaggccgccgtggaccccagaggcggccaggtgcccggcggccccttcagcagactgcagcccagaggcgacggccccagacagcccggccccagacccggcgtgagcggcgacgtgggcagctggaccctggccctgcccatgcccttcgccgcccccccccagagccccacctggctgctgtacagccaccccgtgggcagaagagccagactgcacatgggcatcagactgagccagagccccctggaccccagaagctggaccgagccctgggtgatctacgagggccccagcggctacagcgacctggccagcatcggccccgcccccgagggcggcctggtgttcgcctgcctgtacgagagcggcgccagaaccagctacgacgagatcagcttctgcaccttcagcctgagagaggtgctggagaacgtgcccgccagccccaagccccccaacctgggcgacaagcccagaggctgctgctggcccagctag

SEQ ID NO: 22014 - DNA, 1455 bp, Artificial Sequence
  Description of Artificial Sequence: Synthetic coding sequence
atgggcgtgcccagaacccccagcagaaccgtgctgttcgagagagagagaaccggcctgacctacagagtgcccagcctgctgcccgtgccccccggccccaccctgctggccttcgtggagcagagactgagccccgacgacagccacgcccacagactggtgctgagaagaggcaccctggccggcggcagcgtgagatggggcgccctgcacgtgctgggcaccgccgccctggccgagcacagaagcatgaacccctgccccgtgcacgacgccggcaccggcaccgtgttcctgttcttcatcgccgtgctgggccacacccccgaggccgtgcagatcgccaccggcagaaacgccgccagactgtgctgcgtggccagcagagacgccggcctgagctggggcagcgccagagacctgaccgaggaggccatcggcggcgccgtgcaggactgggccaccttcgccgtgggccccggccacggcgtgcagctgcccagcggcagactgctggtgcccgcctacacctacagagtggacagaagagagtgcttcggcaagatctgcagaaccagcccccacagcttcgccttctacagcgacgaccacggcagaacctggagatgcggcggcctggtgcccaacctgagaagcggcgagtgccagctggccgccgtggacggcggccaggccggcagcttcctgtactgcaacgccagaagccccctgggcagcagagtgcaggccctgagcaccgacgagggcaccagcttcctgcccgccgagagagtggccagcctgcccgagaccgcctggggctgccagggcagcatcgtgggcttccccgcccccgcccccaacagacccagagacgacagctggagcgtgggccccggcagccccctgcagccccccctgctgggccccggcgtgcacgagccccccgaggaggccgccgtggaccccagaggcggccaggtgcccggcggccccttcagcagactgcagcccagaggcgacggccccagacagcccggccccagacccggcgtgagcggcgacgtgggcagctggaccctggccctgcccatgcccttcgccgcccccccccagagccccacctggctgctgtacagccaccccgtgggcagaagagccagactgcacatgggcatcagactgagccagagccccctggaccccagaagctggaccgagccctgggtgatctacgagggccccagcggctacagcgacctggccagcatcggccccgcccccgagggcggcctggtgttcgcctgcctgtacgagagcggcgccagaaccagctacgacgagatcagcttctgcaccttcagcctgagagaggtgctggagaacgtgcccgccagccccaagccccccaacctgggcgacaagcccagaggctgctgctggcccagctag

SEQ ID NO: 22015 - DNA, 1491 bp, Artificial Sequence
  Description of Artificial Sequence: Synthetic coding sequence
atgatgagcagcgccgccttccccagatggctgagcatgggcgtgcccagaacccccagcagaaccgtgctgttcgagagagagagaaccggcctgacctacagagtgcccagcctgctgcccgtgccccccggccccaccctgctggccttcgtggagcagagactgagccccgacgacagccacgcccacagactggtgctgagaagaggcaccctggccggcggcagcgtgagatggggcgccctgcacgtgctgggcaccgccgccctggccgagcacagaagcatgaacccctgccccgtgcacgacgccggcaccggcaccgtgttcctgttcttcatcgccgtgctgggccacacccccgaggccgtgcagatcgccaccggcagaaacgccgccagactgtgctgcgtggccagcagagacgccggcctgagctggggcagcgccagagacctgaccgaggaggccatcggcggcgccgtgcaggactgggccaccttcgccgtgggccccggccacggcgtgcagctgcccagcggcagactgctggtgcccgcctacacctacagagtggacagaagagagtgcttcggcaagatctgcagaaccagcccccacagcttcgccttctacagcgacgaccacggcagaacctggagatgcggcggcctggtgcccaacctgagaagcggcgagtgccagctggccgccgtggacggcggccaggccggcagcttcctgtactgcaacgccagaagccccctgggcagcagagtgcaggccctgagcaccgacgagggcaccagcttcctgcccgccgagagagtggccagcctgcccgagaccgcctggggctgccagggcagcatcgtgggcttccccgcccccgcccccaacagacccagagacgacagctggagcgtgggccccggcagccccctgcagccccccctgctgggccccggcgtgcacgagccccccgaggaggccgccgtggaccccagaggcggccaggtgcccggcggccccttcagcagactgcagcccagaggcgacggccccagacagcccggccccagacccggcgtgagcggcgacgtgggcagctggaccctggccctgcccatgcccttcgccgcccccccccagagccccacctggctgctgtacagccaccccgtgggcagaagagccagactgcacatgggcatcagactgagccagagccccctggaccccagaagctggaccgagccctgggtgatctacgagggccccagcggctacagcgacctggccagcatcggccccgcccccgagggcggcctggtgttcgcctgcctgtacgagagcggcgccagaaccagctacgacgagatcagcttctgcaccttcagcctgagagaggtgctggagaacgtgcccgccagccccaagccccccaacctgggcgacaagcccagaggctgctgctggcccagctag

SEQ ID NO: 22016 - DNA, 1455 bp, Artificial Sequence; identical to SEQ ID NO: 22014
  Description of Artificial Sequence: Synthetic coding sequence

SEQ ID NO: 22017 - DNA, 1455 bp, Artificial Sequence; identical to SEQ ID NO: 22014
  Description of Artificial Sequence: Synthetic coding sequence

SEQ ID NO: 22018 - DNA, 783 bp, Artificial Sequence
  Description of Artificial Sequence: Synthetic coding sequence
atgggcgtgcccagaacccccagcagaaccgtgctgttcgagagagagagaaccggcctgacctacagagtgcccagcctgctgcccgtgccccccggccccaccctgctggccttcgtggagcagagactgagccccgacgacagccacgcccacagactggtgctgagaagaggcaccctggccggcggcagcgtgagatggggcgccctgcacgtgctgggcaccgccgccctggccgagcacagaagcatgaacccctgccccgtgcacgacgccggcaccggcaccgtgttcctgttcttcatcgccgtgctgggccacacccccgaggccgtgcagatcgccaccggcagaaacgccgccagactgtgctgcgtggccagcagagacgccggcctgagctggggcagcgccagagacctgaccgaggaggccatcggcggcgccgtgcaggactgggccaccttcgccgtgggccccggccacggcgtgcagctgcccagcggcagactgctggtgcccgcctacacctacagagtggacagaagagagtgcttcggcaagatctgcagaaccagcccccacagcttcgccttctacagcgacgaccacggcagaacctggagatgcggcggcctggtgcccaacctgagaagcggcgagtgccagctggccgccgtggacggcggccaggccggcagcttcctgtactgcaacgccagaagccccctgggcagcagagtgcaggccctgagcaccgacgagggcaccagcttctag

SEQ ID NO: 22019 - DNA, 567 bp, Artificial Sequence
  Description of Artificial Sequence: Synthetic coding sequence
atgggcgtgcccagaacccccagcagaaccgtgctgttcgagagagagagaaccggcctgacctacagagtgcccagcctgctgcccgtgccccccggccccaccctgctggccttcgtggagcagagactgagccccgacgacagccacgcccacagactggtgctgagaagaggcaccctggccggcggcagcgtgagatggggcgccctgcacgtgctgggcaccgccgccctggccgagcacagaagcatgaacccctgccccgtgcacgacgccggcaccggcaccgtgttcctgttcttcatcgccgtgctgggccacacccccgaggccgtgcagatcgccaccggcagaaacgccgccagactgtgctgcgtggccagcagagacgccggcctgagctggggcagcgccagagacctgaccgaggaggccatcggcggcgccgtgcaggactgggccaccttcgccgtgggccccggccacggcgtgcagctgcccagcggcagactgctggtgcccgcctacacctacagagtggacagaagagagtgcttcggctag

SEQ ID NO: 22020 - DNA, 1485 bp, Artificial Sequence
  Description of Artificial Sequence: Synthetic coding sequence
atgaagctgcaggagggccacaccgtgctgctgagcctgcccctgagactggccggcaccgagaccgagcacggcggccccagctaccccttcaccgacagcgccctgagagccggcgaggacggccccgacctgcccagagccctggccgcccccagagccccccccgacgacagccacgcccacagactggtgctgagaagaggcaccctggccggcggcagcgtgagatggggcgccctgcacgtgctgggcaccgccgccctggccgagcacagaagcatgaacccctgccccgtgcacgacgccggcaccggcaccgtgttcctgttcttcatcgccgtgctgggccacacccccgaggccgtgcagatcgccaccggcagaaacgccgccagactgtgctgcgtggccagcagagacgccggcctgagctggggcagcgccagagacctgaccgaggaggccatcggcggcgccgtgcaggactgggccaccttcgccgtgggccccggccacggcgtgcagctgcccagcggcagactgctggtgcccgcctacacctacagagtggacagaagagagtgcttcggcaagatctgcagaaccagcccccacagcttcgccttctacagcgacgaccacggcagaacctggagatgcggcggcctggtgcccaacctgagaagcggcgagtgccagctggccgccgtggacggcggccaggccggcagcttcctgtactgcaacgccagaagccccctgggcagcagagtgcaggccctgagcaccgacgagggcaccagcttcctgcccgccgagagagtggccagcctgcccgagaccgcctggggctgccagggcagcatcgtgggcttccccgcccccgcccccaacagacccagagacgacagctggagcgtgggccccggcagccccctgcagccccccctgctgggccccggcgtgcacgagccccccgaggaggccgccgtggaccccagaggcggccaggtgcccggcggccccttcagcagactgcagcccagaggcgacggccccagacagcccggccccagacccggcgtgagcggcgacgtgggcagctggaccctggccctgcccatgcccttcgccgcccccccccagagccccacctggctgctgtacagccaccccgtgggcagaagagccagactgcacatgggcatcagactgagccagagccccctggaccccagaagctggaccgagccctgggtgatctacgagggccccagcggctacagcgacctggccagcatcggccccgcccccgagggcggcctggtgttcgcctgcctgtacgagagcggcgccagaaccagctacgacgagatcagcttctgcaccttcagcctgagagaggtgctggagaacgtgcccgccagccccaagccccccaacctgggcgacaagcccagaggctgctgctggcccagctag

SEQ ID NO: 22021 - DNA, 2484 bp, Artificial Sequence
  Description of Artificial Sequence: Synthetic coding sequence
atgagaggctgcctgagactggccctgctgtgcgccctgccctggctgctgctggccgccagccccggccaccccgccaagagccccagacagccccccgcccccagaagagaccccttcgacgccgccagaggcgccgacttcgaccacgtgtacagcggcgtggtgaacctgagcaccgagaacatctacagcttcaactacaccagccagcccgaccaggtgaccgccgtgagagtgtacgtgaacagcagcagcgagaacctgaactaccccgtgctggtggtggtgagacagcagaaggaggtgctgagctggcaggtgcccctgctgttccagggcctgtaccagagaagctacaactaccaggaggtgagcagaaccctgtgccccagcgaggccaccaacgagaccggccccctgcagcagctgatcttcgtggacgtggccagcatggcccccctgggcgcccagtacaagctgctggtgaccaagctgaagcacttccagctgagaaccaacgtggccttccacttcaccgccagccccagccagccccagtacttcctgtacaagttccccaaggacgtggacagcgtgatcatcaaggtggtgagcgagatggcctacccctgcagcgtggtgagcgtgcagaacatcatgtgccccgtgtacgacctggaccacaacgtggagttcaacggcgtgtaccagagcatgaccaagaaggccgccatcaccctgcagaagaaggacttccccggcgagcagttcttcgtggtgttcgtgatcaagcccgaggactacgcctgcggcggcagcttcttcatccaggagaaggagaaccagacctggaacctgcagagaaagaagaacctggaggtgaccatcgtgcccagcatcaaggagagcgtgtacgtgaagagcagcctgttcagcgtgttcatcttcctgagcttctacctgggctgcctgctggtgggcttcgtgcactacctgagattccagagaaagagcatcgacggcagcttcggcagcaacgacggcagcggcaacatggtggccagccaccccatcgccgccagcacccccgagggcagcaactacggcaccatcgacgagagcagcagcagccccggcagacagatgagcagcagcgacggcggcccccccggccagagcgacaccgacagcagcgtggaggagagcgacttcgacaccatgcccgacatcgagagcgacaagaacatcatcagaaccaagatgttcctgtacctgagcgacctgagcagaaaggacagaagaatcgtgagcaagaagtacaagatctacttctggaacatcatcaccatcgccgtgttctacgccctgcccgtgatccagctggtgatcacctaccagaccgtggtgaacgtgaccggcaaccaggacatctgctactacaacttcctgtgcgcccaccccctgggcgtgctgagcgccttcaacaacatcctgagcaacctgggccacgtgctgctgggcttcctgttcctgctgatcgtgctgagaagagacatcctgcacagaagagccctggaggccaaggacatcttcgccgtggagtacggcatccccaagcacttcggcctgttctacgccatgggcatcgccctgatgatggagggcgtgctgagcgcctgctaccacgtgtgccccaactacagcaacttccagttcgacaccagcttcatgtacatgatcgccggcctgtgcatgctgaagctgtaccagaccagacaccccgacatcaacgccagcgcctacagcgcctacgccagcttcgccgtggtgatcatggtgaccgtgctgggcgtggtgttcggcaagaacgacgtgtggttctgggtgatcttcagcgccatccacgtgctggccagcctggccctgagcacccagatctactacatgggcagattcaagatcgacctgggcatcttcagaagagccgccatggtgttctacaccgactgcatccagcagtgcagcagacccctgtacatggacagaatggtgctgctggtggtgggcaacctggtgaactggagcttcgccctgttcggcctgatctacagacccagagacttcgccagctacatgctgggcatcttcatctgcaacctgctgctgtacctggccttctacatcatcatgaagctgagaagcagcgagaaggtgctgcccgtgcccctgttctgcatcgtggccaccgccgtgatgtgggccgccgccctgtacttcttcttccagaacctgagcagctgggagggcacccccgccgagagcagagagaagaacagagagtgcatcctgctggacttcttcgacgaccacgacatctggcacttcctgagcgccaccgccctgttcttcagcttcctggtgctgctgaccctggacgacgacctggacgtggtgagaagagaccagatccccgtgttctag

SEQ ID NO: 22022 - DNA, 2499 bp, Artificial Sequence
  Description of Artificial Sequence: Synthetic coding sequence
atgagaggctgcctgagactggccctgctgtgcgccctgccctggctgctgctggccgccagccccggccaccccgccaagagccccagacagccccccgcccccagaagagaccccttcgacgccgccagaggcgccgacttcgaccacgtgtacagcggcgtggtgaacctgagcaccgagaacatctacagcttcaactacaccagccagcccgaccaggtgaccgccgtgagagtgtacgtgaacagcagcagcgagaacctgaactaccccgtgctggtggtggtgagacagcagaaggaggtgctgagctggcaggtgcccctgctgttccagggcctgtaccagagaagctacaactaccaggaggtgagcagaaccctgtgccccagcgaggccaccaacgagaccggccccctgcagcagctgatcttcgtggacgtggccagcatggcccccctgggcgcccagtacaagctgctggtgaccaagctgaagcacttccagctgagaaccaacgtggccttccacttcaccgccagccccagccagccccagtacttcctgtacaagttccccaaggacgtggacagcgtgatcatcaaggtggtgagcgagatggcctacccctgcagcgtggtgagcgtgcagaacatcatgtgccccgtgtacgacctggaccacaacgtggagttcaacggcgtgtaccagagcatgaccaagaaggccgccatcaccctgcagaagaaggacttccccggcgagcagttcttcgtggtgttcgtgatcaagcccgaggactacgcctgcggcggcagcttcttcatccaggagaaggagaaccagacctggaacctgcagagaaagaagaacctggaggtgaccatcgtgcccagcatcaaggagagcgtgtacgtgaagagcagcctgttcagcgtgttcatcttcctgagcttctacctgggctgcctgctggtgggcttcgtgcactacctgagattccagagaaagagcatcgacggcagcttcggcagcaacgacggcagcggcaacatggtggccagccaccccatcgccgccagcacccccgagggcagcaactacggcaccatcgacgagagcagcagcagccccggcagacagatgagcagcagcgacggcggcccccccggccagagcgacaccgacagcagcgtggaggagagcgacttcgacaccatgcccgacatcgagagcgacaagaacatcatcagaaccaagatgttcctgtacctgagcgacctgagcagaaaggacagaagaatcgtgagcaagaagtacaagatctacttctggaacatcatcaccatcgccgtgttctacgccctgcccgtgatccagctggtgatcacctaccagaccgtggtgaacgtgaccggcaaccaggacatctgctactacaacttcctgtgcgcccaccccctgggcgtgctgagcgccttcaacaacatcctgagcaacctgggccacgtgctgctgggcttcctgttcctgctgatcgtgctgagaagagacatcctgcacagaagagccctggaggccaaggacatcttcgccgtggagtacggcatccccaagcacttcggcctgttctacgccatgggcatcgccctgatgatggagggcgtgctgagcgcctgctaccacgtgtgccccaactacagcaacttccagttcgacaccagcttcatgtacatgatcgccggcctgtgcatgctgaagctgtaccagaccagacaccccgacatcaacgccagcgcctacagcgcctacgccagcttcgccgtggtgatcatggtgaccgtgctgggcgtggtgttcggcaagaacgacgtgtggttctgggtgatcttcagcgccatccacgtgctggccagcctggccctgagcacccagatctactacatgggcagattcaagatcgccatcacccccaccgacctgggcatcttcagaagagccgccatggtgttctacaccgactgcatccagcagtgcagcagacccctgtacatggacagaatggtgctgctggtggtgggcaacctggtgaactggagcttcgccctgttcggcctgatctacagacccagagacttcgccagctacatgctgggcatcttcatctgcaacctgctgctgtacctggccttctacatcatcatgaagctgagaagcagcgagaaggtgctgcccgtgcccctgttctgcatcgtggccaccgccgtgatgtgggccgccgccctgtacttcttcttccagaacctgagcagctgggagggcacccccgccgagagcagagagaagaacagagagtgcatcctgctggacttcttcgacgaccacgacatctggcacttcctgagcgccaccgccctgttcttcagcttcctggtgctgctgaccctggacgacgacctggacgtggtgagaagagaccagatccccgtgttctag

SEQ ID NO: 22023 - DNA, 2568 bp, Artificial Sequence
  Description of Artificial Sequence: Synthetic coding sequence
atgttcgccctgggcctgcccttcctggtgctgctggtggccagcgtggagagccacctgggcgtgctgggccccaagaacgtgagccagaaggacgccgagttcgagagaacctacgtggacgaggtgaacagcgagctggtgaacatctacaccttcaaccacaccgtgaccagaaacagaaccgagggcgtgagagtgagcgtgaacgtgctgaacaagcagaagggcgcccccctgctgttcgtggtgagacagaaggaggccgtggtgagcttccaggtgcccctgatcctgagaggcatgttccagagaaagtacctgtaccagaaggtggagagaaccctgtgccagccccccaccaagaacgagagcgagatccagttcttctacgtggacgtgagcaccctgagccccgtgaacaccacctaccagctgagagtgagcagaatggacgacttcgtgctgagaaccggcgagcagttcagcttcaacaccaccgccgcccagccccagtacttcaagtacgagttccccgagggcgtggacagcgtgatcgtgaaggtgaccagcaacaaggccttcccctgcagcgtgatcagcatccaggacgtgctgtgccccgtgtacgacctggacaacaacgtggccttcatcggcatgtaccagaccatgaccaagaaggccgccatcaccgtgcagagaaaggacttccccagcaacagcttctacgtggtggtggtggtgaagaccgaggaccaggcctgcggcggcagcctgcccttctaccccttcgccgaggacgagcccgtggaccagggccacagacagaagaccctgagcgtgctggtgagccaggccgtgaccagcgaggcctacgtgagcggcatgctgttctgcctgggcatcttcctgagcttctacctgctgaccgtgctgctggcctgctgggagaactggagacagaagaagaagaccctgctggtggccatcgacagagcctgccccgagagcggccaccccagagtgctggccgacagcttccccggcagcagcccctacgagggctacaactacggcagcttcgagaacgtgagcggcagcaccgacggcctggtggacagcgccggcaccggcgacctgagctacggctaccagggccacgaccagttcaagagaagactgcccagcggccagatgagacagctgtgcatcgccatgggcagaagcttcgagcccgtgggcaccagacccagagtggacagcatgagcagcgtggaggaggacgactacgacaccctgaccgacatcgacagcgacaagaacgtgatcagaaccaagcagtacctgtacgtggccgacctggccagaaaggacaagagagtgctgagaaagaagtaccagatctacttctggaacatcgccaccatcgccgtgttctacgccctgcccgtggtgcagctggtgatcacctaccagaccgtggtgaacgtgaccggcaaccaggacatctgctactacaacttcctgtgcgcccaccccctgggcaacctgagcgccttcaacaacatcctgagcaacctgggctacatcctgctgggcctgctgttcctgctgatcatcctgcagagagagatcaaccacaacagagccctgctgagaaacgacctgtgcgccctggagtgcggcatccccaagcacttcggcctgttctacgccatgggcaccgccctgatgatggagggcctgctgagcgcctgctaccacgtgtgccccaactacaccaacttccagttcgacaccagcttcatgtacatgatcgccggcctgtgcatgctgaagctgtaccagaagagacaccccgacatcaacgccagcgcctacagcgcctacgcctgcctggccatcgtgatcttcttcagcgtgctgggcgtggtgttcggcaagggcaacaccgccttctggatcgtgttcagcatcatccacatcatcgccaccctgctgctgagcacccagctgtactacatgggcagatggaagctggacagcggcatcttcagaagaatcctgcacgtgctgtacaccgactgcatcagacagtgcagcggccccctgtacgtggacagaatggtgctgctggtgatgggcaacgtgatcaactggagcctggccgcctacggcctgatcatgagacccaacgacttcgccagctacctgctggccatcggcatctgcaacctgctgctgtacttcgccttctacatcatcatgaagctgagaagcggcgagagaatcaagctgatccccctgctgtgcatcgtgtgcaccagcgtggtgtggggcttcgccctgttcttcttcttccagggcctgagcacctggcagaagacccccgccgagagcagagagcacaacagagactgcatcctgctggacttcttcgacgaccacgacatctggcacttcctgagcagcatcgccatgttcggcagcttcctggtgagcggcccccccggcagagccggctgggtgagagagggcagcagctgcctgctgctgtgcggctag

SEQ ID NO: 22024 - DNA, 2499 bp, Artificial Sequence
  Description of Artificial Sequence: Synthetic coding sequence
atgttcgccctgggcctgcccttcctggtgctgctggtggccagcgtggagagccacctgggcgtgctgggccccaagaacgtgagccagaaggacgccgagttcgagagaacctacgtggacgaggtgaacagcgagctggtgaacatctacaccttcaaccacaccgtgaccagaaacagaaccgagggcgtgagagtgagcgtgaacgtgctgaacaagcagaagggcgcccccctgctgttcgtggtgagacagaaggaggccgtggtgagcttccaggtgcccctgatcctgagaggcatgttccagagaaagtacctgtaccagaaggtggagagaaccctgtgccagccccccaccaagaacgagagcgagatccagttcttctacgtggacgtgagcaccctgagccccgtgaacaccacctaccagctgagagtgagcagaatggacgacttcgtgctgagaaccggcgagcagttcagcttcaacaccaccgccgcccagccccagtacttcaagtacgagttccccgagggcgtggacagcgtgatcgtgaaggtgaccagcaacaaggccttcccctgcagcgtgatcagcatccaggacgtgctgtgccccgtgtacgacctggacaacaacgtggccttcatcggcatgtaccagaccatgaccaagaaggccgccatcaccgtgcagagaaaggacttccccagcaacagcttctacgtggtggtggtggtgaagaccgaggaccaggcctgcggcggcagcctgcccttctaccccttcgccgaggacgagcccgtggaccagggccacagacagaagaccctgagcgtgctggtgagccaggccgtgaccagcgaggcctacgtgagcggcatgctgttctgcctgggcatcttcctgagcttctacctgctgaccgtgctgctggcctgctgggagaactggagacagaagaagaagaccctgctggtggccatcgacagagcctgccccgagagcggccaccccagagtgctggccgacagcttccccggcagcagcccctacgagggctacaactacggcagcttcgagaacgtgagcggcagcaccgacggcctggtggacagcgccggcaccggcgacctgagctacggctaccagggcagaagcttcgagcccgtgggcaccagacccagagtggacagcatgagcagcgtggaggaggacgactacgacaccctgaccgacatcgacagcgacaagaacgtgatcagaaccaagcagtacctgtacgtggccgacctggccagaaaggacaagagagtgctgagaaagaagtaccagatctacttctggaacatcgccaccatcgccgtgttctacgccctgcccgtggtgcagctggtgatcacctaccagaccgtggtgaacgtgaccggcaaccaggacatctgctactacaacttcctgtgcgcccaccccctgggcaacctgagcgccttcaacaacatcctgagcaacctgggctacatcctgctgggcctgctgttcctgctgatcatcctgcagagagagatcaaccacaacagagccctgctgagaaacgacctgtgcgccctggagtgcggcatccccaagcacttcggcctgttctacgccatgggcaccgccctgatgatggagggcctgctgagcgcctgctaccacgtgtgccccaactacaccaacttccagttcgacaccagcttcatgtacatgatcgccggcctgtgcatgctgaagctgtaccagaagagacaccccgacatcaacgccagcgcctacagcgcctacgcctgcctggccatcgtgatcttcttcagcgtgctgggcgtggtgttcggcaagggcaacaccgccttctggatcgtgttcagcatcatccacatcatcgccaccctgctgctgagcacccagctgtactacatgggcagatggaagctggacagcggcatcttcagaagaatcctgcacgtgctgtacaccgactgcatcagacagtgcagcggccccctgtacgtggacagaatggtgctgctggtgatgggcaacgtgatcaactggagcctggccgcctacggcctgatcatgagacccaacgacttcgccagctacctgctggccatcggcatctgcaacctgctgctgtacttcgccttctacatcatcatgaagctgagaagcggcgagagaatcaagctgatccccctgctgtgcatcgtgtgcaccagcgtggtgtggggcttcgccctgttcttcttcttccagggcctgagcacctggcagaagacccccgccgagagcagagagcacaacagagactgcatcctgctggacttcttcgacgaccacgacatctggcacttcctgagcagcatcgccatgttcggcagcttcctggtgctgctgaccctggacgacgacctggacaccgtgcagagagacaagatctacgtgttctag

SEQ ID NO: 22025 - DNA, 561 bp, Artificial Sequence
  Description of Artificial Sequence: Synthetic coding sequence
atgttcgccctgggcctgcccttcctggtgctgctggtggccagcgtggagagccacctgggcgtgctgggccccaagaacgtgagccagaaggacgccgagttcgagagaacctacgtggacagaatggtgctgctggtgatgggcaacgtgatcaactggagcctggccgcctacggcctgatcatgagacccaacgacttcgccagctacctgctggccatcggcatctgcaacctgctgctgtacttcgccttctacatcatcatgaagctgagaagcggcgagagaatcaagctgatccccctgctgtgcatcgtgtgcaccagcgtggtgtggggcttcgccctgttcttcttcttccagggcctgagcacctggcagaagacccccgccgagagcagagagcacaacagagactgcatcctgctggacttcttcgacgaccacgacatctggcacttcctgagcagcatcgccatgttcggcagcttcctggtgctgctgaccctggacgacgacctggacaccgtgcagagagacaagatctacgtgttctag

SEQ ID NO: 22026 - DNA, 2490 bp, Artificial Sequence
  Description of Artificial Sequence: Synthetic coding sequence
atgttcgccctgggcctgcccttcctggtgctgctggtggccagcgtggagagccacctgggcgtgctgggccccaagaacgtgagccagaaggacgccgagttcgagagaacctacgtggacgaggtgaacagcgagctggtgaacatctacaccttcaaccacaccgtgaccagaaacagaaccgagggcgtgagagtgagcgtgaacgtgctgaacaagcagaagggcgcccccctgctgttcgtggtgagacagaaggaggccgtggtgagcttccaggtgcccctgatcctgagaggcatgttccagagaaagtacctgtaccagaaggtggagagaaccctgtgccagccccccaccaagaacgagagcgagatccagttcttctacgtggacgtgagcaccctgagccccgtgaacaccacctaccagctgagagtgagcagaatggacgacttcgtgctgagaaccggcgagcagttcagcttcaacaccaccgccgcccagccccagtacttcaagtacgagttccccgagggcgtggacagcgtgatcgtgaaggtgaccagcaacaaggccttcccctgcagcgtgatcagcatccaggacgtgctgtgccccgtgtacgacctggacaacaacgtggccttcatcggcatgtaccagaccatgaccaagaaggccgccatcaccgtgcagagaaaggacttccccagcaacagcttctacgtggtggtggtggtgaagaccgaggaccaggcctgcggcggcagcctgcccttctaccccttcgccgaggacgagcccgtggaccagggccacagacagaagaccctgagcgtgctggtgagccaggccgtgaccagcgaggcctacgtgagcggcatgctgttctgcctgggcatcttcctgagcttctacctgctgaccgtgctgctggcctgctgggagaactggagacagaagaagaagaccctgctggtggccatcgacagagcctgccccgagagcgccagcctgctgggccaccccagagtgctggccgacagcttccccggcagcagcccctacgagggctacaactacggcagcttcgagaacgtgagcggcagcaccgacggcctggtggacagcgccggcaccggcgacctgagctacggctaccagggcaccagacccagagtggacagcatgagcagcgtggaggaggacgactacgacaccctgaccgacatcgacagcgacaagaacgtgatcagaaccaagcagtacctgtacgtggccgacctggccagaaaggacaagagagtgctgagaaagaagtaccagatctacttctggaacatcgccaccatcgccgtgttctacgccctgcccgtggtgcagctggtgatcacctaccagaccgtggtgaacgtgaccggcaaccaggacatctgctactacaacttcctgtgcgcccaccccctgggcaacctgagcgccttcaacaacatcctgagcaacctgggctacatcctgctgggcctgctgttcctgctgatcatcctgcagagagagatcaaccacaacagagccctgctgagaaacgacctgtgcgccctggagtgcggcatccccaagcacttcggcctgttctacgccatgggcaccgccctgatgatggagggcctgctgagcgcctgctaccacgtgtgccccaactacaccaacttccagttcgacaccagcttcatgtacatgatcgccggcctgtgcatgctgaagctgtaccagaagagacaccccgacatcaacgccagcgcctacagcgcctacgcctgcctggccatcgtgatcttcttcagcgtgctgggcgtggtgttcggcaagggcaacaccgccttctggatcgtgttcagcatcatccacatcatcgccaccctgctgctgagcacccagctgtactacatgggcagatggaagctggacagcggcatcttcagaagaatcctgcacgtgctgtacaccgactgcatcagacagtgcagcggccccctgtacgtggacagaatggtgctgctggtgatgggcaacgtgatcaactggagcctggccgcctacggcctgatcatgagacccaacgacttcgccagctacctgctggccatcggcatctgcaacctgctgctgtacttcgccttctacatcatcatgaagctgagaagcggcgagagaatcaagctgatccccctgctgtgcatcgtgtgcaccagcgtggtgtggggcttcgccctgttcttcttcttccagggcctgagcacctggcagaagacccccgccgagagcagagagcacaacagagactgcatcctgctggacttcttcgacgaccacgacatctggcacttcctgagcagcatcgccatgttcggcagcttcctggtgctgctgaccctggacgacgacctggacaccgtgcagagagacaagatctacgtgttctag

SEQ ID NO: 22027 - DNA, 330 bp, Artificial Sequence
  Description of Artificial Sequence: Synthetic coding sequence
atgttcgccctgggcctgcccttcctggtgctgctggtggccagcgtggagagccacctgggcgtgctgggccccaagaacgtgagccagaaggacgccgagttcgagagaacctacgtggacgaggtgaacagcgagctggtgaacatctacaccttcaaccacaccgtgaccagaaacagaaccgagggcgtgagagtgagcgtgaacgtgctgaacaagcagaagggcgcccccctgctgttcgtggtgagacagaaggaggccgtggtgagcttccaggtgcccctgatcctgagaggcatgttccagagaaagtacctgtactag

SEQ ID NO: 22028 - DNA, 333 bp, Artificial Sequence
  Description of Artificial Sequence: Synthetic coding sequence
atgttcgccctgggcctgcccttcctggtgctgctggtggccagcgtggagagccacctgggcgtgctgggccccaagaacgtgagccagaaggacgccgagttcgagagaacctacgtggacgaggtgaacagcgagctggtgaacatctacaccttcaaccacaccgtgaccagaaacagaaccgagggcgtgagagtgagcgtgaacgtgctgaacaagcagaagggcgcccccctgctgttcgtggtgagacagaaggaggccgtggtgagcttccaggtgcccctgatcctgagaggcatgttccagagaaagtacctgtaccagtag

SEQ ID NO: 22029 - DNA, 6642 bp, Artificial Sequence
  Description of Artificial Sequence: Synthetic coding sequence
atggccagaggcgccagacccagcgccgccggcggcggcggcggcggcgccgagccccccgagagagccggccccggcagacccagaggcagcccccccggcagagccagacccagcctggcccccagacccggccccgagcccagcagacccagagccgcccccgagaccagcggcggcgacaccgccggcgccggcagatgcggcggcagaagagccgccaagctgggccccggcagaagaggctggtgggccctgctggccctgcagctgcacctgctgagagccctggcccaggacgacgtggccccctacttcaagaccgagcccggcctgccccagatccacctggagggcaacagactggtgctgacctgcctggccgagggcagctggcccctggagttcaagtggatgagagacgacagcgagctgaccacctacagcagcgagtacaagtacatcatccccagcctgcagaagctggacgccggcttctacagatgcgtggtgagaaacagaatgggcgccctgctgcagagaaagagcgaggtgcaggtggcctacatgggcagcttcatggacaccgaccagagaaagaccgtgagccagggcagagccgccatcctgaacctgctgcccatcaccagctaccccagaccccaggtgacctggttcagagagggccacaagatcatccccagcaacagaatcgccatcaccctggagaaccagctggtgatcctggccaccaccaccagcgacgccggcgcctactacgtgcaggccgtgaacgagaagaacggcgagaacaagaccagccccttcatccacctgagcatcgccagagacgtgggcacccccgagaccatggcccccaccatcgtggtgccccccggcaacagaagcgtggtggccggcagcagcgagaccaccctggagtgcatcgccagcgccagacccgtggaggacctgagcgtgacctggaagagaaacggcgtgagaatcaccagcggcctgcacagcttcggcagaagactgaccatcagcaaccccaccagcgccgacaccggcccctacgtgtgcgaggccgccctgcccggcagcgccttcgagcccgccagagccaccgccttcctgttcatcatcgagcccccctacttcaccgccgagcccgagagcagaatcagcgccgaggtggaggagaccgtggacatcggctgccaggccatgggcgtgcccctgcccaccctgcagtggtacaaggacgccatcagcatcagcagactgcagaaccccagatacaaggtgctggccagcggcggcctgagaatccagaagctgagacccgaggacagcggcatcttccagtgcttcgccagcaacgagggcggcgagatccagacccacacctacctggacgtgaccaacatcgcccccgtgttcacccagagacccgtggacaccaccgtgaccgacggcatgaccgccatcctgagatgcgaggtgagcggcgcccccaagcccgccatcacctggaagagagagaaccacatcctggccagcggcagcgtgagaatccccagattcatgctgctggagagcggcggcctgcagatcgcccccgtgttcatccaggacgccggcaactacacctgctacgccgccaacaccgagggcagcctgaacgccagcgccaccctgaccgtgtggaacagaaccagcatcgtgcacccccccgaggaccacgtggtgatcaagggcaccaccgccaccctgcactgcggcgccacccacgaccccagagtgagcctgagatacgtgtggaagaaggacaacgtggccctgacccccagcagcaccagcagaatcgtggtggagaaggacggcagcctgctgatcagccagacctggagcggcgacatcggcgactacagctgcgagatcgtgagcgagggcggcaacgacagcagaatggccagactggaggtgatcgagctgccccacagcccccagaacctgctggtgagccccaacagcagccacagccacgccgtggtgctgagctgggtgagacccttcgacggcaacagccccatcctgtactacatcgtggagctgagcgagaacaacagcccctggaaggtgcacctgagcaacgtgggccccgagatgaccggcgtgaccgtgagcggcctgacccccgccagaacctaccagttcagagtgtgcgccgtgaacgaggtgggcagaggccagtacagcgccgagaccagcagactgatgctgcccgaggagccccccagcgccccccccaagaacatcgtggccagcggcagaaccaaccagagcatcatggtgcagtggcagcccccccccgagaccgagcacaacggcgtgctgagaggctacatcctgagatacagactggccggcctgcccggcgagtaccagcagagaaacatcaccagccccgaggtgaactactgcctggtgaccgacctgatcatctggacccagtacgagatccaggtggccgcctacaacggcgccggcctgggcgtgttcagcagagccgtgaccgagtacaccctgcagggcgtgcccaccgcccccccccagaacgtgcagaccgaggccgtgaacagcaccaccatccagttcctgtggaacccccccccccagcagttcatcaacggcatcaaccagggctacaagctgctggcctggcccgccgacgcccccgaggccgtgaccgtggtgaccatcgcccccgacttccacggcgtgcaccacggccacatcaccaacctgaagaagttcaccgcctacttcaccagcgtgctgtgcttcaccacccccggcgacggcccccccagcaccccccagctggtgtggacccaggaggacaagcccggcgccgtgggccacctgagcttcaccgagatcctggacaccagcctgaaggtgagctggcaggagcccctggagaagaacggcatcatcaccggctaccagatcagctgggaggtgtacggcagaaacgacagcagactgacccacaccctgaacagcaccacccacgagtacaagatccagggcctgagcagcctgaccacctacaccatcgacgtggccgccgtgaccgccgtgggcaccggcctggtgaccagcagcaccatcagcagcggcgtgccccccgacctgcccggcgcccccagcaacctggtgatcagcaacatcagccccagaagcgccaccctgcagttcagacccggctacgacggcaagaccagcatcagcagatggatcgtggagggccaggtgggcgccatcggcgacgaggaggagtgggtgaccctgtacgaggaggagaacgagcccgacgcccagatgctggagatccccaacctgaccccctacacccactacagattcagaatgaagcaggtgaacatcgtgggccccagcccctacagccccagcagcagagtgatccagaccctgcaggccccccccgacgtggcccccaccagcgtgaccgtgagaaccgccagcgagaccagcctgagactgagatgggtgcccctgcccgacagccagtacaacggcaaccccgagagcgtgggctacagaatcaagtactggagaagcgacctgcagagcagcgccgtggcccaggtggtgagcgacagactggagagagagttcaccatcgaggagctggaggagtggatggagtacgagctgcagatgcaggccttcaacgccgtgggcgccggcccctggagcgaggtggtgagaggcagaaccagagagagcgtgcccagcgccgcccccgagaacgtgagcgccgaggccgtgagcagcacccagatcctgctgacctggaccagcgtgcccgagcaggaccagaacggcctgatcctgggctacaagatcctgttcagagccaaggacctggaccccgagcccagaagccacatcgtgagaggcaaccacacccagagcgccctgctggccggcctgagaaagttcgtgctgtacgagctgcaggtgctggccttcaccagaatcggcaacggcgtgcccagcacccccctgatcctggagagaaccaaggacgacgcccccggcccccccgtgagactggtgttccccgaggtgagactgaccagcgtgagaatcgtgtggcagccccccgaggagcccaacggcatcatcctgggctaccagatcgcctacagactggccagcagcagcccccacaccttcaccaccgtggaggtgggcgccaccgtgagacagttcaccgccaccgacctggcccccgagagcgcctacatcttcagactgagcgccaagaccagacagggctggggcgagcccctggaggccaccgtgatcaccaccgagaagagagagagacccgccccccccagagagctgctggtgccccaggccgaggtgaccgccagaagcctgagactgcagtgggtgcccggcagcgacggcgccagccccatcagatacttcaccatgcaggtgagagagctgcccagaggcgagtggcagacctacagcagcagcatcagccacgaggccaccgcctgcgtggtggacagactgagacccttcaccagctacaagctgagactgaaggccaccaacgacatcggcgacagcgacttcagcagcgagaccgaggccgtgaccaccctgcaggacgtgcccggcgagccccccggcagcgtgagcgccaccccccacaccaccagcagcgtgctgatccagtggcagccccccagagacgagagcctgaacggcctgctgcagggctacagaatctactacagagagctggagtacgaggccggcagcggcaccgaggccaagaccctgaagaaccccatcgccctgcacgccgagctgaccgcccagagcagcttcaagaccgtgaacagcagcagcaccagcaccatgtgcgagctgacccacctgaagaagtacagaagatacgaggtgatcatgaccgcctacaacatcatcggcgagagccccgccagcgcccccgtggaggtgttcgtgggcgaggccgcccccgccatggccccccagaacgtgcaggtgacccccctgaccgccagccagctggaggtgacctgggacccccccccccccgagagccagaacggcaacatccagggctacaagatctactactgggaggccgacagccagaacgagaccgagaagatgaaggtgctgttcctgcccgagcccgtggtgagactgaagaacctgaccagccacaccaagtacctggtgagcatcagcgccttcaacgccgccggcgacggccccaagagcgacccccagcagggcagaacccaccaggccgcccccggcgcccccagcttcctggccttcagcgagatcaccagcaccaccctgaacgtgagctggggcgagcccgccgccgccaacggcatcctgcagggctacagagtggtgtacgagcccctggcccccgtgcagggcgtgagcaaggtggtgaccgtggaggtgagaggcaactggcagagatggctgaaggtgagagacctgaccaagggcgtgacctacttcttcagagtgcaggccagaaccatcacctacggccccgagctgcaggccaacatcaccgccggccccgccgagggcagccccggcagccccagagacgtgctggtgaccaagagcgccagcgagctgaccctgcagtggaccgagggccacagcggcgacacccccaccaccggctacgtgatcgaggccagacccagcgacgagggcctgtgggacatgttcgtgaaggacatccccagaagcgccaccagctacaccctgagcctggacaagctgagacagggcgtgacctacgagttcagagtggtggccgtgaacgaggccggctacggcgagcccagcaaccccagcaccgccgtgagcgcccaggtggaggcccccttctacgaggagtggtggttcctgctggtgatggccctgagcagcctgatcgtgatcctgctggtggtgttcgccctggtgctgcacggccagaacaagaagtacaagaactgcagcaccggcaagggcatcagcaccatggaggagagcgtgaccctggacaacggcggcttcgccgccctggagctgagcagcagacacctgaacgtgaagagcaccttcagcaagaagaacggcaccagaagcccccccagacccagccccggcggcctgcactacagcgacgaggacatctgcaacaagtacaacggcgccgtgctgaccgagagcgtgagcctgaaggagaagagcgccgacgccagcgagagcgaggccaccgacagcgactacgaggacgccctgcccaagcacagcttcgtgaaccactacatgagcgaccccacctactacaacagctggaagagaagagcccagggcagagcccccgccccccacagatacgaggccgtggccggcagcgaggccggcgcccagctgcaccccgtgatcaccacccagagcgccggcggcgtgtacacccccgccggccccggcgccagaacccccctgaccggcttcagcagcttcgtgtag

SEQ ID NO: 22030 - DNA, 1386 bp, Artificial Sequence
  Description of Artificial Sequence: Synthetic coding sequence
atgaaggtgctgttcctgcccgagcccgtggtgagactgaagaacctgaccagccacaccaagtacctggtgagcatcagcgccttcaacgccgccggcgacggccccaagagcgacccccagcagggcagaacccaccaggccgcccccggcgcccccagcttcctggccttcagcgagatcaccagcaccaccctgaacgtgagctggggcgagcccgccgccgccaacggcatcctgcagggctacagagtggtgtacgagcccctggcccccgtgcagggcgtgagcaaggtggtgaccgtggaggtgagaggcaactggcagagatggctgaaggtgagagacctgaccaagggcgtgacctacttcttcagagtgcaggccagaaccatcacctacggccccgagctgcaggccaacatcaccgccggccccgccgagggcagccccggcagccccagagacgtgctggtgaccaagagcgccagcgagctgaccctgcagtggaccgagggccacagcggcgacacccccaccaccggctacgtgatcgaggccagacccagcgacgagggcctgtgggacatgttcgtgaaggacatccccagaagcgccaccagctacaccctgagcctggacaagctgagacagggcgtgacctacgagttcagagtggtggccgtgaacgaggccggctacggcgagcccagcaaccccagcaccgccgtgagcgcccaggtggaggcccccttctacgaggagtggtggttcctgctggtgatggccctgagcagcctgatcgtgatcctgctggtggtgttcgccctggtgctgcacggccagaacaagaagtacaagaactgcagcaccggcaagggcatcagcaccatggaggagagcgtgaccctggacaacggcggcttcgccgccctggagctgagcagcagacacctgaacgtgaagagcaccttcagcaagaagaacggcaccagaagcccccccagacccagccccggcggcctgcactacagcgacgaggacatctgcaacaagtacaacggcgccgtgctgaccgagagcgtgagcctgaaggagaagagcgccgacgccagcgagagcgaggccaccgacagcgactacgaggacgccctgcccaagcacagcttcgtgaaccactacatgagcgaccccacctactacaacagctggaagagaagagcccagggcagagcccccgccccccacagatacgaggccgtggccggcagcgaggccggcgcccagctgcaccccgtgatcaccacccagagcgccggcggcgtgtacacccccgccggccccggcgccagaacccccctgaccggcttcagcagcttcgtgtag

SEQ ID NO: 22031 - DNA, 6651 bp, Artificial Sequence
  Description of Artificial Sequence: Synthetic coding sequence
atgtggggcctgctgatctggaccctgctggccctgcaccagatcagagccgccagagcccaggacgacgtgagcccctacttcaagaccgagcccgtgagaacccaggtgcacctggagggcaacagactggtgctgacctgcatggccgagggcagctggcccctggagttcaagtggctgcacaacaacagagagctgaccaagttcagcctggagtacagatacatgatcaccagcctggacagaacccacgccggcttctacagatgcatcgtgagaaacagaatgggcgccctgctgcagagacagaccgaggtgcaggtggcctacatgggcagcttcgaggagggcgagaagcaccagagcgtgagccacggcgaggccgccgtgatcagagcccccagaatcgccagcttcccccagccccaggtgacctggttcagagacggcagaaagatcccccccagcagcagaatcgccatcaccctggagaacaccctggtgatcctgagcaccgtggcccccgacgccggcagatactacgtgcaggccgtgaacgacaagaacggcgacaacaagaccagccagcccatcaccctgaccgtggagaacgtgggcggccccgccgaccccatcgcccccaccatcatcatcccccccaagaacaccagcgtggtggccggcaccagcgaggtgaccctggagtgcgtggccaacgccagacccctgatcaagctgcacatcatctggaagaaggacggcgtgctgctgagcggcggcatcagcgaccacaacagaagactgaccatccccaaccccaccggcagcgacgccggctactacgagtgcgaggccgtgctgagaagcagcagcgtgcccagcgtggtgagaggcgcctacctgagcgtgctggagcccccccagttcgtgaaggagcccgagagacacatcaccgccgagatggagaaggtggtggacatcccctgccaggccaagggcgtgcccccccccagcatcacctggtacaaggacgccgccgtggtggaggtggagaagctgaccagattcagacagagaaacgacggcggcctgcagatcagcggcctggtgcccgacgacaccggcatgttccagtgcttcgccagaaacgccgccggcgaggtgcagaccagcacctacctggccgtgaccagcatcgcccccaacatcaccagaggccccctggacagcaccgtgatcgacggcatgagcgtggtgctggcctgcgagaccagcggcgcccccagacccgccatcacctggcagaagggcgagagaatcctggccagcggcagcgtgcagctgcccagattcacccccctggagagcggcagcctgctgatcagccccacccacatcagcgacgccggcacctacacctgcctggccaccaacagcagaggcgtggacgaggccagcgccgacctggtggtgtgggccagaaccagaatcaccaagcccccccaggaccagagcgtgatcaagggcacccaggccagcatggtgtgcggcgtgacccacgaccccagagtgaccatcagatacatctgggagaaggacggcgccaccctgggcaccgagagccaccccagaatcagactggacagaaacggcagcctgcacatcagccagacctggagcggcgacatcggcacctacacctgcagagtgatcagcgccggcggcaacgacagcagaagcgcccacctgagagtgagacagctgccccacgcccccgagcaccccgtggccaccctgagcaccgtggagagaagagccatcaacctgacctggaccaagcccttcgacggcaacagccccctgatcagatacatcctggagatgagcgagaacaacgccccctggaccgtgctgctggccagcgtggaccccaaggccaccagcgtgaccgtgaagggcctggtgcccgccagaagctaccagttcagactgtgcgccgtgaacgacgtgggcaagggccagttcagcaaggacaccgagagagtgagcctgcccgaggagccccccaccgcccccccccagaacgtgatcgccagcggcagaaccaaccagagcatcatgatccagtggcagcccccccccgagagccaccagaacggcatcctgaagggctacatcatcagatactgcctggccggcctgcccgtgggctaccagttcaagaacatcaccgacgccgacgtgaacaacctgctgctggaggacctgatcatctggaccaactacgagatcgaggtggccgcctacaacagcgccggcctgggcgtgtacagcagcaaggtgaccgagtggaccctgcagggcgtgcccaccgtgccccccggcaacgtgcacgccgaggccaccaacagcaccaccatcagattcacctggaacgcccccagcccccagttcatcaacggcatcaaccagggctacaagctgatcgcctgggagcccgagcaggaggaggaggtgaccatggtgaccgccagacccaacttccaggacagcatccacgtgggcttcgtgagcggcctgaagaagttcaccgagtacttcaccagcgtgctgtgcttcaccacccccggcgacggccccagaagcaccccccagctggtgagaacccacgaggacgtgcccggccccgtgggccacctgagcttcagcgagatcctggacaccagcctgaaggtgagctggcaggagcccggcgagaagaacggcatcctgaccggctacagaatcagctgggaggagtacaacagaaccaacaccagagtgacccactacctgcccaacgtgaccctggagtacagagtgaccggcctgaccgccctgaccacctacaccatcgaggtggccgccatgaccagcaagggccagggccaggtgagcgccagcaccatcagcagcggcgtgccccccgagctgcccggcccccccaccaacctgggcatcagcaacatcggccccagaagcgtgaccctgcagttcagacccggctacgacggcaagaccagcatcagcagatggctggtggaggcccaggtgggcgtggtgggcgagggcgaggagtggctgctgatccaccagctgagcaacgagcccgacgccagaagcatggaggtgcccgacctgaaccccttcacctgctacagcttcagaatgagacaggtgaacatcgtgggcaccagcccccccagccagcccagcagaaagatccagaccctgcaggccccccccgacatggcccccgccaacgtgagcctgagaaccgccagcgagaccagcctgtggctgagatggatgcccctgcccgagatggagtacaacggcaaccccgagagcgtgggctacaagatcaagtacagcagaagcgacggccacggcaagaccctgagccacgtggtgcaggacagagtggagagagactacaccatcgaggacctggaggagtggaccgagtacagagtgcaggtgcaggccttcaacgccatcggcagcggcccctggagccagaccgtggtgggcagaaccagagagagcgtgcccagcagcggccccaccaacgtgagcgccctggccaccaccagcagcagcatgctggtgagatggagcgaggtgcccgaggccgacagaaacggcctggtgctgggctacaaggtgatgtacaaggagaaggacagcgacacccagcccagattctggctggtggagggcaacagcagcagaagcgcccagctgaccggcctgggcaagtacgtgctgtacgaggtgcaggtgctggccttcaccagaatcggcgacggcagccccagccacccccccatcctggagagaaccctggacgacgtgcccggcccccccatgggcatcctgttccccgaggtgagaaccaccagcgtgagactgatctggcagccccccgccgcccccaacggcatcatcctggcctaccagatcacccacagactgaacaccaccaccgccaacaccgccaccgtggaggtgctggcccccagcgccagacagtacaccgccaccggcctgaagcccgagagcgtgtacctgttcagaatcaccgcccagaccagaaagggctggggcgaggccgccgaggccctggtggtgaccaccgagaagagagacagaccccagccccccagcagacccatggtgcagcaggaggacgtgagagccagaagcgtgctgctgagctgggagcccggcagcgacggcctgagccccgtgagatactacaccatccagaccagagagctgcccagcggcagatgggccctgcacagcgccagcgtgagccacaacgccagcagcttcatcgtggacagactgaagcccttcaccagctacaagttcagagtgaaggccaccaacgacatcggcgacagcgagttcagcgaggagagcgagagcctgaccaccctgcaggccgcccccgacgaggcccccaccatcctgagcgtgaccccccacaccaccaccagcgtgctgatcagatggcagccccccgccgaggacaagatcaacggcatcctgctgggcttcagaatcagatacagagagctgctgtacgagggcctgagaggcttcaccctgagaggcatcaacaaccccggcgccacctgggccgagctgaccagcatgtacagcatgagaaacctgagcagacccagcctgacccagtacgagctggacaacctgaacaagcacagaagatacgagatcagaatgagcgtgtacaacgccgtgggcgagggccccagcagccccccccaggaggtgttcgtgggcgaggccgtgcccaccgccgcccccagaaacgtggtggtgcacggcgccaccgccacccagctggacgtgacctgggagcccccccccctggacagccagaacggcgacatccagggctacaagatctacttctgggaggcccagagaggcaacctgaccgagagagtgaagaccctgttcctggccgagaacagcgtgaagctgaagaacctgaccggctacaccgcctacatggtgagcgtggccgccttcaacgccgccggcgacggccccagaagcacccccacccagggccagacccagcaggccgcccccagcgcccccagcagcgtgaagttcagcgagctgaccaccaccagcgtgaacgtgagctgggaggccccccagttccccaacggcatcctggagggctacagactggtgtacgagccctgcagccccgtggacggcgtgagcaagatcgtgaccgtggacgtgaagggcaacagccccctgtggctgaaggtgaaggacctggccgagggcgtgacctacagattcagaatcagagccaagaccttcacctacggccccgagatcgaggccaacgtgaccaccggccccggcgagggcgcccccggcccccccggcgtgcccatcatcgtgagatacagcagcgccatcgccatccactggagcagcggcgaccccggcaagggccccatcaccagatacgtgatcgaggccagacccagcgacgagggcctgtgggacatcctgatcaaggacatccccaaggaggtgagcagctacaccttcagcatggacatcctgaagcccggcgtgagctacgacttcagagtgatcgccgtgaacgactacggcttcggcacccccagcagccccagccagagcgtgcccgcccagaaggccaaccccttctacgaggagtggtggttcctggtggtgatcgccctggtgggcctgatcttcatcctgctgctggtgttcgtgctgatcatcagaggccagagcaagaagtacgccaagaagaccgacagcggcaacagcgccaagagcggcgccctgggccacagcgagatgatgagcctggacgagagcagcttccccgccctggagctgaacaacagaagactgagcgtgaagaacagcttctgcagaaagaacggcctgtacaccagaagcccccccagacccagccccggcagcctgcactacagcgacgaggacgtgaccaagtacaacgacctgatccccgccgagagcagcagcctgaccgagaagcccagcgagatcagcgacagccagggcagcgacagcgagtacgaggtggacagcaaccaccagaaggcccacagcttcgtgaaccactacatcagcgaccccacctactacaacagctggagaagacagcagaagggcatcagcagagcccaggcctacagctacaccgagagcgacagcggcgagcccgaccacaccaccgtgaccaacagcaccagcacccagcagggcagcctgttcagacccaaggccagcagaacccccaccccccagaacccccccaacccccccagccagcagagcaccctgtacagaccccccagcaaggccggcgtgcagaaggagggcgagaacagagagagaatgtgcgtggccagcagcagcagcgccctgagatggtggggcagcctgctgccctgggagctgcacggcgccggcgaggtggccgtgagcctgctgtggaccagaagcggcgccggcatctggagagagagaggcagcggcggctag

SEQ ID NO: 22032 - DNA, 6462 bp, Artificial Sequence
  Description of Artificial Sequence: Synthetic coding sequence
atgtggggcctgctgatctggaccctgctggccctgcaccagatcagagccgccagagcccaggacgacgtgagcccctacttcaagaccgagcccgtgagaacccaggtgcacctggagggcaacagactggtgctgacctgcatggccgagggcagctggcccctggagttcaagtggctgcacaacaacagagagctgaccaagttcagcctggagtacagatacatgatcaccagcctggacagaacccacgccggcttctacagatgcatcgtgagaaacagaatgggcgccctgctgcagagacagaccgaggtgcaggtggcctacatgggcagcttcgaggagggcgagaagcaccagagcgtgagccacggcgaggccgccgtgatcagagcccccagaatcgccagcttcccccagccccaggtgacctggttcagagacggcagaaagatcccccccagcagcagaatcgccatcaccctggagaacaccctggtgatcctgagcaccgtggcccccgacgccggcagatactacgtgcaggccgtgaacgacaagaacggcgacaacaagaccagccagcccatcaccctgaccgtggagaacgtgggcggccccgccgaccccatcgcccccaccatcatcatcccccccaagaacaccagcgtggtggccggcaccagcgaggtgaccctggagtgcgtggccaacgccagacccctgatcaagctgcacatcatctggaagaaggacggcgtgctgctgagcggcggcatcagcgaccacaacagaagactgaccatccccaaccccaccggcagcgacgccggctactacgagtgcgaggccgtgctgagaagcagcagcgtgcccagcgtggtgagaggcgcctacctgagcgtgctggagcccccccagttcgtgaaggagcccgagagacacatcaccgccgagatggagaaggtggtggacatcccctgccaggccaagggcgtgcccccccccagcatcacctggtacaaggacgccgccgtggtggaggtggagaagctgaccagattcagacagagaaacgacggcggcctgcagatcagcggcctggtgcccgacgacaccggcatgttccagtgcttcgccagaaacgccgccggcgaggtgcagaccagcacctacctggccgtgaccagcatcgcccccaacatcaccagaggccccctggacagcaccgtgatcgacggcatgagcgtggtgctggcctgcgagaccagcggcgcccccagacccgccatcacctggcagaagggcgagagaatcctggccagcggcagcgtgcagctgcccagattcacccccctggagagcggcagcctgctgatcagccccacccacatcagcgacgccggcacctacacctgcctggccaccaacagcagaggcgtggacgaggccagcgccgacctggtggtgtgggccagaaccagaatcaccaagcccccccaggaccagagcgtgatcaagggcacccaggccagcatggtgtgcggcgtgacccacgaccccagagtgaccatcagatacatctgggagaaggacggcgccaccctgggcaccgagagccaccccagaatcagactggacagaaacggcagcctgcacatcagccagacctggagcggcgacatcggcacctacacctgcagagtgatcagcgccggcggcaacgacagcagaagcgcccacctgagagtgagacagctgccccacgcccccgagcaccccgtggccaccctgagcaccgtggagagaagagccatcaacctgacctggaccaagcccttcgacggcaacagccccctgatcagatacatcctggagatgagcgagaacaacgccccctggaccgtgctgctggccagcgtggaccccaaggccaccagcgtgaccgtgaagggcctggtgcccgccagaagctaccagttcagactgtgcgccgtgaacgacgtgggcaagggccagttcagcaaggacaccgagagagtgagcctgcccgaggagccccccaccgcccccccccagaacgtgatcgccagcggcagaaccaaccagagcatcatgatccagtggcagcccccccccgagagccaccagaacggcatcctgaagggctacatcatcagatactgcctggccggcctgcccgtgggctaccagttcaagaacatcaccgacgccgacgtgaacaacctgctgctggaggacctgatcatctggaccaactacgagatcgaggtggccgcctacaacagcgccggcctgggcgtgtacagcagcaaggtgaccgagtggaccctgcagggcgtgcccaccgtgccccccggcaacgtgcacgccgaggccaccaacagcaccaccatcagattcacctggaacgcccccagcccccagttcatcaacggcatcaaccagggctacaagctgatcgcctgggagcccgagcaggaggaggaggtgaccatggtgaccgccagacccaacttccaggacagcatccacgtgggcttcgtgagcggcctgaagaagttcaccgagtacttcaccagcgtgctgtgcttcaccacccccggcgacggccccagaagcaccccccagctggtgagaacccacgaggacgtgcccggccccgtgggccacctgagcttcagcgagatcctggacaccagcctgaaggtgagctggcaggagcccggcgagaagaacggcatcctgaccggctacagaatcagctgggaggagtacaacagaaccaacaccagagtgacccactacctgcccaacgtgaccctggagtacagagtgaccggcctgaccgccctgaccacctacaccatcgaggtggccgccatgaccagcaagggccagggccaggtgagcgccagcaccatcagcagcggcgtgccccccgagctgcccggcccccccaccaacctgggcatcagcaacatcggccccagaagcgtgaccctgcagttcagacccggctacgacggcaagaccagcatcagcagatggctggtggaggcccaggtgggcgtggtgggcgagggcgaggagtggctgctgatccaccagctgagcaacgagcccgacgccagaagcatggaggtgcccgacctgaaccccttcacctgctacagcttcagaatgagacaggtgaacatcgtgggcaccagcccccccagccagcccagcagaaagatccagaccctgcaggccccccccgacatggcccccgccaacgtgagcctgagaaccgccagcgagaccagcctgtggctgagatggatgcccctgcccgagatggagtacaacggcaaccccgagagcgtgggctacaagatcaagtacagcagaagcgacggccacggcaagaccctgagccacgtggtgcaggacagagtggagagagactacaccatcgaggacctggaggagtggaccgagtacagagtgcaggtgcaggccttcaacgccatcggcagcggcccctggagccagaccgtggtgggcagaaccagagagagcgtgcccagcagcggccccaccaacgtgagcgccctggccaccaccagcagcagcatgctggtgagatggagcgaggtgcccgaggccgacagaaacggcctggtgctgggctacaaggtgatgtacaaggagaaggacagcgacacccagcccagattctggctggtggagggcaacagcagcagaagcgcccagctgaccggcctgggcaagtacgtgctgtacgaggtgcaggtgctggccttcaccagaatcggcgacggcagccccagccacccccccatcctggagagaaccctggacgacgtgcccggcccccccatgggcatcctgttccccgaggtgagaaccaccagcgtgagactgatctggcagccccccgccgcccccaacggcatcatcctggcctaccagatcacccacagactgaacaccaccaccgccaacaccgccaccgtggaggtgctggcccccagcgccagacagtacaccgccaccggcctgaagcccgagagcgtgtacctgttcagaatcaccgcccagaccagaaagggctggggcgaggccgccgaggccctggtggtgaccaccgagaagagagacagaccccagccccccagcagacccatggtgcagcaggaggacgtgagagccagaagcgtgctgctgagctgggagcccggcagcgacggcctgagccccgtgagatactacaccatccagaccagagagctgcccagcggcagatgggccctgcacagcgccagcgtgagccacaacgccagcagcttcatcgtggacagactgaagcccttcaccagctacaagttcagagtgaaggccaccaacgacatcggcgacagcgagttcagcgaggagagcgagagcctgaccaccctgcaggccgcccccgacgaggcccccaccatcctgagcgtgaccccccacaccaccaccagcgtgctgatcagatggcagccccccgccgaggacaagatcaacggcatcctgctgggcttcagaatcagatacagagagctgctgtacgagggcctgagaggcttcaccctgagaggcatcaacaaccccggcgccacctgggccgagctgacctacctgaacaagcacagaagatacgagatcagaatgagcgtgtacaacgccgtgggcgagggccccagcagccccccccaggaggtgttcgtgggcgaggccgtgcccaccgccgcccccagaaacgtggtggtgcacggcgccaccgccacccagctggacgtgacctgggagcccccccccctggacagccagaacggcgacatccagggctacaagatctacttctgggaggcccagagaggcaacctgaccgagagagtgaagaccctgttcctggccgagaacagcgtgaagctgaagaacctgaccggctacaccgcctacatggtgagcgtggccgccttcaacgccgccggcgacggccccagaagcacccccacccagggccagacccagcaggccgcccccagcgcccccagcagcgtgaagttcagcgagctgaccaccaccagcgtgaacgtgagctgggaggccccccagttccccaacggcatcctggagggctacagactggtgtacgagccctgcagccccgtggacggcgtgagcaagatcgtgaccgtggacgtgaagggcaacagccccctgtggctgaaggtgaaggacctggccgagggcgtgacctacagattcagaatcagagccaagaccttcacctacggccccgagatcgaggccaacgtgaccaccggccccggcgagggcgcccccggcccccccggcgtgcccatcatcgtgagatacagcagcgccatcgccatccactggagcagcggcgaccccggcaagggccccatcaccagatacgtgatcgaggccagacccagcgacgagggcctgtgggacatcctgatcaaggacatccccaaggaggtgagcagctacaccttcagcatggacatcctgaagcccggcgtgagctacgacttcagagtgatcgccgtgaacgactacggcttcggcacccccagcagccccagccagagcgtgcccgcccagaaggccaaccccttctacgaggagtggtggttcctggtggtgatcgccctggtgggcctgatcttcatcctgctgctggtgttcgtgctgatcatcagaggccagagcaagaagtacgccaagaagaccgacagcggcaacagcgccaagagcggcgccctgggccacagcgagatgatgagcctggacgagagcagcttccccgccctggagctgaacaacagaagactgagcgtgaagaacagcttctgcagaaagaacggcctgtacaccagaagcccccccagacccagccccggcagcctgcactacagcgacgaggacgtgaccaagtacaacgacctgatccccgccgagagcagcagcctgaccgagaagcccagcgagatcagcgacagccagggcagcgacagcgagtacgaggtggacagcaaccaccagaaggcccacagcttcgtgaaccactacatcagcgaccccacctactacaacagctggagaagacagcagaagggcatcagcagagcccaggcctacagctacaccgagagcgacagcggcgagcccgaccacaccaccgtgaccaacagcaccagcacccagcagggcagcctgttcagacccaaggccagcagaacccccaccccccagaacccccccaacccccccagccagcagagcaccctgtacagaccccccagcagcctggcccccggcagcagagcccccatcgccggcttcagcagcttcgtgtag

SEQ ID NO: 22033 - DNA, 6519 bp, Artificial Sequence
  Description of Artificial Sequence: Synthetic coding sequence
atgtggggcctgctgatctggaccctgctggccctgcaccagatcagagccgccagagcccaggacgacgtgagcccctacttcaagaccgagcccgtgagaacccaggtgcacctggagggcaacagactggtgctgacctgcatggccgagggcagctggcccctggagttcaagtggctgcacaacaacagagagctgaccaagttcagcctggagtacagatacatgatcaccagcctggacagaacccacgccggcttctacagatgcatcgtgagaaacagaatgggcgccctgctgcagagacagaccgaggtgcaggtggcctacatgggcagcttcgaggagggcgagaagcaccagagcgtgagccacggcgaggccgccgtgatcagagcccccagaatcgccagcttcccccagccccaggtgacctggttcagagacggcagaaagatcccccccagcagcagaatcgccatcaccctggagaacaccctggtgatcctgagcaccgtggcccccgacgccggcagatactacgtgcaggccgtgaacgacaagaacggcgacaacaagaccagccagcccatcaccctgaccgtggagaacgtgggcggccccgccgaccccatcgcccccaccatcatcatcccccccaagaacaccagcgtggtggccggcaccagcgaggtgaccctggagtgcgtggccaacgccagacccctgatcaagctgcacatcatctggaagaaggacggcgtgctgctgagcggcggcatcagcgaccacaacagaagactgaccatccccaaccccaccggcagcgacgccggctactacgagtgcgaggccgtgctgagaagcagcagcgtgcccagcgtggtgagaggcgcctacctgagcgtgctggagcccccccagttcgtgaaggagcccgagagacacatcaccgccgagatggagaaggtggtggacatcccctgccaggccaagggcgtgcccccccccagcatcacctggtacaaggacgccgccgtggtggaggtggagaagctgaccagattcagacagagaaacgacggcggcctgcagatcagcggcctggtgcccgacgacaccggcatgttccagtgcttcgccagaaacgccgccggcgaggtgcagaccagcacctacctggccgtgaccagcatcgcccccaacatcaccagaggccccctggacagcaccgtgatcgacggcatgagcgtggtgctggcctgcgagaccagcggcgcccccagacccgccatcacctggcagaagggcgagagaatcctggccagcggcagcgtgcagctgcccagattcacccccctggagagcggcagcctgctgatcagccccacccacatcagcgacgccggcacctacacctgcctggccaccaacagcagaggcgtggacgaggccagcgccgacctggtggtgtgggccagaaccagaatcaccaagcccccccaggaccagagcgtgatcaagggcacccaggccagcatggtgtgcggcgtgacccacgaccccagagtgaccatcagatacatctgggagaaggacggcgccaccctgggcaccgagagccaccccagaatcagactggacagaaacggcagcctgcacatcagccagacctggagcggcgacatcggcacctacacctgcagagtgatcagcgccggcggcaacgacagcagaagcgcccacctgagagtgagacagctgccccacgcccccgagcaccccgtggccaccctgagcaccgtggagagaagagccatcaacctgacctggaccaagcccttcgacggcaacagccccctgatcagatacatcctggagatgagcgagaacaacgccccctggaccgtgctgctggccagcgtggaccccaaggccaccagcgtgaccgtgaagggcctggtgcccgccagaagctaccagttcagactgtgcgccgtgaacgacgtgggcaagggccagttcagcaaggacaccgagagagtgagcctgcccgaggagccccccaccgcccccccccagaacgtgatcgccagcggcagaaccaaccagagcatcatgatccagtggcagcccccccccgagagccaccagaacggcatcctgaagggctacatcatcagatactgcctggccggcctgcccgtgggctaccagttcaagaacatcaccgacgccgacgtgaacaacctgctgctggaggacctgatcatctggaccaactacgagatcgaggtggccgcctacaacagcgccggcctgggcgtgtacagcagcaaggtgaccgagtggaccctgcagggcgtgcccaccgtgccccccggcaacgtgcacgccgaggccaccaacagcaccaccatcagattcacctggaacgcccccagcccccagttcatcaacggcatcaaccagggctacaagctgatcgcctgggagcccgagcaggaggaggaggtgaccatggtgaccgccagacccaacttccaggacagcatccacgtgggcttcgtgagcggcctgaagaagttcaccgagtacttcaccagcgtgctgtgcttcaccacccccggcgacggccccagaagcaccccccagctggtgagaacccacgaggacgtgcccggccccgtgggccacctgagcttcagcgagatcctggacaccagcctgaaggtgagctggcaggagcccggcgagaagaacggcatcctgaccggctacagaatcagctgggaggagtacaacagaaccaacaccagagtgacccactacctgcccaacgtgaccctggagtacagagtgaccggcctgaccgccctgaccacctacaccatcgaggtggccgccatgaccagcaagggccagggccaggtgagcgccagcaccatcagcagcggcgtgccccccgagctgcccggcccccccaccaacctgggcatcagcaacatcggccccagaagcgtgaccctgcagttcagacccggctacgacggcaagaccagcatcagcagatggctggtggaggcccaggtgggcgtggtgggcgagggcgaggagtggctgctgatccaccagctgagcaacgagcccgacgccagaagcatggaggtgcccgacctgaaccccttcacctgctacagcttcagaatgagacaggtgaacatcgtgggcaccagcccccccagccagcccagcagaaagatccagaccctgcaggccccccccgacatggcccccgccaacgtgagcctgagaaccgccagcgagaccagcctgtggctgagatggatgcccctgcccgagatggagtacaacggcaaccccgagagcgtgggctacaagatcaagtacagcagaagcgacggccacggcaagaccctgagccacgtggtgcaggacagagtggagagagactacaccatcgaggacctggaggagtggaccgagtacagagtgcaggtgcaggccttcaacgccatcggcagcggcccctggagccagaccgtggtgggcagaaccagagagagcgtgcccagcagcggccccaccaacgtgagcgccctggccaccaccagcagcagcatgctggtgagatggagcgaggtgcccgaggccgacagaaacggcctggtgctgggctacaaggtgatgtacaaggagaaggacagcgacacccagcccagattctggctggtggagggcaacagcagcagaagcgcccagctgaccggcctgggcaagtacgtgctgtacgaggtgcaggtgctggccttcaccagaatcggcgacggcagccccagccacccccccatcctggagagaaccctggacgacgtgcccggcccccccatgggcatcctgttccccgaggtgagaaccaccagcgtgagactgatctggcagccccccgccgcccccaacggcatcatcctggcctaccagatcacccacagactgaacaccaccaccgccaacaccgccaccgtggaggtgctggcccccagcgccagacagtacaccgccaccggcctgaagcccgagagcgtgtacctgttcagaatcaccgcccagaccagaaagggctggggcgaggccgccgaggccctggtggtgaccaccgagaagagagacagaccccagccccccagcagacccatggtgcagcaggaggacgtgagagccagaagcgtgctgctgagctgggagcccggcagcgacggcctgagccccgtgagatactacaccatccagaccagagagctgcccagcggcagatgggccctgcacagcgccagcgtgagccacaacgccagcagcttcatcgtggacagactgaagcccttcaccagctacaagttcagagtgaaggccaccaacgacatcggcgacagcgagttcagcgaggagagcgagagcctgaccaccctgcaggccgcccccgacgaggcccccaccatcctgagcgtgaccccccacaccaccaccagcgtgctgatcagatggcagccccccgccgaggacaagatcaacggcatcctgctgggcttcagaatcagatacagagagctgctgtacgagggcctgagaggcttcaccctgagaggcatcaacaaccccggcgccacctgggccgagctgaccagcatgtacagcatgagaaacctgagcagacccagcctgacccagtacgagctggacaacctgaacaagcacagaagatacgagatcagaatgagcgtgtacaacgccgtgggcgagggccccagcagccccccccaggaggtgttcgtgggcgaggccgtgcccaccgccgcccccagaaacgtggtggtgcacggcgccaccgccacccagctggacgtgacctgggagcccccccccctggacagccagaacggcgacatccagggctacaagatctacttctgggaggcccagagaggcaacctgaccgagagagtgaagaccctgttcctggccgagaacagcgtgaagctgaagaacctgaccggctacaccgcctacatggtgagcgtggccgccttcaacgccgccggcgacggccccagaagcacccccacccagggccagacccagcaggccgcccccagcgcccccagcagcgtgaagttcagcgagctgaccaccaccagcgtgaacgtgagctgggaggccccccagttccccaacggcatcctggagggctacagactggtgtacgagccctgcagccccgtggacggcgtgagcaagatcgtgaccgtggacgtgaagggcaacagccccctgtggctgaaggtgaaggacctggccgagggcgtgacctacagattcagaatcagagccaagaccttcacctacggccccgagatcgaggccaacgtgaccaccggccccggcgagggcgcccccggcccccccggcgtgcccatcatcgtgagatacagcagcgccatcgccatccactggagcagcggcgaccccggcaagggccccatcaccagatacgtgatcgaggccagacccagcgacgagggcctgtgggacatcctgatcaaggacatccccaaggaggtgagcagctacaccttcagcatggacatcctgaagcccggcgtgagctacgacttcagagtgatcgccgtgaacgactacggcttcggcacccccagcagccccagccagagcgtgcccgcccagaaggccaaccccttctacgaggagtggtggttcctggtggtgatcgccctggtgggcctgatcttcatcctgctgctggtgttcgtgctgatcatcagaggccagagcaagaagtacgccaagaagaccgacagcggcaacagcgccaagagcggcgccctgggccacagcgagatgatgagcctggacgagagcagcttccccgccctggagctgaacaacagaagactgagcgtgaagaacagcttctgcagaaagaacggcctgtacaccagaagcccccccagacccagccccggcagcctgcactacagcgacgaggacgtgaccaagtacaacgacctgatccccgccgagagcagcagcctgaccgagaagcccagcgagatcagcgacagccagggcagcgacagcgagtacgaggtggacagcaaccaccagaaggcccacagcttcgtgaaccactacatcagcgaccccacctactacaacagctggagaagacagcagaagggcatcagcagagcccaggcctacagctacaccgagagcgacagcggcgagcccgaccacaccaccgtgaccaacagcaccagcacccagcagggcagcctgttcagacccaaggccagcagaacccccaccccccagaacccccccaacccccccagccagcagagcaccctgtacagaccccccagcagcctggcccccggcagcagagcccccatcgccggcttcagcagcttcgtgtag

SEQ ID NO: 22034 - DNA, 969 bp, Artificial Sequence
  Description of Artificial Sequence: Synthetic coding sequence
atgagcggcgagctgccccccaacatcaacatcaaggagcccagatgggaccagagcaccttcatcggcagagccaaccacttcttcaccgtgaccgaccccagaaacatcctgctgaccaacgagcagctggagagcgccagaaagatcgtgcacgactacagacagggcatcgtgccccccggcctgaccgagaacgagctgtggagagccaagtacatctacgacagcgccttccaccccgacaccggcgagaagatgatcctgatcggcagaatgagcgcccaggtgcccatgaacatgaccatcaccggctgcatgatgaccttctacagaaccacccccgccgtgctgttctggcagtggatcaaccagagcttcaacgccgtggtgaactacaccaacagaagcggcgacgcccccctgaccgtgaacgagctgggcaccgcctacgtgagcgccaccaccggcgccgtggccaccgccctgggcctgaacgccctgaccaagcacgtgagccccctgatcggcagattcgtgcccttcgccgccgtggccgccgccaactgcatcaacatccccctgatgagacagagagagctgaaggtgggcatccccgtgaccgacgagaacggcaacagactgggcgagagcgccaacgccgccaagcaggccatcacccaggtggtggtgagcagaatcctgatggccgcccccggcatggccatcccccccttcatcatgaacaccctggagaagaaggccttcctgaagagattcccctggatgagcgcccccatccaggtgggcctggtgggcttctgcctggtgttcgccacccccctgtgctgcgccctgttcccccagaagagcagcatgagcgtgaccagcctggaggccgagctgcaggccaagatccaggagagccaccccgagctgagaagagtgtacttcaacaagggcctgtag

SEQ ID NO: 22035 - DNA, 585 bp, Artificial Sequence
  Description of Artificial Sequence: Synthetic coding sequence
atgagcggcgagctgccccccaacatcaacatcaaggagcccagatgggaccagagcaccttcatcggcagagccaaccacttcttcaccgtgaccgaccccagaaacatcctgctgaccaacgagcagctggagagcgccagaaagatcgtgcacgactacagacagggcatcgtgccccccggcctgaccgagaacgagctgtggagagccaagtacatctacgacagcgccttccaccccgacaccggcgagaagatgatcctgatcggcagaatgagcgcccaggtgcccatgaacatgaccatcaccggctgcatgatgaccttctacagaaccacccccgccgtgctgttctggcagtggatcaaccagagcttcaacgccgtggtgaactacaccaacagaagcggcgacgcccccctgaccgtgaacgagctgggcaccgcctacgtgagcgccaccaccggcgccgtggccaccgccctgggcctgaacgccctgaccaagcacgtgagccccctgatcggcagattcgtgcccttcgccgccgtggccgccgccaactgcatcaacatcccctag

SEQ ID NO: 22036 - DNA, 435 bp, Artificial Sequence
  Description of Artificial Sequence: Synthetic coding sequence
atgagcggcgagctgccccccaacatcaacatcaaggagcccagatgggaccagagcaccttcatcggcagagccaaccacttcttcaccgtgaccgaccccagaaacatcctgctgaccaacgagcagctggagagcgccagaaagatcgtgcacgactacagacagggcatcgtgccccccggcctgaccgagaacgagctgtggagagccaagtacatctacgacagcgccttccaccccgacaccggcgagaagatgatcctgatcggcagaatgagcgcccaggtgcccatgaacatgaccatcaccggctgcatgatgaccttctacagaaccacccccgccgtgctgttctggcagtggatcaaccagagcttcaacgccgtggtgaactacaccaacagaagcggcgacgcccccctgaccgtgtag

SEQ ID NO: 22037 - DNA, 969 bp, Artificial Sequence
  Description of Artificial Sequence: Synthetic coding sequence
atggaggccgacctgagcggcttcaacatcgacgcccccagatgggaccagagaaccttcctgggcagagtgaagcacttcctgaacatcaccgaccccagaaccgtgttcgtgagcgagagagagctggactgggccaaggtgatggtggagaagagcagaatgggcgtggtgccccccggcacccaggtggagcagctgctgtacgccaagaagctgtacgacagcgccttccaccccgacaccggcgagaagatgaacgtgatcggcagaatgagcttccagctgcccggcggcatgatcatcaccggcttcatgctgcagttctacagaaccatgcccgccgtgatcttctggcagtgggtgaaccagagcttcaacgccctggtgaactacaccaacagaaacgccgccagccccaccagcgtgagacagatggccctgagctacttcaccgccaccaccaccgccgtggccaccgccgtgggcatgaacatgctgaccaagaaggccccccccctggtgggcagatgggtgcccttcgccgccgtggccgccgccaactgcgtgaacatccccatgatgagacagcaggagctgatcaagggcatctgcgtgaaggacagaaacgagaacgagatcggccacagcagaagagccgccgccatcggcatcacccaggtggtgatcagcagaatcaccatgagcgcccccggcatgatcctgctgcccgtgatcatggagagactggagaagctgcacttcatgcagaaggtgaaggtgctgcacgcccccctgcaggtgatgctgagcggctgcttcctgatcttcatggtgcccgtggcctgcggcctgttcccccagaagtgcgagctgcccgtgagctacctggagcccaagctgcaggacaccatcaaggccaagtacggcgagctggagccctacgtgtacttcaacaagggcctgtag

SEQ ID NO: 22038 - DNA, 1134 bp, Artificial Sequence
  Description of Artificial Sequence: Synthetic coding sequence
atgtgcgaggaggaggacagcaccgccctggtgtgcgacaacggcagcggcctgtgcaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcatcaccaactgggacgacatggagaagatctggcaccacagcttctacaacgagctgagagtggcccccgaggagcaccccaccctgctgaccgaggcccccctgaaccccaaggccaacagagagaagatgacccagatcatgttcgagaccttcaacgtgcccgccatgtacgtggccatccaggccgtgctgagcctgtacgccagcggcagaaccaccggcatcgtgctggacagcggcgacggcgtgacccacaacgtgcccatctacgagggctacgccctgccccacgccatcatgagactggacctggccggcagagacctgaccgactacctgatgaagatcctgaccgagagaggctacagcttcgtgaccaccgccgagagagagatcgtgagagacatcaaggagaagctgtgctacgtggccctggacttcgagaacgagatggccaccgccgccagcagcagcagcctggagaagagctacgagctgcccgacggccaggtgatcaccatcggcaacgagagattcagatgccccgagaccctgttccagcccagcttcatcggcatggagagcgccggcatccacgagaccacctacaacagcatcatgaagtgcgacatcgacatcagaaaggacctgtacgccaacaacgtgctgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcagcaagcaggagtacgacgaggccggccccagcatcgtgcacagaaagtgcttctag

SEQ ID NO: 22039 - DNA, 966 bp, Artificial Sequence
  Description of Artificial Sequence: Synthetic coding sequence
atgggcgagctgcccctggacatcaacatccaggagcccagatgggaccagagcaccttcctgggcagagccagacacttcttcaccgtgaccgaccccagaaacctgctgctgagcggcgcccagctggaggccagcagaaacatcgtgcagaactacagagccggcgtggtgacccccggcatcaccgaggaccagctgtggagagccaagtacgtgtacgacagcgccttccaccccgacaccggcgagaaggtggtgctgatcggcagaatgagcgcccaggtgcccatgaacatgaccatcaccggctgcatgctgaccttctacagaaagacccccaccgtggtgttctggcagtgggtgaaccagagcttcaacgccatcgtgaactacagcaacagaagcggcgacacccccatcaccgtgagacagctgggcaccgcctacgtgagcgccaccaccggcgccgtggccaccgccctgggcctgaagagcctgaccaagcacctgccccccctggtgggcagattcgtgcccttcgccgccgtggccgccgccaactgcatcaacatccccctgatgagacagagagagctgcaggtgggcatccccgtggccgacgaggccggccagagactgggctacagcgtgaccgccgccaagcagggcatcttccaggtggtgatcagcagaatctgcatggccatccccgccatggccatcccccccctgatcatggacaccctggagaagaaggacttcctgaagagaagaccctggctgggcgcccccctgcaggtgggcctggtgggcttctgcctggtgttcgccacccccctgtgctgcgccctgttcccccagaagagcagcatccacatcagcaacctggagcccgagctgagagcccagatccacgagcagaaccccagcgtggaggtggtgtactacaacaagggcctgtag

SEQ ID NO: 22040 - DNA, 987 bp, Artificial Sequence
  Description of Artificial Sequence: Synthetic coding sequence
atgagcctggagcaggaggaggagacccagcccggcagactgctgggcagaagagacgccgtgcccgccttcatcgagcccaacgtgagattctggatcaccgagagacagagcttcatcagaagattcctgcagtggaccgagctgctggaccccaccaacgtgttcatcagcgtggagagcatcgagaacagcagacagctgctgtgcaccaacgaggacgtgagcagccccgccagcgccgaccagagagccaccgtgcaccccgacagcagcaacctgatccccaagctgttcagacccgccgccttcctgcccttcatggcccccaccgtgttcctgagcatgacccccctgaagggcatcaagagcgtgatcctgccccaggtgttcctgtgcgcctacatggccgccttcaacagcatcaacggcaacagaagctacacctgcaagcccctggagagaagcctgctgatggccggcgccgtggccagcagcaccttcctgggcgtgatcccccagttcgtgcagatgaagtacggcctgaccggcccctggatcaagagactgctgcccgtgatcttcctggtgcaggccagcggcatgaacgtgtacatgagcagaagcctggagagcatcaagggcatcgccgtgatggacaaggagggcaacgtgctgggccacagcagaatcgccggcaccaaggccgtgagagagaccctggccagcagaatcgtgctgttcggcaccagcgccctgatccccgaggtgttcacctacttcttcaagagaacccagtacttcagaaagaaccccggcagcctgtggatcctgaagctgagctgcaccgtgctggccatgggcctgatggtgcccttcagcttcagcatcttcccccagatcggccagatccagtactgcagcctggaggagaagatccagagccccaccgaggagaccgagatcttctaccacagaggcgtgtag

SEQ ID NO: 22041 - DNA, 1014 bp, Artificial Sequence
  Description of Artificial Sequence: Synthetic coding sequence
atgagcctggagcaggaggaggagacccagcccggcagactgctgggcagaagagacgccgtgcccgccttcatcgagcccaacgtgagattctggatcaccgagagacagagcttcatcagaagattcctgcagtggaccgagctgctggaccccaccaacgtgttcatcagcgtggagagcatcgagaacagcagacagctgctgtgcaccaacgaggacgtgagcagccccgccagcgccgaccagagaatccaggaggcctggaagagaagcctggccaccgtgcaccccgacagcagcaacctgatccccaagctgttcagacccgccgccttcctgcccttcatggcccccaccgtgttcctgagcatgacccccctgaagggcatcaagagcgtgatcctgccccaggtgttcctgtgcgcctacatggccgccttcaacagcatcaacggcaacagaagctacacctgcaagcccctggagagaagcctgctgatggccggcgccgtggccagcagcaccttcctgggcgtgatcccccagttcgtgcagatgaagtacggcctgaccggcccctggatcaagagactgctgcccgtgatcttcctggtgcaggccagcggcatgaacgtgtacatgagcagaagcctggagagcatcaagggcatcgccgtgatggacaaggagggcaacgtgctgggccacagcagaatcgccggcaccaaggccgtgagagagaccctggccagcagaatcgtgctgttcggcaccagcgccctgatccccgaggtgttcacctacttcttcaagagaacccagtacttcagaaagaaccccggcagcctgtggatcctgaagctgagctgcaccgtgctggccatgggcctgatggtgcccttcagcttcagcatcttcccccagatcggccagatccagtactgcagcctggaggagaagatccagagccccaccgaggagaccgagatcttctaccacagaggcgtgtag

SEQ ID NO: 22042 - DNA, 537 bp, Artificial Sequence
  Description of Artificial Sequence: Synthetic coding sequence
atggcccccaccgtgttcctgagcatgacccccctgaagggcatcaagagcgtgatcctgccccaggtgttcctgtgcgcctacatggccgccttcaacagcatcaacggcaacagaagctacacctgcaagcccctggagagaagcctgctgatggccggcgccgtggccagcagcaccttcctgggcgtgatcccccagttcgtgcagatgaagtacggcctgaccggcccctggatcaagagactgctgcccgtgatcttcctggtgcaggccagcggcatgaacgtgtacatgagcagaagcctggagagcatcaagggcatcgccgtgatggacaaggagggcaacgtgctgggccacagcagaatcgccggcaccaaggccgtgagagagaccctggccagcagaatcgtgctgttcggcaccagcgccctgatccccgaggtgttcacctacttcttcaagagaacccagtacttcagaaagaaccccggcagcctgtggatcctgaagctgagctgcaccgtgctgtag

SEQ ID NO: 22043 - DNA, 663 bp, Artificial Sequence
  Description of Artificial Sequence: Synthetic coding sequence
agccccctggtgttcctgagcatgacccccctgaagggcatcaagagcgtgatcctgccccaggtgttcctgtgcgcctacatggccgccttcaacagcatcaacggcaacagaagctacacctgcaagcccctggagagaagcctgctgatggccggcgccgtggccagcagcaccttcctgggcgtgatcccccagttcgtgcagatgaagtacggcctgaccggcccctggatcaagagactgctgcccgtgatcttcctggtgcaggccagcggcatgaacgtgtacatgagcagaagcctggagagcatcaagggcatcgccgtgatggacaaggagggcaacgtgctgggccacagcagaatcgccggcaccaaggccgtgagagagaccctggccagcagaatcgtgctgttcggcaccagcgccctgatccccgaggtgttcacctacttcttcaagagaacccagtacttcagaaagaaccccggcagcctgtggatcctgaagctgagctgcaccgtgctggccatgggcctgatggtgcccttcagcttcagcatcttcccccagatcggccagatccagtactgcagcctggaggagaagatccagagccccaccgaggagaccgagatcttctaccacagaggcgtgtag

SEQ ID NO: 22044 - DNA, 192 bp, Artificial Sequence
  Description of Artificial Sequence: Synthetic coding sequence
atggcccccaccgtgttcctgagcatgacccccctgaagggcatcaagagcgtgatcctgccccaggtgttcctgtgcgcctacatggccgccttcaacagcatcaacggcaacagaagctacacctgcaagcccctggagagaagcctgctgatggccggcgccgtggccagcagcaccttcctgggctag

SEQ ID NO: 22045 - DNA, 1023 bp, Artificial Sequence
  Description of Artificial Sequence: Synthetic coding sequence
atggccgacaccgccaccaccgccagcgccgccgccgccagcgccgccagcgccagcagcgacgccccccccttccagctgggcaagcccagattccagcagaccagcttctacggcagattcagacacttcctggacatcatcgaccccagaaccctgttcgtgaccgagagaagactgagagaggccgtgcagctgctggaggactacaagcacggcaccctgagacccggcgtgaccaacgagcagctgtggagcgcccagaagatcaagcaggccatcctgcaccccgacaccaacgagaagatcttcatgcccttcagaatgagcggctacatccccttcggcacccccatcgtggtgggcctgctgctgcccaaccagaccctggccagcaccgtgttctggcagtggctgaaccagagccacaacgcctgcgtgaactacgccaacagaaacgccaccaagcccagccccgccagcaagttcatccagggctacctgggcgccgtgatcagcgccgtgagcatcgccgtgggcctgaacgtgctggtgcagaaggccaacaagttcacccccgccaccagactgctgatccagagattcgtgcccttccccgccgtggccagcgccaacatctgcaacgtggtgctgatgagatacggcgagctggaggagggcatcgacgtgctggacagcgacggcaacctggtgggcagcagcaagatcgccgccagacacgccctgctggagaccgccctgaccagagtggtgctgcccatgcccatcctggtgctgccccccatcgtgatgagcatgctggagaagaccgccctgctgcaggccagacccagactgctgctgcccgtgcagagcctggtgtgcctggccgccttcggcctggccctgcccctggccatcagcctgttcccccagatgagcgagatcgagaccagccagctggagcccgagatcgcccaggccaccagcagcagaaccgtggtgtacaacaagggcctgtag

SEQ ID NO: 22046 - DNA, 4389 bp, Artificial Sequence
  Description of Artificial Sequence: Synthetic coding sequence
atgggcgcccaggacagaccccagtgccacttcgacatcgagatcaacagagagcccgtgggcagaatcatgttccagctgttcagcgacatctgccccaagacctgcaagaacttcctgtgcctgtgcagcggcgagaagggcctgggcaagaccaccggcaagaagctgtgctacaagggcagcaccttccacagagtggtgaagaacttcatgatccagggcggcgacttcagcgagggcaacggcaagggcggcgagagcatctacggcggctacttcaaggacgagaacttcatcctgaagcacgacagagccttcctgctgagcatggccaacagaggcaagcacaccaacggcagccagttcttcatcaccaccaagcccgccccccacctggacggcgtgcacgtggtgttcggcctggtgatcagcggcttcgaggtgatcgagcagatcgagaacctgaagaccgacgccgccagcagaccctacgccgacgtgagagtgatcgactgcggcgtgctggccaccaagagcatcaaggacgtgttcgagaagaagagaaagaagcccacccacagcgagggcagcgacagcagcagcaacagcagcagcagcagcgagagcagcagcgagagcgagctggagcacgagagaagcagaagaagaaagcacaagagaagacccaaggtgaagagaagcaagaagagaagaaaggaggccagcagcagcgaggagcccagaaacaagcacgccatgaaccccaagggccacagcgagagaagcgacaccaacgagaagagaagcgtggacagcagcgccaagagagagaagcccgtggtgagacccgaggagatcccccccgtgcccgagaacagattcctgctgagaagagacatgcccgtggtgaccgccgagcccgagcccaagatccccgacgtggcccccatcgtgagcgaccagaagcccagcgtgagcaagagcggcagaaagatcaagggcagaggcaccatcagataccacaccccccccagaagcagaagctgcagcgagagcgacgacgacgacagcagcgagacccccccccactggaaggaggagatgcagagactgagagcctacagaccccccagcggcgagaagtggagcaagggcgacaagctgagcgacccctgcagcagcagatgggacgagagaagcctgagccagagaagcagaagctggagctacaacggctactacagcgacctgagcaccgccagacacagcggccaccacaagaagagaagaaaggagaagaaggtgaagcacaagaagaagggcaagaagcagaagcactgcagaagacacaagcagaccaagaagagaagaatcctgatccccagcgacatcgagagcagcaagagcagcaccagaagaatgaagagcagctgcgacagagagagaagcagcagaagcagcagcctgagcagccaccacagcagcaagagagactggagcaagagcgacaaggacgtgcagagcagcctgacccacagcagcagagacagctacagaagcaagagccacagccagagctacagcagaggcagcagcagaagcagaaccgccagcaagagcagcagccacagcagaagcagaagcaagagcagaagcagcagcaagagcggccacagaaagagagccagcaagagccccagaaagaccgccagccagctgagcgagaacaagcccgtgaagaccgagcccctgagagccaccatggcccagaacgagaacgtggtggtgcagcccgtggtggccgagaacatccccgtgatccccctgagcgacagccccccccccagcagatggaagcccggccagaagccctggaagcccagctacgagagaatccaggagatgaaggccaagaccacccacctgctgcccatccagagcacctacagcctggccaacatcaaggagaccggcagcagcagcagctaccacaagagagagaagaacagcgagagcgaccagagcacctacagcaagtacagcgacagaagcagcgagagcagccccagaagcagaagcagaagcagcagaagcagaagctacagcagaagctacaccagaagcagaagcctggccagcagccacagcagaagcagaagccccagcagcagaagccacagcagaaacaagtacagcgaccacagccagtgcagcagaagcagcagctacaccagcatcagcagcgacgacggcagaagagccaagagaagactgagaagcagcggcaagaagaacagcgtgagccacaagaagcacagcagcagcagcgagaagaccctgcacagcaagtacgtgaagggcagagacagaagcagctgcgtgagaaagtacagcgagagcagaagcagcctggactacagcagcgacagcgagcagagcagcgtgcaggccacccagagcgcccaggagaaggagaagcagggccagatggagagaacccacaacaagcaggagaagaacagaggcgaggagaagagcaagagcgagagagagtgcccccacagcaagaagagaaccctgaaggagaacctgagcgaccacctgagaaacggcagcaagcccaagagaaagaactacgccggcagcaagtgggacagcgagagcaacagcgagagagacgtgaccaagaacagcaagaacgacagccaccccagcagcgacaaggaggagggcgaggccaccagcgacagcgagagcgaggtgagcgagatccacatcaaggtgaagcccaccaccaagagcagcaccaacaccagcctgcccgacgacaacggcgcctggaagagcagcaagcagagaaccagcaccagcgacagcgagggcagctgcagcaacagcgagaacaacagaggcaagccccagaagcacaagcacggcagcaaggagaacctgaagagagagcacaccaagaaggtgaaggagaagctgaagggcaagaaggacaagaagcacaaggcccccaagagaaagcaggccttccactggcagccccccctggagttcggcgaggaggaggaggaggagatcgacgacaagcaggtgacccaggagagcaaggagaagaaggtgagcgagaacaacgagaccatcaaggacaacatcctgaagaccgagaagagcagcgaggaggacctgagcggcaagcacgacaccgtgaccgtgagcagcgacctggaccagttcaccaaggacgacagcaagctgagcatcagccccaccgccctgaacaccgaggagaacgtggcctgcctgcagaacatccagcacgtggaggagagcgtgcccaacggcgtggaggacgtgctgcagaccgacgacaacatggagatctgcacccccgacagaagcagccccgccaaggtggaggagaccagccccctgggcaacgccagactggacacccccgacatcaacatcgtgctgaagcaggacatggccaccgagcacccccaggccgaggtggtgaagcaggagagcagcatgagcgagagcaaggtgctgggcgaggtgggcaagcaggacagcagcagcgccagcctggccagcgccggcgagagcaccggcaagaaggaggtggccgagaagagccagatcaacctgatcgacaagaagtggaagcccctgcagggcgtgggcaacctggccgcccccaacgccgccaccagcagcgccgtggaggtgaaggtgctgaccaccgtgcccgagatgaagccccagggcctgagaatcgagatcaagagcaagaacaaggtgagacccggcagcctgttcgacgaggtgagaaagaccgccagactgaacagaagacccagaaaccaggagagcagcagcgacgagcagacccccagcagagacgacgacagccagagcagaagccccagcagaagcagaagcaagagcgagaccaagagcagacacagaaccagaagcgtgagctacagccacagcagaagcagaagcagaagcagcaccagcagctacagaagcagaagctacagcagaagcagaagcagaggctggtacagcagaggcagaaccagaagcagaagcagcagctacagaagctacaagagccacagaaccagcagcagaagcagaagcagaagcagcagctacgacccccacagcagaagcagaagctacacctacgacagctactacagcagaagcagaagcagaagcagaagccagagaagcgacagctaccacagaggcagaagctacaacagaagaagcagaagctgcagaagctacggcagcgacagcgagagcgacagaagctacagccaccacagaagccccagcgagagcagcagatacagctag

SEQ ID NO: 22047 - DNA, 681 bp, Artificial Sequence
  Description of Artificial Sequence: Synthetic coding sequence
atggccgccgccgccgtgcagggcggcagaagcggcggcagcggcggctgcagcggcgccggcggcgccagcaactgcggcaccggcagcggcagaagcggcctgctggacaagtggaagatcgacgacaagcccgtgaagatcgacaagtgggacggcagcgccgtgaagaacagcctggacgacagcgccaagaaggtgctgctggagaagtacaagtacgtggagaacttcggcctgatcgacggcagactgaccatctgcaccatcagctgcttcttcgccatcgtggccctgatctgggactacatgcaccccttccccgagagcaagcccgtgctggccctgtgcgtgatcagctacttcgtgatgatgggcatcctgaccatctacaccagctacaaggagaagagcatcttcctggtggcccacagaaaggaccccaccggcatggaccccgacgacatctggcagctgagcagcagcctgaagagattcgacgacaagtacaccctgaagctgaccttcatcagcggcagaaccaagcagcagagagaggccgagttcaccaagagcatcgccaagttcttcgaccacagcggcaccctggtgatggacgcctacgagcccgagatcagcagactgcacgacagcctggccatcgagagaaagatcaagtag

SEQ ID NO: 22048 - DNA, 543 bp, Artificial Sequence
  Description of Artificial Sequence: Synthetic coding sequence
atgaacaccgtgctgagcagagccaacagcctgttcgccttcagcctgagcgtgatggccgccctgaccttcggctgcttcatcaccaccgccttcaaggacagaagcgtgcccgtgagactgcacgtgagcagaatcatgctgaagaacgtggaggacttcaccggccccagagagagaagcgacctgggcttcatcaccttcgacatcaccgccgacctggagaacatcttcgactggaacgtgaagcagctgttcctgtacctgagcgccgagtacagcaccaagaacaacgccctgaaccaggtggtgctgtgggacaagatcgtgctgagaggcgacaaccccaagctgctgctgaaggacatgaagaccaagtacttcttcttcgacgacggcaacggcctgaagggcaacagaaacgtgaccctgaccctgagctggaacgtggtgcccaacgccggcatcctgcccctggtgaccggcagcggccacgtgagcgtgcccttccccgacacctacgagatcaccaagagctactag

SEQ ID NO: 22049 - DNA, 1563 bp, Artificial Sequence
  Description of Artificial Sequence: Synthetic coding sequence
atgggcccccagagaagactgagccccgccggcgccgccctgctgtggggcttcctgctgcagctgaccgccgcccaggaggccatcctgcacgccagcggcaacggcaccaccaaggactactgcatgctgtacaacccctactggaccgccctgcccagcaccctggagaacgccaccagcatcagcctgatgaacctgaccagcacccccctgtgcaacctgagcgacatcccccccgtgggcatcaagagcaaggccgtggtggtgccctggggcagctgccacttcctggagaaggccagaatcgcccagaagggcggcgccgaggccatgctggtggtgaacaacagcgtgctgttcccccccagcggcaacagaagcgagttccccgacgtgaagatcctgatcgccttcatcagctacaaggacttcagagacatgaaccagaccctgggcgacaacatcaccgtgaagatgtacagccccagctggcccaacttcgactacaccatggtggtgatcttcgtgatcgccgtgttcaccgtggccctgggcggctactggagcggcctggtggagctggagaacctgaaggccgtgaccaccgaggacagagagatgagaaagaagaaggaggagtacctgaccttcagccccctgaccgtggtgatcttcgtggtgatctgctgcgtgatgatggtgctgctgtacttcttctacaagtggctggtgtacgtgatgatcgccatcttctgcatcgccagcgccatgagcctgtacaactgcctggccgccctgatccacaagatcccctacggccagtgcaccatcgcctgcagaggcaagaacatggaggtgagactgatcttcctgagcggcctgtgcatcgccgtggccgtggtgtgggccgtgttcagaaacgaggacagatgggcctggatcctgcaggacatcctgggcatcgccttctgcctgaacctgatcaagaccctgaagctgcccaacttcaagagctgcgtgatcctgctgggcctgctgctgctgtacgacgtgttcttcgtgttcatcacccccttcatcaccaagaacggcgagagcatcatggtggagctggccgccggccccttcggcaacaacgagaagctgcccgtggtgatcagagtgcccaagctgatctacttcagcgtgatgagcgtgtgcctgatgcccgtgagcatcctgggcttcggcgacatcatcgtgcccggcctgctgatcgcctactgcagaagattcgacgtgcagaccggcagcagctacatctactacgtgagcagcaccgtggcctacgccatcggcatgatcctgaccttcgtggtgctggtgctgatgaagaagggccagcccgccctgctgtacctggtgccctgcaccctgatcaccgccagcgtggtggcctggagaagaaaggagatgaagaagttctggaagggcaacagctaccagatgatggaccacctggactgcgccaccaacgaggagaaccccgtgatcagcggcgagcagatcgtgcagcagtag

SEQ ID NO: 22050 - DNA, 2055 bp, Artificial Sequence
  Description of Artificial Sequence: Synthetic coding sequence
atggcctgcctgggcttcctgctgcccgtgggcttcctgctgctgatcagcaccgtggccggcggcaagtacggcgtggcccacgtggtgagcgagaactggagcaaggactactgcatcctgttcagcagcgactacatcaccctgcccagagacctgcaccacgcccccctgctgcccctgtacgacggcaccaaggccccctggtgccccggcgaggacagcccccaccaggcccagctgagaagccccagccagagacccctgagacagaccaccgccatggtgatgagaggcaactgcagcttccacaccaagggctggctggcccagggccagggcgcccacggcctgctgatcgtgagcagagtgagcgaccagcagtgcagcgacaccaccctggccccccaggaccccagacagcccctggccgacctgaccatccccgtggccatgctgcactacgccgacatgctggacatcctgagccacaccagaggcgaggccgtggtgagagtggccatgtacgccccccccgagcccatcatcgactacaacatgctggtgatcttcatcctggccgtgggcaccgtggccgccggcggctactgggccggcctgaccgaggccaacagactgcagagaagaagagccagaagaggcggcggcagcggcggccaccaccagctgcaggaggccgccgccgccgagggcgcccagaaggaggacaacgaggacatccccgtggacttcacccccgccatgaccggcgtggtggtgaccctgagctgcagcctgatgctgctgctgtacttcttctacgaccacttcgtgtacgtgaccatcggcatcttcggcctgggcgccggcatcggcctgtacagctgcctgagccccctggtgtgcagactgagcctgagacagtaccagagacccccccacagcctgtgggccagcctgcccctgcccctgctgctgctggccagcctgtgcgccaccgtgatcatcttctgggtggcctacagaaacgaggacagatgggcctggctgctgcaggacaccctgggcatcagctactgcctgttcgtgctgcacagagtgagactgcccaccctgaagaactgcagcagcttcctgctggccctgctggccttcgacgtgttcttcgtgttcgtgacccccttcttcaccaagaccggcgagagcatcatggcccaggtggccctgggccccgccgagagcagcagccacgagagactgcccatggtgctgaaggtgcccagactgagagtgagcgccctgaccctgtgcagccagcccttcagcatcctgggcttcggcgacatcgtggtgcccggcttcctggtggcctactgctgcagattcgacgtgcaggtgtgcagcagacagatctacttcgtggcctgcaccgtggcctacgccgtgggcctgctggtgaccttcatggccatggtgctgatgcagatgggccagcccgccctgctgtacctggtgagcagcaccctgctgaccagcctggccgtggccgcctgcagacaggagctgagcctgttctggaccggccagggcagagccaagatgtgcggcctgggctgcgcccccagcgccggcagcagacagaagcaggagggcgccgccgacgcccacaccgccagcaccctggagagaggcaccagcagaggcgccggcgacctggacagcaaccccggcgaggacaccaccgagatcgtgaccatcagcgagaacgaggccaccaaccccgaggacagaagcgacagcagcgagggctggagcgacgcccacctggaccccaacgagctgcccttcatcccccccggcgccagcgaggagctgatgcccctgatgcccatggccatgctgatccccctgatgcccctgatgcccccccccagcgagctgggccacgtgcacgcccaggcccaggcccacgagaccggcctgccctgggccggcctgcacaagagaaagggcctgaaggtgagaaagagcatgagcacccaggcccccctgtag

SEQ ID NO: 22051 - DNA, 1155 bp, Artificial Sequence
  Description of Artificial Sequence: Synthetic coding sequence
atggccgagcagacctacagctgggcctacagcctggtggacagcagccaggtgagcaccttcctgatcagcatcctgctgatcgtgtacggcagcttcagaagcctgaacatggacttcgagaaccaggacaaggagaaggacagcaacagcagcagcggcagcttcaacggcaacagcaccaacaacagcatccagaccatcgacagcacccaggccctgttcctgcccatcggcgccagcgtgagcctgctggtgatgttcttcttcttcgacagcgtgcaggtggtgttcaccatctgcaccgccgtgctggccaccatcgccttcgccttcctgctgctgcccatgtgccagtacctgaccagaccctgcagcccccagaacaagatcagcttcggctgctgcggcagattcaccgccgccgagctgctgagcttcagcctgagcgtgatgctggtgctgatctgggtgctgaccggccactggctgctgatggacgccctggccatgggcctgtgcgtggccatgatcgccttcgtgagactgcccagcctgaaggtgagctgcctgctgctgagcggcctgctgatctacgacgtgttctgggtgttcttcagcgcctacatcttcaacagcaacgtgatggtgaaggtggccacccagcccgccgacaaccccctggacgtgctgagcagaaagctgcacctgggccccaacgtgggcagagacgtgcccagactgagcctgcccggcaagctggtgttccccagcagcaccggcagccacttcagcatgctgggcatcggcgacatcgtgatgcccggcctgctgctgtgcttcgtgctgagatacgacaactacaagaagcaggccagcggcgacagctgcggcgcccccggccccgccaacatcagcggcagaatgcagaaggtgagctacttccactgcaccctgatcggctacttcgtgggcctgctgaccgccaccgtggccagcagaatccacagagccgcccagcccgccctgctgtacctggtgcccttcaccctgctgcccctgctgaccatggcctacctgaagggcgacctgagaagaatgtggagcgagcccttccacagcaagagcagcagcagcagattcctggaggtgtag

SEQ ID NO: 22052 - DNA, 1152 bp, Artificial Sequence
  Description of Artificial Sequence: Synthetic coding sequence
agcatcagaacccactgcatggcctacagcctggtggacagcagccaggtgagcaccttcctgatcagcatcctgctgatcgtgtacggcagcttcagaagcctgaacatggacttcgagaaccaggacaaggagaaggacagcaacagcagcagcggcagcttcaacggcaacagccccatcatcggcatccagaccatcgacagcacccaggccctgttcctgcccatcggcgccagcgtgagcctgctggtgatgttcttcttcttcgacagcgtgcaggtggtgttcaccatctgcaccgccgtgctggccaccatcgccttcgccttcctgctgctgcccatgtgccagtacctgaccagaccctgcagcccccagaacaagatcagcttcggctgctgcggcagattcaccgccgccgagctgctgagcttcagcctgagcgtgatgctggtgctgatctgggtgctgaccggccactggctgctgatggacgccctggccatgggcctgtgcgtggccatgatcgccttcgtgagactgcccagcctgaaggtgagctgcctgctgctgagcggcctgctgatctacgacgtgttctgggtgttcttcagcgcctacatcttcaacagcaacgtgatggtgaaggtggccacccagcccgccgacaaccccctggacgtgctgagcagaaagctgcacctgggccccaacgtgggcagagacgtgcccagactgagcctgcccggcaagctggtgttccccagcagcaccggcagccacttcagcatgctgggcatcggcgacatcgtgatgcccggcctgctgctgtgcttcgtgctgagatacgacaactacaagaagcaggccagcggcgacagctgcggcgcccccggccccgccaacatcagcggcagaatgcagaaggtgagctacttccactgcaccctgatcggctacttcgtgggcctgctgaccgccaccgtggccagcagaatccacagagccgcccagcccgccctgctgtacctggtgcccttcaccctgctgcccctgctgaccatggcctacctgaagggcgacctgagaagaatgtggagcgagcccttccacagcaagagcagcagcagcagattcctggaggtgtag

SEQ ID NO: 22053 - DNA, 816 bp, Artificial Sequence
  Description of Artificial Sequence: Synthetic coding sequence
atggccagcgccgacagcagaagagtggccgacggcggcggcgccggcggcaccttccagccctacctggacaccctgagacaggagctgcagcagaccgaccccaccctgctgagcgtggtggtggccgtgctggccgtgctgctgaccctggtgttctggaagctgatcagaagcagaagaagcagccagagagccgtgctgctggtgggcctgtgcgacagcggcaagaccctgctgttcgtgagactgctgaccggcctgtacagagacacccagaccagcatcaccgacagctgcgccgtgtacagagtgaacaacaacagaggcaacagcctgaccctgatcgacctgcccggccacgagagcctgagactgcagttcctggagagattcaagagcagcgccagagccatcgtgttcgtggtggacagcgccgccttccagagagaggtgaaggacgtggccgagttcctgtaccaggtgctgatcgacagcatgggcctgaagaacacccccagcttcctgatcgcctgcaacaagcaggacatcgccatggccaagagcgccaagctgatccagcagcagctggagaaggagctgaacaccctgagagtgaccagaagcgccgcccccagcaccctggacagcagcagcaccgcccccgcccagctgggcaagaagggcaaggagttcgagttcagccagctgcccctgaaggtggagttcctggagtgcagcgccaagggcggcagaggcgacgtgggcagcgccgacatccaggacctggagaagtggctggccaagatcgcctag

SEQ ID NO: 22054 - DNA, 279 bp, Artificial Sequence
  Description of Artificial Sequence: Synthetic coding sequence
atggccagcgccgacagcagaagagtggccgacggcggcggcgccggcggcaccttccagccctacctggacaccctgagacaggagctgcagcagaccgaccccaccctgctgagcgtggtggtggccgtgctggccgtgctgctgaccctggtgttctggaagctgatcagaagcagaagaagcagccagagagccgtgctgctggtgggcctgtgcgacagcggcaagaccctgctgttcgtgagactgctgaccggcctgtacagagacacctag

SEQ ID NO: 22055 - DNA, 861 bp, Artificial Sequence
  Description of Artificial Sequence: Synthetic coding sequence
atgagactgctgcccagactgctgctgctgctgctgctggtgttccccgccaccgtgctgttcagaggcggccccagaggcctgctggccgtggcccaggacctgaccgaggacgaggagaccgtggaggacagcatcatcgaggacgaggacgacgaggccgaggtggaggaggacgagcccaccgacctggtggaggacaaggaggaggaggacgtgagcggcgagcccgaggccagccccagcgccgacaccaccatcctgttcgtgaagggcgaggacttccccgccaacaacatcgtgaagttcctggtgggcttcaccaacaagggcaccgaggacttcatcgtggagagcctggacgccagcttcagatacccccaggactaccagttctacatccagaacttcaccgccctgcccctgaacaccgtggtgcccccccagagacaggccaccttcgagtacagcttcatccccgccgagcccatgggcggcagacccttcggcctggtgatcaacctgaactacaaggacctgaacggcaacgtgttccaggacgccgtgttcaaccagaccgtgaccgtgatcgagagagaggacggcctggacggcgagaccatcttcatgtacatgttcctggccggcctgggcctgctggtgatcgtgggcctgcaccagctgctggagagcagaaagagaaagagacccatccagaaggtggagatgggcaccagcagccagaacgacgtggacatgagctggatcccccaggagaccctgaaccagatcaacaaggccagccccagaagactgcccagaaagagagcccagaagagaagcgtgggcagcgacgagtag

SEQ ID NO: 22056 - DNA, 780 bp, Artificial Sequence
  Description of Artificial Sequence: Synthetic coding sequence
atgagactgctgcccagactgctgctgctgctgctgctggtgttccccgccaccgtgctgttcagaggcggccccagaggcctgctggccgtggcccaggacctgaccgaggacgaggagaccgtggaggacagcatcatcgaggacgaggacgacgaggccgaggtggaggaggacgagcccaccgacctggtgaagtacttccccgccaacaacatcgtgaagttcctggtgggcttcaccaacaagggcaccgaggacttcatcgtggagagcctggacgccagcttcagatacccccaggactaccagttctacatccagaacttcaccgccctgcccctgaacaccgtggtgcccccccagagacaggccaccttcgagtacagcttcatccccgccgagcccatgggcggcagacccttcggcctggtgatcaacctgaactacaaggacctgaacggcaacgtgttccaggacgccgtgttcaaccagaccgtgaccgtgatcgagagagaggacggcctggacggcgagaccatcttcatgtacatgttcctggccggcctgggcctgctggtgatcgtgggcctgcaccagctgctggagagcagaaagagaaagagacccatccagaaggtggagatgggcaccagcagccagaacgacgtggacatgagctggatcccccaggagaccctgaaccagatcaacaaggccagccccagaagactgcccagaaagagagcccagaagagaagcgtgggcagcgacgagtag

SEQ ID NO: 22057 - DNA, 558 bp, Artificial Sequence
  Description of Artificial Sequence: Synthetic coding sequence
atggcccccaagggcagcagcaagcagcagagcgaggaggacctgctgctgcaggacttcagcagaaacctgagcgccaagagcagcgccctgttcttcggcaacgccttcatcgtgagcgccatccccatctggctgtactggagaatctggcacatggacctgatccagagcgccgtgctgtacagcgtgatgaccctggtgagcacctacctggtggccttcgcctacaagaacgtgaagttcgtgctgaagcacaaggtggcccagaagagagaggacgccgtgagcaaggaggtgaccagaaagctgagcgaggccgacaacagaaagatgagcagaaaggagaaggacgagagaatcctgtggaagaagaacgaggtggccgactacgaggccaccaccttcagcatcttctacaacaacaccctgttcctggtggtggtgatcgtggccagcttcttcatcctgaagaacttcaaccccaccgtgaactacatcctgagcatcagcgccagcagcggcctgatcgccctgctgagcaccggcagcaagtag

SEQ ID NO: 22058 - DNA, 597 bp, Artificial Sequence
  Description of Artificial Sequence: Synthetic coding sequence
atggcccccaagggcagcagcaagcagcagagcgaggaggacctgctgctgcaggacttcagcagaaacctgagcgccaagagcagcgccctgttcttcggcaacgccttcatcgtgagcgccatccccatctggctgtactggagaatctggcacatggacctgatccagagcgccgtgctgtacagcgtgatgaccctggtgagcacctacctggtggccttcgcctacaagaacgtgaagttcgtgctgaagcacaaggtggcccagaagagagaggacgccgtgagcaaggaggtgaccagaaagctgagcgaggccgacaacagaaagatgagcagaaaggagaaggacgagagattcgacagctgcctgaagtacggccaccacaagagaggcatcctgtggaagaagaacgaggtggccgactacgaggccaccaccttcagcatcttctacaacaacaccctgttcctggtggtggtgatcgtggccagcttcttcatcctgaagaacttcaaccccaccgtgaactacatcctgagcatcagcgccagcagcggcctgatcgccctgctgagcaccggcagcaagtag

SEQ ID NO: 22059 - DNA, 5352 bp, Artificial Sequence
  Description of Artificial Sequence: Synthetic coding sequence
atgaccagcctgaagagaagccagaccgagagacccctggccaccgacagagccagcgtggtgggcaccgacggcacccccaaggtgcacaccgacgacttctacatgagaagattcagaagccagaacggcagcctgggcagcagcgtgatggcccccgtgggcccccccagaagcgagggcagccaccacatcaccagcacccccggcgtgcccaagatgggcgtgagagccagaatcgccgactggccccccagaaaggagaacatcaaggagagcagcagaagcagccaggagatcgagaccagcagctgcctggacagcctgagcagcaagagcagccccgtgagccagggcagcagcgtgagcctgaacagcaacgacagcgccatgctgaagagcatccagaacaccctgaagaacaagaccagacccagcgagaacatggacagcagattcctgatgcccgaggcctaccccagcagccccagaaaggccctgagaagaatcagacagagaagcaacagcgacatcaccatcagcgagctggacgtggacagcttcgacgagtgcatcagccccacctacaagaccggccccagcctgcacagagagtacggcagcaccagcagcatcgacaagcagggcaccagcggcgagagcttcttcgacctgctgaagggctacaaggacgacaagagcgacagaggccccacccccaccaagctgagcgacttcctgatcaccggcggcggcaagggcagcggcttcagcctggacgtgatcgacggccccatcagccagagagagaacctgagactgttcaaggagagagagaagcccctgaagagaagaagcaagagcgagaccggcgacagcagcatcttcagaaagctgagaaacgccaagggcgaggagctgggcaagagcagcgacctggaggacaacagaagcgaggacagcgtgagaccctggacctgccccaagtgcttcgcccactacgacgtgcagagcatcctgttcgacctgaacgaggccatcatgaacagacacaacgtgatcaagagaagaaacaccaccaccggcgccagcgccgccgccgtggccagcctggtgagcggccccctgagccacagcgccagcttcagcagccccatgggcagcaccgaggacctgaacagcaagggcagcctgagcatggaccagggcgacgacaagagcaacgagctggtgatgagctgcccctacttcagaaacgagatcggcggcgagggcgagagaaagatcagcctgagcaagagcaacagcggcagcttcagcggctgcgagagcgccagcttcgagagcaccctgagcagccactgcaccaacgccggcgtggccgtgctggaggtgcccaaggagaacctggtgctgcacctggacagagtgaagagatacatcgtggagcacgtggacctgggcgcctactactacagaaagttcttctaccagaaggagcactggaactacttcggcgccgacgagaacctgggccccgtggccgtgagcatcagaagagagaagcccgacgagatgaaggagaacggcagcccctacaactacagaatcatcttcagaaccagcgagctgatgaccctgagaggcagcgtgctggaggacgccatccccagcaccgccaagcacagcaccgccagaggcctgcccctgaaggaggtgctggagcacgtggtgcccgagctgaacgtgcagtgcctgagactggccttcaacacccccaaggtgaccgagcagctgatgaagctggacgagcagggcctgaactaccagcagaaggtgggcatcatgtactgcaaggccggccagagcaccgaggaggagatgtacaacaacgagagcgccggccccgccttcgaggagttcctgcagctgctgggcgagagagtgagactgaagggcttcgagaagtacagagcccagctggacaccaagaccgacagcaccggcacccacagcctgtacaccacctacaaggactacgagatcatgttccacgtgagcaccatgctgccctacacccccaacaacaagcagcagctgctgagaaagagacacatcggcaacgacatcgtgaccatcgtgttccaggagcccggcgcccagcccttcagccccaagaacatcagaagccacttccagcacgtgttcgtgatcgtgagagtgcacaacccctgcagcgacagcgtgtgctacagcgtggccgtgaccagaagcagagacgtgcccagcttcggcccccccatccccaagggcgtgaccttccccaagagcaacgtgttcagagacttcctgctggccaaggtgatcaacgccgagaacgccgcccacaagagcgagaagttcagagccatggccaccagaaccagacaggagtacctgaaggacctggccgagaagaacgtgaccaacacccccatcgaccccagcggcaagttccccttcatcagcctggccagcaagaagaaggagaagagcaagccctaccccggcgccgagctgagcagcatgggcgccatcgtgtgggccgtgagagccgaggactacaacaaggccatggagctggactgcctgctgggcatcagcaacgagttcatcgtgctgatcgagcaggagaccaagagcgtggtgttcaactgcagctgcagagacgtgatcggctggaccagcaccgacaccagcctgaagatcttctacgagagaggcgagtgcgtgagcgtgggcagcttcatcaacatcgaggagatcaaggagatcgtgaagagactgcagttcgtgagcaagggctgcgagagcgtggagatgaccctgagaagaaacggcctgggccagctgggcttccacgtgaactacgagggcatcgtggccgacgtggagccctacggctacgcctggcaggccggcctgagacagggcagcagactggtggagatctgcaaggtggccgtggccaccctgagccacgagcagatgatcgacctgctgagaaccagcgtgaccgtgaaggtggtgatcatccccccccacgacgactgcacccccagaagaagctgcagcgagacctacagaatgcccgtgatggagtacaagatgaacgagggcgtgagctacgagttcaagttccccttcagaaacaacaacaagtggcagagaaacgccagcaagggcccccacagcccccaggtgcccagccaggtgcagagccccatgaccagcagactgaacgccggcaagggcgacggcaagatgcccccccccgagagagccgccaacatccccagaagcatcagcagcgacggcagacccctggagagaagactgagccccggcagcgacatctacgtgaccgtgagcagcatggccctggccagaagccagtgcagaaacagccccagcaacctgagcagcagcagcgacaccggcagcgtgggcggcacctacagacagaagagcatgcccgagggcttcggcgtgagcagaagaagccccgccagcatcgacagacagaacacccagagcgacatcggcggcagcggcaagagcacccccagctggcagagaagcgaggacagcatcgccgaccagatggagcccacctgccacctgcccgccgtgagcaaggtgctgcccgccttcagagagagccccagcggcagactgatgagacaggaccccgtggtgcacctgagccccaacaagcagggccacagcgacagccactacagcagccacagcagcagcaacaccctgagcagcaacgccagcagcgcccacagcgacgagaagtggtacgacggcgacagaaccgagagcgagctgaacagctacaactacctgcagggcaccagcgccgacagcggcatcgacaccaccagctacggccccagccacggcagcaccgccagcctgggcgccgccaccagcagccccagaagcggccccggcaaggagaaggtggcccccctgtggcacagcagcagcgaggtgatcagcatggccgacagaaccctggagaccgagagccacggcctggacagaaagaccgagagcagcctgagcctggacatccacagcaagagccaggccggcagcacccccctgaccagagagaacagcaccttcagcatcaacgacgccgccagccacaccagcaccatgagcagcagacacagcgccagccccgtggtgttcaccagcgccagaagcagccccaaggaggagctgcaccccgccgcccccagccagctggcccccagcttcagcagcagcagcagcagcagcagcggccccagaagcttctaccccagacagggcgccaccagcaagtacctgatcggctggaagaagcccgagggcaccatcaacagcgtgggcttcatggacaccagaaagagacaccagagcgacggcaacgagatcgcccacaccagactgagagccagcaccagagacctgagagccagccccaagcccaccagcaagagcaccatcgaggaggacctgaagaagctgatcgacctggagagccccacccccgagagccagaagagcttcaagttccacgccctgagcagcccccagagccccttccccagcacccccaccagcagaagagccctgcacagaaccctgagcgacgagagcatctacaacagccagagagagcacttcttcaccagcagagccagcctgctggaccaggccctgcccaacgacgtgctgttcagcagcacctaccccagcctgcccaagagcctgcccctgagaagacccagctacaccctgggcatgaagagcctgcacggcgagttcagcgccagcgacagcagcctgaccgacatccaggagaccagaagacagcccatgcccgaccccggcctgatgcccctgcccgacaccgccgccgacctggactggagcaacctggtggacgccgccaaggcctacgaggtgcagagagccagcttcttcgccgccagcgacgagaaccacagacccctgagcgccgccagcaacagcgaccagctggaggaccaggccctggcccagatgaagccctacagcagcagcaaggacagcagccccaccctggccagcaaggtggaccagctggagggcatgctgaagatgctgagagaggacctgaagaaggagaaggaggacaaggcccacctgcaggccgaggtgcagcacctgagagaggacaacctgagactgcaggaggagagccagaacgccagcgacaagctgaagaagttcaccgagtgggtgttcaacaccatcgacatgagctag

SEQ ID NO: 22060 - DNA, 3774 bp, Artificial Sequence
  Description of Artificial Sequence: Synthetic coding sequence
atgaaggagaacggcagcccctacaactacagaatcatcttcagaaccagcgagctgatgaccctgagaggcagcgtgctggaggacgccatccccagcaccgccaagcacagcaccgccagaggcctgcccctgaaggaggtgctggagcacgtggtgcccgagctgaacgtgcagtgcctgagactggccttcaacacccccaaggtgaccgagcagctgatgaagctggacgagcagggcctgaactaccagcagaaggtgggcatcatgtactgcaaggccggccagagcaccgaggaggagatgtacaacaacgagagcgccggccccgccttcgaggagttcctgcagctgctgggcgagagagtgagactgaagggcttcgagaagtacagagcccagctggacaccaagaccgacagcaccggcacccacagcctgtacaccacctacaaggactacgagatcatgttccacgtgagcaccatgctgccctacacccccaacaacaagcagcagctgctgagaaagagacacatcggcaacgacatcgtgaccatcgtgttccaggagcccggcgcccagcccttcagccccaagaacatcagaagccacttccagcacgtgttcgtgatcgtgagagtgcacaacccctgcagcgacagcgtgtgctacagcgtggccgtgaccagaagcagagacgtgcccagcttcggcccccccatccccaagggcgtgaccttccccaagagcaacgtgttcagagacttcctgctggccaaggtgatcaacgccgagaacgccgcccacaagagcgagaagttcagagccatggccaccagaaccagacaggagtacctgaaggacctggccgagaagaacgtgaccaacacccccatcgaccccagcggcaagttccccttcatcagcctggccagcaagaagaaggagaagagcaagccctaccccggcgccgagctgagcagcatgggcgccatcgtgtgggccgtgagagccgaggactacaacaaggccatggagctggactgcctgctgggcatcagcaacgagttcatcgtgctgatcgagcaggagaccaagagcgtggtgttcaactgcagctgcagagacgtgatcggctggaccagcaccgacaccagcctgaagatcttctacgagagaggcgagtgcgtgagcgtgggcagcttcatcaacatcgaggagatcaaggagatcgtgaagagactgcagttcgtgagcaagggctgcgagagcgtggagatgaccctgagaagaaacggcctgggccagctgggcttccacgtgaactacgagggcatcgtggccgacgtggagccctacggctacgcctggcaggccggcctgagacagggcagcagactggtggagatctgcaaggtggccgtggccaccctgagccacgagcagatgatcgacctgctgagaaccagcgtgaccgtgaaggtggtgatcatccccccccacgacgactgcacccccagaagaagctgcagcgagacctacagaatgcccgtgatggagtacaagatgaacgagggcgtgagctacgagttcaagttccccttcagaaacaacaacaagtggcagagaaacgccagcaagggcccccacagcccccaggtgcccagccaggtgcagagccccatgaccagcagactgaacgccggcaagggcgacggcaagatgcccccccccgagagagccgccaacatccccagaagcatcagcagcgacggcagacccctggagagaagactgagccccggcagcgacatctacgtgaccgtgagcagcatggccctggccagaagccagtgcagaaacagccccagcaacctgagcagcagcagcgacaccggcagcgtgggcggcacctacagacagaagagcatgcccgagggcttcggcgtgagcagaagaagccccgccagcatcgacagacagaacacccagagcgacatcggcggcagcggcaagagcacccccagctggcagagaagcgaggacagcatcgccgaccagatggagcccacctgccacctgcccgccgtgagcaaggtgctgcccgccttcagagagagccccagcggcagactgatgagacaggaccccgtggtgcacctgagccccaacaagcagggccacagcgacagccactacagcagccacagcagcagcaacaccctgagcagcaacgccagcagcgcccacagcgacgagaagtggtacgacggcgacagaaccgagagcgagctgaacagctacaactacctgcagggcaccagcgccgacagcggcatcgacaccaccagctacggccccagccacggcagcaccgccagcctgggcgccgccaccagcagccccagaagcggccccggcaaggagaaggtggcccccctgtggcacagcagcagcgaggtgatcagcatggccgacagaaccctggagaccgagagccacggcctggacagaaagaccgagagcagcctgagcctggacatccacagcaagagccaggccggcagcacccccctgaccagagagaacagcaccttcagcatcaacgacgccgccagccacaccagcaccatgagcagcagacacagcgccagccccgtggtgttcaccagcgccagaagcagccccaaggaggagctgcaccccgccgcccccagccagctggcccccagcttcagcagcagcagcagcagcagcagcggccccagaagcttctaccccagacagggcgccaccagcaagtacctgatcggctggaagaagcccgagggcaccatcaacagcgtgggcttcatggacaccagaaagagacaccagagcgacggcaacgagatcgcccacaccagactgagagccagcaccagagacctgagagccagccccaagcccaccagcaagagcaccatcgaggaggacctgaagaagctgatcgacctggagagccccacccccgagagccagaagagcttcaagttccacgccctgagcagcccccagagccccttccccagcacccccaccagcagaagagccctgcacagaaccctgagcgacgagagcatctacaacagccagagagagcacttcttcaccagcagagccagcctgctggaccaggccctgcccaacgacgtgctgttcagcagcacctaccccagcctgcccaagagcctgcccctgagaagacccagctacaccctgggcatgaagagcctgcacggcgagttcagcgccagcgacagcagcctgaccgacatccaggagaccagaagacagcccatgcccgaccccggcctgatgcccctgcccgacaccgccgccgacctggactggagcaacctggtggacgccgccaaggcctacgaggtgcagagagccagcttcttcgccgccagcgacgagaaccacagacccctgagcgccgccagcaacagcgaccagctggaggaccaggccctggcccagatgaagccctacagcagcaaggacagcagccccaccctggccagcaaggtggaccagctggagggcatgctgaagatgctgagagaggacctgaagaaggagaaggaggacaaggcccacctgcaggccgaggtgcagcacctgagagaggacaacctgagactgcaggaggagagccagaacgccagcgacaagctgaagaagttcaccgagtgggtgttcaacaccatcgacatgagctag

SEQ ID NO: 22061 - DNA, 5415 bp, Artificial Sequence
  Description of Artificial Sequence: Synthetic coding sequence
atgaccagcctgaagagaagccagaccgagagacccctggccaccgacagagccagcgtggtgggcaccgacggcacccccaaggtgcacaccgacgacttctacatgagaagattcagaagccagaacggcagcctgggcagcagcgtgatggcccccgtgggcccccccagaagcgagggcagccaccacatcaccagcacccccggcgtgcccaagatgggcgtgagagccagaatcgccgactggccccccagaaaggagaacatcaaggagagcagcagaagcagccaggagatcgagaccagcagctgcctggacagcctgagcagcaagagcagccccgtgagccagggcagcagcgtgagcctgaacagcaacgacagcgccatgctgaagagcatccagaacaccctgaagaacaagaccagacccagcgagaacatggacagcagattcctgatgcccgaggcctaccccagcagccccagaaaggccctgagaagaatcagacagagaagcaacagcgacatcaccatcagcgagctggacgtggacagcttcgacgagtgcatcagccccacctacaagaccggccccagcctgcacagagagtacggcagcaccagcagcatcgacaagcagggcaccagcggcgagagcttcttcgacctgctgaagggctacaaggacgacaagagcgacagaggccccacccccaccaagctgagcgacttcctgatcaccggcggcggcaagggcagcggcttcagcctggacgtgatcgacggccccatcagccagagagagaacctgagactgttcaaggagagagagaagcccctgaagagaagaagcaagagcgagaccggcgacagcagcatcttcagaaagctgagaaacgccaagggcgaggagctgggcaagagcagcgacctggaggacaacagaagcgaggacagcgtgagaccctggacctgccccaagtgcttcgcccactacgacgtgcagagcatcctgttcgacctgaacgaggccatcatgaacagacacaacgtgatcaagagaagaaacaccaccaccggcgccagcgccgccgccgtggccagcctggtgagcggccccctgagccacagcgccagcttcagcagccccatgggcagcaccgaggacctgaacagcaagggcagcctgagcatggaccagggcgacgacaagagcaacgagctggtgatgagctgcccctacttcagaaacgagatcggcggcgagggcgagagaaagatcagcctgagcaagagcaacagcggcagcttcagcggctgcgagagcgccagcttcgagagcaccctgagcagccactgcaccaacgccggcgtggccgtgctggaggtgcccaaggagaacctggtgctgcacctggacagagtgaagagatacatcgtggagcacgtggacctgggcgcctactactacagaaagttcttctaccagaaggagcactggaactacttcggcgccgacgagaacctgggccccgtggccgtgagcatcagaagagagaagcccgacgagatgaaggagaacggcagcccctacaactacagaatcatcttcagaaccagcgagctgatgaccctgagaggcagcgtgctggaggacgccatccccagcaccgccaagcacagcaccgccagaggcctgcccctgaaggaggtgctggagcacgtggtgcccgagctgaacgtgcagtgcctgagactggccttcaacacccccaaggtgaccgagcagctgatgaagctggacgagcagggcctgaactaccagcagaaggtgggcatcatgtactgcaaggccggccagagcaccgaggaggagatgtacaacaacgagagcgccggccccgccttcgaggagttcctgcagctgctgggcgagagagtgagactgaagggcttcgagaagtacagagcccagctggacaccaagaccgacagcaccggcacccacagcctgtacaccacctacaaggactacgagatcatgttccacgtgagcaccatgctgccctacacccccaacaacaagcagcagctgctgagaaagagacacatcggcaacgacatcgtgaccatcgtgttccaggagcccggcgcccagcccttcagccccaagaacatcagaagccacttccagcacgtgttcgtgatcgtgagagtgcacaacccctgcagcgacagcgtgtgctacagcgtggccgtgaccagaagcagagacgtgcccagcttcggcccccccatccccaagggcgtgaccttccccaagagcaacgtgttcagagacttcctgctggccaaggtgatcaacgccgagaacgccgcccacaagagcgagaagttcagagccatggccaccagaaccagacaggagtacctgaaggacctggccgagaagaacgtgaccaacacccccatcgaccccagcggcaagttccccttcatcagcctggccagcaagaagaaggagaagagcaagccctaccccggcgccgagctgagcagcatgggcgccatcgtgtgggccgtgagagccgaggactacaacaaggccatggagctggactgcctgctgggcatcagcaacgagttcatcgtgctgatcgagcaggagaccaagagcgtggtgttcaactgcagctgcagagacgtgatcggctggaccagcaccgacaccagcctgaagatcttctacgagagaggcgagtgcgtgagcgtgggcagcttcatcaacatcgaggagatcaaggagatcgtgaagagactgcagttcgtgagcaagggctgcgagagcgtggagatgaccctgagaagaaacggcctgggccagctgggcttccacgtgaactacgagggcatcgtggccgacgtggagccctacggctacgcctggcaggccggcctgagacagggcagcagactggtggagatctgcaaggtggccgtggccaccctgagccacgagcagatgatcgacctgctgagaaccagcgtgaccgtgaaggtggtgatcatccccccccacgacgactgcacccccagaagaagctgcagcgagacctacagaatgcccgtgatggagtacaagatgaacgagggcgtgagctacgagttcaagttccccttcagaaacaacaacaagtggcagagaaacgccagcaagggcccccacagcccccaggtgcccagccaggtgcagagccccatgaccagcagactgaacgccggcaagggcgacggcaagatgcccccccccgagagagccgccaacatccccagaagcatcagcagcgacggcagacccctggagagaagactgagccccggcagcgacatctacgtgaccgtgagcagcatggccctggccagaagccagtgcagaaacagccccagcaacctgagcagcagcagcgacaccggcagcgtgggcggcacctacagacagaagagcatgcccgagggcttcggcgtgagcagaagaagccccgccagcatcgacagacagaacacccagagcgacatcggcggcagcggcaagagcacccccagctggcagagaagcgaggacagcatcgccgaccagatggcctacagctacagaggcccccaggacttcaacagcttcgtgctggagcagcacgagtacaccgagcccacctgccacctgcccgccgtgagcaaggtgctgcccgccttcagagagagccccagcggcagactgatgagacaggaccccgtggtgcacctgagccccaacaagcagggccacagcgacagccactacagcagccacagcagcagcaacaccctgagcagcaacgccagcagcgcccacagcgacgagaagtggtacgacggcgacagaaccgagagcgagctgaacagctacaactacctgcagggcaccagcgccgacagcggcatcgacaccaccagctacggccccagccacggcagcaccgccagcctgggcgccgccaccagcagccccagaagcggccccggcaaggagaaggtggcccccctgtggcacagcagcagcgaggtgatcagcatggccgacagaaccctggagaccgagagccacggcctggacagaaagaccgagagcagcctgagcctggacatccacagcaagagccaggccggcagcacccccctgaccagagagaacagcaccttcagcatcaacgacgccgccagccacaccagcaccatgagcagcagacacagcgccagccccgtggtgttcaccagcgccagaagcagccccaaggaggagctgcaccccgccgcccccagccagctggcccccagcttcagcagcagcagcagcagcagcagcggccccagaagcttctaccccagacagggcgccaccagcaagtacctgatcggctggaagaagcccgagggcaccatcaacagcgtgggcttcatggacaccagaaagagacaccagagcgacggcaacgagatcgcccacaccagactgagagccagcaccagagacctgagagccagccccaagcccaccagcaagagcaccatcgaggaggacctgaagaagctgatcgacctggagagccccacccccgagagccagaagagcttcaagttccacgccctgagcagcccccagagccccttccccagcacccccaccagcagaagagccctgcacagaaccctgagcgacgagagcatctacaacagccagagagagcacttcttcaccagcagagccagcctgctggaccaggccctgcccaacgacgtgctgttcagcagcacctaccccagcctgcccaagagcctgcccctgagaagacccagctacaccctgggcatgaagagcctgcacggcgagttcagcgccagcgacagcagcctgaccgacatccaggagaccagaagacagcccatgcccgaccccggcctgatgcccctgcccgacaccgccgccgacctggactggagcaacctggtggacgccgccaaggcctacgaggtgcagagagccagcttcttcgccgccagcgacgagaaccacagacccctgagcgccgccagcaacagcgaccagctggaggaccaggccctggcccagatgaagccctacagcagcagcaaggacagcagccccaccctggccagcaaggtggaccagctggagggcatgctgaagatgctgagagaggacctgaagaaggagaaggaggacaaggcccacctgcaggccgaggtgcagcacctgagagaggacaacctgagactgcaggaggagagccagaacgccagcgacaagctgaagaagttcaccgagtgggtgttcaacaccatcgacatgagctag

SEQ ID NO: 22062 - DNA, 591 bp, Artificial Sequence
  Description of Artificial Sequence: Synthetic coding sequence
atgaaccaggccgaccccagactgagagccgtgtgcctgtggaccctgaccagcgccgccatgagcagaggcgacaactgcaccgacctgctggccctgggcatccccagcatcacccaggcctggggcctgtgggtgctgctgggcgccgtgaccctgctgttcctgatcagcctggccgcccacctgagccagtggaccagaggcagaagcagaagccaccccggccagggcagaagcggcgagagcgtggaggaggtgcccctgtacggcaacctgcactacctgcagaccggcagactgagccaggaccccgagcccgaccagcaggaccccaccctgggcggccccgccagagccgccgaggaggtgatgtgctacaccagcctgcagctgagacccccccagggcagaatccccggccccggcacccccgtgaagtacagcgaggtggtgctggacagcgagcccaagagccaggccagcggccccgagcccgagctgtacgccagcgtgtgcgcccagaccagaagagccagagccagcttccccgaccaggcctacgccaacagccagcccgccgccagctag

SEQ ID NO: 22063 - DNA, 1515 bp, Artificial Sequence
  Description of Artificial Sequence: Synthetic coding sequence
atggagcccgccggccccgcccccggcagactgggccccctgctgtgcctgctgctggccgccagctgcgcctggagcggcgtggccggcgaggaggagctgcaggtgatccagcccgacaagagcgtgctggtggccgccggcgagaccgccaccctgagatgcaccgccaccagcctgatccccgtgggccccatccagtggttcagaggcgccggccccggcagagagctgatctacaaccagaaggagggccacttccccagagtgaccaccgtgagcgacctgaccaagagaaacaacatggacttcagcatcagaatcggcaacatcacccccgccgacgccggcacctactactgcgtgaagttcagaaagggcagccccgacgacgtggagttcaagagcggcgccggcaccgagctgagcgtgagagccaagcccagcgcccccgtggtgagcggccccgccgccagagccaccccccagcacaccgtgagcttcacctgcgagagccacggcttcagccccagagacatcaccctgaagtggttcaagaacggcaacgagctgagcgacttccagaccaacgtggaccccgtgggcgagagcgtgagctacagcatccacagcaccgccaaggtggtgctgaccagagaggacgtgcacagccaggtgatctgcgaggtggcccacgtgaccctgcagggcgaccccctgagaggcaccgccaacctgagcgagaccatcagagtgccccccaccctggaggtgacccagcagcccgtgagagccgagaaccaggtgaacgtgacctgccaggtgagaaagttctacccccagagactgcagctgacctggctggagaacggcaacgtgagcagaaccgagaccgccagcaccgtgaccgagaacaaggacggcacctacaactggatgagctggctgctggtgaacgtgagcgcccacagagacgacgtgaagctgacctgccaggtggagcacgacggccagcccgccgtgagcaagagccacgacctgaaggtgagcgcccaccccaaggagcagggcagcaacaccgccgccgagaacaccggcagcaacgagagaaacatctacatcgtggtgggcgtggtgtgcaccctgctggtggccctgctgatggccgccctgtacctggtgagaatcagacagaagaaggcccagggcagcaccagcagcaccagactgcacgagcccgagaagaacgccagagagatcacccaggacaccaacgacatcacctacgccgacctgaacctgcccaagggcaagaagcccgccccccaggccgccgagcccaacaaccacaccgagtacgccagcatccagaccagcccccagcccgccagcgaggacaccctgacctacgccgacctggacatggtgcacctgaacagaacccccaagcagcccgcccccaagcccgagcccagcttcagcgagtacgccagcgtgcaggtgcccagaaagtag

SEQ ID NO: 22064 - DNA, 1515 bp, Artificial Sequence; identical to SEQ ID NO: 22063
  Description of Artificial Sequence: Synthetic coding sequence

SEQ ID NO: 22065 - DNA, 1527 bp, Artificial Sequence
  Description of Artificial Sequence: Synthetic coding sequence
atggagcccgccggccccgcccccggcagactgggccccctgctgtgcctgctgctggccgccagctgcgcctggagcggcgtggccggcgaggaggagctgcaggtgatccagcccgacaagagcgtgctggtggccgccggcgagaccgccaccctgagatgcaccgccaccagcctgatccccgtgggccccatccagtggttcagaggcgccggccccggcagagagctgatctacaaccagaaggagggccacttccccagagtgaccaccgtgagcgacctgaccaagagaaacaacatggacttcagcatcagaatcggcaacatcacccccgccgacgccggcacctactactgcgtgaagttcagaaagggcagccccgacgacgtggagttcaagagcggcgccggcaccgagctgagcgtgagagccaagcccagcgcccccgtggtgagcggccccgccgccagagccaccccccagcacaccgtgagcttcacctgcgagagccacggcttcagccccagagacatcaccctgaagtggttcaagaacggcaacgagctgagcgacttccagaccaacgtggaccccgtgggcgagagcgtgagctacagcatccacagcaccgccaaggtggtgctgaccagagaggacgtgcacagccaggtgatctgcgaggtggcccacgtgaccctgcagggcgaccccctgagaggcaccgccaacctgagcgagaccatcagagtgccccccaccctggaggtgacccagcagcccgtgagagccgagaaccaggtgaacgtgacctgccaggtgagaaagttctacccccagagactgcagctgacctggctggagaacggcaacgtgagcagaaccgagaccgccagcaccgtgaccgagaacaaggacggcacctacaactggatgagctggctgctggtgaacgtgagcgcccacagagacgacgtgaagctgacctgccaggtggagcacgacggccagcccgccgtgagcaagagccacgacctgaaggtgagcgcccaccccaaggagcagggcagcaacaccgccgccgagaacaccggcagcaacgagagaaacatctacatcgtggtgggcgtggtgtgcaccctgctggtggccctgctgatggccgccctgtacctggtgagaatcagacagaagaaggcccagggcagcaccagcagcaccagactgcacgagcccgagaagaacgccagagagatcacccaggtgcagagcctggacaccaacgacatcacctacgccgacctgaacctgcccaagggcaagaagcccgccccccaggccgccgagcccaacaaccacaccgagtacgccagcatccagaccagcccccagcccgccagcgaggacaccctgacctacgccgacctggacatggtgcacctgaacagaacccccaagcagcccgcccccaagcccgagcccagcttcagcgagtacgccagcgtgcaggtgcccagaaagtag

SEQ ID NO: 22066 - DNA, 543 bp, Artificial Sequence
  Description of Artificial Sequence: Synthetic coding sequence
atgcccgtgcccgccagctggccccaccccccctgccccttcctgctgctgaccctgctgctgggcctgaccggcgtggccggcgaggacgagctgcaggtgatccagcccgagaagagcgtgagcgtggccgccggcgagagcgccaccctgagatgcgccatgaccagcctgatccccgtgggccccatcatgtggttcagaggcgccggcgccggcagagagctgatctacaaccagaaggagggccacttccccagagtgaccaccgtgagcgagctgaccaagagaaacaacctggacttcagcatcagcatcagcaacatcacccccgccgacgccggcacctactactgcgtgaagttcagaaagggcagccccgacgacgtggagttcaagagcggcgccggcaccgagctgagcgtgagagaggccgccctggcccccaccgcccccctgctggtggccctgctgctgggccccaagctgctgctggtggtgggcgtgagcgccatctacatctgctggaagcagaaggcctag

SEQ ID NO: 22067 - DNA, 1197 bp, Artificial Sequence
  Description of Artificial Sequence: Synthetic coding sequence
atgcccgtgcccgccagctggccccacctgcccagccccttcctgctgatgaccctgctgctgggcagactgaccggcgtggccggcgaggaggagctgcaggtgatccagcccgacaagagcatcagcgtggccgccggcgagagcgccaccctgcactgcaccgtgaccagcctgatccccgtgggccccatccagtggttcagaggcgccggccccggcagagagctgatctacaaccagaaggagggccacttccccagagtgaccaccgtgagcgacctgaccaagagaaacaacatggacttcagcatcagaatcagcaacatcacccccgccgacgccggcacctactactgcgtgaagttcagaaagggcagccccgaccacgtggagttcaagagcggcgccggcaccgagctgagcgtgagagccaagcccagcgcccccgtggtgagcggccccgccgccagagccaccccccagcacaccgtgagcttcacctgcgagagccacggcttcagccccagagacatcaccctgaagtggttcaagaacggcaacgagctgagcgacttccagaccaacgtggaccccgccggcgacagcgtgagctacagcatccacagcaccgccaaggtggtgctgaccagagaggacgtgcacagccaggtgatctgcgaggtggcccacgtgaccctgcagggcgaccccctgagaggcaccgccaacctgagcgagaccatcagagtgccccccaccctggaggtgacccagcagcccgtgagagccgagaaccaggtgaacgtgacctgccaggtgagaaagttctacccccagagactgcagctgacctggctggagaacggcaacgtgagcagaaccgagaccgccagcaccctgaccgagaacaaggacggcacctacaactggatgagctggctgctggtgaacgtgagcgcccacagagacgacgtgaagctgacctgccaggtggagcacgacggccagcccgccgtgagcaagagccacgacctgaaggtgagcgcccaccccaaggagcagggcagcaacaccgcccccggccccgccctggccagcgccgcccccctgctgatcgccttcctgctgggccccaaggtgctgctggtggtgggcgtgagcgtgatctacgtgtactggaagcagaaggcctag

SEQ ID NO: 22068 - DNA, 519 bp, Artificial Sequence
  Description of Artificial Sequence: Synthetic coding sequence
atgcccgtgcccgccagctggccccacctgcccagccccttcctgctgatgaccctgctgctgggcagactgaccggcgtggccggcgaggaggagctgcaggtgatccagcccgacaagagcatcagcgtggccgccggcgagagcgccaccctgcactgcaccgtgaccagcctgatccccgtgggccccatccagtggttcagaggcgccggccccggcagagagctgatctacaaccagaaggagggccacttccccagagtgaccaccgtgagcgacctgaccaagagaaacaacatggacttcagcatcagaatcagcaacatcacccccgccgacgccggcacctactactgcgtgaagttcagaaagggcagccccgaccacgtggagttcaagagcggcgccggcaccgagctgagcgtgagagtgctgcaggtgaaggagatcaagatccccagaaccctggccagcgtggtgatccaggtgtacctgctgcagcaccccgtggcctag

SEQ ID NO: 22069 - DNA, 546 bp, Artificial Sequence
  Description of Artificial Sequence: Synthetic coding sequence
atgcccgtgcccgccagctggccccacctgcccagccccttcctgctgatgaccctgctgctgggcagactgaccggcgtggccggcgaggacgagctgcaggtgatccagcccgagaagagcgtgagcgtggccgccggcgagagcgccaccctgagatgcgccatgaccagcctgatccccgtgggccccatcatgtggttcagaggcgccggcgccggcagagagctgatctacaaccagaaggagggccacttccccagagtgaccaccgtgagcgagctgaccaagagaaacaacctggacttcagcatcagcatcagcaacatcacccccgccgacgccggcacctactactgcgtgaagttcagaaagggcagccccgacgacgtggagttcaagagcggcgccggcaccgagctgagcgtgagagaggccgccctggcccccaccgcccccctgctggtggccctgctgctgggccccaagctgctgctggtggtgggcgtgagcgccatctacatctgctggaagcagaaggcctag

SEQ ID NO: 22070 - DNA, 1197 bp, Artificial Sequence
  Description of Artificial Sequence: Synthetic coding sequence
atgcccgtgcccgccagctggccccacctgcccagccccttcctgctgatgaccctgctgctgggcagactgaccggcgtggccggcgaggacgagctgcaggtgatccagcccgagaagagcgtgagcgtggccgccggcgagagcgccaccctgagatgcgccatgaccagcctgatccccgtgggccccatcatgtggttcagaggcgccggcgccggcagagagctgatctacaaccagaaggagggccacttccccagagtgaccaccgtgagcgagctgaccaagagaaacaacctggacttcagcatcagcatcagcaacatcacccccgccgacgccggcacctactactgcgtgaagttcagaaagggcagccccgacgacgtggagttcaagagcggcgccggcaccgagctgagcgtgagagccaagcccagcgcccccgtggtgagcggccccgccgtgagagccacccccgagcacaccgtgagcttcacctgcgagagccacggcttcagccccagagacatcaccctgaagtggttcaagaacggcaacgagctgagcgacttccagaccaacgtggaccccgccggcgacagcgtgagctacagcatccacagcaccgccagagtggtgctgaccagaggcgacgtgcacagccaggtgatctgcgagatcgcccacatcaccctgcagggcgaccccctgagaggcaccgccaacctgagcgaggccatcagagtgccccccaccctggaggtgacccagcagcccatgagagccgagaaccaggccaacgtgacctgccaggtgagcaacttctaccccagaggcctgcagctgacctggctggagaacggcaacgtgagcagaaccgagaccgccagcaccctgatcgagaacaaggacggcacctacaactggatgagctggctgctggtgaacacctgcgcccacagagacgacgtggtgctgacctgccaggtggagcacgacggccagcaggccgtgagcaagagctacgccctggagatcagcgcccaccagaaggagcacggcagcgacatcacccacgaggccgccctggcccccaccgcccccctgctggtggccctgctgctgggccccaagctgctgctggtggtgggcgtgagcgccatctacatctgctggaagcagaaggcctag

SEQ ID NO: 22071 - DNA, 519 bp, Artificial Sequence
  Description of Artificial Sequence: Synthetic coding sequence
atgctggccgccggcgtgggcggccagggcgagagactggccggcagaagaagaaagatggccgtggagagcagagtgacccaggaggagatcaagaaggagcccgagaagcccatcgacagagagaagacctgccccctgctgctgagagtgttcaccaccaacaacggcagacaccacagaatggacgagttcagcagaggcaacgtgcccagcagcgagctgcagatctacacctggatggacgccaccctgaaggagctgaccagcctggtgaaggaggtgtaccccgaggccagaaagaagggcacccacttcaacttcgccatcgtgttcaccgacgtgaagagacccggctacagagtgaaggagatcggcagcaccatgagcggcagaaagggcaccgacgacagcatgaccctgcagagccagaagttccagatcggcgactacctggacatcgccatcaccccccccaacagagcccccccccccagcggcagaatgagaccctactag

SEQ ID NO: 22072 - DNA, 1020 bp, Artificial Sequence
  Description of Artificial Sequence: Synthetic coding sequence
atggagagcagaaaggacatcaccaaccaggaggagctgtggaagatgaagcccagaagaaacctggaggaggacgactacctgcacaaggacaccggcgagaccagcatgctgaagagacccgtgctgctgcacctgcaccagaccgcccacgccgacgagttcgactgccccagcgagctgcagcacacccaggagctgttcccccagtggcacctgcccatcaagatcgccgccatcatcgccagcctgaccttcctgtacaccctgctgagagaggtgatccaccccctggccaccagccaccagcagtacttctacaagatccccatcctggtgatcaacaaggtgctgcccatggtgagcatcaccctgctggccctggtgtacctgcccggcgtgatcgccgccatcgtgcagctgcacaacggcaccaagtacaagaagttcccccactggctggacaagtggatgctgaccagaaagcagttcggcctgctgagcttcttcttcgccgtgctgcacgccatctacagcctgagctaccccatgagaagaagctacagatacaagctgctgaactgggcctaccagcaggtgcagcagaacaaggaggacgcctggatcgagcacgacgtgtggagaatggagatctacgtgagcctgggcatcgtgggcctggccatcctggccctgctggccgtgaccagcatccccagcgtgagcgacagcctgacctggagagagttccactacatccagagcaagctgggcatcgtgagcctgctgctgggcaccatccacgccctgatcttcgcctggaacaagtggatcgacatcaagcagttcgtgtggtacaccccccccaccttcatgatcgccgtgttcctgcccatcgtggtgctgatcttcaagagcatcctgttcctgccctgcctgagaaagaagatcctgaagatcagacacggctgggaggacgtgaccaagatcaacaagaccgagatctgcagccagctgtag

SEQ ID NO: 22073 - DNA, 597 bp, Artificial Sequence
  Description of Artificial Sequence: Synthetic coding sequence
atgtgcgccttcccctggctgctgctgctgctgctgctgcaggagggcagccagagaagactgtggagatggtgcggcagcgaggaggtggtggccgtgctgcaggagagcatcagcctgcccctggagatcccccccgacgaggaggtggagaacatcatctggagcagccacaagagcctggccaccgtggtgcccggcaaggagggccaccccgccaccatcatggtgaccaacccccactaccagggccaggtgagcttcctggaccccagctacagcctgcacatcagcaacctgagctgggaggacagcggcctgtaccaggcccaggtgaacctgagaaccagccagatcagcaccatgcagcagtacaacatctgcgtgtaccaccccaactacgccagcgagaagcccagcaccgccttctgcctgctggccaagggcctgctgatcttcctgctgctggtgatcctggccatgggcctgtgggtgatcagagtgcagaagagacacaagatgcccagaatgaagaagctgatgagaaacagaatgaagctgagaaaggaggccaagcccggcagcagccccgcctag

SEQ ID NO: 22074 - DNA, 870 bp, Artificial Sequence
  Description of Artificial Sequence: Synthetic coding sequence
atgtgcgccttcccctggctgctgctgctgctgctgctgcaggagggcagccagagaagactgtggagatggtgcggcagcgaggaggtggtggccgtgctgcaggagagcatcagcctgcccctggagatcccccccgacgaggaggtggagaacatcatctggagcagccacaagagcctggccaccgtggtgcccggcaaggagggccaccccgccaccatcatggtgaccaacccccactaccagggccaggtgagcttcctggaccccagctacagcctgcacatcagcaacctgagctgggaggacagcggcctgtaccaggcccaggtgaacctgagaaccagccagatcagcaccatgcagcagtacaacatctgcgtgtacagatggctgagcgagccccagatcaccgtgaacttcgagagcagcggcgagggcgcctgcagcatgagcctggtgtgcagcgtggagaaggccggcatggacatgacctacagctggctgagcagaggcgacagcacctacaccttccacgagggccccgtgctgagcaccagctggagacccggcgacagcgccctgagctacacctgcagagccaacaaccccatcagcaacgtgagcagctgccccatccccgacggccccttctacgccgaccccaactacgccagcgagaagcccagcaccgccttctgcctgctggccaagggcctgctgatcttcctgctgctggtgatcctggccatgggcctgtgggtgatcagagtgcagaagagacacaagatgcccagaatgaagaagctgatgagaaacagaatgaagctgagaaaggaggccaagcccggcagcagccccgcctag

SEQ ID NO: 22075 - DNA, 519 bp, Artificial Sequence
  Description of Artificial Sequence: Synthetic coding sequence
atgaagatctggagcagcgagcacgtgttcggccacccctgggacaccgtgatccaggccgccatgagaaagtaccccaaccccatgaaccccagcgtgctgggcgtggacgtgctgcagagaagagtggacggcagaggcagactgcacagcctgagactgctgagcaccgagtggggcctgcccagcctggtgagagccatcctgggcaccagcagaaccctgacctacatcagagagcacagcgtggtggaccccgtggagaagaagatggagctgtgcagcaccaacatcaccctgaccaacctggtgagcgtgaacgagagactggtgtacaccccccaccccgagaaccccgagatgaccgtgctgacccaggaggccatcatcaccgtgaagggcatcagcctgggcagctacctggagagcctgatggccaacaccatcagcagcaacgccaagaagggctgggccgccatcgagtggatcatcgagcacagcgagagcgccgtgagctag

SEQ ID NO: 22076 - DNA, 519 bp, Artificial Sequence; identical to SEQ ID NO: 22075
  Description of Artificial Sequence: Synthetic coding sequence

SEQ ID NO: 22077 - DNA, 585 bp, Artificial Sequence
  Description of Artificial Sequence: Synthetic coding sequence
atgaagatctggaccagcgagcacgtgttcgaccacccctgggagaccgtgaccaccgccgccatgcagaagtaccccaaccccatgaaccccagcgtggtgggcgtggacgtgctggacagacacatcgaccccagcggcaagctgcacagccacagactgctgagcaccgagtggggcctgcccagcatcgtgaagagcctgatcggcgccgccagaaccaagacctacgtgcaggagcacagcgtggtggaccccgtggagaagaccatggagctgaagagcaccaacatcagcttcaccaacatggtgagcgtggacgagagactgatctacaagccccacccccaggaccccgagaagaccgtgctgacccaggaggccatcatcaccgtgaagggcgtgagcctgagcagctacctggagggcctgatggccagcaccatcagcagcaacgccagcaagggcagagaggccatggagtgggtgatccacaagctgaacgccgagatcgaggagctgaccgccagcgccagaggcaccatcagaacccccatggccgccgccgccttcgccgagaagtag

SEQ ID NO: 22078 - DNA, 2247 bp, Artificial Sequence
  Description of Artificial Sequence: Synthetic coding sequence
atgagcaaccccggcggcagaagaaacggccccgtgaagctgagactgaccgtgctgtgcgccaagaacctggtgaagaaggacttcttcagactgcccgaccccttcgccaaggtggtggtggacggcagcggccagtgccacagcaccgacaccgtgaagaacaccctggaccccaagtggaaccagcactacgacctgtacatcggcaagagcgacagcgtgaccatcagcgtgtggaaccacaagaagatccacaagaagcagggcgccggcttcctgggctgcgtgagactgctgagcaacgccatcaacagactgaaggacaccggctaccagagactggacctgtgcaagctgggccccaacgacaacgacaccgtgagaggccagatcgtggtgagcctgcagagcagagacagaatcggcaccggcggccaggtggtggactgcagcagactgttcgacaacgacctgcccgacggctgggaggagagaagaaccgccagcggcagaatccagtacctgaaccacatcaccagaaccacccagtgggagagacccaccagacccgccagcgagtacagcagccccggcagacccctgagctgcttcgtggacgagaacacccccatcagcggcaccaacggcgccacctgcggccagagcagcgaccccagactggccgagagaagagtgagaagccagagacacagaaactacatgagcagaacccacctgcacaccccccccgacctgcccgagggctacgagcagagaaccacccagcagggccaggtgtacttcctgcacacccagaccggcgtgagcacctggcacgaccccagagtgcccagagacctgagcaacatcaactgcgaggagctgggccccctgccccccggctgggagatcagaaacaccgccaccggcagagtgtacttcgtggaccacaacaacagaaccacccagttcaccgaccccagactgagcgccaacctgcacctggtgctgaacagacagaaccagctgaaggaccagcagcagcagcaggtggtgagcctgtgccccgacgacaccgagtgcctgaccgtgcccagatacaagagagacctggtgcagaagctgaagatcctgagacaggagctgagccagcagcagccccaggccggccactgcagaatcgaggtgagcagagaggagatcttcgaggagagctacagacaggtgatgaagatgagacccaaggacctgtggaagagactgatgatcaagttcagaggcgaggagggcctggactacggcggcgtggccagagagtggctgtacctgctgagccacgagatgctgaacccctactacggcctgttccagtacagcagagacgacatctacaccctgcagatcaaccccgacagcgccgtgaaccccgagcacctgagctacttccacttcgtgggcagaatcatgggcatggccgtgttccacggccactacatcgacggcggcttcaccctgcccttctacaagcagctgctgggcaagagcatcaccctggacgacatggagctggtggaccccgacctgcacaacagcctggtgtggatcctggagaacgacatcaccggcgtgctggaccacaccttctgcgtggagcacaacgcctacggcgagatcatccagcacgagctgaagcccaacggcaagagcatccccgtgaacgaggagaacaagaaggagtacgtgagactgtacgtgaactggagattcctgagaggcatcgaggcccagttcctggccctgcagaagggcttcaacgaggtgatcccccagcacctgctgaagaccttcgacgagaaggagctggagctgatcatctgcggcctgggcaagatcgacgtgaacgactggaaggtgaacaccagactgaagcactgcacccccgacagcaacatcgtgaagtggttctggaaggccgtggagttcttcgacgaggagagaagagccagactgctgcagttcgtgaccggcagcagcagagtgcccctgcagggcttcaaggccctgcagggcgccgccggccccagactgttcaccatccaccagatcgacgcctgcaccaacaacctgcccaaggcccacacctgcttcaacagaatcgacatccccccctacgagagctacgagaagctgtacgagaagctgctgaccgccatcgaggagacctgcggcttcgccgtggagtag

SEQ ID NO: 22079 - DNA, 294 bp, Artificial Sequence
  Description of Artificial Sequence: Synthetic coding sequence
atgaccagcctgctgaccacccccagccccagagaggagctgatgaccacccccatcctgcagcccaccgaggccctgagccccgaggacggcgccagcaccgccctgatcgccgtggtgatcaccgtggtgttcctgaccctgctgagcgtggtgatcctgatcttcttctacctgtacaagaacaagggcagctacgtgacctacgagcccaccgagggcgagcccagcgccatcgtgcagatggagagcgacctggccaagggcagcgagaaggaggagtacttcatctag

SEQ ID NO: 22080 - DNA, 294 bp, Artificial Sequence; identical to SEQ ID NO: 22079
  Description of Artificial Sequence: Synthetic coding sequence

SEQ ID NO: 22081 - DNA, 3282 bp, Artificial Sequence
  Description of Artificial Sequence: Synthetic coding sequence
atggccagcgcccccgccgaggccgagaccagacagagactgctgagaaccgtgaagaaggaggtgaagcagatcatggaggaggccgtgaccagaaagttcgtgcacgaggacagcagccacatcatcagcttctgcgccgccgtggaggcctgcgtgctgcacggcctgagaagaagagccgccggcttcctgagaagcaacaagatcgccgccctgttcatgaaggtgggcaagaacttcccccccgccgaggacctgagcagaaaggtgcaggacctggagcagctgatcgagagcgccagaaaccagatccagggcctgcaggagaacgtgagaaagctgcccaagctgcccaacctgagccccctggccatcaagcacctgtggatcagaaccgccctgttcgagaaggtgctggacaagatcgtgcactacctggtggagaacagcagcaagtactacgagaaggaggccctgctgatggaccccgtggacggccccatcctggccagcctgctggtgggcccctgcgccctggagtacaccaagatgaagaccgccgaccacttctggaccgaccccagcgccgacgagctggtgcagagacacagaatccacagcagccacgtgagacaggacagccccaccaagagacccgccctgtgcatccagaagagacacagcagcggcagcatggacgacagacccagcctgagcgccagagactacgtggagagcctgcaccagaacagcagagccaccctgctgtacggcaagaacaacgtgctggtgcagcccagagacgacatggaggccgtgcccggctacctgagcctgcaccagaccgccgacgtgatgaccctgaagtggacccccaaccagctgatgaacggcagcgtgggcgacctggactacgagaagagcgtgtactgggactacgccatgaccatcagactggaggagatcgtgtacctgcactgccaccagcaggtggacagcggcggcaccgtggtgctggtgagccaggacggcatccagagaccccccttcagattccccaagggcggccacctgctgcagttcctgagctgcctggagaacggcctgctgccccacggccagctggacccccccctgtggagccagagaggcaagggcaaggtgttccccaagctgagaaagagaagcccccagggcagcgccgagagcaccagcagcgacaaggacgacgacgaggccaccgactacgtgttcagaatcatctaccccggcatgcagagcgagttcgtgccccaggacctgatggacgtgagcgtgagcaacctgcccagcctgtggcagcccagccccagaaagagcagctgcagcagctgcagccagagcggcagcgccgacggcagcagcaccaacggctgcaaccacgagagagcccccctgaagctgctgtgcgacaacatgaagtaccagatcctgagcagagccttctacggctggctggcctactgcagacacctgagcaccgtgagaacccacctgagcgccctggtgaaccacatgatcgtgagccccgacctgccctgcgacgccggccagggcctgaccgccagaatctgggagcagtacctgcacgacagcaccagctacgaggagcaggagctgctgagactgatctactacggcggcatccagcccgagatcagaaaggccgtgtggcccttcctgctgggccactaccagttcggcatgaccgagaccgagagaaaggaggtggacgagcagatccacgcctgctacgcccagaccatggccgagtggctgggctgcgaggccatcgtgagacagagagagagagagagccacgccgccgccctggccaagtgcagcagcggcgccagcctggacagccacctgcacagaatgctgcacagagacagcaccatcagcaacgagagcagccagagctgcagcagcggcagacagaacatcagactgcacagcgacagcagcagcagcacccaggtgttcgagagcgtggacgaggtggagcaggtggaggccgagggcagactggaggagaagcagcccaagatccccaacggcaacctggtgaacggcacctgcagccccgacagcggccaccccagcagccacaacttcagcagcggcctgagcgagcacagcgagcccagcctgagcaccgaggacagcgtgctggacgcccagagaaacacccccaccgtgctgagacccagagacggcagcgtggacgacagacagagcagcgaggccaccaccagccaggacgaggcccccagagaggagctggccgtgcaggacagcctggagagcgacctgctggccaacgagagcatggacgagttcatgagcatcaccggcagcctggacatggccctgcccgagaaggacgacgtggtgatggagggctggagaagcagcgagaccgagaagcacggccaggccgacagcgaggacaacctgagcgaggagcccgagatggagagcctgttccccgccctggccagcctggccgtgaccaccagcgccaacgaggtgagccccgtgagcagcagcggcgtgacctacagccccgagctgctggacctgtacaccgtgaacctgcacagaatcgagaaggacgtgcagagatgcgacagaaactactggtacttcacccccgccaacctggagaagctgagaaacatcatgtgcagctacatctggcagcacatcgagatcggctacgtgcagggcatgtgcgacctgctggcccccctgctggtgatcctggacgacgaggccctggccttcagctgcttcaccgagctgatgaagagaatgaaccagaacttcccccacggcggcgccatggacacccacttcgccaacatgagaagcctgatccagatcctggacagcgagctgttcgagctgatgcaccagaacggcgactacacccacttctacttctgctacagatggttcctgctggacttcaagagagagctggtgtacgacgacgtgttcctggtgtgggagaccatctgggccgccaagcacgtgagcagcgcccactacgtgctgttcatcgccctggccctggtggaggtgtacagagacatcatcctggagaacaacatggacttcaccgacatcatcaagttcttcaacgagatggccgagagacacaacaccaagcaggtgctgaagctggccagagacctggtgtacaaggtgcagaccctgatcgagaacaagtag

SEQ ID NO: 22082 - DNA, 3447 bp, Artificial Sequence
  Description of Artificial Sequence: Synthetic coding sequence
atggccagcgcccccgccgaggccgagaccagacagagactgctgagaaccgtgaagaaggaggtgaagcagatcatggaggaggccgtgaccagaaagttcgtgcacgaggacagcagccacatcatcagcttctgcgccgccgtggaggcctgcgtgctgcacggcctgagaagaagagccgccggcttcctgagaagcaacaagatcgccgccctgttcatgaaggtgggcaagaacttcccccccgccgaggacctgagcagaaaggtgcaggacctggagcagctgatcgagagcgccagaaaccagatccagggcctgcaggagaacgtgagaaagctgcccaagctgcccaacctgagccccctggccatcaagcacctgtggatcagaaccgccctgttcgagaaggtgctggacaagatcgtgcactacctggtggagaacagcagcaagtactacgagaaggaggccctgctgatggaccccgtggacggccccatcctggccagcctgctggtgggcccctgcgccctggagtacaccaagatgaagaccgccgaccacttctggaccgaccccagcgccgacgagctggtgcagagacacagaatccacagcagccacgtgagacaggacagccccaccaagagacccgccctgtgcatccagaagagacacagcagcggcagcatggacgacagacccagcctgagcgccagagactacgtggagagcctgcaccagaacagcagagccaccctgctgtacggcaagaacaacgtgctggtgcagcccagagacgacatggaggccgtgcccggctacctgagcctgcaccagaccgccgacgtgatgaccctgaagtggacccccaaccagctgatgaacggcagcgtgggcgacctggactacgagaagagcgtgtactgggactacgccatgaccatcagactggaggagatcgtgtacctgcactgccaccagcaggtggacagcggcggcaccgtggtgctggtgagccaggacggcatccagagaccccccttcagattccccaagggcggccacctgctgcagttcctgagctgcctggagaacggcctgctgccccacggccagctggacccccccctgtggagccagagaggcaagggcaaggtgttccccaagctgagaaagagaagcccccagggcagcgccgagagcaccagcagcgacaaggacgacgacgaggccaccgactacgtgttcagaatcatctaccccggcatgcagagcgagttcgtggcccccgacttcctgggcagcaccagcagcgtgagcgtgggccccgcctggatgatggtgcccgccggcagaagcatgctggtggtggccagaggcagccagtgggagcccgccagatgggacaccaccctgcccacccccagccccaaggagcagccccccatgccccaggacctgatggacgtgagcgtgagcaacctgcccagcctgtggcagcccagccccagaaagagcagctgcagcagctgcagccagagcggcagcgccgacggcagcagcaccaacggctgcaaccacgagagagcccccctgaagctgctgtgcgacaacatgaagtaccagatcctgagcagagccttctacggctggctggcctactgcagacacctgagcaccgtgagaacccacctgagcgccctggtgaaccacatgatcgtgagccccgacctgccctgcgacgccggccagggcctgaccgccagaatctgggagcagtacctgcacgacagcaccagctacgaggagcaggagctgctgagactgatctactacggcggcatccagcccgagatcagaaaggccgtgtggcccttcctgctgggccactaccagttcggcatgaccgagaccgagagaaaggaggtggacgagcagatccacgcctgctacgcccagaccatggccgagtggctgggctgcgaggccatcgtgagacagagagagagagagagccacgccgccgccctggccaagtgcagcagcggcgccagcctggacagccacctgcacagaatgctgcacagagacagcaccatcagcaacgagagcagccagagctgcagcagcggcagacagaacatcagactgcacagcgacagcagcagcagcacccaggtgttcgagagcgtggacgaggtggagcaggtggaggccgagggcagactggaggagaagcagcccaagatccccaacggcaacctggtgaacggcacctgcagccccgacagcggccaccccagcagccacaacttcagcagcggcctgagcgagcacagcgagcccagcctgagcaccgaggacagcgtgctggacgcccagagaaacacccccaccgtgctgagacccagagacggcagcgtggacgacagacagagcagcgaggccaccaccagccaggacgaggcccccagagaggagctggccgtgcaggacagcctggagagcgacctgctggccaacgagagcatggacgagttcatgagcatcaccggcagcctggacatggccctgcccgagaaggacgacgtggtgatggagggctggagaagcagcgagaccgagaagcacggccaggccgacagcgaggacaacctgagcgaggagcccgagatggagagcctgttccccgccctggccagcctggccgtgaccaccagcgccaacgaggtgagccccgtgagcagcagcggcgtgacctacagccccgagctgctggacctgtacaccgtgaacctgcacagaatcgagaaggacgtgcagagatgcgacagaaactactggtacttcacccccgccaacctggagaagctgagaaacatcatgtgcagctacatctggcagcacatcgagatcggctacgtgcagggcatgtgcgacctgctggcccccctgctggtgatcctggacgacgaggccctggccttcagctgcttcaccgagctgatgaagagaatgaaccagaacttcccccacggcggcgccatggacacccacttcgccaacatgagaagcctgatccagatcctggacagcgagctgttcgagctgatgcaccagaacggcgactacacccacttctacttctgctacagatggttcctgctggacttcaagagagagctggtgtacgacgacgtgttcctggtgtgggagaccatctgggccgccaagcacgtgagcagcgcccactacgtgctgttcatcgccctggccctggtggaggtgtacagagacatcatcctggagaacaacatggacttcaccgacatcatcaagttcttcaacgagatggccgagagacacaacaccaagcaggtgctgaagctggccagagacctggtgtacaaggtgcagaccctgatcgagaacaagtag

SEQ ID NO: 22083 - DNA, 3447 bp, Artificial Sequence
  Description of Artificial Sequence: Synthetic coding sequence
atggaggaggccgtgaccagaaagttcgtgcacgaggacagcagccacatcatcagcttctgcgccgccgtggaggcctgcgtgctgcacggcctgagaagaagagccgccggcttcctgagaagcaacaagatcgccgccctgttcatgaaggtgggcaagaacttcccccccgccgaggacctgagcagaaaggtgcaggacctggagcagctgatcgagagcgccagaaaccagatccagggcctgcaggagaacgtgagaaagctgcccaagctgcccaacctgagccccctggccatcaagcacctgtggatcagaaccgccctgttcgagaaggtgctggacaagatcgtgcactacctggtggagaacagcagcaagtactacgagaaggaggccctgctgatggaccccgtggacggccccatcctggccagcctgctggtgggcccctgcgccctggagtacaccaagatgaagaccgccgaccacttctggaccgaccccagcgccgacgagctggtgcagagacacagaatccacagcagccacgtgagacaggacagccccaccaagagacccgccctgtgcatccagaagagacacagcagcggcagcatggacgacagacccagcctgagcgccagagactacgtggagagcctgcaccagaacagcagagccaccctgctgtacggcaagaacaacgtgctggtgcagcccggcctgacccccggctacagaggcaagggcctgagcggcagcagactgcccatccacagcagcatctacgccctgacccacgcccacatccacccccccaacacccacagcagcatccacctgtacctgcacgcccccatcctgaccagcatccacccccccatcgtgatcagcatccacccccccatcgtgaccaccatccaccccagcacccacctgtacatccacctgagcaaccacctgtacatccaccccagcacccacctgtacatccaccccagcacccacctgtacatctaccccagcatccaccccagcatccaccccagcatctaccccagcatccacttcagcgactacgtgttcctgaaccagaccggccagacctacgtgcacagcaacagcagcaccatggccagacccgaggacgacatggaggccgtgcccggctacctgagcctgcaccagaccgccgacgtgatgaccctgaagtggacccccaaccagctgatgaacggcagcgtgggcgacctggactacgagaagagcgtgtactgggactacgccatgaccatcagactggaggagatcgtgtacctgcactgccaccagcaggtggacagcggcggcaccgtggtgctggtgagccaggacggcatccagagaccccccttcagattccccaagggcggccacctgctgcagttcctgagctgcctggagaacggcctgctgccccacggccagctggacccccccctgtggagccagagaggcaagggcaaggtgttccccaagctgagaaagagaagcccccagggcagcgccgagagcaccagcagcgacaaggacgacgacgaggccaccgactacgtgttcagaatcatctaccccggcatgcagagcgagttcgtgccccaggacctgatggacgtgagcgtgagcaacctgcccagcctgtggcagcccagccccagaaagagcagctgcagcagctgcagccagagcggcagcgccgacggcagcagcaccaacggctgcaaccacgagagagcccccctgaagctgctgtgcgacaacatgaagtaccagatcctgagcagagccttctacggctggctggcctactgcagacacctgagcaccgtgagaacccacctgagcgccctggtgaaccacatgatcgtgagccccgacctgccctgcgacgccggccagggcctgaccgccagaatctgggagcagtacctgcacgacagcaccagctacgaggagcaggagctgctgagactgatctactacggcggcatccagcccgagatcagaaaggccgtgtggcccttcctgctgggccactaccagttcggcatgaccgagaccgagagaaaggagagcagccagagctgcagcagcggcagacagaacatcagactgcacagcgacagcagcagcagcacccaggtgttcgagagcgtggacgaggtggagcaggtggaggccgagggcagactggaggagaagcagcccaagatccccaacggcaacctggtgaacggcacctgcagccccgacagcggccaccccagcagccacaacttcagcagcggcctgagcgagcacagcgagcccagcctgagcaccgaggacagcgtgctggacgcccagagaaacacccccaccgtgctgagacccagagacggcagcgtggacgacagacagagcagcgaggccaccaccagccaggacgaggcccccagagaggagctggccgtgcaggacagcctggagagcgacctgctggccaacgagagcatggacgagttcatgagcatcaccggcagcctggacatggccctgcccgagaaggacgacgtggtgatggagggctggagaagcagcgagaccgagaagcacggccaggccgacagcgaggacaacctgagcgaggagcccgagatggagagcctgttccccgccctggccagcctggccgtgaccaccagcgccaacgaggtgagccccgtgagcagcagcggcgtgacctacagccccgagctgctggacctgtacaccgtgaacctgcacagaatcgagaaggacgtgcagagatgcgacagaaactactggtacttcacccccgccaacctggagaagctgagaaacatcatgtgcagctacatctggcagcacatcgagatcggctacgtgcagggcatgtgcgacctgctggcccccctgctggtgatcctggacgacgaggccctggccttcagctgcttcaccgagctgatgaagagaatgaaccagaacttcccccacggcggcgccatggacacccacttcgccaacatgagaagcctgatccagatcctggacagcgagctgttcgagctgatgcaccagaacggcgactacacccacttctacttctgctacagatggttcctgctggacttcaagagagagctggtgtacgacgacgtgttcctggtgtgggagaccatctgggccgccaagcacgtgagcagcgcccactacgtgctgttcatcgccctggccctggtggaggtgtacagagacatcatcctggagaacaacatggacttcaccgacatcatcaagttcttcaacgagatggccgagagacacaacaccaagcaggtgctgaagctggccagagacctggtgtacaaggtgcagaccctgatcgagaacaagtag

SEQ ID NO: 22084 - DNA, 234 bp, Artificial Sequence
  Description of Artificial Sequence: Synthetic coding sequence
atgggcctgtgcttcccctgccccggcgagagcgccccccccacccccgacctggaggagaagagagccaagctggccgaggccgccgagagaagacagaaggaggccgccagcagaggcatcctggacgtgcagagcgtgcaggagaagagaaagaagaaggagaagatcgagaagcagatcgccaccagcggccccccccccgagggcggcctgagatggaccgtgagctag

SEQ ID NO: 22085 - DNA, 1365 bp, Artificial Sequence
  Description of Artificial Sequence: Synthetic coding sequence
atggccgagttcagccagaagagaggcaagagaagaagcgacgagggcctgggcagcatggtggacttcctgctggccaacgccagactggtgctgggcgtgggcggcgccgccgtgctgggcatcgccaccctggccgtgaagagattcatcgacagagccaccagccccagagacgaggacgacaccaaggccgacagctggaaggagctgagcctgctgaaggccaccccccacctgcagcccagacccccccccgccgccctgagccagcccgtgctgcccctggcccccagcagcagcgcccccgagggccccgccgagaccgaccccgaggtgaccccccagctgagcagccccgcccccctgtgcctgaccctgcaggagagactgctggccttcgagagagacagagtgaccatccccgccgcccaggtggccctggccaagcagctggccggcgacatcgccctggagctgcaggcctacttcagaagcaagttccccgagctgcccttcggcgccttcgtgcccggcggccccctgtacgacggcctgcaggccggcgccgccgaccacgtgagactgctggtgcccctggtgctggagcccggcctgtggagcctggtgcccggcgtggacaccgtggccagagaccccagatgctgggccgtgagaagaacccagctggagttctgccccagaggcagcagcccctgggacagattcctggtgggcggctacctgagcagcagagtgctgctggagctgctgagaaaggccctggccgccagcgtgaactggcccgccatcggcagcctgctgggctgcctgatcagacccagcatggccagcgaggagctgctgctggaggtgcagcacgagagactggagctgaccgtggccgtgctggtggccgtgcccggcgtggacgccgacgacagactgctgctggcctggcccctggagggcctggccggcaacctgtggctgcaggacctgtaccccgtggaggccgccagactgagagccctggacgaccacgacgccggcaccagaagaagactgctgctgctgctgtgcgccgtgtgcagaggctgcagcgccctgggccagctgggcagaggccacctgacccaggtggtgctgagactgggcgaggacaacgtggactggaccgaggaggccctgggcgagagattcctgcaggccctggagctgctgatcggcagcctggagcaggccagcctgccctgccacttcaaccccagcgtgaacctgttcagcagcctgagagaggaggagatcgacgacatcggctacgccctgtacagcggcctgcaggagcccgagggcctgctgtag

SEQ ID NO: 22086 - DNA, 492 bp, Artificial Sequence
  Description of Artificial Sequence: Synthetic coding sequence
atggccgagttcagccagaagagaggcaagagaagaagcgacgagggcctgggcagcatggtggacttcctgctggccaacgccagactggtgctgggcgtgggcggcgccgccgtgctgggcatcgccaccctggccgtgaagagattcatcgacagagccaccagccccagagacgaggacgacaccaaggccgacagctggaaggagctgagcctgctgaaggccaccccccacctgcagcccagacccccccccgccgccctgagccagcccgtgctgcccctggcccccagcagcagcgcccccggcgagtggcacagcttccccagcttcggcgtgaccttcaagagaagaagccccggcttcgccctgaccgactgcgtgaccctgagagagagcctgctgctgagcagactgtgggccccccagatcttcaacggcggcggcgtgagcctgccctgcagctggagcaaggtggtggccctgtag

SEQ ID NO: 22087 - DNA, 618 bp, Artificial Sequence
  Description of Artificial Sequence: Synthetic coding sequence
atggccgagttcagccagaagagaggcaagagaagaagcgacgagggcctgggcagcatggtggacttcctgctggccaacgccagactggtgctgggcgtgggcggcgccgccgtgctgggcatcgccaccctggccgtgaagagattcatcgacagagccaccagccccagagacgaggacgacaccaaggccgacagctggaaggagctgagcctgctgaaggccaccccccacctgcagcccagacccccccccgccgccctgagccagcccgtgctgcccctggcccccagcagcagcgcccccggcgaggccgccggcctgagagccggcccctgcgaccaccccagcagccccggcggcttcggccagaccgccggctggagacacagacccggcgccgccggcctgctgagcgagcaggtgcccggcaccgccctgtggggcatcagagcctggggcgccgccctgagaagagccgccggcggcggctgcggcccctgcgccagccccggcgccaccggcgccggcgccggccccgtggagcccggcgccggcagaggccactgcggcgagggccccagcctgctgggcagagcccaggacgccgcctag

SEQ ID NO: 22088 - DNA, 1398 bp, Artificial Sequence
  Description of Artificial Sequence: Synthetic coding sequence
atgggcctgagccccaacctggacagacagaccatggccgagttcagccagaagagaggcaagagaagaagcgacgagggcctgggcagcatggtggacttcctgctggccaacgccagactggtgctgggcgtgggcggcgccgccgtgctgggcatcgccaccctggccgtgaagagattcatcgacagagccaccagccccagagacgaggacgacaccaaggccgacagctggaaggagctgagcctgctgaaggccaccccccacctgcagcccagacccccccccgccgccctgagccagcccgtgctgcccctggcccccagcagcagcgcccccgagggccccgccgagaccgaccccgaggtgaccccccagctgagcagccccgcccccctgtgcctgaccctgcaggagagactgctggccttcgagagagacagagtgaccatccccgccgcccaggtggccctggccaagcagctggccggcgacatcgccctggagctgcaggcctacttcagaagcaagttccccgagctgcccttcggcgccttcgtgcccggcggccccctgtacgacggcctgcaggccggcgccgccgaccacgtgagactgctggtgcccctggtgctggagcccggcctgtggagcctggtgcccggcgtggacaccgtggccagagaccccagatgctgggccgtgagaagaacccagctggagttctgccccagaggcagcagcccctgggacagattcctggtgggcggctacctgagcagcagagtgctgctggagctgctgagaaaggccctggccgccagcgtgaactggcccgccatcggcagcctgctgggctgcctgatcagacccagcatggccagcgaggagctgctgctggaggtgcagcacgagagactggagctgaccgtggccgtgctggtggccgtgcccggcgtggacgccgacgacagactgctgctggcctggcccctggagggcctggccggcaacctgtggctgcaggacctgtaccccgtggaggccgccagactgagagccctggacgaccacgacgccggcaccagaagaagactgctgctgctgctgtgcgccgtgtgcagaggctgcagcgccctgggccagctgggcagaggccacctgacccaggtggtgctgagactgggcgaggacaacgtggactggaccgaggaggccctgggcgagagattcctgcaggccctggagctgctgatcggcagcctggagcaggccagcctgccctgccacttcaaccccagcgtgaacctgttcagcagcctgagagaggaggagatcgacgacatcggctacgccctgtacagcggcctgcaggagcccgagggcctgctgtag

SEQ ID NO: 22089 - DNA, 1392 bp, Artificial Sequence
  Description of Artificial Sequence: Synthetic coding sequence
atggccggcgccggcgagagaaagggcaagaaggacgacaacggcatcggcaccgccatcgacttcgtgctgagcaacgccagactggtgctgggcgtgggcggcgccgccatgctgggcatcgccaccctggccgtgaagagaatgtacgacagagccatcagcgcccccaccagccccaccagactgagccacagcggcaagagaagctgggaggagcccaactggatgggcagccccagactgctgaacagagacatgaagaccggcctgagcagaagcctgcagaccctgcccaccgacagcagcaccttcgacaccgacaccttctgcccccccagacccaagcccgtggccagaaagggccaggtggacctgaagaagagcagactgagaatgagcctgcaggagaagctgctgacctactacagaaacagagccgccatccccgccggcgagcaggccagagccaagcaggccgccgtggacatctgcgccgagctgagaagcttcctgagagccaagctgcccgacatgcccctgagagacatgtacctgagcggcagcctgtacgacgacctgcaggtggtgaccgccgaccacatccagctgatcgtgcccctggtgctggagcagaacctgtggagctgcatccccggcgaggacaccatcatgaacgtgcccggcttcttcctggtgagaagagagaaccccgagtacttccccagaggcagcagctactgggacagatgcgtggtgggcggctacctgagccccaagaccgtggccgacaccttcgagaaggtggtggccggcagcatcaactggcccgccatcggcagcctgctggactacgtgatcagacccgcccccccccccgaggccctgaccctggaggtgcagtacgagagagacaagcacctgttcatcgacttcctgcccagcgtgaccctgggcgacaccgtgctggtggccaagccccacagactggcccagtacgacaacctgtggagactgagcctgagacccgccgagaccgccagactgagagccctggaccaggccgacagcggctgcagaagcctgtgcctgaagatcctgaaggccatctgcaagagcacccccgccctgggccacctgaccgccagccagctgaccaacgtgatcctgcacctggcccaggaggaggccgactggagccccgacatgctggccgacagattcctgcaggccctgagaggcctgatcagctacctggaggccggcgtgctgcccagcgccctgaaccccaaggtgaacctgttcgccgagctgacccccgaggagatcgacgagctgggctacaccctgtactgcagcctgagcgagcccgaggtgctgctgcagacctag

SEQ ID NO: 22090 - DNA, 1437 bp, Artificial Sequence
  Description of Artificial Sequence: Synthetic coding sequence
atggccggcgccggcgagagaaagggcaagaaggacgacaacggcatcggcaccgccatcgacttcgtgctgagcaacgccagactggtgctgggcgtgggcggcgccgccatgctgggcatcgccaccctggccgtgaagagaatgtacgacagagccatcagcgcccccaccagccccaccagactgagccacagcggcaagagaagctgggaggagcccaactggatgggcagccccagactgctgaacagagacatgaagaccggcctgagcagaagcctgcagaccctgcccaccgacagcagcaccttcgacaccgacaccttctgcccccccagacccaagcccgtggccagaaagggccaggtggacctgaagaagagcagactgagaatgagcctgcaggagaagctgctgacctactacagaaacagagccgccatccccgccggcgagcaggccagagccaagcaggccgccgtggacatctgcgccgagctgagaagcttcctgagagccaagctgcccgacatgcccctgagagacatgtacctgagcggcagcctgtacgacgacctgcaggtggtgaccgccgaccacatccagctgatcgtgcccctggtgctggagcagaacctgtggagctgcatccccggcgaggacaccatcatgaacgtgcccggcttcttcctggtgagaagagagaaccccgagtacttccccagaggcagcagctactgggacagatgcgtggtgggcggctacctgagccccaagaccgtggccgacaccttcgagaaggtggtggccggcagcatcaactggcccgccatcggcagcctgctggactacgtgatcagacccgcccccccccccgaggccctgaccctggaggtgcagtacgagagagacaagcacctgttcatcgacttcctgcccagcgtgaccctgggcgacaccgtgctggtggccaagccccacagactggcccagtacgacaacctgtggagactgagcctgagacccgccgagaccgccagactgagagccctggaccaggccgacagcggctgcagaagcctgtgcctgaagatcctgaaggccatctgcaagagcacccccgccctgggccacctgaccgccagccagctgaccaacgtgatcctgcacctggcccaggaggaggccgactggagccccgacatgctggccgacagattcctgcaggccctgagaggcctgatcagctacctggaggccggcgtgctgcccagcgccctgaaccccaaggacaaggccctgaaggagagaagcctgagacaccaggtgagaatgatggaggtggacagcagactgaacgtgagctggaagatccagagcctggtgggcgtgtggtggccctgcttcctgcccagacaggccctgctgttctag

SEQ ID NO: 22091 - DNA, 1392 bp, Artificial Sequence; identical to SEQ ID NO: 22089
  Description of Artificial Sequence: Synthetic coding sequence

SEQ ID NO: 22092 - DNA, 447 bp, Artificial Sequence
  Description of Artificial Sequence: Synthetic coding sequence
atggccggcgccggcgagagaaagggcaagaaggacgacaacggcatcggcaccgccatcgacttcgtgctgagcaacgccagactggtgctgggcgtgggcggcgccgccatgctgggcatcgccaccctggccgtgaagagaatgtacgacagagccatcagcgcccccaccagccccaccagactgagccacagcggcaagagaagctgggaggagcccaactggatgggcagccccagactgctgaacagagacatgaagaccggcctgagcagaagcctgcagaccctgcccaccgacagcagcaccttcgacaccggcgagaccagctacctgctgcccgagcccggcagccacccctgctggagagccggcagcggccaggccagctgctgcggccacatgtgcagagcccccgagctgcccgccggccaggtggcctag

SEQ ID NO: 22093 - DNA, 447 bp, Artificial Sequence; identical to SEQ ID NO: 22092
  Description of Artificial Sequence: Synthetic coding sequence

SEQ ID NO: 22094 - DNA, 132 bp, Artificial Sequence
  Description of Artificial Sequence: Synthetic coding sequence
atggccggcgccggcgagagaaagggcaagaaggacgacaacggcatcggcaccgccatcgacttcgtgctgagcaacgccagactggtgctgggcgtgggcggcgccgccatgctgggcatcgccacctag

SEQ ID NO: 22095 - DNA, 2067 bp, Artificial Sequence
  Description of Artificial Sequence: Synthetic coding sequence
atggccgccgagatcgacttcctgagagagcagaacagaagactgaacgaggacttcagaagataccagatggagagcttcagcaagtacagcagcgtgcagaaggccgtgtgccagggcgagggcgacgacaccttcgagaacctggtgttcgaccagagcttcctggcccccctggtgaccgagtacgacaagcacctgggcgagctgaacggccagctgaagtactaccagaagcaggtgggcgagatgaagctgcagctggagaacgtgatcaaggagaacgagagactgcacagcgagctgaaggacgccgtggagaagaagctggaggccttccccctgggcaccgaggtgggcaccgacatctacgccgacgacgagaccgtgagaaacctgcaggagcagctgcagctggccaaccaggagaagacccaggccgtggagctgtggcagaccgtgagccaggagctggacagactgcacaagctgtaccaggagcacatgaccgaggcccagatccacgtgttcgagagccagaagcagaaggaccagctgttcgacttccagcagctgaccaagcagctgcacgtgaccaacgagaacatggaggtgaccaaccagcagttcctgaagaccgtgaccgagcagagcgtgatcatcgagcagctgagaaagaagctgagacaggccaagctggagctgagagtggccgtggccaaggtggaggagctgaccaacgtgaccgaggacctgcagggccagatgaagaagaaggagaaggacgtggtgagcgcccacggcagagaggaggccagcgacagaagactgcagcagctgcagagcagcatcaagcagctggagatcagactgtgcgtgaccatccaggaggccaaccagctgagaaccgagaacacccacctggagaagcagaccagagagctgcaggccaagtgcaacgagctggagaacgagagatacgaggccatcgtgagagccagaaacagcatgcagctgctggaggaggccaacctgcagaagagccaggccctgctggaggagaagcagaaggaggaggacatcgagaagatgaaggagaccgtgagcagattcgtgcaggacgccaccatcagaaccaagaaggaggtggccaacaccaagaagcagtgcaacatccagatcagcagactgaccgaggagctgagcgccctgcagatggagtgcgccgagaagcagggccagatcgagagagtgatcaaggagaagaaggccgtggaggaggagctggagaagatctacagagagggcagaggcaacgagagcgactacagaaagctggaggagatgcaccagagattcctggtgagcgagagaagcaaggacgacctgcagctgagactgaccagagccgagaacagaatcaagcagctggagaccgacagcagcgaggagatcagcagataccaggagatgatccagaagctgcagaacgtgctggagagcgagagagagaactgcggcctggtgagcgagcagagactgaagctgcagcaggagaacaagcagctgagaaaggagaccgagagcctgagaaagatcgccctggaggcccagaagaaggccaaggtgaagatcagcaccatggagcacgagttcagcatcaaggagagaggcttcgaggtgcagctgagagagatggaggacagcaacagaaacagcatcgtggagctgagacacctgctggccacccagcagaaggccgccaacagatggaaggaggagaccaagaagctgaccgagagcgccgagatcagaatcaacaacctgaagagcgagctgagcagacagaagctgcacacccaggagctgctgagccagctggagatggccaacgagaaggtggccgagaacgagaagctgatcctggagcaccaggagaaggccaacagactgcagagaagactgagccaggccgaggagagagccgccagcgccagccagcagctgagcgtgatcaccgtgcagagaagaaaggccgccagcctgatgaacctggagaacatctag

SEQ ID NO: 22096 - DNA, 924 bp, Artificial Sequence
  Description of Artificial Sequence: Synthetic coding sequence
atggccgccgagatcgacttcctgagagagcagaacagaagactgaacgaggacttcagaagataccagatggagagcttcagcaagtacagcagcgtgcagaaggccgtgtgccagggcgagggcgacgacaccttcgagaacctggtgttcgaccagagcttcctggcccccctggtgaccgagtacgacaagcacctgggcgagctgaacggccagctgaagtactaccagaagcaggtgggcgagatgaagctgcagctggagaacgtgatcaaggagaacgagagactgcacagcgagctgaaggacgccgtggagaagaagctggaggccttccccctgggcaccgaggtgggcaccgacatctacgccgacgacgagaccgtgagaaacctgcaggagcagctgcagctggccaaccaggagaagacccaggccgtggagctgtggcagaccgtgagccaggagctggacagactgcacaagctgtaccaggagcacatgaccgaggcccagatccacgtgttcgagagccagaagcagaaggaccagctgttcgacttccagcagctgaccaagcagctgcacgtgaccaacgagaacatggaggtgaccaaccagcagttcctgaagaccgtgaccgagcagagcgtgatcatcgagcagctgagaaagaagctgagaagcgagctgagcagacagaagctgcacacccaggagctgctgagccagctggagatggccaacgagaaggtggccgagaacgagaagctgatcctggagcaccaggagaaggccaacagactgcagagaagactgagccaggccgaggagagagccgccagcgccagccagcagctgagcgtgatcaccgtgcagagaagaaaggccgccagcctgatgaacctggagaacatctag

SEQ ID NO: 22097 - DNA, 528 bp, Artificial Sequence
  Description of Artificial Sequence: Synthetic coding sequence
atggccgccgagatcgacttcctgagagagcagaacagaagactgaacgaggacttcagaagataccagatggagagcttcagcaagtacagcagcgtgcagaaggccgtgtgccagggcgagggcgacgacaccttcgagaacctggtgttcgaccagagcttcctggcccccctggtgaccgagtacgacaagcacctgggcgagctgaacggccagctgaagtactaccagaagcaggtgggcgagatgaagctgcagctggagaacgtgatcaaggagaacgagagaagcgagctgagcagacagaagctgcacacccaggagctgctgagccagctggagatggccaacgagaaggtggccgagaacgagaagctgatcctggagcaccaggagaaggccaacagactgcagagaagactgagccaggccgaggagagagccgccagcgccagccagcagctgagcgtgatcaccgtgcagagaagaaaggccgccagcctgatgaacctggagaacatctag

SEQ ID NO: 22098 - DNA, 240 bp, Artificial Sequence
  Description of Artificial Sequence: Synthetic coding sequence
atggccgccgagatcgacttcctgagagagcagaacagaagactgaacgaggacttcagaagataccagatggagagcttcagcaagtacagcagcgtgcagaaggccgtgtgccagggcgagggcgacgacaccttcgagaacctggtgttcgaccagagcttcctggcccccctggtgaccgagtacgacaagcacctgggcgagctgaacggccagctgaagtactaccaggcctag

SEQ ID NO: 22099 - DNA, 738 bp, Artificial Sequence
  Description of Artificial Sequence: Synthetic coding sequence
atggagggcaacaagctggaggagcaggacagcagccccccccagagcacccccggcctgatgaagggcaacaagagagaggagcagggcctgggccccgagcccgccgccccccagcagcccaccgccgaggaggaggccctgatcgagttccacagaagctacagagagctgttcgagttcttctgcaacaacaccaccatccacggcgccatcagactggtgtgcagccagcacaacagaatgaagaccgccttctgggccgtgctgtggctgtgcaccttcggcatgatgtactggcagttcggcctgctgttcggcgagtacttcagctaccccgtgagcctgaacatcaacctgaacagcgacaagctggtgttccccgccgtgaccatctgcaccctgaacccctacagataccccgagatcaaggaggagctggaggagctggacagaatcaccgagcagaccctgttcgacctgtacaagtacagcagcttcaccaccctggtggccggcagcagaagcagaagagacctgagaggcaccctgccccaccccctgcagagactgagagtgcccccccccccccacggcgccagaagagccagaagcgtggccagcagcctgagagacaacaacccccaggtggactggaaggactggaagatcggcttccagctggagctgctgagcctgcccccccccgacgtgtggaagctgctgtacttccagtag

SEQ ID NO: 22100 - DNA, 2187 bp, Artificial Sequence
  Description of Artificial Sequence: Synthetic coding sequence
atgggcatggccagaggcagcctgaccagagtgcccggcgtgatgggcgagggcacccagggccccgagctgagcctggaccccgacccctgcagcccccagagcacccccggcctgatgaagggcaacaagctggaggagcaggaccccagacccctgcagcccatccccggcctgatggagggcaacaagctggaggagcaggacagcagccccccccagagcacccccggcctgatgaagggcaacaagagagaggagcagggcctgggccccgagcccgccgccccccagcagcccaccgccgaggaggaggccctgatcgagttccacagaagctacagagagctgttcgagttcttctgcaacaacaccaccatccacggcgccatcagactggtgtgcagccagcacaacagaatgaagaccgccttctgggccgtgctgtggctgtgcaccttcggcatgatgtactggcagttcggcctgctgttcggcgagtacttcagctaccccgtgagcctgaacatcaacctgaacagcgacaagctggtgttccccgccgtgaccatctgcaccctgaacccctacagataccccgagatcaaggaggagctggaggagctggacagaatcaccgagcagaccctgttcgacctgtacaagtacagcagcttcaccaccctggtggccggcagcagaagcagaagagacctgagaggcaccctgccccaccccctgcagagactgagagtgcccccccccccccacggcgccagaagagccagaagcgtggccagcagcctgagagacaacaacccccaggtggactggaaggactggaagatcggcttccagctgtgcaaccagaacaagagcgactgcttctaccagacctacagcagcggcgtggacgccgtgagagagtggtacagattccactacatcaacatcctgagcagactgcccgagaccctgcccagcctggaggaggacaccctgggcaacttcatcttcgcctgcagattcaaccaggtgagctgcaaccaggccaactacagccacttccaccaccccatgtacggcaactgctacaccttcaacgacaagaacaacagcaacctgtggatgagcagcatgcccggcatcaacaacggcctgagcctgatgctgagagccgagcagaacgacttcatccccctgctgagcaccgtgaccggcgccagagtgatggtgcacggccaggacgagcccgccttcatggacgacggcggcttcaacctgagacccggcgtggagaccagcatcagcatgagaaaggagaccctggacagactgggcggcgactacggcgactgcaccaagaacggcagcgacgtgcccgtggagaacctgtaccccagcaagtacacccagcaggtgtgcatccacagctgcttccaggagagcatgatcaaggagtgcggctgcgcctacatcttctaccccagaccccagaacgtggagtactgcgactacagaaagcacagcagctggggctactgctactacaagctgcaggtggacttcagcagcgaccacctgggctgcttcaccaagtgcagaaagccctgcagcgtgaccagctaccagctgagcgccggctacagcagatggcccagcgtgaccagccaggagtgggtgttccagatgctgagcagacagaacaactacaccgtgaacaacaagagaaacggcgtggccaaggtgaacatcttcttcaaggagctgaactacaagaccaacagcgagagccccagcgtgaccatggtgaccctgctgagcaacctgggcagccagtggagcctgtggttcggcagcagcgtgctgagcgtggtggagatggccgagctggtgttcgacctgctggtgatcatgttcctgatgctgctgagaagattcagaagcagatactggagccccggcagaggcggcagaggcgcccaggaggtggccagcaccctggccagcagcccccccagccacttctgcccccaccccatgagcctgagcctgagccagcccggccccgcccccagccccgccctgaccgcccccccccccgcctacgccaccctgggccccagacccagccccggcggcagcgccggcgccagcagcagcacctgccccctgggcggcccctag

SEQ ID NO: 22101 - DNA, 2079 bp, Artificial Sequence
  Description of Artificial Sequence: Synthetic coding sequence
atgagcagcatcaagggcaacaagctggaggagcaggaccccagacccctgcagcccatccccggcctgatggagggcaacaagctggaggagcaggacagcagccccccccagagcacccccggcctgatgaagggcaacaagagagaggagcagggcctgggccccgagcccgccgccccccagcagcccaccgccgaggaggaggccctgatcgagttccacagaagctacagagagctgttcgagttcttctgcaacaacaccaccatccacggcgccatcagactggtgtgcagccagcacaacagaatgaagaccgccttctgggccgtgctgtggctgtgcaccttcggcatgatgtactggcagttcggcctgctgttcggcgagtacttcagctaccccgtgagcctgaacatcaacctgaacagcgacaagctggtgttccccgccgtgaccatctgcaccctgaacccctacagataccccgagatcaaggaggagctggaggagctggacagaatcaccgagcagaccctgttcgacctgtacaagtacagcagcttcaccaccctggtggccggcagcagaagcagaagagacctgagaggcaccctgccccaccccctgcagagactgagagtgcccccccccccccacggcgccagaagagccagaagcgtggccagcagcctgagagacaacaacccccaggtggactggaaggactggaagatcggcttccagctgtgcaaccagaacaagagcgactgcttctaccagacctacagcagcggcgtggacgccgtgagagagtggtacagattccactacatcaacatcctgagcagactgcccgagaccctgcccagcctggaggaggacaccctgggcaacttcatcttcgcctgcagattcaaccaggtgagctgcaaccaggccaactacagccacttccaccaccccatgtacggcaactgctacaccttcaacgacaagaacaacagcaacctgtggatgagcagcatgcccggcatcaacaacggcctgagcctgatgctgagagccgagcagaacgacttcatccccctgctgagcaccgtgaccggcgccagagtgatggtgcacggccaggacgagcccgccttcatggacgacggcggcttcaacctgagacccggcgtggagaccagcatcagcatgagaaaggagaccctggacagactgggcggcgactacggcgactgcaccaagaacggcagcgacgtgcccgtggagaacctgtaccccagcaagtacacccagcaggtgtgcatccacagctgcttccaggagagcatgatcaaggagtgcggctgcgcctacatcttctaccccagaccccagaacgtggagtactgcgactacagaaagcacagcagctggggctactgctactacaagctgcaggtggacttcagcagcgaccacctgggctgcttcaccaagtgcagaaagccctgcagcgtgaccagctaccagctgagcgccggctacagcagatggcccagcgtgaccagccaggagtgggtgttccagatgctgagcagacagaacaactacaccgtgaacaacaagagaaacggcgtggccaaggtgaacatcttcttcaaggagctgaactacaagaccaacagcgagagccccagcgtgaccatggtgaccctgctgagcaacctgggcagccagtggagcctgtggttcggcagcagcgtgctgagcgtggtggagatggccgagctggtgttcgacctgctggtgatcatgttcctgatgctgctgagaagattcagaagcagatactggagccccggcagaggcggcagaggcgcccaggaggtggccagcaccctggccagcagcccccccagccacttctgcccccaccccatgagcctgagcctgagccagcccggccccgcccccagccccgccctgaccgcccccccccccgcctacgccaccctgggccccagacccagccccggcggcagcgccggcgccagcagcagcacctgccccctgggcggcccctag

SEQ ID NO: 22102 - DNA, 477 bp, Artificial Sequence
  Description of Artificial Sequence: Synthetic coding sequence
atggtgccccacgccatcctggccagaggcagagacgtgtgcagaagaaacggcctgctgatcctgagcgtgctgagcgtgatcgtgggctgcctgctgggcttcttcctgagaaccagaagactgagcccccaggagatcagctacttccagttccccggcgagctgctgatgagaatgctgaagatgatgatcctgcccctggtggtgagcagcctgatgagcggcctggccagcctggacgccaagaccagcagcagactgggcgtgctgaccgtggcctactacctgtggaccaccttcatggccgtgatcgtgggcatcttcatggtgagcatcatccaccccggcagcgccgcccagaaggagaccaccgagcagagcggcaagcccatcatgagcagcgccgacgccctgctggacctgatcagacagaaggaggagagctggagaaacggccccaagggccccggctag

SEQ ID NO: 22103 - DNA, 1683 bp, Artificial Sequence
  Description of Artificial Sequence: Synthetic coding sequence
atggtgccccacgccatcctggccagaggcagagacgtgtgcagaagaaacggcctgctgatcctgagcgtgctgagcgtgatcgtgggctgcctgctgggcttcttcctgagaaccagaagactgagcccccaggagatcagctacttccagttccccggcgagctgctgatgagaatgctgaagatgatgatcctgcccctggtggtgagcagcctgatgagcggcctggccagcctggacgccaagaccagcagcagactgggcgtgctgaccgtggcctactacctgtggaccaccttcatggccgtgatcgtgggcatcttcatggtgagcatcatccaccccggcagcgccgcccagaaggagaccaccgagcagagcggcaagcccatcatgagcagcgccgacgccctgctggacctgatcagaaacatgttccccgccaacctggtggaggccaccttcaagcagtacagaaccaagaccacccccgtggtgaagagccccaaggtggcccccgaggaggccccccccagaagaatcctgatctacggcgtgcaggaggagaacggcagccacgtgcagaacttcgccctggacctgacccccccccccgaggtggtgtacaagagcgagcccggcaccagcgacggcatgaacgtgctgggcatcgtgttcttcagcgccaccatgggcatcatgctgggcagaatgggcgacagcggcgcccccctggtgagcttctgccagtgcctgaacgagagcgtgatgaagatcgtggccgtggccgtgtggtacttccccttcggcatcgtgttcctgatcgccggcaagatcctggagatggacgaccccagagccgtgggcaagaagctgggcttctacagcgtgaccgtggtgtgcggcctggtgctgcacggcctgttcatcctgcccctgctgtacttcttcatcaccaagaagaaccccatcgtgttcatcagaggcatcctgcaggccctgctgatcgccctggccaccagcagcagcagcgccaccctgcccatcaccttcaagtgcctgctggagaacaaccacatcgacagaagaatcgccagattcgtgctgcccgtgggcgccaccatcaacatggacggcaccgccctgtacgaggccgtggccgccatcttcatcgcccaggtgaacaactacgagctggacttcggccagatcatcaccatcagcatcaccgccaccgccgccagcatcggcgccgccggcatcccccaggccggcctggtgaccatggtgatcgtgctgaccagcgtgggcctgcccaccgacgacatcaccctgatcatcgccgtggactgggccctggacagattcagaaccatgatcaacgtgctgggcgacgccctggccgccggcatcatggcccacatctgcagaaaggacttcgccagagacaccggcaccgagaagctgctgccctgcgagaccaagcccgtgagcctgcaggagatcgtggccgcccagcagaacggctgcgtgaagagcgtggccgaggccagcgagctgaccctgggccccacctgcccccaccacgtgcccgtgcaggtggagcaggacgaggagctgcccgccgccagcctgaaccactgcaccatccagatcagcgagctggagaccaacgtgtag

SEQ ID NO: 22104 - DNA, 729 bp, Artificial Sequence
  Description of Artificial Sequence: Synthetic coding sequence
atgagcaaccccagaagcctggaggaggagaagtacgacatgagcggcgccagactggccctgatcctgtgcgtgaccaaggccagagagggcagcgaggaggacctggacgccctggagcacatgttcagacagctgagattcgagagcaccatgaagagagaccccaccgccgagcagttccaggaggagctggagaagttccagcaggccatcgacagcagagaggaccccgtgagctgcgccttcgtggtgctgatggcccacggcagagagggcttcctgaagggcgaggacggcgagatggtgaagctggagaacctgttcgaggccctgaacaacaagaactgccaggccctgagagccaagcccaaggtgtacatcatccaggcctgcagaggcgagcagagagaccccggcgagaccgtgggcggcgacgagatcgtgatggtgatcaaggacagcccccagaccatccccacctacaccgacgccctgcacgtgtacagcaccgtggagggctacatcgcctacagacacgaccagaagggcagctgcttcatccagaccctggtggacgtgttcaccaagagaaagggccacatcctggagctgctgaccgaggtgaccagaagaatggccgaggccgagctggtgcaggagggcaaggccagaaagaccaaccccgagatccagagcaccctgagaaagagactgtacctgcagtag

SEQ ID NO: 22105 - DNA, 1503 bp, Artificial Sequence
  Description of Artificial Sequence: Synthetic coding sequence
atgagcatcgaccacgagcagccctggcagcagcccgtgcccgccggcgagagacccgccgccggccccggcggcctggccgccgccgccgccggcaagcccgccgccgagagcaccgcccacgcccccgcccccgccgaccacgaccccagagccagagccgccctgcccgcccccaagagactgcacagcgccgacggccagagaagaggccactggggccagcccggcctgtgccccgcccccatcagcgcccacctgccccccgaccaggtgctgctgttcagctggagagccagcgacgaggacgccgccgacgccggcgtgaccagccactgcctgcagcccggccacagaaacatgttcccccccaacctggtggaggcctgcttcaagcagttcaagacccagtacagcaccagagtggtgaccagaaccatggtgagaaccgagaacggcagcgagcccggcgccagcatgcccccccccttcagcgtggagaacggcaccagcttcctggagaacgtgaccagagccctgggcaccctgcaggagatgctgagcttcgaggagaccgtgcccgtgcccggcagcgccaacggcatcaacgccctgggcctggtggtgttcagcgtggccttcggcctggtgatcggcggcatgaagcacaagggcagagtgctgagagacttcttcgacagcctgaacgaggccatcatgagactggtgggcatcatcatctggtacgcccccgtgggcatcctgttcctgatcgccggcaagatcctggagatggaggacatggccgtgctgggcggccagctgggcatgtacaccctgaccgtgatcgtgggcctgttcctgcacgccggcatcgtgctgcccctgatctacttcctggtgacccacagaaaccccttccccttcatcggcggcatgctgcaggccctgatcaccgccatgggcaccagcagcagcagcgccaccctgcccatcaccttcagatgcctggaggagggcctgggcgtggacagaagaatcaccagattcgtgctgcccgtgggcgccaccgtgaacatggacggcaccgccctgtacgaggccctggccgccatcttcatcgcccaggtgaacaactacgagctgaacctgggccagatcaccaccatcagcatcaccgccaccgccgccagcgtgggcgccgccggcatcccccaggccggcctggtgaccatggtgatcgtgctgaccagcgtgggcctgcccaccgaggacatcaccctgatcatcgccgtggactggttcctggacagactgagaaccatgaccaacgtgctgggcgacagcatcggcgccgccgtgatcgagcacctgagccagagagagctggagctgcaggaggccgagctgaccctgcccagcctgggcaagccctacaagagcctgatggcccaggagaagggcgccagcagaggcagaggcggcaacgagagcgccatgtag

SEQ ID NO: 22106 - DNA, 618 bp, Artificial Sequence
  Description of Artificial Sequence: Synthetic coding sequence
accatgagcagccacggcaacagcctgttcctgagagagagcggccagagactgggcagagtgggctggctgcagagactgcaggagagcctgcagcagagagccctgagaaccagactgagactgcagaccatgaccctggagcacgtgctgagattcctgagaagaaacgccttcatcctgctgaccgtgagcgccgtggtgatcggcgtgagcctggccttcgccctgagaccctaccagctgacctacagacagatcaagtacttcagcttccccggcgagctgctgatgagaatgctgcagatgctggtgctgcccctgatcgtgagcagcctggtgaccggcatggccagcctggacaacaaggccaccggcagaatgggcatgagagccgccgtgtactacatggtgaccaccatcatcgccgtgttcatcggcatcctgatggtgaccatcatccaccccggcaagggcagcaaggagggcctgcacagagagggcagaatcgagaccatccccaccgccgacgccttcatggacctgatcagaaacatgttcccccccaacctggtggaggcctgcttcaagcaggtgagaggcaagtacaccgtgtag

SEQ ID NO: 22107 - DNA, 939 bp, Artificial Sequence
  Description of Artificial Sequence: Synthetic coding sequence
atgagcagccacggcaacagcctgttcctgagagagagcggccagagactgggcagagtgggctggctgcagagactgcaggagagcctgcagcagagagccctgagaaccagactgagactgcagaccatgaccctggagcacgtgctgagattcctgagaagaaacgccttcatcctgctgaccgtgagcgccgtggtgatcggcgtgagcctggccttcgccctgagaccctaccagctgacctacagacagatcaagtacttcagcttccccggcgagctgctgatgagaatgctgcagatgctggtgctgcccctgatcgtgagcagcctggtgaccggcatggccagcctggacaacaaggccaccggcagaatgggcatgagagccgccgtgtactacatggtgaccaccatcatcgccgtgttcatcggcatcctgatggtgaccatcatccaccccggcaagggcagcaaggagggcctgcacagagagggcagaatcgagaccatccccaccgccgacgccttcatggacctgatcagaaacatgttcccccccaacctggtggaggcctgcttcaagcagttcaagacccagtacagcaccagagtggtgaccagaaccatggtgagaaccgagaacggcagcgagcccggcgccagcatgcccccccccttcagcgtggagaacggcaccagcttcctggagaacgtgaccagagccctgggcaccctgcaggagatgctgagcttcgaggagaccgtgcccgtgcccggcagcgccaacggcatcaacgccctgggcctggtggtgttcagcgtggccttcggcctggtgatcggcggcatgaagcacaagggcagagtgctgagagacttcttcgacagcctgaacgaggccatcatgagactggtgggcatcatcatctggtag

SEQ ID NO: 22108 - DNA, 1317 bp, Artificial Sequence
  Description of Artificial Sequence: Synthetic coding sequence
atgatcagaaagctgttcatcgtgctgctgctgctgctggtgaccatcgaggaggccagaatgagcagcctgagcttcctgaacatcgagaagaccgagatcctgttcttcaccaagaccgaggagaccatcctggtgagcagcagctacgagaacaagagacccaacagcagccacctgttcgtgaagatcgaggaccccaagatcctgcagatggtgaacgtggccaagaagatcagcagcgacgccaccaacttcaccatcaacctggtgaccgacgaggagggcgagaccaacgtgaccatccagctgtgggacagcgagggcagacaggagagactgatcgaggagatcaagaacgtgaaggtgaaggtgctgaagcagaaggacagcctgctgcaggcccccatgcacatcgacagaaacatcctgatgctgatcctgcccctgatcctgctgaacaagtgcgccttcggctgcaagatcgagctgcagctgttccagaccgtgtggaagagacccctgcccgtgatcctgggcgccgtgacccagttcttcctgatgcccttctgcggcttcctgctgagccagatcgtggccctgcccgaggcccaggccttcggcgtggtgatgacctgcacctgccccggcggcggcggcggctacctgttcgccctgctgctggacggcgacttcaccctggccatcctgatgacctgcaccagcaccctgctggccctgatcatgatgcccgtgaacagctacatctacagcagaatcctgggcctgagcggcaccttccacatccccgtgagcaagatcgtgagcaccctgctgttcatcctggtgcccgtgagcatcggcatcgtgatcaagcacagaatccccgagaaggccagcttcctggagagaatcatcagacccctgagcttcatcctgatgttcgtgggcatctacctgaccttcaccgtgggcctggtgttcctgaagaccgacaacctggaggtgatcctgctgggcctgctggtgcccgccctgggcctgctgttcggctacagcttcgccaaggtgtgcaccctgcccctgcccgtgtgcaagaccgtggccatcgagagcggcatgctgaacagcttcctggccctggccgtgatccagctgagcttcccccagagcaaggccaacctggccagcgtggcccccttcaccgtggccatgtgcagcggctgcgagatgctgctgatcatcctggtgtacaaggccaagaagagatgcatcttcttcctgcaggacaagagaaagagaaacttcctgatctag

SEQ ID NO: 22109 - DNA, 258 bp, Artificial Sequence
  Description of Artificial Sequence: Synthetic coding sequence
atgagactgctggagagaatgagaaaggactggttcatggtgggcatcgtgctggccatcgccggcgccaagctggagcccagcatcggcgtgaacggcggccccctgaagcccgagatcaccgtgagctacatcgccgtggccaccatcttcttcaacagcggcctgagcctgaagaccgagttcgccgacagcagactgcacgccagcgcctgcgtgttctgcagcgacttcaaccagggcagctggtggaagtag

SEQ ID NO: 22110 - DNA, 1023 bp, Artificial Sequence
  Description of Artificial Sequence: Synthetic coding sequence
atgagactgctggagagaatgagaaaggactggttcatggtgggcatcgtgctggccatcgccggcgccaagctggagcccagcatcggcgtgaacggcggccccctgaagcccgagatcaccgtgagctacatcgccgtggccaccatcttcttcaacagcggcctgagcctgaagaccgaggagctgaccagcgccctggtgcacctgaagctgcacctgttcatccagatcttcaccctggccttcttccccgccaccatctggctgttcctgcagctgctgagcatcacccccatcaacgagtggctgctgaagggcctgcagaccgtgggctgcatgcccccccccgtgagcagcgccgtgatcctgaccaaggccgtgggcggcaacgaggccgccgccatcttcaacagcgccttcggcagcttcctgggcatcgtgatcacccccctgctgctgctgctgttcctgggcagcagcagcagcgtgcccttcaccagcatcttcagccagctgttcatgaccgtggtggtgcccctgatcatcggccagatcgtgagaagatacatcaaggactggctggagagaaagaagccccccttcggcgccatcagcagcagcgtgctgctgatgatcatctacaccaccttctgcgacaccttcagcaaccccaacatcgacctggacaagttcagcctggtgctgatcctgttcatcatcttcagcatccagctgagcttcatgctgctgaccttcatcttcagcaccagaaacaacagcggcttcacccccgccgacaccgtggccatcatcttctgcagcacccacaagagcctgaccctgggcatccccatgctgaagatcgtgttcgccggccacgagcacctgagcctgatcagcgtgcccctgctgatctaccaccccgcccagatcctgctgggcagcgtgctggtgcccaccatcaagagctggatggtgagcagacagaagggcgtgaagctgaccagacccaccgtgtag

SEQ ID NO: 22111 - DNA, 480 bp, Artificial Sequence
  Description of Artificial Sequence: Synthetic coding sequence
atgagactgctggagagaatgagaaaggactggttcatggtgggcatcgtgctggccatcgccggcgccaagctggagcccagcatcggcgtgaacggcggccccctgaagcccgagatcaccgtgagctacatcgccgtggccaccatcttcttcaacagcggcctgagcctgaagaccgaggagctgaccagcgccctggtgcacctgaagctgcacctgttcatccagatcttcaccctggccttcttccccgccaccatctggctgttcctgcagctgctgagcatcacccccatcaacgagtggctgctgaagggcctgcagaccgtgggctgcatgcccccccccgtgagcagcgccgtgatcctgaccaaggccgtgggcggcaacgaggccgccgccatcttcaacagcgccttcggcagcttcctggtgagcaagcacagcctgacctgcctgctgcagctgctgctgtag

SEQ ID NO: 22112 - DNA, 1077 bp, Artificial Sequence
  Description of Artificial Sequence: Synthetic coding sequence
atgagactgctggagagaatgagaaaggactggttcatggtgggcatcgtgctggccatcgccggcgccaagctggagcccagcatcggcgtgaacggcggccccctgaagcccgagatcaccgtgagctacatcgccgtggccaccatcttcttcaacagcggcctgagcctgaagaccgaggagctgaccagcgccctggtgcacctgaagctgcacctgttcatccagatcttcaccctggccttcttccccgccaccatctggctgttcctgcagctgctgagcatcacccccatcaacgagtggctgctgaagggcctgcagaccgtgggctgcatgcccccccccgtgagcagcgccgtgatcctgaccaaggccgtgggcggcaacgaggccgccgccatcttcaacagcgccttcggcagcttcctgggcatcgtgatcacccccctgctgctgctgctgttcctgggcagcagcagcagcgtgcccttcaccagcatcttcagccagctgttcatgaccgtggtggtgcccctgatcatcggccagatcgtgagaagatacatcaaggactggctggagagaaagaagccccccttcggcgccatcagcagcagcgtgctgctgatgatcatctacaccaccttctgcgacaccttcagcaaccccaacatcgacctggacaagttcagcctggtgctgatcctgttcatcatcttcagcatccagctgagcttcatgctgctgaccttcatcttcagcaccagaaacaacagcggcttcacccccgccgacaccgtggccatcatcttctgcagcacccacaagagcctgaccctgggcatccccatgctgaagatcgtgttcgccggccacgagcacctgagcctgatcagcgtgcccctgctgatctaccaccccgcccagatcctgctgggcagcgtgctggtgcccaccatcaagagctggatggtgagcagacagaagaagctgctgcagaccagaggccccctggccaacctgaacaaccccgagggcctggagtacctgagcatcaagttcggccactag

SEQ ID NO: 22113 - DNA, 984 bp, Artificial Sequence
  Description of Artificial Sequence: Synthetic coding sequence
atgagactgctggagagaatgagaaaggactggttcatggtgggcatcgtgctggccatcgccggcgccaagctggagcccagcatcggcgtgaacggcggccccctgaagcccgagatcaccgtgagctacatcgccgtggccaccatcttcttcaacagcggcctgagcctgaagaccgaggagctgaccagcgccctggtgcacctgaagctgcacctgttcatccagatcttcaccctggccttcttccccgccaccatctggctgttcctgcagctgctgagcatcacccccatcaacgagtggctgctgaagggcctgcagaccgtgggctgcatgcccccccccgtgagcagcgccgtgatcctgaccaaggccgtgggcggcaacgagggcatcgtgatcacccccctgctgctgctgctgttcctgggcagcagcagcagcgtgcccttcaccagcatcttcagccagctgttcatgaccgtggtggtgcccctgatcatcggccagatcgtgagaagatacatcaaggactggctggagagaaagaagccccccttcggcgccatcagcagcagcgtgctgctgatgatcatctacaccaccttctgcgacaccttcagcaaccccaacatcgacctggacaagttcagcctggtgctgatcctgttcatcatcttcagcatccagctgagcttcatgctgctgaccttcatcttcagcaccagaaacaacagcggcttcacccccgccgacaccgtggccatcatcttctgcagcacccacaagagcctgaccctgggcatccccatgctgaagatcgtgttcgccggccacgagcacctgagcctgatcagcgtgcccctgctgatctaccaccccgcccagatcctgctgggcagcgtgctggtgcccaccatcaagagctggatggtgagcagacagaagggcgtgaagctgaccagacccaccgtgtag

SEQ ID NO: 22114 - DNA, 195 bp, Artificial Sequence
  Description of Artificial Sequence: Synthetic coding sequence
atgagactgctggagagaatgagaaaggactggttcatggtgggcatcgtgctggccatcgccggcgccaagctggagcccagcatcggcgtgaacggcggccccctgaagcccgagatcaccgtgagctacatcgccgtggccaccatcttcttcaacagcggcctgagcctgaagaccgagctgctgacctag

SEQ ID NO: 22115 - DNA, 1077 bp, Artificial Sequence; identical to SEQ ID NO: 22112
  Description of Artificial Sequence: Synthetic coding sequence

SEQ ID NO: 22116 - DNA, 1707 bp, Artificial Sequence
  Description of Artificial Sequence: Synthetic coding sequence
atggtgctgggccccgagcagaagatgagcgacgacagcgtgagcggcgaccacggcgagagcgccagcctgggcaacatcaaccccgcctacagcaaccccagcctgagccagagccccggcgacagcgaggagtacttcgccacctacttcaacgagaagatcagcatccccgaggaggagtacagctgcttcagcttcagaaagctgtgggccttcaccggccccggcttcctgatgagcatcgcctacctggaccccggcaacatcgagagcgacctgcagagcggcgccgtggccggcttcaagctgctgtggatcctgctgctggccaccctggtgggcctgctgctgcagagactggccgccagactgggcgtggtgaccggcctgcacctggccgaggtgtgccacagacagtaccccaaggtgcccagagtgatcctgtggctgatggtggagctggccatcatcggcagcgacatgcaggaggtgatcggcagcgccatcgccatcaacctgctgagcgtgggcagaatccccctgtggggcggcgtgctgatcaccatcgccgacaccttcgtgttcctgttcctggacaagtacggcctgagaaagctggaggccttcttcggcttcctgatcaccatcatggccctgaccttcggctacgagtacgtgaccgtgaagcccagccagagccaggtgctgaagggcatgttcgtgcccagctgcagcggctgcagaaccccccagatcgagcaggccgtgggcatcgtgggcgccgtgatcatgccccacaacatgtacctgcacagcgccctggtgaagagcagacaggtgaacagaaacaacaagcaggaggtgagagaggccaacaagtacttcttcatcgagagctgcatcgccctgttcgtgagcttcatcatcaacgtgttcgtggtgagcgtgttcgccgaggccttcttcggcaagaccaacgagcaggtggtggaggtgtgcaccaacaccagcagcccccacgccggcctgttccccaaggacaacagcaccctggccgtggacatctacaagggcggcgtggtgctgggctgctacttcggccccgccgccctgtacatctgggccgtgggcatcctggccgccggccagagcagcaccatgaccggcacctacagcggccagttcgtgatggagggcttcctgaacctgaagtggagcagattcgccagagtggtgctgaccagaagcatcgccatcatccccaccctgctggtggccgtgttccaggacgtggagcacctgaccggcatgaacgacttcctgaacgtgctgcagagcctgcagctgcccttcgccctgatccccatcctgaccttcaccagcctgagacccgtgatgagcgacttcgccaacggcctgggctggagaatcgccggcggcatcctggtgctgatcatctgcagcatcaacatgtacttcgtggtggtgtacgtgagagacctgggccacgtggccctgtacgtggtggccgccgtggtgagcgtggcctacctgggcttcgtgttctacctgggctggcagtgcctgatcgccctgggcatgagcttcctggactgcggccacacctgccacctgggcctgaccgcccagcccgagctgtacctgctgaacaccatggacgccgacagcctggtgagcagatag

SEQ ID NO: 22117 - DNA, 1686 bp, Artificial Sequence
  Description of Artificial Sequence: Synthetic coding sequence
atggtgctgggccccgagcagaagatgagcgacgacagcgtgagcggcgaccacggcgagagcgccagcctgggcaacatcaaccccgcctacagcaaccccagcctgagccagagccccggcgacagcgaggagtacttcgccacctacttcaacgagaagatcagcatccccgaggaggagtacagctgcttcagcttcagaaagctgtgggccttcaccggccccggcttcctgatgagcatcgcctacctggaccccggcaacatcgagagcgacctgcagagcggcgccgtggccggcttcaagctgctgtggatcctgctgctggccaccctggtgggcctgctgctgcagagactggccgccagactgggcgtggtgaccggcctgcacctggccgaggtgtgccacagacagtaccccaaggtgcccagagtgatcctgtggctgatggtggagctggccatcatcggcagcgacatgcaggaggtgatcggcagcgccatcgccatcaacctgctgagcgtgggcagaatccccctgtggggcggcgtgctgatcaccatcgccgacaccttcgtgttcctgttcctggacaagtacggcctgagaaagctggaggccttcttcggcttcctgatcaccatcatggccctgaccttcggctacgagtacgtgaccgtgaagcccagccagagccaggtgctgaagggcatgttcgtgcccagctgcagcggctgcagaaccccccagatcgagcaggccgtgggcatcgtgggcgccgtgatcatgccccacaacatgtacctgcacagcgccctggtgaagagcagacaggtgaacagaaacaacaagcaggaggtgagagaggccaacaagtacttcttcatcgagagctgcatcgccctgttcgtgagcttcatcatcaacgtgttcgtggtgagcgtgttcgccgaggccttcttcggcaagaccaacgagcaggtggtggaggtgtgcaccaacaccagcagcccccacgccggcctgttccccaaggacaacagcaccctggccgtggacatctacaagggcggcgtggtgctgggctgctacttcggccccgccgccctgtacatctgggccgtgggcatcctggccgccggccagagcagcaccatgaccggcacctacagcggccagttcgtgatggagggcttcctgaacctgaagtggagcagattcgccagagtggtgctgaccagaagcatcgccatcatccccaccctgctggtggccgtgttccaggacgtggagcacctgaccggcatgaacgacttcctgaacgtgctgcagagcctgcagctgcccttcgccctgatccccatcctgaccttcaccagcctgagacccgtgatgagcgacttcgccaacggcctgggctggagaatcgccggcggcatcctggtgctgatcatctgcagcatcaacatgtacttcgtggtggtgtacgtgagagacctgggccacgtggccctgtacgtggtggccgccgtggtgagcgtggcctacctgggcttcgtgttctacctgggctggcagtgcctgatcgccctgggcatgagcttcctggactgcggccacaccgtgagcatcagcaagggcctgctgaccgaggaggccaccagaggctacgtgaagtag

SEQ ID NO: 22118 - DNA, 1773 bp, Artificial Sequence
  Description of Artificial Sequence: Synthetic coding sequence
atgagaaagaagcagctgaagaccgaggccgccccccactgcgagctgaagagctacagcaagaacagcgccacccaggtgagcaccatggtgctgggccccgagcagaagatgagcgacgacagcgtgagcggcgaccacggcgagagcgccagcctgggcaacatcaaccccgcctacagcaaccccagcctgagccagagccccggcgacagcgaggagtacttcgccacctacttcaacgagaagatcagcatccccgaggaggagtacagctgcttcagcttcagaaagctgtgggccttcaccggccccggcttcctgatgagcatcgcctacctggaccccggcaacatcgagagcgacctgcagagcggcgccgtggccggcttcaagctgctgtggatcctgctgctggccaccctggtgggcctgctgctgcagagactggccgccagactgggcgtggtgaccggcctgcacctggccgaggtgtgccacagacagtaccccaaggtgcccagagtgatcctgtggctgatggtggagctggccatcatcggcagcgacatgcaggaggtgatcggcagcgccatcgccatcaacctgctgagcgtgggcagaatccccctgtggggcggcgtgctgatcaccatcgccgacaccttcgtgttcctgttcctggacaagtacggcctgagaaagctggaggccttcttcggcttcctgatcaccatcatggccctgaccttcggctacgagtacgtgaccgtgaagcccagccagagccaggtgctgaagggcatgttcgtgcccagctgcagcggctgcagaaccccccagatcgagcaggccgtgggcatcgtgggcgccgtgatcatgccccacaacatgtacctgcacagcgccctggtgaagagcagacaggtgaacagaaacaacaagcaggaggtgagagaggccaacaagtacttcttcatcgagagctgcatcgccctgttcgtgagcttcatcatcaacgtgttcgtggtgagcgtgttcgccgaggccttcttcggcaagaccaacgagcaggtggtggaggtgtgcaccaacaccagcagcccccacgccggcctgttccccaaggacaacagcaccctggccgtggacatctacaagggcggcgtggtgctgggctgctacttcggccccgccgccctgtacatctgggccgtgggcatcctggccgccggccagagcagcaccatgaccggcacctacagcggccagttcgtgatggagggcttcctgaacctgaagtggagcagattcgccagagtggtgctgaccagaagcatcgccatcatccccaccctgctggtggccgtgttccaggacgtggagcacctgaccggcatgaacgacttcctgaacgtgctgcagagcctgcagctgcccttcgccctgatccccatcctgaccttcaccagcctgagacccgtgatgagcgacttcgccaacggcctgggctggagaatcgccggcggcatcctggtgctgatcatctgcagcatcaacatgtacttcgtggtggtgtacgtgagagacctgggccacgtggccctgtacgtggtggccgccgtggtgagcgtggcctacctgggcttcgtgttctacctgggctggcagtgcctgatcgccctgggcatgagcttcctggactgcggccacaccgtgagcatcagcaagggcctgctgaccgaggaggccaccagaggctacgtgaagtag

SEQ ID NO: 22119 - DNA, 1686 bp, Artificial Sequence; identical to SEQ ID NO: 22117
  Description of Artificial Sequence: Synthetic coding sequence

SEQ ID NO: 22120 - DNA, 1674 bp, Artificial Sequence
  Description of Artificial Sequence: Synthetic coding sequence
atgagcaccgtggactacctgaacagcgtgagcggcgaccacggcgagagcgccagcctgggcaacatcaaccccgcctacagcaaccccagcctgagccagagccccggcgacagcgaggagtacttcgccacctacttcaacgagaagatcagcatccccgaggaggagtacagctgcttcagcttcagaaagctgtgggccttcaccggccccggcttcctgatgagcatcgcctacctggaccccggcaacatcgagagcgacctgcagagcggcgccgtggccggcttcaagctgctgtggatcctgctgctggccaccctggtgggcctgctgctgcagagactggccgccagactgggcgtggtgaccggcctgcacctggccgaggtgtgccacagacagtaccccaaggtgcccagagtgatcctgtggctgatggtggagctggccatcatcggcagcgacatgcaggaggtgatcggcagcgccatcgccatcaacctgctgagcgtgggcagaatccccctgtggggcggcgtgctgatcaccatcgccgacaccttcgtgttcctgttcctggacaagtacggcctgagaaagctggaggccttcttcggcttcctgatcaccatcatggccctgaccttcggctacgagtacgtgaccgtgaagcccagccagagccaggtgctgaagggcatgttcgtgcccagctgcagcggctgcagaaccccccagatcgagcaggccgtgggcatcgtgggcgccgtgatcatgccccacaacatgtacctgcacagcgccctggtgaagagcagacaggtgaacagaaacaacaagcaggaggtgagagaggccaacaagtacttcttcatcgagagctgcatcgccctgttcgtgagcttcatcatcaacgtgttcgtggtgagcgtgttcgccgaggccttcttcggcaagaccaacgagcaggtggtggaggtgtgcaccaacaccagcagcccccacgccggcctgttccccaaggacaacagcaccctggccgtggacatctacaagggcggcgtggtgctgggctgctacttcggccccgccgccctgtacatctgggccgtgggcatcctggccgccggccagagcagcaccatgaccggcacctacagcggccagttcgtgatggagggcttcctgaacctgaagtggagcagattcgccagagtggtgctgaccagaagcatcgccatcatccccaccctgctggtggccgtgttccaggacgtggagcacctgaccggcatgaacgacttcctgaacgtgctgcagagcctgcagctgcccttcgccctgatccccatcctgaccttcaccagcctgagacccgtgatgagcgacttcgccaacggcctgggctggagaatcgccggcggcatcctggtgctgatcatctgcagcatcaacatgtacttcgtggtggtgtacgtgagagacctgggccacgtggccctgtacgtggtggccgccgtggtgagcgtggcctacctgggcttcgtgttctacctgggctggcagtgcctgatcgccctgggcatgagcttcctggactgcggccacaccgtgagcatcagcaagggcctgctgaccgaggaggccaccagaggctacgtgaagtag

SEQ ID NO: 22121 - DNA, 1707 bp, Artificial Sequence; identical to SEQ ID NO: 22116
  Description of Artificial Sequence: Synthetic coding sequence

SEQ ID NO: 22122 - DNA, 1449 bp, Artificial Sequence
  Description of Artificial Sequence: Synthetic coding sequence
atgagcatcgcctacctggaccccggcaacatcgagagcgacctgcagagcggcgccgtggccggcttcaagctgctgtggatcctgctgctggccaccctggtgggcctgctgctgcagagactggccgccagactgggcgtggtgaccggcctgcacctggccgaggtgtgccacagacagtaccccaaggtgcccagagtgatcctgtggctgatggtggagctggccatcatcggcagcgacatgcaggaggtgatcggcagcgccatcgccatcaacctgctgagcgtgggcagaatccccctgtggggcggcgtgctgatcaccatcgccgacaccttcgtgttcctgttcctggacaagtacggcctgagaaagctggaggccttcttcggcttcctgatcaccatcatggccctgaccttcggctacgagtacgtgaccgtgaagcccagccagagccaggtgctgaagggcatgttcgtgcccagctgcagcggctgcagaaccccccagatcgagcaggccgtgggcatcgtgggcgccgtgatcatgccccacaacatgtacctgcacagcgccctggtgaagagcagacaggtgaacagaaacaacaagcaggaggtgagagaggccaacaagtacttcttcatcgagagctgcatcgccctgttcgtgagcttcatcatcaacgtgttcgtggtgagcgtgttcgccgaggccttcttcggcaagaccaacgagcaggtggtggaggtgtgcaccaacaccagcagcccccacgccggcctgttccccaaggacaacagcaccctggccgtggacatctacaagggcggcgtggtgctgggctgctacttcggccccgccgccctgtacatctgggccgtgggcatcctggccgccggccagagcagcaccatgaccggcacctacagcggccagttcgtgatggagggcttcctgaacctgaagtggagcagattcgccagagtggtgctgaccagaagcatcgccatcatccccaccctgctggtggccgtgttccaggacgtggagcacctgaccggcatgaacgacttcctgaacgtgctgcagagcctgcagctgcccttcgccctgatccccatcctgaccttcaccagcctgagacccgtgatgagcgacttcgccaacggcctgggctggagaatcgccggcggcatcctggtgctgatcatctgcagcatcaacatgtacttcgtggtggtgtacgtgagagacctgggccacgtggccctgtacgtggtggccgccgtggtgagcgtggcctacctgggcttcgtgttctacctgggctggcagtgcctgatcgccctgggcatgagcttcctggactgcggccacaccgtgagcatcagcaagggcctgctgaccgaggaggccaccagaggctacgtgaagtag

SEQ ID NO: 22123 - DNA, 1707 bp, Artificial Sequence; identical to SEQ ID NO: 22116
  Description of Artificial Sequence: Synthetic coding sequence

SEQ ID NO: 22124 - DNA, 1773 bp, Artificial Sequence; identical to SEQ ID NO: 22118
  Description of Artificial Sequence: Synthetic coding sequence

SEQ ID NO: 22125 - DNA, 12 bp, Artificial Sequence
  Description of Artificial Sequence: Synthetic coding sequence
atggtgctgtag

SEQ ID NO: 22126 - DNA, 450 bp, Artificial Sequence
  Description of Artificial Sequence: Synthetic coding sequence
atggtgctgggccccgagcagaagatgagcgacgacagcgtgagcggcgaccacggcgagagcgccagcctgggcaacatcaaccccgcctacagcaaccccagcctgagccagagccccggcgacagcgaggagtacttcgccacctacttcaacgagaagatcagcatccccgaggaggagtacagctgcttcagcttcagaaagctgtgggccttcaccggccccggcttcctgatgagcatcgcctacctggaccccggcaacatcgagagcgacctgcagagcggcgccgtggccggcttcaagctgctgtggatcctgctgctggccaccctggtgggcctgctgctgcagagactggccgccagactgggcgtggtgaccggcctgcacctggccgaggtgtgccacagacagtaccccaaggtgcccagagtgatcctgtag

SEQ ID NO: 22127 - DNA, 2145 bp, Artificial Sequence
  Description of Artificial Sequence: Synthetic coding sequence
atgacccagatgagccaggtgcaggagctgttccacgaggccgcccagcaggacgccctggcccagccccagccctggtggaagacccagctgttcatgtgggagcccgtgctgttcggcacctgggacggcgtgttcaccagctgcatgatcaacatcttcggcgtggtgctgttcctgagaaccggctggctggtgggcaacaccggcgtgctgctgggcatgttcctggtgagcttcgtgatcctggtggccctggtgaccgtgctgagcggcatcggcgtgggcgagagaagcagcatcggcagcggcggcgtgtacagcatgatcagcagcgtgctgggcggccagaccggcggcaccatcggcctgctgtacgtgttcggccagtgcgtggccggcgccatgtacatcaccggcttcgccgagagcatcagcgacctgctgggcctgggcaacatctgggccgtgagaggcatcagcgtggccgtgctgctggccctgctgggcatcaacctggccggcgtgaagtggatcatcagactgcagctgctgctgctgttcctgctggccgtgagcaccctggacttcgtggtgggcagcttcacccacctggaccccgagcacggcttcatcggctacagccccgagctgctgcagaacaacaccctgcccgactacagccccggcgagagcttcttcaccgtgttcggcgtgttcttccccgccgccaccggcgtgatggccggcttcaacatgggcggcgacctgagagagcccgccgccagcatcccccccggcagcctggccgccgtgggcatcagctggttcctgtacatcatcttcgtgttcctgctgggcgccatctgcaccagagaggccctgagatacgacttcctgatcgccgagaaggtgagcctgatgggcttcctgttcctgctgggcctgtacatcagcagcctggccagctgcatgggcggcctgtacggcgcccccagaatcctgcagtgcatcgcccaggagaaggtgatccccgccctggcctgcctgggccagggcaagggccccaacaagacccccgtggccgccatctgcctgaccagcctggtgaccatggccttcgtgttcgtgggccaggtgaacgtgctggcccccatcgtgaccatcaacttcatgctgacctacgtggccgtggactacagctacttcagcctgagcatgtgcagctgcagcctgacccccgtgcccgagcccgtgctgagagagggcgccgagggcctgcactgcagcgagcacctgctgctggagaaggcccccagctacggcagcgagggccccgcccagagagtgctggagggcaccctgctggagttcaccaaggacatggaccagctgctgcagctgaccagaaagctggagagcagccagcccagacagggcgagggcaacagaacccccgagagccagaagagaaagagcaagaaggccaccaagcagaccctgcaggacagcttcctgctggacctgaagagcccccccagcttccccgtggagatcagcgacagactgcccgccgccagctgggagggccaggagagctgctggaacaagcagaccagcaagagcgagggcacccagcccgagggcacctacggcgagcagctggtgcccgagctgtgcaaccagagcgagagcagcggcgaggacttcttcctgaagagcagactgcaggagcaggacgtgtggagaagaagcaccagcttctacacccacatgtgcaacccctgggtgagcctgctgggcgccgtgggcagcctgctgatcatgttcgtgatccagtgggtgtacaccctggtgaacatgggcgtggccgccatcgtgtacttctacatcggcagagccagccccggcctgcacctgggcagcgccagcaacttcagcttcttcagatggatgagaagcctgctgctgcccagctgcagaagcctgagaagcccccaggagcagatcatcctggcccccagcctggccaaggtggacatggagatgacccagctgacccaggagaacgccgacttcgccaccagagacagataccaccacagcagcctggtgaacagagagcagctgatgccccactactag

SEQ ID NO: 22128 - DNA, 2145 bp, Artificial Sequence; identical to SEQ ID NO: 22127
  Description of Artificial Sequence: Synthetic coding sequence

SEQ ID NO: 22129 - DNA, 1617 bp, Artificial Sequence
  Description of Artificial Sequence: Synthetic coding sequence
atggccagcgagagcagccccctgctggcctacagactgctgggcgaggagggcgtggccctgcccgccaacggcgccggcggccccggcggcgccagcgccagaaagctgagcaccttcctgggcgtggtggtgcccaccgtgctgagcatgttcagcatcgtggtgttcctgagaatcgacgccaccggccccagcggcctgagagtgctgccccagggctacggctggaacctgctgtacggcagcctgctgctgggcctggtgggcggcgtgtgcaccctgggcgccggcctgtacgccagagccagcttcctgaccttcctgctggtgagcggcagcctggccagcgtgctgatcagcttcgtggccgtgggccccagagacatcagactgacccccagacccggccccaacggcagcagcctgccccccagattcggccacttcaccggcttcaacagcagcaccctgaaggacaacctgggcgccggctacgccgaggactacaccaccggcgccgtgatgaacttcgccagcgtgttcgccgtgctgttcaacggctgcaccggcatcatggccggcgccaacatgagcggcgagctgaaggaccccagcagagccatccccctgggcaccatcgtggccgtggcctacaccttcttcgtgtacgtgctgctgttcttcctgagcagcttcacctgcgacagaaccctgctgcaggaggactacggcttcttcagagccatcagcctgtggccccccctggtgctgatcggcatctacgccaccgccctgagcgccagcatgagcagcctgatcggcgccagcagaatcctgcacgccctggccagagacgacctgttcggcgtgatcctggcccccgccaaggtggtgagcagaggcggcaacccctgggccgccgtgctgtacagctggggcctggtgcagctggtgctgctggccggcaagctgaacaccctggccgccgtggtgaccgtgttctacctggtggcctacgccgccgtggacctgagctgcctgagcctggagtgggccagcgcccccaacttcagacccaccttcagcctgttcagctggcacacctgcctgctgggcgtggccagctgcctgctgatgatgttcctgatcagccccggcgccgccggcggcagcctgctgctgatgggcctgctggccgccctgctgaccgccagaggcggccccagcagctggggctacgtgagccaggccctgctgttccaccaggtgagaaagtacctgctgagactggacgtgagaaaggaccacgtgaagttctggagaccccagctgctgctgctggtgggcaaccccagaggcgccctgcccctgctgagactggccaaccagctgaagaagggcggcctgtacgtgctgggccacgtgaccctgggcgacctggacagcctgcccagcgaccccgtgcagccccagtacggcgcctggctgagcctggtggacagagcccaggtgaaggccttcgtggacctgaccctgagccccagcgtgagacagggcgcccagcacctgctgagaatcagcggcctggagagcaacagccaccccctgccctag

SEQ ID NO: 22130 - DNA, 2745 bp, Artificial Sequence
  Description of Artificial Sequence: Synthetic coding sequence
atggccagcgagagcagccccctgctggcctacagactgctgggcgaggagggcgtggccctgcccgccaacggcgccggcggccccggcggcgccagcgccagaaagctgagcaccttcctgggcgtggtggtgcccaccgtgctgagcatgttcagcatcgtggtgttcctgagaatcggcttcgtggtgggccacgccggcctgctgcaggccctggccatgctgctggtggcctacttcatcctggccctgaccgtgctgagcgtgtgcgccatcgccaccaacggcgccgtgcagggcggcggcgcctacttcatgatcagcagaaccctgggccccgaggtgggcggcagcatcggcctgatgttctacctggccaacgtgtgcggctgcgccgtgagcctgctgggcctggtggagagcgtgctggacgtgttcggcgccgacgccaccggccccagcggcctgagagtgctgccccagggctacggctggaacctgctgtacggcagcctgctgctgggcctggtgggcggcgtgtgcaccctgggcgccggcctgtacgccagagccagcttcctgaccttcctgctggtgagcggcagcctggccagcgtgctgatcagcttcgtggccgtgggccccagagacatcagactgacccccagacccggccccaacggcagcagcctgccccccagattcggccacttcaccggcttcaacagcagcaccctgaaggacaacctgggcgccggctacgccgaggactacaccaccggcgccgtgatgaacttcgccagcgtgttcgccgtgctgttcaacggctgcaccggcatcatggccggcgccaacatgagcggcgagctgaaggaccccagcagagccatccccctgggcaccatcgtggccgtggcctacaccttcttcgtgtacgtgctgctgttcttcctgagcagcttcacctgcgacagaaccctgctgcaggaggactacggcttcttcagagccatcagcctgtggccccccctggtgctgatcggcatctacgccaccgccctgagcgccagcatgagcagcctgatcggcgccagcagaatcctgcacgccctggccagagacgacctgttcggcgtgatcctggcccccgccaaggtggtgagcagaggcggcaacccctgggccgccgtgctgtacagctggggcctggtgcagctggtgctgctggccggcaagctgaacaccctggccgccgtggtgaccgtgttctacctggtggcctacgccgccgtggacctgagctgcctgagcctggagtgggccagcgcccccaacttcagacccaccttcagcctgttcagctggcacacctgcctgctgggcgtggccagctgcctgctgatgatgttcctgatcagccccggcgccgccggcggcagcctgctgctgatgggcctgctggccgccctgctgaccgccagaggcggccccagcagctggggctacgtgagccaggccctgctgttccaccaggtgagaaagtacctgctgagactggacgtgagaaaggaccacgtgaagttctggagaccccagctgctgctgctggtgggcaaccccagaggcgccctgcccctgctgagactggccaaccagctgaagaagggcggcctgtacgtgctgggccacgtgaccctgggcgacctggacagcctgcccagcgaccccgtgcagccccagtacggcgcctggctgagcctggtggacagagcccaggtgaaggccttcgtggacctgaccctgagccccagcgtgagacagggcgcccagcacctgctgagaatcagcggcctgggcggcatgaagcccaacaccctggtgctgggcttctacgacgacgcccccccccaggaccacttcctgaccgaccccgccttcagcgagcccgccgacagcaccagagagggcagcagccccgccctgagcaccctgttccccccccccagagcccccggcagccccagagccctgaacccccaggactacgtggccaccgtggccgacgccctgaagatgaacaagaacgtggtgctggccagagccagcggcgccctgccccccgagagactgagcagaggcagcggcggcaccagccagctgcaccacgtggacgtgtggcccctgaacctgctgagacccagaggcggccccggctacgtggacgtgtgcggcctgttcctgctgcagatggccaccatcctgggcatggtgcccgcctggcacagcgccagactgagaatcttcctgtgcctgggccccagagaggcccccggcgccgccgagggcagactgagagccctgctgagccagctgagaatcagagccgaggtgcaggaggtggtgtggggcgagggcgccggcgccggcgagcccgaggccgaggaggagggcgacttcgtgaacagcggcagaggcgacgccgaggccgaggccctggccagaagcgccaacgccctggtgagagcccagcagggcagaggcaccggcggcggccccggcggccccgagggcggcgacgccgagggccccatcaccgccctgaccttcctgtacctgcccagaccccccgccgaccccgccagataccccagatacctggccctgctggagaccctgaccagagacctgggccccaccctgctggtgcacggcgtgacccccgtgacctgcaccgacctgtag

SEQ ID NO: 22131 - DNA, 1617 bp, Artificial Sequence; identical to SEQ ID NO: 22129
  Description of Artificial Sequence: Synthetic coding sequence

SEQ ID NO: 22132 - DNA, 1884 bp, Artificial Sequence
  Description of Artificial Sequence: Synthetic coding sequence
atggccagcgagagcagccccctgctggcctacagactgctgggcgaggagggcgtggccctgcccgccaacggcgccggcggccccggcggcgccagcgccagaaagctgagcaccttcctgggcgtggtggtgcccaccgtgctgagcatgttcagcatcgtggtgttcctgagaatcggcttcgtggtgggccacgccggcctgctgcaggccctggccatgctgctggtggcctacttcatcctggccctgaccgtgctgagcgtgtgcgccatcgccaccaacggcgccgtgcagggcggcggcgcctacttcatgatcagcagaaccctgggccccgaggtgggcggcagcatcggcctgatgttctacctggccaacgtgtgcggctgcgccgtgagcctgctgggcctggtggagagcgtgctggacgtgttcggcgccgacgccaccggccccagcggcctgagagtgctgccccagggctacggctggaacctgctgtacggcagcctgctgctgggcctggtgggcggcgtgtgcaccctgggcgccggcctgtacgccagagccagcttcctgaccttcctgctggtgagcggcagcctggccagcgtgctgatcagcttcgtggccgtgggccccagagacatcagactgacccccagacccggccccaacggcagcagcctgccccccagattcggccacttcaccggcttcaacagcagcaccctgaaggacaacctgggcgccggctacgccgaggactacaccaccggcgccgtgatgaacttcgccagcgtgttcgccgtgctgttcaacggctgcaccggcatcatggccggcgccaacatgagcggcgagctgaaggaccccagcagagccatccccctgggcaccatcgtggccgtggcctacaccttcttcgtgtacgtgctgctgttcttcctgagcagcttcacctgcgacagaaccctgctgcaggaggactacggcttcttcagagccatcagcctgtggccccccctggtgctgatcggcatctacgccaccgccctgagcgccagcatgagcagcctgatcggcgccagcagaatcctgcacgccctggccagagacgacctgttcggcgtgatcctggcccccgccaaggtggtgagcagaggcggcaacccctgggccgccgtgctgtacagctggggcctggtgcagctggtgctgctggccggcaagctgaacaccctggccgccgtggtgaccgtgttctacctggtggcctacgccgccgtggacctgagctgcctgagcctggagtgggccagcgcccccaacttcagacccaccttcagcctgttcagctggcacacctgcctgctgggcgtggccagctgcctgctgatgatgttcctgatcagccccggcgccgccggcggcagcctgctgctgatgggcctgctggccgccctgctgaccgccagaggcggccccagcagctggggctacgtgagccaggccctgctgttccaccaggtgagaaagtacctgctgagactggacgtgagaaaggaccacgtgaagttctggagaccccagctgctgctgctggtgggcaaccccagaggcgccctgcccctgctgagactggccaaccagctgaagaagggcggcctgtacgtgctgggccacgtgaccctgggcgacctggacagcctgcccagcgaccccgtgcagccccagtacggcgcctggctgagcctggtggacagagcccaggtgaaggccttcgtggacctgaccctgagccccagcgtgagacagggcgcccagcacctgctgagaatcagcggcctggagagcaacagccaccccctgccctag

SEQ ID NO: 22133 - DNA, 390 bp, Artificial Sequence
  Description of Artificial Sequence: Synthetic coding sequence
atggccagcgagagcagccccctgctggcctacagactgctgggcgaggagggcgtggccctgcccgccaacggcgccggcggccccggcggcgccagcgccagaaagctgagcaccttcctgggcgtggtggtgcccaccgtgctgagcatgttcagcatcgtggtgttcctgagaatcggcttcgtggtgggccacgccggcctgctgcaggccctggccatgctgctggtggcctacttcatcctggccctgaccgtgctgagcgtgtgcgccatcgccaccaacggcgccgtgcagggcggcggcgcctacttcatgatcagcagaaccctgggccccgaggtgggcggcagcatcggcctgatgttctacctggccaacgtgtag

SEQ ID NO: 22134 - DNA, 1461 bp, Artificial Sequence
  Description of Artificial Sequence: Synthetic coding sequence
cacttcggcgtgcactggcacagcctggtgttcaccggcatcctgggcgtgcactggcacttcggcaccaccgccagactgctggccctggcccagctggtgctgctggccggcaagctgaacaccctggccgccgtggtgaccgtgttctacctggtggcctacgccgccgtggacctgagctgcctgagcctggagtgggccagcgcccccaacttcagacccaccttcagcctgttcagctggcacacctgcctgctgggcgtggccagctgcctgctgatgatgttcctgatcagccccggcgccgccggcggcagcctgctgctgatgggcctgctggccgccctgctgaccgccagaggcggccccagcagctggggctacgtgagccaggccctgctgttccaccaggtgagaaagtacctgctgagactggacgtgagaaaggaccacgtgaagttctggagaccccagctgctgctgctggtgggcaaccccagaggcgccctgcccctgctgagactggccaaccagctgaagaagggcggcctgtacgtgctgggccacgtgaccctgggcgacctggacagcctgcccagcgaccccgtgcagccccagtacggcgcctggctgagcctggtggacagagcccaggtgaaggccttcgtggacctgaccctgagccccagcgtgagacagggcgcccagcacctgctgagaatcagcggcctgggcggcatgaagcccaacaccctggtgctgggcttctacgacgacgcccccccccaggaccacttcctgaccgaccccgccttcagcgagcccgccgacagcaccagagagggcagcagccccgccctgagcaccctgttccccccccccagagcccccggcagccccagagccctgaacccccaggactacgtggccaccgtggccgacgccctgaagatgaacaagaacgtggtgctggccagagccagcggcgccctgccccccgagagactgagcagaggcagcggcggcaccagccagctgcaccacgtggacgtgtggcccctgaacctgctgagacccagaggcggccccggctacgtggacgtgtgcggcctgttcctgctgcagatggccaccatcctgggcatggtgcccgcctggcacagcgccagactgagaatcttcctgtgcctgggccccagagaggcccccggcgccgccgagggcagactgagagccctgctgagccagctgagaatcagagccgaggtgcaggaggtggtgtggggcgagggcgccggcgccggcgagcccgaggccgaggaggagggcgacttcgtgaacagcggcagaggcgacgccgaggccgaggccctggccagaagcgccaacgccctggtgagagcccagcagggcagacacagaagaagagccggctgggccggcggctggggctgctag

SEQ ID NO: 22135 - DNA, 1896 bp, Artificial Sequence
  Description of Artificial Sequence: Synthetic coding sequence
atggccagcgagagcagccccctgctggcctacagactgctgggcgaggagggcgtggccctgcccgccaacggcgccggcggccccggcggcgccagcgccagaaagctgagcaccttcctgggcgtggtggtgcccaccgtgctgagcatgttcagcatcgtggtgttcctgagaatcggcttcgtggtgggccacgccggcctgctgcaggccctggccatgctgctggtggcctacttcatcctggccctgaccgtgctgagcgtgtgcgccatcgccaccaacggcgccgtgcagggcggcggcgcctacttcatgatcagcagaaccctgggccccgaggtgggcggcagcatcggcctgatgttctacctggccaacgtgtgcggctgcgccgtgagcctgctgggcctggtggagagcgtgctggacgtgttcggcgccgacgccaccggccccagcggcctgagagtgctgccccagggctacggctggaacctgctgtacggcagcctgctgctgggcctggtgggcggcgtgtgcaccctgggcgccggcctgtacgccagagccagcttcctgaccttcctgctggtgagcggcagcctggccagcgtgctgatcagcttcgtggccgtgggccccagagacatcagactgacccccagacccggccccaacggcagcagcctgccccccagattcggccacttcaccggcttcaacagcagcaccctgaaggacaacctgggcgccggctacgccgaggactacaccaccggcgccgtgatgaacttcgccagcgtgttcgccgtgctgttcaacggctgcaccggcatcatggccggcgccaacatgagcggcgagctgaaggaccccagcagagccatccccctgggcaccatcgtggccgtggcctacaccttcttcgtgtacgtgctgctgttcttcctgagcagcttcacctgcgacagaaccctgctgcaggaggactacggcttcttcagagccatcagcctgtggccccccctggtgctgatcggcatctacgccaccgccctgagcgccagcatgagcagcctgatcggcgccagcagaatcctgcacgccctggccagagacgacctgttcggcgtgatcctggcccccgccaaggtggtgagcagaggcggcaacccctgggccgccgtgctgtacagctggggcctggtgcagctggtgctgctggccggcaagctgaacaccctggccgccgtggtgaccgtgttctacctggtggcctacgccgccgtggacctgagctgcctgagcctggagtgggccagcgcccccaacttcagacccaccttcagcctgttcagctggcacacctgcctgctgggcgtggccagctgcctgctgatgatgttcctgatcagccccggcgccgccggcggcagcctgctgctgatgggcctgctggccgccctgctgaccgccagaggcggccccagcagctggggctacgtgagccaggccctgctgttccaccaggtgagaaagtacctgctgagactggacgtgagaaaggaccacgtgaagttctggagaccccagctgctgctgctggtgggcaaccccagaggcgccctgcccctgctgagactggccaaccagctgaagaagggcggcctgtacgtgctgggccacgtgaccctgggcgacctggacagcctgcccagcgaccccgtgcagccccagtacggcgcctggctgagcctggtggacagagcccaggtgaaggccttcgtggacctgaccctgagccccagcgtgagacagggcgcccagcacctgctgagaatcagcggcctggagagcggcaccctgctgccctggggcttcagaagctag

SEQ ID NO: 22136 - DNA, 2097 bp, Artificial Sequence
  Description of Artificial Sequence: Synthetic coding sequence
atgaaccccttccagaagaacgagagcaaggagaccctgttcagccccgtgagcatcgaggaggtgccccccagaccccccagcccccccaagaagcccagccccaccatctgcggcagcaactaccccctgagcatcgccttcatcgtggtgaacgagttctgcgagagattcagctactacggcatgaaggccgtgctgatcctgtacttcctgtacttcctgcactggaacgaggacaccagcaccagcatctaccacgccttcagcagcctgtgctacttcacccccatcctgggcgccgccatcgccgacagctggctgggcaagttcaaggtgctgagcctgatcggcctgagcctgatcgccctgggcaccggcggcatcaagccctgcgtggccgccttcggcggcgaccagttcgaggagaagcacgccgaggagagaaccagatacttcagcgtgttctacctgagcatcaacgccggcagcctgatcagcaccttcatcacccccatgctgagaggcgacgtgcagtgcttcggcgaggactgctacgccctggccttcggcgtgcccggcctgctgatggtgatcgccctggtggtgttcgccatgggcagcaagatctacaacaagcccccccccgagggcaacatcgtggcccaggtgttcaagtgcatctggttcgccatcagcaacagattcaagaacagaagcggcgacatccccaagagacagcactggctggactgggccgccgagaagtaccccaagcagctgatcatggacgtgaaggccctgaccagagtgctgttcctgtacatccccctgcccatgttctgggccctgctggaccagcagggcagcagatggaccctgcaggccatcagaatgaacagaaacctgggcttcttcgtgctgcagcccgaccagatgcaggtgctgaaccccctgctggtgctgatcttcatccccctgttcgacttcgtgatctacagactggtgagcaagtgcggcatcaacttcagcagcctgagaaagatggccgtgggcatgatcctggcctgcctggccttcgccgtggccgccgccgtggagatcaagatcaacgagatggcccccgcccagcccggcccccaggaggtgttcctgcaggtgctgaacctggccgacgacgaggtgaaggtgaccgtggtgggcaacgagaacaacagcctgctgatcgagagcatcaagagcttccagaagaccccccactacagcaagctgcacctgaagaccaagagccaggacttccacttccacctgaagtaccacaacctgagcctgtacaccgagcacagcgtgcaggagaagaactggtacagcctggtgatcagagaggacggcaacagcatcagcagcatgatggtgaaggacaccgagagcagaaccaccaacggcatgaccaccgtgagattcgtgaacaccctgcacaaggacgtgaacatcagcctgagcaccgacaccagcctgaacgtgggcgaggactacggcgtgagcgcctacagaaccgtgcagagaggcgagtaccccgccgtgcactgcagaaccgaggacaagaacttcagcctgaacctgggcctgctggacttcggcgccgcctacctgttcgtgatcaccaacaacaccaaccagggcctgcaggcctggaagatcgaggacatccccgccaacaagatgagcatcgcctggcagctgccccagtacgccctggtgaccgccggcgaggtgatgttcagcgtgaccggcctggagttcagctacagccaggcccccagcagcatgaagagcgtgctgcaggccgcctggctgctgaccatcgccgtgggcaacatcatcgtgctggtggtggcccagttcagcggcctggtgcagtgggccgagttcatcctgttcagctgcctgctgctggtgatctgcctgatcttcagcatcatgggctactactacgtgcccgtgaagaccgaggacatgagaggccccgccgacaagcacatcccccacatccagggcaacatgatcaagctggagaccaagaagaccaagctgtag

SEQ ID NO: 22137 - DNA, 2190 bp, Artificial Sequence
  Description of Artificial Sequence: Synthetic coding sequence
atgaaccccttccagaagaacgagagcaaggagaccctgttcagccccgtgagcatcgaggaggtgccccccagaccccccagcccccccaagaagcccagccccaccatctgcggcagcaactaccccctgagcatcgccttcatcgtggtgaacgagttctgcgagagattcagctactacggcatgaaggccgtgctgatcctgtacttcctgtacttcctgcactggaacgaggacaccagcaccagcatctaccacgccttcagcagcctgtgctacttcacccccatcctgggcgccgccatcgccgacagctggctgggcaagttcaagaccatcatctacctgagcctggtgtacgtgctgggccacgtgatcaagagcctgggcgccctgcccatcctgggcggccaggtggtgcacaccgtgctgagcctgatcggcctgagcctgatcgccctgggcaccggcggcatcaagccctgcgtggccgccttcggcggcgaccagttcgaggagaagcacgccgaggagagaaccagatacttcagcgtgttctacctgagcatcaacgccggcagcctgatcagcaccttcatcacccccatgctgagaggcgacgtgcagtgcttcggcgaggactgctacgccctggccttcggcgtgcccggcctgctgatggtgatcgccctggtggtgttcgccatgggcagcaagatctacaacaagcccccccccgagggcaacatcgtggcccaggtgttcaagtgcatctggttcgccatcagcaacagattcaagaacagaagcggcgacatccccaagagacagcactggctggactgggccgccgagaagtaccccaagcagctgatcatggacgtgaaggccctgaccagagtgctgttcctgtacatccccctgcccatgttctgggccctgctggaccagcagggcagcagatggaccctgcaggccatcagaatgaacagaaacctgggcttcttcgtgctgcagcccgaccagatgcaggtgctgaaccccctgctggtgctgatcttcatccccctgttcgacttcgtgatctacagactggtgagcaagtgcggcatcaacttcagcagcctgagaaagatggccgtgggcatgatcctggcctgcctggccttcgccgtggccgccgccgtggagatcaagatcaacgagatggcccccgcccagcccggcccccaggaggtgttcctgcaggtgctgaacctggccgacgacgaggtgaaggtgaccgtggtgggcaacgagaacaacagcctgctgatcgagagcatcaagagcttccagaagaccccccactacagcaagctgcacctgaagaccaagagccaggacttccacttccacctgaagtaccacaacctgagcctgtacaccgagcacagcgtgcaggagaagaactggtacagcctggtgatcagagaggacggcaacagcatcagcagcatgatggtgaaggacaccgagagcagaaccaccaacggcatgaccaccgtgagattcgtgaacaccctgcacaaggacgtgaacatcagcctgagcaccgacaccagcctgaacgtgggcgaggactacggcgtgagcgcctacagaaccgtgcagagaggcgagtaccccgccgtgcactgcagaaccgaggacaagaacttcagcctgaacctgggcctgctggacttcggcgccgcctacctgttcgtgatcaccaacaacaccaaccagggcctgcaggcctggaagatcgaggacatccccgccaacaagatgagcatcgcctggcagctgccccagtacgccctggtgaccgccggcgaggtgatgttcagcgtgaccggcctggagttcagctacagccaggcccccagcagcatgaagagcgtgctgcaggccgcctggctgctgaccatcgccgtgggcaacatcatcgtgctggtggtggcccagttcagcggcctggtgcagtgggccgagttcatcctgttcagctgcctgctgctggtgatctgcctgatcttcagcatcatgggctactactacgtgcccgtgaagaccgaggacatgagaggccccgccgacaagcacatcccccacatccagggcaacatgatcaagctggagaccaagaagaccaagctgtag

SEQ ID NO: 22138 - DNA, 2076 bp, Artificial Sequence
  Description of Artificial Sequence: Synthetic coding sequence
atgagccccagaaagctgttcttccccgtgagcatcgaggaggtgccccccagaccccccagcccccccaagaagcccagccccaccatctgcggcagcaactaccccctgagcatcgccttcatcgtggtgaacgagttctgcgagagattcagctactacggcatgaaggccgtgctgatcctgtacttcctgtacttcctgcactggaacgaggacaccagcaccagcatctaccacgccttcagcagcctgtgctacttcacccccatcctgggcgccgccatcgccgacagctggctgggcaagttcaaggtgctgagcctgatcggcctgagcctgatcgccctgggcaccggcggcatcaagccctgcgtggccgccttcggcggcgaccagttcgaggagaagcacgccgaggagagaaccagatacttcagcgtgttctacctgagcatcaacgccggcagcctgatcagcaccttcatcacccccatgctgagaggcgacgtgcagtgcttcggcgaggactgctacgccctggccttcggcgtgcccggcctgctgatggtgatcgccctggtggtgttcgccatgggcagcaagatctacaacaagcccccccccgagggcaacatcgtggcccaggtgttcaagtgcatctggttcgccatcagcaacagattcaagaacagaagcggcgacatccccaagagacagcactggctggactgggccgccgagaagtaccccaagcagctgatcatggacgtgaaggccctgaccagagtgctgttcctgtacatccccctgcccatgttctgggccctgctggaccagcagggcagcagatggaccctgcaggccatcagaatgaacagaaacctgggcttcttcgtgctgcagcccgaccagatgcaggtgctgaaccccctgctggtgctgatcttcatccccctgttcgacttcgtgatctacagactggtgagcaagtgcggcatcaacttcagcagcctgagaaagatggccgtgggcatgatcctggcctgcctggccttcgccgtggccgccgccgtggagatcaagatcaacgagatggcccccgcccagcccggcccccaggaggtgttcctgcaggtgctgaacctggccgacgacgaggtgaaggtgaccgtggtgggcaacgagaacaacagcctgctgatcgagagcatcaagagcttccagaagaccccccactacagcaagctgcacctgaagaccaagagccaggacttccacttccacctgaagtaccacaacctgagcctgtacaccgagcacagcgtgcaggagaagaactggtacagcctggtgatcagagaggacggcaacagcatcagcagcatgatggtgaaggacaccgagagcagaaccaccaacggcatgaccaccgtgagattcgtgaacaccctgcacaaggacgtgaacatcagcctgagcaccgacaccagcctgaacgtgggcgaggactacggcgtgagcgcctacagaaccgtgcagagaggcgagtaccccgccgtgcactgcagaaccgaggacaagaacttcagcctgaacctgggcctgctggacttcggcgccgcctacctgttcgtgatcaccaacaacaccaaccagggcctgcaggcctggaagatcgaggacatccccgccaacaagatgagcatcgcctggcagctgccccagtacgccctggtgaccgccggcgaggtgatgttcagcgtgaccggcctggagttcagctacagccaggcccccagcagcatgaagagcgtgctgcaggccgcctggctgctgaccatcgccgtgggcaacatcatcgtgctggtggtggcccagttcagcggcctggtgcagtgggccgagttcatcctgttcagctgcctgctgctggtgatctgcctgatcttcagcatcatgggctactactacgtgcccgtgaagaccgaggacatgagaggccccgccgacaagcacatcccccacatccagggcaacatgatcaagctggagaccaagaagaccaagctgtag

SEQ ID NO: 22139 - DNA, 1506 bp, Artificial Sequence
  Description of Artificial Sequence: Synthetic coding sequence
atggccgccagctggagactgggctgcgaccccagactgctgagatacctggtgggcttccccggcagaagaagcgtgggcctggtgaagggcgccctgggctggagcgtgagcagaggcgccaactggagatggttccacagcacccagtggctgagaggcgaccccatcaagatcctgatgcccagcctgagccccaccatggaggagggcaacatcgtgaagtggctgaagaaggagggcgaggccgtgagcgccggcgacgccctgtgcgagatcgagaccgacaaggccgtggtgaccctggacgccagcgacgacggcatcctggccaagatcgtggtggaggagggcagcaagaacatcagactgggcagcctgatcggcctgatcgtggaggagggcgaggactggaagcacgtggagatccccaaggacgtgggcccccccccccccgtgagcaagcccagcgagcccagacccagccccgagccccagatcagcatccccgtgaagaaggagcacatccccggcaccctgagattcagactgagccccgccgccagaaacatcctggagaagcacagcctggacgccagccagggcaccgccaccggccccagaggcatcttcaccaaggaggacgccctgaagctggtgcagctgaagcagaccggcaagatcaccgagagcagacccacccccgcccccaccgccacccccaccgcccccagccccctgcaggccaccgccggccccagctaccccagacccgtgatcccccccgtgagcacccccggccagcccaacgccgtgggcaccttcaccgagatccccgccagcaacatcagaagagtgatcgccaagagactgaccgagagcaagagcaccgtgccccacgcctacgccaccgccgactgcgacctgggcgccgtgctgaaggtgagacaggacctggtgaaggacgacatcaaggtgagcgtgaacgacttcatcatcaaggccgccgccgtgaccctgaagcagatgcccgacgtgaacgtgagctgggacggcgagggccccaagcagctgcccttcatcgacatcagcgtggccgtggccaccgacaagggcctgctgacccccatcatcaaggacgccgccgccaagggcatccaggagatcgccgacagcgtgaaggccctgagcaagaaggccagagacggcaagctgctgcccgaggagtaccagggcggcagcttcagcatcagcaacctgggcatgttcggcatcgacgagttcaccgccgtgatcaaccccccccaggcctgcatcctggccgtgggcagattcagacccgtgctgaagctgaccgaggacgaggagggcaacgccaagctgcagcagagacagctgatcaccgtgaccatgagcagcgacagcagagtggtggacgacgagctggccaccagattcctgaagagcttcaaggccaacctggagaaccccatcagactggcctag

SEQ ID NO: 22140 - DNA, 942 bp, Artificial Sequence
  Description of Artificial Sequence: Synthetic coding sequence
atgcccgcccccagagccagagagcagcccagagtgcccggcgagagacagcccctgctgcccagaggcgccagaggccccagaagatggagaagagccgccggcgccgccgtgctgctggtggagatgctggagagagccgccttcttcggcgtgaccgccaacctggtgctgtacctgaacagcaccaacttcaactggaccggcgagcaggccaccagagccgccctggtgttcctgggcgccagctacctgctggcccccgtgggcggctggctggccgacgtgtacctgggcagatacagagccgtggccctgagcctgctgctgtacctggccgccagcggcctgctgcccgccaccgccttccccgacggcagaagcagcttctgcggcgagatgcccgccagccccctgggccccgcctgccccagcgccggctgccccagaagcagccccagcccctactgcgcccccgtgctgtacgccggcctgctgctgctgggcctggccgccagcagcgtgagaagcaacctgaccagcttcggcgccgaccaggtgatggacctgggcagagacgccaccagaagattcttcaactggttcaccggcgccagcacctgggtgctgtgctgcagatgctggtggtggagactgttcagcagaaccagcgccagctgctgggccaccgccagcctgtgggccgtgtgggcctggcacttcagcagcagcagcctgcccccccccagcagcagccccagccccagatgggccgccaagtgccccctgtgcctgagcagcctgagcaagaccgccgcccccagctgcggcaacgacaccagacccgagaccgtgaacgtgcccgcctgctggcccaccagaggcctgcccagccagggcctgcccagaaagagaaccagccccaccagcagatgctggtag

SEQ ID NO: 22141 - DNA, 1734 bp, Artificial Sequence
  Description of Artificial Sequence: Synthetic coding sequence
atggagggcagcggcggcggcgccggcgagagagcccccctgctgggcgccagaagagccgccgccgccgccgccgccgccggcgccttcgccggcagaagagccgcctgcggcgccgtgctgctgaccgagctgctggagagagccgccttctacggcatcaccagcaacctggtgctgttcctgaacggcgcccccttctgctgggagggcgcccaggccagcgaggccctgctgctgttcatgggcctgacctacctgggcagccccttcggcggctggctggccgacgccagactgggcagagccagagccatcctgctgagcctggccctgtacctgctgggcatgctggccttccccctgctggccgcccccgccaccagagccgccctgtgcggcagcgccagactgctgaactgcaccgcccccggccccgacgccgccgccagatgctgcagccccgccaccttcgccggcctggtgctggtgggcctgggcgtggccaccgtgaaggccaacatcacccccttcggcgccgaccaggtgaaggacagaggccccgaggccaccagaagattcttcaactggttctactggagcatcaacctgggcgccatcctgagcctgggcggcatcgcctacatccagcagaacgtgagcttcgtgaccggctacgccatccccaccgtgtgcgtgggcctggccttcgtggtgttcctgtgcggccagagcgtgttcatcaccaagccccccgacggcagcgccttcaccgacatgttcaagatcctgacctacagctgctgcagccagaagagaagcggcgagagacagagcaacggcgagggcatcggcgtgttccagcagagcagcaagcagagcctgttcgacagctgcaagatgagccacggcggccccttcaccgaggagaaggtggaggacgtgaaggccctggtgaagatcgtgcccgtgttcctggccctgatcccctactggaccgtgtacttccagatgcagaccacctacgtgctgcagagcctgcacctgagaatccccgagatcagcaacatcaccaccaccccccacaccctgcccgccgcctggctgaccatgttcgacgccgtgctgatcctgctgctgatccccctgaaggacaagctggtggaccccatcctgagaagacacggcctgctgcccagcagcctgaagagaatcgccgtgggcatgttcttcgtgatgtgcagcgccttcgccgccggcatcctggagagcaagagactgaacctggtgaaggagaagaccatcaaccagaccatcggcaacgtggtgtaccacgccgccgacctgagcctgtggtggcaggtgccccagtacctgctgatcggcatcagcgagatcttcgccagcatcgccggcctggagttcgcctacagcgccgcccccaagagcatgcagagcgccatcatgggcctgttcttcttcttcagcggcgtgggcagcttcgtgggcagcggcctgctggccctggtgagcatcaaggccatcggctggatgagcagccacaccgacttcggcaacatcaacggctgctacctgaactactacttcttcctgctggccgccatccagggcgccaccctgctgctgttcctgatcatcagcgtgaagtacgaccaccacagagaccaccagagaagcagagccaacggcgtgcccaccagcagaagagcctag

SEQ ID NO: 22142 - DNA, 1320 bp, Artificial Sequence
  Description of Artificial Sequence: Synthetic coding sequence
atgctgaagagagagggcaaggtgcagccctacaccaagaccctggacggcggctggggctggatgatcgtgatccacttcttcctggtgaacgtgttcgtgatgggcatgaccaagaccttcgccatcttcttcgtggtgttccaggaggagttcgagggcaccagcgagcagatcggctggatcggcagcatcatgagcagcctgagattctgcgccggcctgggcagcgccttcctgtaccaggtggccgccgtggtgaccaccaagtacttcaagaagagactggccctgagcaccgccatcgccagaagcggcatgggcctgaccttcctgctggcccccttcaccaagttcctgatcgacctgtacgactggaccggcgccctgatcctgttcggcgccatcgccctgaacctggtgcccagcagcatgctgctgagacccatccacatcaagagcgagaacaacagcggcatcaaggacaagggcagcagcctgagcgcccacggccccgaggcccacgccaccgagacccactgccacgagaccgaggagagcaccatcaaggacagcaccacccagaaggccggcctgcccagcaagaacctgaccgtgagccagaaccagagcgaggagttctacaacggccccaacagaaacagactgctgctgaagagcgacgaggagagcgacaaggtgatcagctggagctgcaagcagctgttcgacatcagcctgttcagaaaccccttcttctacatcttcacctggagcttcctgctgagccagctggcctacttcatccccaccttccacctggtggccagagccaagaccctgggcatcgacatcatggacgccagctacctggtgagcgtggccggcatcctggagaccgtgagccagatcatcagcggctgggtggccgaccagaactggatcaagaagtaccactaccacaagagctacctgatcctgtgcggcatcaccaacctgctggcccccctggccaccaccttccccctgctgatgacctacaccatctgcttcgccatcttcgccggcggctacctggccctgatcctgcccgtgctggtggacctgtgcagaaacagcaccgtgaacagattcctgggcctggccagcttcttcgccggcatggccgtgctgagcggcccccccatcgccggctggctgtacgactacacccagacctacaacggcagcttctacttcagcggcatctgctacctgctgagcagcgtgagcttcttcttcgtgcccctggccgagagatggaagaacagcctgacctag

SEQ ID NO: 22143 - DNA, 1416 bp, Artificial Sequence
  Description of Artificial Sequence: Synthetic coding sequence
atgcccgccccccagagaaagcacagaagaggcggcttcagccacagatgcttccccaccccccagaccgccatgaccccccagcccgccggcccccccgacggcggctggggctgggtggtggccgccgccgccttcgccatcaacggcctgagctacggcctgctgagaagcctgggcctggccttccccgacctggccgagcacttcgacagaagcgcccaggacaccgcctggatcagcgccctggccctggccgtgcagcaggccgccagccccgtgggcagcgccctgagcaccagatggggcgccagacccgtggtgatggtgggcggcgtgctggccagcctgggcttcgtgttcagcgccttcgccagcgacctgctgcacctgtacctgggcctgggcctgctggccggcttcggctgggccctggtgttcgcccccgccctgggcaccctgagcagatacttcagcagaagaagagtgctggccgtgggcctggccctgaccggcaacggcgccagcagcctgctgctggcccccgccctgcagctgctgctggacaccttcggctggagaggcgccctgctgctgctgggcgccatcaccctgcacctgaccccctgcggcgccctgctgctgcccctggtgctgcccggcgacccccccgccccccccagaagccccctggccgccctgggcctgagcctgttcaccagaagagccttcagcatcttcgccctgggcaccgccctggtgggcggcggctacttcgtgccctacgtgcacctggccccccacgccctggacagaggcctgggcggctacggcgccgccctggtggtggccgtggccgccatgggcgacgccggcgccagactggtgtgcggctggctggccgaccagggctgggtgcccctgcccagactgctggccgtgttcggcgccctgaccggcctgggcctgtgggtggtgggcctggtgcccgtggtgggcggcgaggagagctggggcggccccctgctggccgccgccgtggcctacggcctgagcgccggcagctacgcccccctggtgttcggcgtgctgcccggcctggtgggcgtgggcggcgtggtgcaggccaccggcctggtgatgatgctgatgagcctgggcggcctgctgggcccccccctgagcggcttcctgagagacgagaccggcgacttcaccgccagcttcctgctgagcggcagcctgatcctgagcggcagcttcatctacatcggcctgcccagagccctgcccagctgcggccccgccagcccccccgccacccccccccccgagaccggcgagctgctgcccgccccccaggccgtgctgctgagccccggcggccccggcagcaccctggacaccacctgctag

SEQ ID NO: 22144 - DNA, 1320 bp, Artificial Sequence
  Description of Artificial Sequence: Synthetic coding sequence
atgaccccccagcccgccggcccccccgacggcggctggggctgggtggtggccgccgccgccttcgccatcaacggcctgagctacggcctgctgagaagcctgggcctggccttccccgacctggccgagcacttcgacagaagcgcccaggacaccgcctggatcagcgccctggccctggccgtgcagcaggccgccagccccgtgggcagcgccctgagcaccagatggggcgccagacccgtggtgatggtgggcggcgtgctggccagcctgggcttcgtgttcagcgccttcgccagcgacctgctgcacctgtacctgggcctgggcctgctggccggcttcggctgggccctggtgttcgcccccgccctgggcaccctgagcagatacttcagcagaagaagagtgctggccgtgggcctggccctgaccggcaacggcgccagcagcctgctgctggcccccgccctgcagctgctgctggacaccttcggctggagaggcgccctgctgctgctgggcgccatcaccctgcacctgaccccctgcggcgccctgctgctgcccctggtgctgcccggcgacccccccgccccccccagaagccccctggccgccctgggcctgagcctgttcaccagaagagccttcagcatcttcgccctgggcaccgccctggtgggcggcggctacttcgtgccctacgtgcacctggccccccacgccctggacagaggcctgggcggctacggcgccgccctggtggtggccgtggccgccatgggcgacgccggcgccagactggtgtgcggctggctggccgaccagggctgggtgcccctgcccagactgctggccgtgttcggcgccctgaccggcctgggcctgtgggtggtgggcctgagctggggcggccccctgctggccgccgccgtggcctacggcctgagcgccggcagctacgcccccctggtgttcggcgtgctgcccggcctggtgggcgtgggcggcgtggtgcaggccaccggcctggtgatgatgctgatgagcctgggcggcctgctgggcccccccctgagcggcttcctgagagacgagaccggcgacttcaccgccagcttcctgctgagcggcagcctgatcctgagcggcagcttcatctacatcggcctgcccagagccctgcccagctgcggccccgccagcccccccgccacccccccccccgagaccggcgagctgctgcccgccccccaggccgtgctgctgagccccggcggccccggcagcaccctggacaccacctgctag

SEQ ID NO: 22145 - DNA, 1281 bp, Artificial Sequence
  Description of Artificial Sequence: Synthetic coding sequence
atggccagaagaaccgagccccccgacggcggctggggctgggtggtggtgctgagcgccttcttccagagcgccctggtgttcggcgtgctgagaagcttcggcgtgttcttcgtggagttcgtggccgccttcgaggagcaggccgccagagtgagctggatcgccagcatcggcatcgccgtgcagcagttcggcagccccgtgggcagcgccctgagcaccaagttcggccccagacccgtggtgatgaccggcggcatcctggccgccctgggcatgctgctggccagcttcgccaccagcctgacccacctgtacctgagcatcggcctgctgagcggcagcggctgggccctgaccttcgcccccaccctggcctgcctgagctgctacttcagcagaagaagaagcctggccaccggcctggccctgaccggcgtgggcctgagcagcttcaccttcgcccccttcttccagtggctgctgagccactacgcctggagaggcagcctgctgctggtgagcgccctgagcctgcacctggtggcctgcggcgccctgctgagaccccccagcctggccgaggaccccgccgtgggcggccccagagcccagctgaccagcctgctgcaccacggccccttcctgagatacaccgtggccctgaccctgatcaacaccggctacttcatcccctacctgcacctggtggcccacctgcaggacctggactgggaccccctgcccgccgccttcctgctgagcgtggtggccatcagcgacctggtgggcagagtggtgagcggctggctgggcgacgccgtgcccggccccgtgaccagactgctgatgctgtggaccaccctgaccggcgtgagcctggccctgttccccgtggcccaggcccccaccgccctggtggccctggccgtggcctacggcttcaccagcggcgccctggcccccctggccttcagcgtgctgcccgagctgatcggcaccagaagaatctactgcggcctgggcctgctgcagatgatcgagagcatcggcggcctgctgggcccccccctgagcggctacctgagagacgtgaccggcaactacaccgccagcttcgtggtggccggcgccttcctgctgagcggcagcggcatcctgctgaccctgccccacttcttctgcttcagcaccaccaccagcggcccccaggacctggtgaccgaggccctggacaccaaggtgcccctgcccaaggagggcctggaggaggactag

SEQ ID NO: 22146 - DNA, 1533 bp, Artificial Sequence
  Description of Artificial Sequence: Synthetic coding sequence
atgtacaccagccacgaggacatcggctacgacttcgaggacggccccaaggacaagaagaccctgaagccccaccccaacatcgacggcggctgggcctggatgatggtgctgagcagcttcttcgtgcacatcctgatcatgggcagccagatggccctgggcgtgctgaacgtggagtggctggaggagttccaccagagcagaggcctgaccgcctgggtgagcagcctgagcatgggcatcaccctgatcgtgggccccttcatcggcctgttcatcaacacctgcggctgcagacagaccgccatcatcggcggcctggtgaacagcctgggctgggtgctgagcgcctacgccgccaacgtgcactacctgttcatcaccttcggcgtggccgccggcctgggcagcggcatggcctacctgcccgccgtggtgatggtgggcagatacttccagaagagaagagccctggcccagggcctgagcaccaccggcaccggcttcggcaccttcctgatgaccgtgctgctgaagtacctgtgcgccgagtacggctggagaaacgccatgctgatccagggcgccgtgagcctgaacctgtgcgtgtgcggcgccctgatgagacccctgagccccggcaagaaccccaacgaccccggcgagaaggacgtgagaggcctgcccgcccacagcaccgagagcgtgaagagcaccggccagcagggcagaaccgaggagaaggacggcggcctgggcaacgaggagaccctgtgcgacctgcaggcccaggagtgccccgaccaggccggccacagaaagaacatgtgcgccctgagaatcctgaagaccgtgagctggctgaccatgagagtgagaaagggcttcgaggactggtacagcggctacttcggcaccgccagcctgttcaccaacagaatgttcgtggccttcatcttctgggccctgttcgcctacagcagcttcgtgatccccttcatccacctgcccgagatcgtgaacctgtacaacctgagcgagcagaacgacgtgttccccctgaccagcatcatcgccatcgtgcacatcttcggcaaggtgatcctgggcgtgatcgccgacctgccctgcatcagcgtgtggaacgtgttcctgctggccaacttcaccctggtgctgagcatcttcatcctgcccctgatgcacacctacgccggcctggccgtgatctgcgccctgatcggcttcagcagcggctacttcagcctgatgcccgtggtgaccgaggacctggtgggcatcgagcacctggccaacgcctacggcatcatcatctgcgccaacggcatcagcgccctgctgggcccccccttcgccggctggatctacgacatcacccagaagtacgacttcagcttctacatctgcggcctgctgtacatgatcggcatcctgttcctgctgatccagccctgcatcagaatcatcgagcagagcagaagaaagtacatggacggcgcccacgtgtag

SEQ ID NO: 22147 - DNA, 1458 bp, Artificial Sequence
  Description of Artificial Sequence: Synthetic coding sequence
atgtacaccagccacgaggacatcggctacgacttcgaggacggccccaaggacaagaagaccctgaagccccaccccaacatcgacggcggctgggcctggatgatggtgctgagcagcttcttcgtgcacatcctgatcatgggcagccagatggccctgggcgtgctgaacgtggagtggctggaggagttccaccagagcagaggcctgaccgcctgggtgagcagcctgagcatgggcatcaccctgatcgtgggccccttcatcggcctgttcatcaacacctgcggctgcagacagaccgccatcatcggcggcctggtgaacagcctgggctgggtgctgagcgcctacgccgccaacgtgcactacctgttcatcaccttcggcgtggccgccggcctgggcagcggcatggcctacctgcccgccgtggtgatggtgggcagatacttccagaagagaagagccctggcccagggcctgagcaccaccggcaccggcttcggcaccttcctgatgaccgtgctgctgaagtacctgtgcgccgagtacggctggagaaacgccatgctgatccagggcgccgtgagcctgaacctgtgcgtgtgcggcgccctgatgagacccctgagccccggcaagaaccccaacgaccccggcgagaaggacgtgagaggcctgcccgcccacagcaccgagagcgtgaagagcaccggccagcagggcagaaccgaggagaaggacggcggcctgggcaacgaggagaccctgtgcgacctgcaggcccaggagtgccccgaccaggccggccacagaaagaacatgtgcgccctgagaatcctgaagaccgtgagctggctgaccatgagagtgagaaagggcttcgaggactggtacagcggctacttcggcaccgccagcctgttcaccaacagaatgttcgtggccttcatcttctgggccctgttcgcctacagcagcttcgtgatccccttcatccacctgcccgagatcgtgaacctgtacaacctgagcgagcagaacgacgtgttccccctgaccagcatcatcgccatcgtgcacatcttcggcaaggtgatcctgggcgtgatcgccgacctgccctgcatcagcgtgtggaacgtgttcctgctggccaacttcaccctggtgctgagcatcttcatcctgcccctgatgcacacctacgccggcctggccgtgatctgcgccctgatcggcttcagcagcggctacttcagcctgatgcccgtggtgaccgaggacctggtgggcatcgagcacctggccaacgcctacggcatcatcatctgcgccaacggcatcagcgccctgctgggcccccccttcgccggcaagctgagcgaggtgctgagagcccagagcgcctgcacctacggcgccctgtgctacaaggtgcccgacaagtag

SEQ ID NO: 22148 - DNA, 129 bp, Artificial Sequence
  Description of Artificial Sequence: Synthetic coding sequence
atgtacaccagccacgaggacatcggctacgacttcgaggacggccccaaggacaagaagaccctgaagccccaccccaacatcgacggcggctgggcctggatgatggtgctgagcagcttcttctag

SEQ ID NO: 22149 - DNA, 57 bp, Artificial Sequence
  Description of Artificial Sequence: Synthetic coding sequence
atgtacaccagccacgaggacatcggctacgacttcgaggacggccccaaggactag

SEQ ID NO: 22150 - DNA, 1470 bp, Artificial Sequence
  Description of Artificial Sequence: Synthetic coding sequence
atgtacaccagccacgaggacatcggctacgacttcgaggacggccccaaggacaagaagaccctgaagccccaccccaacatcgacggcggctgggcctggatgatggtgctgagcagcttcttcgtgcacatcctgatcatgggcagccagatggccctgggcgtgctgaacgtggagtggctggaggagttccaccagagcagaggcctgaccgcctgggtgagcagcctgagcatgggcatcaccctgatcgtgggccccttcatcggcctgttcatcaacacctgcggctgcagacagaccgccatcatcggcggcctggtgaacagcctgggctgggtgctgagcgcctacgccgccaacgtgcactacctgttcatcaccttcggcgtggccgccggcctgggcagcggcatggcctacctgcccgccgtggtgatggtgggcagatacttccagaagagaagagccctggcccagggcctgagcaccaccggcaccggcttcggcaccttcctgatgaccgtgctgctgaagtacctgtgcgccgagtacggctggagaaacgccatgctgatccagggcgccgtgagcctgaacctgtgcgtgtgcggcgccctgatgagacccctgagccccggcaagaaccccaacgaccccggcgagaaggacgtgagaggcctgcccgcccacagcaccgagagcgtgaagagcaccggccagcagggcagaaccgaggagaaggacggcggcctgggcaacgaggagaccctgtgcgacctgcaggcccaggagtgccccgaccaggccggccacagaaagaacatgtgcgccctgagaatcctgaagaccgtgagctggctgaccatgagagtgagaaagggcttcgaggactggtacagcggctacttcggcaccgccagcctgttcaccaacagaatgttcgtggccttcatcttctgggccctgttcgcctacagcagcttcgtgatccccttcatccacctgcccgagatcgtgaacctgtacaacctgagcgagcagaacgacgtgttccccctgaccagcatcatcgccatcgtgcacatcttcggcaaggtgatcctgggcgtgatcgccgacctgccctgcatcagcgtgtggaacgtgttcctgctggccaacttcaccctggtgctgagcatcttcatcctgcccctgatgcacacctacgccggcctggccgtgatctgcgccctgatcggcttcagcagcggctacttcagcctgatgcccgtggtgaccgaggacctggtgggcatcgagcacctggccaacgcctacggcatcatcatctgcgccaacggcatcagcgccctgctgggcccccccttcgccggcaagctgagcgaggtgctgagagcccagagcgcctgcacctacggcgccctgtgctacaaggtgcccgacaaggaggagggcttctag

SEQ ID NO: 22151 - DNA, 1464 bp, Artificial Sequence
  Description of Artificial Sequence: Synthetic coding sequence
atgctgaagagagagggcaaggtgcagccctacaccaagaccctggacggcggctggggctggatgatcgtgatccacttcttcctggtgaacgtgttcgtgatgggcatgaccaagaccttcgccatcttcttcgtggtgttccaggaggagttcgagggcaccagcgagcagatcggctggatcggcagcatcatgagcagcctgagattctgcgccggccccctggtggccatcatctgcgacatcctgggcgagaagaccaccagcatcctgggcgccttcgtggtgaccggcggctacctgatcagcagctgggccaccagcatccccttcctgtgcgtgaccatgggcctgctgcccggcctgggcagcgccttcctgtaccaggtggccgccgtggtgaccaccaagtacttcaagaagagactggccctgagcaccgccatcgccagaagcggcatgggcctgaccttcctgctggcccccttcaccaagttcctgatcgacctgtacgactggaccggcgccctgatcctgttcggcgccatcgccctgaacctggtgcccagcagcatgctgctgagacccatccacatcaagagcgagaacaacagcggcatcaaggacaagggcagcagcctgagcgcccacggccccgaggcccacgccaccgagacccactgccacgagaccgaggagagcaccatcaaggacagcaccacccagaaggccggcctgcccagcaagaacctgaccgtgagccagaaccagagcgaggagttctacaacggccccaacagaaacagactgctgctgaagagcgacgaggagagcgacaaggtgatcagctggagctgcaagcagctgttcgacatcagcctgttcagaaaccccttcttctacatcttcacctggagcttcctgctgagccagctggcctacttcatccccaccttccacctggtggccagagccaagaccctgggcatcgacatcatggacgccagctacctggtgagcgtggccggcatcctggagaccgtgagccagatcatcagcggctgggtggccgaccagaactggatcaagaagtaccactaccacaagagctacctgatcctgtgcggcatcaccaacctgctggcccccctggccaccaccttccccctgctgatgacctacaccatctgcttcgccatcttcgccggcggctacctggccctgatcctgcccgtgctggtggacctgtgcagaaacagcaccgtgaacagattcctgggcctggccagcttcttcgccggcatggccgtgctgagcggcccccccatcgccggctggctgtacgactacacccagacctacaacggcagcttctacttcagcggcatctgctacctgctgagcagcgtgagcttcttcttcgtgcccctggccgagagatggaagaacagcctgacctag

SEQ ID NO: 22152 - DNA, 960 bp, Artificial Sequence
  Description of Artificial Sequence: Synthetic coding sequence
atgctgaagagagagggcaaggtgcagccctacaccaagaccctggacggcggctggggctggatgatcgtgatccacttcttcctggtgaacgtgttcgtgatgggcatgaccaagaccttcgccatcttcttcgtggtgttccaggaggagttcgagggcaccagcgagcagatcggctggatcggcagcatcatgagcagcctgagattctgcgccggccccctggtggccatcatctgcgacatcctgggcgagaagaccaccagcatcctgggcgccttcgtggtgaccggcggctacctgatcagcagctgggccaccagcatccccttcctgtgcgtgaccatgggcctgctgcccggcctgggcagcgccttcctgtaccaggtggccgccgtggtgaccaccaagtacttcaagaagagactggccctgagcaccgccatcgccagaagcggcatgggcctgaccttcctgctggcccccttcaccaagttcctgatcgacctgtacgactggaccggcatcctggagaccgtgagccagatcatcagcggctgggtggccgaccagaactggatcaagaagtaccactaccacaagagctacctgatcctgtgcggcatcaccaacctgctggcccccctggccaccaccttccccctgctgatgacctacaccatctgcttcgccatcttcgccggcggctacctggccctgatcctgcccgtgctggtggacctgtgcagaaacagcaccgtgaacagattcctgggcctggccagcttcttcgccggcatggccgtgctgagcggcccccccatcgccggctggctgtacgactacacccagacctacaacggcagcttctacttcagcggcatctgctacctgctgagcagcgtgagcttcttcttcgtgcccctggccgagagatggaagaacagcctgacctag

SEQ ID NO: 22153 - DNA, 1149 bp, Artificial Sequence
  Description of Artificial Sequence: Synthetic coding sequence
atgggcatggacgactgcgacagcttcttccccggcctgggcagcgccttcctgtaccaggtggccgccgtggtgaccaccaagtacttcaagaagagactggccctgagcaccgccatcgccagaagcggcatgggcctgaccttcctgctggcccccttcaccaagttcctgatcgacctgtacgactggaccggcgccctgatcctgttcggcgccatcgccctgaacctggtgcccagcagcatgctgctgagacccatccacatcaagagcgagaacaacagcggcatcaaggacaagggcagcagcctgagcgcccacggccccgaggcccacgccaccgagacccactgccacgagaccgaggagagcaccatcaaggacagcaccacccagaaggccggcctgcccagcaagaacctgaccgtgagccagaaccagagcgaggagttctacaacggccccaacagaaacagactgctgctgaagagcgacgaggagagcgacaaggtgatcagctggagctgcaagcagctgttcgacatcagcctgttcagaaaccccttcttctacatcttcacctggagcttcctgctgagccagctggcctacttcatccccaccttccacctggtggccagagccaagaccctgggcatcgacatcatggacgccagctacctggtgagcgtggccggcatcctggagaccgtgagccagatcatcagcggctgggtggccgaccagaactggatcaagaagtaccactaccacaagagctacctgatcctgtgcggcatcaccaacctgctggcccccctggccaccaccttccccctgctgatgacctacaccatctgcttcgccatcttcgccggcggctacctggccctgatcctgcccgtgctggtggacctgtgcagaaacagcaccgtgaacagattcctgggcctggccagcttcttcgccggcatggccgtgctgagcggcccccccatcgccgagatcatccccagcttccaggccggctacatgatcatccccagacacaccatggccctgagcaccagcctggcctacgccatcagcagcctgcagttccccttcttcctgtaccactggcccaaggacggcaagaccgtgtag

SEQ ID NO: 22154 - DNA, 1278 bp, Artificial Sequence
  Description of Artificial Sequence: Synthetic coding sequence
atgggcatggacgactgcgacagcttcttccccggccccctggtggccatcatctgcgacatcctgggcgagaagaccaccagcatcctgggcgccttcgtggtgaccggcggctacctgatcagcagctgggccaccagcatccccttcctgtgcgtgaccatgggcctgctgcccggcctgggcagcgccttcctgtaccaggtggccgccgtggtgaccaccaagtacttcaagaagagactggccctgagcaccgccatcgccagaagcggcatgggcctgaccttcctgctggcccccttcaccaagttcctgatcgacctgtacgactggaccggcgccctgatcctgttcggcgccatcgccctgaacctggtgcccagcagcatgctgctgagacccatccacatcaagagcgagaacaacagcggcatcaaggacaagggcagcagcctgagcgcccacggccccgaggcccacgccaccgagacccactgccacgagaccgaggagagcaccatcaaggacagcaccacccagaaggccggcctgcccagcaagaacctgaccgtgagccagaaccagagcgaggagttctacaacggccccaacagaaacagactgctgctgaagagcgacgaggagagcgacaaggtgatcagctggagctgcaagcagctgttcgacatcagcctgttcagaaaccccttcttctacatcttcacctggagcttcctgctgagccagctggcctacttcatccccaccttccacctggtggccagagccaagaccctgggcatcgacatcatggacgccagctacctggtgagcgtggccggcatcctggagaccgtgagccagatcatcagcggctgggtggccgaccagaactggatcaagaagtaccactaccacaagagctacctgatcctgtgcggcatcaccaacctgctggcccccctggccaccaccttccccctgctgatgacctacaccatctgcttcgccatcttcgccggcggctacctggccctgatcctgcccgtgctggtggacctgtgcagaaacagcaccgtgaacagattcctgggcctggccagcttcttcgccggcatggccgtgctgagcggcccccccatcgccggctggctgtacgactacacccagacctacaacggcagcttctacttcagcggcatctgctacctgctgagcagcgtgagcttcttcttcgtgcccctggccgagagatggaagaacagcctgacctag

SEQ ID NO: 22155 - DNA, 1518 bp, Artificial Sequence
  Description of Artificial Sequence: Synthetic coding sequence
atgccccaggccctggagagagccgacggcagctgggcctgggtggtgctgctggccaccatggtgacccagggcctgaccctgggcttccccacctgcatcggcatcttcttcaccgagctgcagtgggagttccaggccagcaacagcgagaccagctggttccccagcatcctgaccgccgtgctgcacatggccggccccctgtgcagcatcctggtgggcagattcggctgcagagtgaccgtgatgctgggcggcgtgctggccagcctgggcatggtggccagcagcttcagccacaacctgagccagctgtacttcaccgccggcttcatcaccggcctgggcatgtgcttcagcttccagagcagcatcaccgtgctgggcttctacttcgtgagaagaagagtgctggccaacgccctggccagcatgggcgtgagcctgggcatcaccctgtggcccctgctgagcagatacctgctggagaacctgggctggagaggcaccttcctggtgttcggcggcatcttcctgcactgctgcatctgcggcgccatcatcagacccgtggccaccagcgtggcccccgagaccaaggagtgccccccccccccccccgagacccccgccctgggctgcctggccgcctgcggcagaaccatccagagacacctggccttcgacatcctgagacacaacaccggctactgcgtgtacatcctgggcgtgatgtggagcgtgctgggcttccccctgccccaggtgttcctggtgccctacgccatgtggcacagcgtggacgagcagcaggccgccctgctgatcagcatcatcggcttcagcaacatcttcctgagacccctggccggcctgatggccggcagacccgccttcgccagccacagaaagtacctgttcagcctggccctgctgctgaacggcctgaccaacctggtgtgcgccgccagcggcgacttctgggtgctggtgggctactgcctggcctacagcgtgagcatgagcggcatcggcgccctgatcttccaggtgctgatggacatcgtgcccatggaccagttccccagagccctgggcctgttcaccgtgctggacggcctggccttcctgatcagcccccccctggccggcctgctgctggacgccaccaacaacttcagctacgtgttctacatgagcagcttcttcctgatcagcgccgccctgttcatgggcggcagcttctacgccctgcagaagaaggagcagggcaagcaggccgtggccgccgacgccctggagagagacctgttcctggaggccaaggacggccccggcaagcagagaagccccgagatcatgtgccagagcagcagacagcccagacccgccggcgtgaacaagcacctgtggggctgccccgccagcagcagaaccagccacgagtggctgctgtggcccaaggccgtgctgcaggccaagcagaccgccctgggctggaacagccccacctag

SEQ ID NO: 22156 - DNA, 1518 bp, Artificial Sequence; identical to SEQ ID NO: 22155
  Description of Artificial Sequence: Synthetic coding sequence

SEQ ID NO: 22157 - DNA, 1503 bp, Artificial Sequence
  Description of Artificial Sequence: Synthetic coding sequence
atgcccagacccaccagaggccccctggccaccagccagggctggtgccccagcgtgacccccggcacctgggccgccgccaccctggccgtgagaccctggcagagaagacagcagagaatgccccaggccctggagagagccgacggcagctgggcctgggtggtgctgctggccaccatggtgacccagggcctgaccctgggcttccccacctgcatcggcatcttcttcaccgagctgcagtgggagttccaggccagcaacagcgagaccagctggttccccagcatcctgaccgccgtgctgcacatggccggccccctgtgcagcatcctggtgggcagattcggctgcagagtgaccgtgatgctgggcggcgtgctggccagcctgggcatggtggccagcagcttcagccacaacctgagccagctgtacttcaccgccggcttcatcaccggcctgggcatgtgcttcagcttccagagcagcatcaccgtgctgggcttctacttcgtgagaagaagagtgctggccaacgccctggccagcatgggcgtgagcctgggcatcaccctgtggcccctgctgagcagatacctgctggagaacctgggctggagaggcaccttcctggtgttcggcggcatcttcctgcactgctgcatctgcggcgccatcatcagacccgtggccaccagcgtggcccccgagaccaaggagtgccccccccccccccccgagacccccgccctgggctgcctggccgcctgcggcagaaccatccagagacacctggccttcgacatcctgagacacaacaccggctactgcgtgtacatcctgggcgtgatgtggagcgtgctgggcttccccctgccccaggtgttcctggtgccctacgccatgtggcacagcgtggacgagcagcaggccgccctgctgatcagcatcatcggcttcagcaacatcttcctgagacccctggccggcctgatggccggcagacccgccttcgccagccacagaaagtacctgttcagcctggccctgctgctgaacggcctgaccaacctggtgtgcgccgccagcggcgacttctgggtgctggtgggctactgcctggcctacagcgtgagcatgagcggcatcggcgccctgatcttccaggtgctgatggacatcgtgcccatggaccagttccccagagccctgggcctgttcaccgtgctggacggcctggccttcctgatcagcccccccctggccggcctgctgctggacgccaccaacaacttcagctacgtgttctacatgagcagcttcttcctgatcagcgccgccctgttcatgggcggcagcttctacgccctgcagaagaaggagcagggcaagcaggccgtggccgccgacgccctggagagagacctgttcctggaggccaaggacggccccggcaagcagagaagccccgagatcatgtacgtgaccagcgtgtag

SEQ ID NO: 22158 - DNA, 1572 bp, Artificial Sequence
  Description of Artificial Sequence: Synthetic coding sequence
atgacccagaacaagctgaagctgtgcagcaaggccaacgtgtacaccgaggtgcccgacggcggctggggctgggccgtggccgtgagcttcttcttcgtggaggtgttcacctacggcatcatcaagaccttcggcgtgttcttcaacgacctgatggacagcttcaacgagagcaacagcagaatcagctggatcatcagcatctgcgtgttcgtgctgaccttcagcgcccccctggccaccgtgctgagcaacagattcggccacagactggtggtgatgctgggcggcctgctggtgagcaccggcatggtggccgccagcttcagccaggaggtgagccacatgtacgtggccatcggcatcatcagcggcctgggctactgcttcagcttcctgcccaccgtgaccatcctgagccagtacttcggcaagagaagaagcatcgtgaccgccgtggccagcaccggcgagtgcttcgccgtgttcgccttcgcccccgccatcatggccctgaaggagagaatcggctggagatacagcctgctgttcgtgggcctgctgcagctgaacatcgtgatcttcggcgccctgctgagacccatcttcatcagaggccccgccagccccaagatcgtgatccaggagaacagaaaggaggcccagtacatgctggagaacgagaagaccagaaccagcatcgacagcatcgacagcggcgtggagctgaccaccagccccaagaacgtgcccacccacaccaacctggagctggagcccaaggccgacatgcagcaggtgctggtgaagaccagccccagacccagcgagaagaaggcccccctgctggacttcagcatcctgaaggagaagagcttcatctgctacgccctgttcggcctgttcgccaccctgggcttcttcgcccccagcctgtacatcatccccctgggcatcagcctgggcatcgaccaggacagagccgccttcctgctgagcaccatggccatcgccgaggtgttcggcagaatcggcgccggcttcgtgctgaacagagagcccatcagaaagatctacatcgagctgatctgcgtgatcctgctgaccgtgagcctgttcgccttcaccttcgccaccgagttctggggcctgatgagctgcagcatcttcttcggcttcatggtgggcaccatcggcggcacccacatccccctgctggccgaggacgacgtggtgggcatcgagaagatgagcagcgccgccggcgtgtacatcttcatccagagcatcgccggcctggccggcccccccctggccggcctgctggtggaccagagcaagatctacagcagagccttctacagctgcgccgccggcatggccctggccgccgtgtgcctggccctggtgagaccctgcaagatgggcctgtgccagcaccaccacagcggcgagaccaaggtggtgagccacagaggcaagaccctgcaggacatccccgaggacttcctggagatggacctggccaagaacgagcacagagtgcacgtgcagatggagcccgtgtag

SEQ ID NO: 22159 - DNA, 1515 bp, Artificial Sequence
  Description of Artificial Sequence: Synthetic coding sequence
atgggcgccggcggccccagaagaggcgagggcccccccgacggcggctggggctgggtggtgctgggcgcctgcttcgtggtgaccggcttcgcctacggcttccccaaggccgtgagcgtgttcttcagagccctgatgagagacttcgacgccggctacagcgacaccgcctgggtgagcagcatcatgctggccatgctgtacggcaccggccccgtgagcagcatcctggtgaccagattcggctgcagacccgtgatgctggccggcggcctgctggccagcgccggcatgatcctggccagcttcgccaccagactgctggagctgtacctgaccgccggcgtgctgaccggcctgggcctggccctgaacttccagcccagcctgatcatgctgggcctgtacttcgagagaagaagacccctggccaacggcctggccgccgccggcagccccgtgttcctgagcgccctgagccccctgggccagcagctgctggagagattcggctggagaggcggcttcctgctgctgggcggcctgctgctgcactgctgcgcctgcggcgccgtgatgagacccccccccggccccggccccagacccagaagagacagcgccggcgacagagccggcgacgcccccggcgaggccgaggccgacggcgccggcctgcagctgagagaggccagccccagagtgagacccagaagaagactgctggacctggccgtgtgcaccgacagagccttcgccgtgtacgccgtgaccaagttcctgatggccctgggcctgttcgtgcccgccatcctgctggtgaactacgccaaggacgccggcgtgcccgacaccgacgccgccttcctgctgagcatcgtgggcttcgtggacatcgtggccagacccgcctgcggcgccctggccggcctggccagactgagaccccacgtgccctacctgttcagcctggccctgctggccaacggcctgaccgacctgagcagcgccagagccagaagctacggcgccctggtggccttctgcgtggccttcggcctgagctacggcatggtgggcgccctgcagttcgaggtgctgatggccgccgtgggcgcccccagattccccagcgccctgggcctggtgctgctggtggaggccgccgccgtgctgatcggcccccccagcgccggcagactggtggacgtgctgaagaactacgagatcatcttctacctggccggcagcgaggtggccctggccggcgtgttcatggccgtggccaccaactgctgcctgagatgcgccaaggccgcccccagcggccccggcaccgagggcggcgccagcgacaccgaggacgccgaggccgagggcgacagcgagcccctgcccgtggtggccgaggagcccggcaacctggaggccctggaggtgctgagcgccagaggcgagcccaccgagcccgagatcgaggccagacccagactggccgccgagagcgtgtag

SEQ ID NO: 22160 - DNA, 294 bp, Artificial Sequence
  Description of Artificial Sequence: Synthetic coding sequence
atgggcgccggcggccccagaagaggcgagggcccccccgacggcggctggggctgggtggtgctgggcgcctgcttcgtggtgaccggcttcgcctacggcttccccaaggccgtgagcgtgttcttcagagccctgatgagagacttcgacgccggctacagcgacaccgcctgggtgagcagcatcatgctggccatgctgtacggcaccggccccgtgagcagcatcctggtgaccagattcggctgcagacccgtgatgctggccggcggcctgctggccagcgcctag

SEQ ID NO: 22161 - DNA, 1500 bp, Artificial Sequence
  Description of Artificial Sequence: Synthetic coding sequence
atgctgcacgccctgctgagaagcagaatgatccagggcagaatcctgctgctgaccatctgcgccgccggcatcggcggcaccttccagttcggctacaacctgagcatcatcaacgcccccaccctgcacatccaggagttcaccaacgagacctggcaggccagaaccggcgagcccctgcccgaccacctggtgctgctgatgtggagcctgatcgtgagcctgtaccccctgggcggcctgttcggcgccctgctggccggccccctggccatcaccctgggcagaaagaagagcctgctggtgaacaacatcttcgtggtgagcgccgccatcctgttcggcttcagcagaaaggccggcagcttcgagatgatcatgctgggcagactgctggtgggcgtgaacgccggcgtgagcatgaacatccagcccatgtacctgggcgagagcgcccccaaggagctgagaggcgccgtggccatgagcagcgccatcttcaccgccctgggcatcgtgatgggccaggtggtgggcctgagagagctgctgggcggcccccaggcctggcccctgctgctggccagctgcctggtgcccggcgccctgcagctggccagcctgcccctgctgcccgagagccccagatacctgctgatcgactgcggcgacaccgaggcctgcctggccgccctgagaagactgagaggcagcggcgacctggccggcgagctggaggagctggaggaggagagagccgcctgccagggctgcagagccagaagaccctgggagctgttccagcacagagccctgagaagacaggtgaccagcctggtggtgctgggcagcgccatggagctgtgcggcaacgacagcgtgtacgcctacgccagcagcgtgttcagaaaggccggcgtgcccgaggccaagatccagtacgccatcatcggcaccggcagctgcgagctgctgaccgccgtggtgagctgcgtggtgatcgagagagtgggcagaagagtgctgctgatcggcggctacagcctgatgacctgctggggcagcatcttcaccgtggccctgtgcctgcagagcagcttcccctggaccctgtacctggccatggcctgcatcttcgccttcatcctgagcttcggcatcggccccgccggcgtgaccggcatcctggccaccgagctgttcgaccagatggccagacccgccgcctgcatggtgtgcggcgccctgatgtggatcatgctgatcctggtgggcctgggcttccccttcatcatggaggccctgagccacttcctgtacgtgcccttcctgggcgtgtgcgtgtgcggcgccatctacaccggcctgttcctgcccgagaccaagggcaagaccttccaggagatcagcaaggagctgcacagactgaacttccccagaagagcccagggccccacctggagaagcctggaggtgatccagagcaccgagctgtag

SEQ ID NO: 22162 - DNA, 1491 bp, Artificial Sequence
  Description of Artificial Sequence: Synthetic coding sequence
atgagagccctgagaagactgatccagggcagaatcctgctgctgaccatctgcgccgccggcatcggcggcaccttccagttcggctacaacctgagcatcatcaacgcccccaccctgcacatccaggagttcaccaacgagacctggcaggccagaaccggcgagcccctgcccgaccacctggtgctgctgatgtggagcctgatcgtgagcctgtaccccctgggcggcctgttcggcgccctgctggccggccccctggccatcaccctgggcagaaagaagagcctgctggtgaacaacatcttcgtggtgagcgccgccatcctgttcggcttcagcagaaaggccggcagcttcgagatgatcatgctgggcagactgctggtgggcgtgaacgccggcgtgagcatgaacatccagcccatgtacctgggcgagagcgcccccaaggagctgagaggcgccgtggccatgagcagcgccatcttcaccgccctgggcatcgtgatgggccaggtggtgggcctgagagagctgctgggcggcccccaggcctggcccctgctgctggccagctgcctggtgcccggcgccctgcagctggccagcctgcccctgctgcccgagagccccagatacctgctgatcgactgcggcgacaccgaggcctgcctggccgccctgagaagactgagaggcagcggcgacctggccggcgagctggaggagctggaggaggagagagccgcctgccagggctgcagagccagaagaccctgggagctgttccagcacagagccctgagaagacaggtgaccagcctggtggtgctgggcagcgccatggagctgtgcggcaacgacagcgtgtacgcctacgccagcagcgtgttcagaaaggccggcgtgcccgaggccaagatccagtacgccatcatcggcaccggcagctgcgagctgctgaccgccgtggtgagctgcgtggtgatcgagagagtgggcagaagagtgctgctgatcggcggctacagcctgatgacctgctggggcagcatcttcaccgtggccctgtgcctgcagagcagcttcccctggaccctgtacctggccatggcctgcatcttcgccttcatcctgagcttcggcatcggccccgccggcgtgaccggcatcctggccaccgagctgttcgaccagatggccagacccgccgcctgcatggtgtgcggcgccctgatgtggatcatgctgatcctggtgggcctgggcttccccttcatcatggaggccctgagccacttcctgtacgtgcccttcctgggcgtgtgcgtgtgcggcgccatctacaccggcctgttcctgcccgagaccaagggcaagaccttccaggagatcagcaaggagctgcacagactgaacttccccagaagagcccagggccccacctggagaagcctggaggtgatccagagcaccgagctgtag

SEQ ID NO: 22163 - DNA, 1512 bp, Artificial Sequence
  Description of Artificial Sequence: Synthetic coding sequence
atggaggacgagctggagcccagcctgagacccagaacccagatccagggcagaatcctgctgctgaccatctgcgccgccggcatcggcggcaccttccagttcggctacaacctgagcatcatcaacgcccccaccctgcacatccaggagttcaccaacgagacctggcaggccagaaccggcgagcccctgcccgaccacctggtgctgctgatgtggagcctgatcgtgagcctgtaccccctgggcggcctgttcggcgccctgctggccggccccctggccatcaccctgggcagaaagaagagcctgctggtgaacaacatcttcgtggtgagcgccgccatcctgttcggcttcagcagaaaggccggcagcttcgagatgatcatgctgggcagactgctggtgggcgtgaacgccggcgtgagcatgaacatccagcccatgtacctgggcgagagcgcccccaaggagctgagaggcgccgtggccatgagcagcgccatcttcaccgccctgggcatcgtgatgggccaggtggtgggcctgagagagctgctgggcggcccccaggcctggcccctgctgctggccagctgcctggtgcccggcgccctgcagctggccagcctgcccctgctgcccgagagccccagatacctgctgatcgactgcggcgacaccgaggcctgcctggccgccctgagaagactgagaggcagcggcgacctggccggcgagctggaggagctggaggaggagagagccgcctgccagggctgcagagccagaagaccctgggagctgttccagcacagagccctgagaagacaggtgaccagcctggtggtgctgggcagcgccatggagctgtgcggcaacgacagcgtgtacgcctacgccagcagcgtgttcagaaaggccggcgtgcccgaggccaagatccagtacgccatcatcggcaccggcagctgcgagctgctgaccgccgtggtgagctgcgtggtgatcgagagagtgggcagaagagtgctgctgatcggcggctacagcctgatgacctgctggggcagcatcttcaccgtggccctgtgcctgcagagcagcttcccctggaccctgtacctggccatggcctgcatcttcgccttcatcctgagcttcggcatcggccccgccggcgtgaccggcatcctggccaccgagctgttcgaccagatggccagacccgccgcctgcatggtgtgcggcgccctgatgtggatcatgctgatcctggtgggcctgggcttccccttcatcatggaggccctgagccacttcctgtacgtgcccttcctgggcgtgtgcgtgtgcggcgccatctacaccggcctgttcctgcccgagaccaagggcaagaccttccaggagatcagcaaggagctgcacagactgaacttccccagaagagcccagggccccacctggagaagcctggaggtgatccagagcaccgagctgtag

SEQ ID NO: 22164 - DNA, 1104 bp, Artificial Sequence
  Description of Artificial Sequence: Synthetic coding sequence
atggaggacgagctggagcccagcctgagacccagaacccagatccagggcagaatcctgctgctgaccatctgcgccgccggcatcggcggcaccttccagttcggctacaacctgagcatcatcaacgcccccaccctgcacatccaggagttcaccaacgagacctggcaggccagaaccggcgagcccctgcccgaccacctggtgctgctgatgtggagcctgatcgtgagcctgtaccccctgggcggcctgttcggcgccctgctggccggccccctggccatcaccctgggcagaaagaagagcctgctggtgaacaacatcttcgtggtgagcgccgccatcctgttcggcttcagcagaaaggccggcagcttcgagatgatcatgctgggcagactgctggtgggcgtgaacgccggcgtgagcatgaacatccagcccatgtacctgggcgagagcgcccccaaggagctgagaggcgccgtggccatgagcagcgccatcttcaccgccctgggcatcgtgatgggccaggtggtgggcctgagagagctgctgggcggcccccaggcctggcccctgctgctggccagctgcctggtgcccggcgccctgcagctggccagcctgcccctgctgcccgagagccccagatacctgctgatcgactgcggcgacaccgaggcctgcctggccgccctgagaagactgagaggcagcggcgacctggccggcgagctggaggagctggaggaggagagagccgcctgccagggctgcagagccagaagaccctgggagctgttccagcacagagccctgagaagacaggtgaccagcctggtggtgctgggcagcgccatggagctgtgcggcaacgacagcgtgtacgcctacgccagcagcgtgttcagaaaggccggcgtgcccgaggccaagatccagtacgccatcatcggcaccggcagctgcgagctgctgaccgccgtggtgagcgtgagcctggagggcgccctgcccccccccgccctgtggggcggcacccccagaagcagcgccctgaaccagttcaccctgcagaagaagaagaagtag

SEQ ID NO: 22165 - DNA, 1104 bp, Artificial Sequence
  Description of Artificial Sequence: Synthetic coding sequence
atgagagccctgagaagactgatccagggcagaatcctgctgctgaccatctgcgccgccggcatcggcggcaccttccagttcggctacaacctgagcatcatcaacgcccccaccctgcacatccaggagttcaccaacgagacctggcaggccagaaccggcgagcccctgcccgaccacctggtgctgctgatgtggagcctgatcgtgagcctgtaccccctgggcggcctgttcggcgccctgctggccggccccctggccatcaccctgggcagaaagaagagcctgctggtgaacaacatcttcgtggtgagcgccgccatcctgttcggcttcagcagaaaggccggcagcttcgagatgatcatgctgggcagactgctggtgggcgtgaacgccggcgtgagcatgaacatccagcccatgtacctgggcgagagcgcccccaaggagctgagaggcgccgtggccatgagcagcgccatcttcaccgccctgggcatcgtgatgggccaggtggtgggcctgagcaccaccgccgcccccggcctgagaggcctgggcagaggcgccggcggcgccggcggcggcgccagatgcctgcccggcctgccctgcagaccctgggagctgttccagcacagagccctgagaagacaggtgaccagcctggtggtgctgggcagcgccatggagctgtgcggcaacgacagcgtgtacgcctacgccagcagcgtgttcagaaaggccggcgtgcccgaggccaagatccagtacgccatcatcggcaccggcagctgcgagctgctgaccgccgtggtgagcgtgagcctggagggcgccctgcccccccccgccctgtggggcggcacccccagaagcagcgccctgaaccagttcaccctgcagctgatggtgctgaagtgcagcgagggccccggcgccgtggcccacgcctgcaagcccagcaccctgggcggcagaggcggctggatcaccagaagcggcgtgagagaccagcccggccagcacagcgagacccccgtgagcaccaagaagtacaagaagctgagcagaagaggcggcggcagactgtag

SEQ ID NO: 22166 - DNA, 1392 bp, Artificial Sequence
  Description of Artificial Sequence: Synthetic coding sequence
atggaggacgagctggagcccagcctgagacccagaacccagatccagggcagaatcctgctgctgaccatctgcgccgccggcatcggcggcaccttccagttcggctacaacctgagcatcatcaacgcccccaccctgcacatccaggagttcaccaacgagacctggcaggccagaaccggcgagcccctgcccgaccacctggtgctgctgatgtggagcctgatcgtgagcctgtaccccctgggcggcctgttcggcgccctgctggccggccccctggccatcaccctgggcagaaagaagagcctgctggtgaacaacatcttcgtggtgagcgccgccatcctgttcggcttcagcagaaaggccggcagcttcgagatgatcatgctgggcagactgctggtgggcgtgaacgccggcgtgagcatgaacatccagcccatgtacctgggcgagagcgcccccaaggagctgagaggcgccgtggccatgagcagcgccatcttcaccgccctgggcatcgtgatgggccaggtggtgggcctgagagagctgctgggcggcccccaggcctggcccctgctgctggccagctgcctggtgcccggcgccctgcagctggccagcctgcccctgctgcccgagagccccagatacctgctgatcgactgcggcgacaccgaggcctgcctggccgccctgagaagactgagaggcagcggcgacctggccggcgagctggaggagctggaggaggagagagccgcctgccagggctgcagagccagaagaccctgggagctgttccagcacagagccctgagaagacaggtgaccagcctggtggtgctgggcagcgccatggagctgtgcggcaacgacagcgtgtacgcctacgccagcagcgtgttcagaaaggccggcgtgcccgaggccaagatccagtacgccatcatcggcaccggcagctgcgagctgctgaccgccgtggtgagcgtggccggcgtggacgagggctggggcgtgcaggccggcctgaccagcaccagccccccccccagacccagacagagcagcttcccctggaccctgtacctggccatggcctgcatcttcgccttcatcctgagcttcggcatcggccccgccggcgtgaccggcatcctggccaccgagctgttcgaccagatggccagacccgccgcctgcatggtgtgcggcgccctgatgtggatcatgctgatcctggtgggcctgggcttccccttcatcatggtgctgggcagcttcctgatcgccggcggcctggtgcccctgcccctgtgccccttcccctggtgcctgtgcctgtggggccacctgcactggcccgtgcccagctag

SEQ ID NO: 22167 - DNA, 1854 bp, Artificial Sequence
  Description of Artificial Sequence: Synthetic coding sequence
atggtgcccgtggagaacaccgagggccccagcctgctgaaccagaagggcaccgccgtggagaccgagggcagcggcagcagacaccccccctgggccagaggctgcggcatgttcaccttcctgagcagcgtgaccgccgccgtgagcggcctgctggtgggctacgagctgggcatcatcagcggcgccctgctgcagatcaagaccctgctggccctgagctgccacgagcaggagatggtggtgagcagcctggtgatcggcgccctgctggccagcctgaccggcggcgtgctgatcgacagatacggcagaagaaccgccatcatcctgagcagctgcctgctgggcctgggcagcctggtgctgatcctgagcctgagctacaccgtgctgatcgtgggcagaatcgccatcggcgtgagcatcagcctgagcagcatcgccacctgcgtgtacatcgccgagatcgccccccagcacagaagaggcctgctggtgagcctgaacgagctgatgatcgtgatcggcatcctgagcgcctacatcagcaactacgccttcgccaacgtgttccacggctggaagtacatgttcggcctggtgatccccctgggcgtgctgcaggccatcgccatgtacttcctgccccccagccccagattcctggtgatgaagggccaggagggcgccgccagcaaggtgctgggcagactgagagccctgagcgacaccaccgaggagctgaccgtgatcaagagcagcctgaaggacgagtaccagtacagcttctgggacctgttcagaagcaaggacaacatgagaaccagaatcatgatcggcctgaccctggtgttcttcgtgcagatcaccggccagcccaacatcctgttctacgccagcaccgtgctgaagagcgtgggcttccagagcaacgaggccgccagcctggccagcaccggcgtgggcgtggtgaaggtgatcagcaccatccccgccaccctgctggtggaccacgtgggcagcaagaccttcctgtgcatcggcagcagcgtgatggccgccagcctggtgaccatgggcatcgtgaacctgaacatccacatgaacttcacccacatctgcagaagccacaacagcatcaaccagagcctggacgagagcgtgatctacggccccggcaacctgagcaccaacaacaacaccctgagagaccacttcaagggcatcagcagccacagcagaagcagcctgatgcccctgagaaacgacgtggacaagagaggcgagaccaccagcgccagcctgctgaacgccggcctgagccacaccgagtaccagatcgtgaccgaccccggcgacgtgcccgccttcctgaagtggctgagcctggccagcctgctggtgtacgtggccgccttcagcatcggcctgggccccatgccctggctggtgctgagcgagatcttccccggcggcatcagaggcagagccatggccctgaccagcagcatgaactggggcatcaacctgctgatcagcctgaccttcctgaccgtgaccgacctgatcggcctgccctgggtgtgcttcatctacaccatcatgagcctggccagcctgctgttcgtggtgatgttcatccccgagaccaagggctgcagcctggagcagatcagcatggagctggccaaggtgaactacgtgaagaacaacatctgcttcatgagccaccaccaggaggagctggtgcccaagcagccccagaagagaaagccccaggagcagctgctggagtgcaacaagctgtgcggcagaggccagagcagacagctgagccccgagacctag

SEQ ID NO: 22168 - DNA, 1656 bp, Artificial Sequence
  Description of Artificial Sequence: Synthetic coding sequence
atggcccagttcgtgcaggtgctggccgagatcggcgacttcggcagattccagatccagctgctgatcctgctgtgcgtgctgaacttcctgagccccttctacttcttcgcccacgtgttcatggtgctggacgagccccaccactgcgccgtggcctgggtgaagaaccacaccttcaacctgagcgccgccgagcagctggtgctgagcgtgcccctggacaccgccggccaccccgagccctgcctgatgttcagacccccccccgccaacgccagcctgcaggacatcctgagccacagattcaacgagacccagccctgcgacatgggctgggagtaccccgagaacagactgcccagcctgaagaacgagttcaacctggtgtgcgacagaaagcacctgaaggacaccacccagagcgtgttcatggccggcctgctggtgggcaccctgatgttcggccccctgtgcgacagaatcggcagaaaggccaccatcctggcccagctgctgctgttcaccctgatcggcctggccaccgccttcgtgcccagcttcgagctgtacatggccctgagattcgccgtggccaccgccgtggccggcctgagcttcagcaacgtgaccctgctgaccgagtgggtgggccccagctggagaacccaggccgtggtgctggcccagtgcaacttcagcctgggccagatggtgctggccggcctggcctacggcttcagaaactggagactgctgcagatcaccggcaccgcccccggcctgctgctgttcttctacttctgggccctgcccgagagcgccagatggctgctgaccagaggcagaatggacgaggccatccagctgatccagaaggccgccagcgtgaacagaagaaagctgagccccgagctgatgaaccagctggtgcccgagaagaccggccccagcggcaacgccctggacctgttcagacacccccagctgagaaaggtgaccctgatcatcttctgcgtgtggttcgtggacagcctgggctactacggcctgagcctgcaggtgggcgacttcggcctggacgtgtacctgacccagctgatcttcggcgccgtggaggtgcccgccagatgcagcagcatcttcatgatgcagagattcggcagaaagtggagccagctgggcaccctggtgctgggcggcctgatgtgcatcatcatcatcttcatccccgccgacctgcccgtggtggtgaccatgctggccgtggtgggcaagatggccaccgccgccgccttcaccatcagctacgtgtacagcgccgagctgttccccaccatcctgagacagaccggcatgggcctggtgggcatcttcagcagaatcggcggcatcctgacccccctggtgatcctgctgggcgagtaccacgccgccctgcccatgctgatctacggcagcctgcccatcgtggccggcctgctgtgcaccctgctgcccgagacccacggccagggcctgaaggacaccctgcaggacctggagctgggcccccaccccagaagccccaagagcgtgcccagcgagaaggagaccgaggccaagggcagaaccagcagccccggcgtggccttcgtgagcagcacctacttctag

SEQ ID NO: 22169 - DNA, 618 bp, Artificial Sequence
  Description of Artificial Sequence: Synthetic coding sequence
atggtgctggacgagccccaccactgcgccgtggcctgggtgaagaaccacaccttcaacctgagcgccgccgagcagctggtgctgagcgtgcccctggacaccgccggccaccccgagccctgcctgatgttcagacccccccccgccaacgccagcctgcaggacatcctgagccacagattcaacgagacccagccctgcgacatgggctgggagtaccccgagaacagactgcccagcctgaagaacgagttcaacctggtgtgcgacagaaagcacctgaaggacaccacccagagcgtgttcatggccggcctgctggtgggcaccctgatgttcggccccctgtgcgacagagacagaatgggcggcgccctgatggaggacgccggcagaggccccggccccgtgcagctgctgcccagagccgacggcgcctgcggcaccagactgagattcccccagctggaggcccccagcgaccacagacactgcgcctggctgaccgccctgctgctgctgctgggcagcgccagaatctgcaccctggcccccgacccctgggaggacggcagaggcgacaccaccgaccccgagggcggcctgggccagtag

SEQ ID NO: 22170 - DNA, 1662 bp, Artificial Sequence
  Description of Artificial Sequence: Synthetic coding sequence
atggccttccaggacctgctgggccacgccggcgacctgtggagattccagatcctgcagaccgtgttcctgagcatcttcgccgtggccacctacctgcacttcatgctggagaacttcaccgccttcatccccggccacagatgctgggtgcacatcctggacaacgacaccgtgagcgacaacgacaccggcgccctgagccaggacgccctgctgagaatcagcatccccctggacagcaacatgagacccgagaagtgcagaagattcgtgcacccccagtggcagctgctgcacctgaacggcaccttccccaacaccagcgacgccgacatggagccctgcgtggacggctgggtgtacgacagaatcagcttcagcagcaccatcgtgaccgagtgggacctggtgtgcgacagccagagcctgaccagcgtggccaagttcgtgttcatggccggcatgatggtgggcggcatcctgggcggccacctgagcgacagattcggcagaagattcgtgctgagatggtgctacctgcaggtggccatcgtgggcacctgcgccgccctggcccccaccttcctgatctactgcagcctgagattcctgagcggcatcgccgccatgagcctgatcaccaacaccatcatgctgatcgccgagtgggccacccacagattccaggccatgggcatcaccctgggcatgtgccccagcggcatcgccttcatgaccctggccggcctggccttcgccatcagagactggcacatcctgcagctggtggtgagcgtgccctacttcgtgatcttcctgaccagcagctggctgctggagagcgccagatggctgatcatcaacaacaagcccgaggagggcctgaaggagctgagaaaggccgcccacagaagcggcatgaagaacgccagagacaccctgaccctggagatcctgaagagcaccatgaagaaggagctggaggccgcccagaagaagaagcccagcctgtgcgagatgctgcacatgcccaacatctgcaagagaatcagcctgctgagcttcaccagattcgccaacttcatggcctacttcggcctgaacctgcacgtgcagcacctgggcaacaacgtgttcctgctgcagaccctgttcggcgccgtgatcctgctggccaactgcgtggccccctgggccctgaagtacatgaacagaagagccagccagatgctgctgatgttcctgctggccatctgcctgctggccatcatcttcgtgccccaggagatgcagaccctgagagaggtgctggccaccctgggcctgggcgccagcgccctggccaacaccctggccttcgcccacggcaacgaggtgatccccaccatcatcagagccagagccatgggcatcaacgccaccttcgccaacatcgccggcgccctggcccccctgatgatgatcctgagcgtgtacagcccccccctgccctggatcatctacggcgtgttccccttcatcagcggcttcgccttcctgctgctgcccgagaccagaaacaagcccctgttcgacaccatccaggacgagaagaacgagagaaaggaccccagagagcccaagcaggaggaccccagagtggaggtgacccagttctag

SEQ ID NO: 22171 - DNA, 717 bp, Artificial Sequence
  Description of Artificial Sequence: Synthetic coding sequence
atggccttccaggacctgctgggccacgccggcgacctgtggagattccagatcctgcagaccgtgttcctgagcatcttcgccgtggccacctacctgcacttcatgctggagaacttcaccgccttcatccccggccacagatgctgggtgcacatcctggacaacgacaccgtgagcgacaacgacaccggcgccctgagccaggacgccctgctgagaatcagcatccccctggacagcaacatgagacccgagaagtgcagaagattcgtgcacccccagtggcagctgctgcacctgaacggcaccttccccaacaccagcgacgccgacatggagccctgcgtggacggctgggtgtacgacagaatcagcttcagcagcaccatcgtgaccgagtgggacctggtgtgcgacagccagagcctgaccagcgtggccaagttcgtgttcatggccggcatgatggtgggcggcatcctgggcggccacctgagcgacagcagcagagtgggcaacacccagatccccggccacggcaactacatcggcaacgtgcccttctggtactgcatctacgaccccggcagacccggcttctgccacagcagactggcctacccccccgccggcggcgtgtgcaccatcctgtgcgacctgagcgacctgaagctggccgccagagtgtgcagcgtggcccactaccagcagtag

SEQ ID NO: 22172 - DNA, 1626 bp, Artificial Sequence
  Description of Artificial Sequence: Synthetic coding sequence
atggccttcgaggagctgctgagccaggtgggcggcctgggcagattccagatgctgcacctggtgttcatcctgcccagcctgatgctgctgatcccccacatcctgctggagaacttcgccgccgccatccccggccacagatgctgggtgcacatgctggacaacaacaccggcagcggcaacgagaccggcatcctgagcgaggacgccctgctgagaatcagcatccccctggacagcaacctgagacccgagaagtgcagaagattcgtgcacccccagtggcagctgctgcacctgaacggcaccatccacagcaccagcgaggccgacaccgagccctgcgtggacggctgggtgtacgaccagagctacttccccagcaccatcgtgaccaagtgggacctggtgtgcgactaccagagcctgaagagcgtggtgcagttcctgctgctgaccggcatgctggtgggcggcatcatcggcggccacgtgagcgacagattcggcagaagattcatcctgagatggtgcctgctgcagctggccatcaccgacacctgcgccgccttcgcccccaccttccccgtgtactgcgtgctgagattcctggccggcttcagcagcatgatcatcatcagcaacaacagcctgcccatcaccgagtggatcagacccaacagcaaggccctggtggtgatcctgagcagcggcgccctgagcatcggccagatcatcctgggcggcctggcctacgtgttcagagactggcagaccctgcacgtggtggccagcgtgcccttcttcgtgttcttcctgctgagcagatggctggtggagagcgccagatggctgatcatcaccaacaagctggacgagggcctgaaggccctgagaaaggtggccagaaccaacggcatcaagaacgccgaggagaccctgaacatcgaggtggtgagaagcaccatgcaggaggagctggacgccgcccagaccaagaccaccgtgtgcgacctgttcagaaaccccagcatgagaaagagaatctgcatcctggtgttcctgagattcgccaacaccatccccttctacggcaccatggtgaacctgcagcacgtgggcagcaacatcttcctgctgcaggtgctgtacggcgccgtggccctgatcgtgagatgcctggccctgctgaccctgaaccacatgggcagaagaatcagccagatcctgttcatgttcctggtgggcctgagcatcctggccaacaccttcgtgcccaaggagatgcagaccctgagagtggccctggcctgcctgggcatcggctgcagcgccgccaccttcagcagcgtggccgtgcacttcatcgagctgatccccaccgtgctgagagccagagccagcggcatcgacctgaccgccagcagaatcggcgccgccctggcccccctgctgatgaccctgaccgtgttcttcaccaccctgccctggatcatctacggcatcttccccatcatcggcggcctgatcgtgttcctgctgcccgagaccaagaacctgcccctgcccgacaccatcaaggacgtggagaaccagaagaagaacctgaaggagaaggcctag

SEQ ID NO: 22173 - DNA, 1119 bp, Artificial Sequence
  Description of Artificial Sequence: Synthetic coding sequence
atgctggacaacaacaccggcagcggcaacgagaccggcatcctgagcgaggacgccctgctgagaatcagcatccccctggacagcaacctgagacccgagaagtgcagaagattcgtgcacccccagtggcagctgctgcacctgaacggcaccatccacagcaccagcgaggccgacaccgagccctgcgtggacggctgggtgtacgaccagagctacttccccagcaccatcgtgaccaagtgggacctggtgtgcgactaccagagcctgaagagcgtggtgcagttcctgctgctgaccggcatgctggtgggcggcatcatcggcggccacgtgagcgacagattcggcagaagattcatcctgagatggtgcctgctgcagctggccatcaccgacacctgcgccgccttcgcccccaccttccccgtgtactgcgtgctgagattcctggccggcttcagcagcatgatcatcatcagcaacaacagcctgcccatcaccgagtggatcagacccaacagcaaggccctggtggtgatcctgagcagcggcgccctgagcatcggccagatcatcctgggcggcctggcctacgtgttcagagactggcagaccctgcacgtggtggccagcgtgcccttcttcgtgttcttcctgctgagcagatggctggtggagagcgccagatggctgatcatcaccaacaagctggacgagggcctgaaggccctgagaaaggtggccagaaccaacggcatcaagaacgccgaggagaccctgaacatcgaggtggtgagaagcaccatgcaggaggagctggacgccgcccagaccaagaccaccgtgtgcgacctgttcagaaaccccagcatgagaaagagaatctgcatcctggtgttcctgagattcgccaacaccatccccttctacggcaccatggtgaacctgcagcacgtgggcagcaacatcttcctgctgcagaagtgcagaccctgcgtgtggctgtggcacgtgtgggagagcgccgtgctgctgctgctgttccccgtgctgctgttcaccagcctgaacagcagccccctgttcagcggccaggagctgcaggagtag

SEQ ID NO: 22174 - DNA, 444 bp, Artificial Sequence
  Description of Artificial Sequence: Synthetic coding sequence
atgatcatcatcagcaacaacagcctgcccatcaccgagtggatcagacccaacagcaaggccctggtggtgatcctgagcagcggcgccctgagcatcggccagatcatcctgggcggcctggcctacgtgttcagagactggcagaccctgcacgtggtggccagcgtgcccttcttcgtgttcttcctgctgagcagatggctggtggagagcgccagatggctgatcatcaccaacaagctggacgagggcctgaaggccctgagaaaggtggccagaaccaacggcatcaagaacgccgaggagaccctgaacatcgaggtggtgagaagcaccatgcaggaggagctggacgccgcccagaccaagaccaccgtgtgcgacctgttcagaaaccccagcatgagaaagagaatctgcatcctggtgttcctgagatag

SEQ ID NO: 22175 - DNA, 810 bp, Artificial Sequence
  Description of Artificial Sequence: Synthetic coding sequence
atgctggtgggcggcatcatcggcggccacgtgagcgacagattcggcagaagattcatcctgagatggtgcctgctgcagctggccatcaccgacacctgcgccgccttcgcccccaccttccccgtgtactgcgtgctgagattcctggccggcttcagcagcatgatcatcatcagcaacaacagcctgcccatcaccgagtggatcagacccaacagcaaggccctggtggtgatcctgagcagcggcgccctgagcatcggccagatcatcctgggcggcctggcctacgtgttcagagactggcagaccctgcacgtggtggccagcgtgcccttcttcgtgttcttcctgctgagcagatggctggtggagagcgccagatggctgatcatcaccaacaagctggacgagggcctgaaggccctgagaaaggtggccagaaccaacggcatcaagaacgccgaggagaccctgaacatcgaggtggtgagaagcaccatgcaggaggagctggacgccgcccagaccaagaccaccgtgtgcgacctgttcagaaaccccagcatgagaaagagaatctgcatcctggtgttcctgagattcgccaacaccatccccttctacggcaccatggtgaacctgcagcacgtgggcagcaacatcttcctgctgcagaagtgcagaccctgcgtgtggctgtggcacgtgtgggagagcgccgtgctgctgctgctgttccccgtgctgctgttcaccagcctgaacagcagccccctgttcagcggccaggagctgcaggagtag

SEQ ID NO: 22176 - DNA, 1785 bp, Artificial Sequence
  Description of Artificial Sequence: Synthetic coding sequence
atggccggcgaggagaacttcaaggaggagctgagaagccaggacgccagcagaaacctgaaccagcacgaggtggccggccacccccacagctggagcctggagatgctgctgagaagactgagagccgtgcacaccaagcaggacgacaagttcgccaacctgctggacgccgtgggcgagttcggcaccttccagcagagactggtggccctgaccttcatccccagcatcatgagcgccttcttcatgttcgccgaccacttcgtgttcaccgcccagaagccctactgcaacaccagctggatcctggccgtgggcccccacctgagcaaggccgagcagctgaacctgaccatcccccaggcccccaacggcagcttcctgacctgcttcatgtacctgcccgtgccctggaacctggacagcatcatccagttcggcctgaacgacaccgacacctgccaggacggctggatctaccccgacgccaagaagagaagcctgatcaacgagttcgacctggtgtgcggcatggagaccaagaaggacaccgcccagatcatgttcatggccggcctgcccatcggcagcctgatcttcagactgatcaccgacaagatgggcagataccccgccatcctgctgagcctgctgggcctgatcatcttcggcttcggcaccgccttcatgaacagcttccacctgtacctgttcttcagattcggcatcagccagagcgtggtgggctacgccatcagcagcatcagcctggccaccgagtggctggtgggcgagcacagagcccacgccatcatcctgggccactgcttcttcgccgtgggcgccgtgctgctgaccggcatcgcctacagcctgccccactggcagctgctgttcctggtgggcggcatcctggtgatccccttcatcagctacatctggatcctgcccgagagccccagatggctgatgatgaagggcaaggtgaaggaggccaagcaggtgctgtgctacgccgccagcgtgaacaagaagaccatccccagcaacctgctggacgagctgcagctgcccagaaagaaggtgaccagagccagcgtgctggacttctgcaagaacagacagctgtgcaaggtgaccctggtgatgagctgcgtgtggttcaccgtgagctacacctacttcaccctgagcctgagaatgagagagctgggcgtgagcgtgcacttcagacacgtggtgcccagcatcatggaggtgcccgccagactgtgctgcatcttcctgctgcagcagatcggcagaaagtggagcctggccgtgaccctgctgcaggccatcatctggtgcctgctgctgctgttcctgcccgagggcgaggacggcctgagactgaagtggcccagatgccccgccaccgagctgaagagcatgaccatcctggtgctgatgctgagagagttcagcctggccgccaccgtgaccgtgttcttcctgtacaccgccgagctgctgcccaccgtgctgagagccaccggcctgggcctggtgagcctggccagcgtggccggcgccatcctgagcctgaccatcatcagccagacccccagcctgctgcccatcttcctgtgctgcgtgctggccatcgtggccttcagcctgagcagcctgctgcccgagaccagagaccagcccctgagcgagagcctgaaccacagcagccagatcagaaacaaggtgaaggacatgaagaccaaggagaccagcagcgacgacgtgtag

SEQ ID NO: 22177 - DNA, 1785 bp, Artificial Sequence; identical to SEQ ID NO: 22176
  Description of Artificial Sequence: Synthetic coding sequence

SEQ ID NO: 22178 - DNA, 1275 bp, Artificial Sequence
  Description of Artificial Sequence: Synthetic coding sequence
atgcagggcgccagagcccccagagaccagggcagaagccccggcagaatgagcgccctgggcagaagcagcgtgatcctgctgacctacgtgctggccgccaccgagctgacctgcctgttcatgcagttcagcatcgtgccctacctgagcagaaagctgggcctggacagcatcgccttcggctacctgcagaccaccttcggcgtgctgcagctgctgggcggccccgtgttcggcagattcgccgaccagagaggcgccagagccgccctgaccctgagcttcctggccgccctggccctgtacctgctgctggccgccgccagcagccccgccctgcccggcgtgtacctgctgttcgccagcagactgcccggcgccctgatgcacaccctgcccgccgcccagatggtgatcaccgacctgagcgcccccgaggagagacccgccgccctgggcagactgggcctgtgcttcggcgtgggcgtgatcctgggcagcctgctgggcggcaccctggtgagcgcctacggcatccagtgccccgccatcctggccgccctggccaccctgctgggcgccgtgctgagcttcacctgcatccccgccagcaccaagggcgccaagaccgacgcccaggcccccctgcccggcggccccagagccagcgtgttcgacctgaaggccatcgccagcctgctgagactgcccgacgtgcccagaatcttcctggtgaaggtggccagcaactgccccaccggcctgttcatggtgatgttcagcatcatcagcatggacttcttccagctggaggccgcccaggccggctacctgatgagcttcttcggcctgctgcagatggtgacccagggcctggtgatcggccagctgagcagccacttcagcgaggaggtgctgctgagagccagcgtgctggtgttcatcgtggtgggcctggccatggcctggatgagcagcgtgttccacttctgcctgctggtgcccggcctggtgttcagcctgtgcaccctgaacgtggtgaccgacagcatgctgatcaaggccgtgagcaccagcgacaccggcaccatgctgggcctgtgcgccagcgtgcagcccctgctgagaaccctgggccccaccgtgggcggcctgctgtacagaagcttcggcgtgcccgtgttcggccacgtgcaggtggccatcaacaccctggtgctgctggtgctgtggagaaagcccatgccccagagaaaggacaaggtgagatag

SEQ ID NO: 22179 - DNA, 1275 bp, Artificial Sequence; identical to SEQ ID NO: 22178
  Description of Artificial Sequence: Synthetic coding sequence

SEQ ID NO: 22180 - DNA, 1275 bp, Artificial Sequence; identical to SEQ ID NO: 22178
  Description of Artificial Sequence: Synthetic coding sequence

SEQ ID NO: 22181 - DNA, 981 bp, Artificial Sequence
  Description of Artificial Sequence: Synthetic coding sequence
atgcagggcgccagagcccccagagaccagggcagaagccccggcagaatgagcgccctgggcagaagcagcgtgatcctgctgacctacgtgctggccgccaccgagctgacctgcctgttcatgcagttcagcatcgtgccctacctgagcagaaagctgggcctggacagcatcgccttcggctacctgcagaccaccttcggcgtgctgcagctgctgggcggccccgtgttcggcagaatccagtgccccgccatcctggccgccctggccaccctgctgggcgccgtgctgagcttcacctgcatccccgccagcaccaagggcgccaagaccgacgcccaggcccccctgcccggcggccccagagccagcgtgttcgacctgaaggccatcgccagcctgctgagactgcccgacgtgcccagaatcttcctggtgaaggtggccagcaactgccccaccggcctgttcatggtgatgttcagcatcatcagcatggacttcttccagctggaggccgcccaggccggctacctgatgagcttcttcggcctgctgcagatggtgacccagggcctggtgatcggccagctgagcagccacttcagcgaggaggtgctgctgagagccagcgtgctggtgttcatcgtggtgggcctggccatggcctggatgagcagcgtgttccacttctgcctgctggtgcccggcctggtgttcagcctgtgcaccctgaacgtggtgaccgacagcatgctgatcaaggccgtgagcaccagcgacaccggcaccatgctgggcctgtgcgccagcgtgcagcccctgctgagaaccctgggccccaccgtgggcggcctgctgtacagaagcttcggcgtgcccgtgttcggccacgtgcaggtggccatcaacaccctggtgctgctggtgctgtggagaaagcccatgccccagagaaaggacaaggtgagatag

SEQ ID NO: 22182 - DNA, 405 bp, Artificial Sequence
  Description of Artificial Sequence: Synthetic coding sequence
atgcagggcgccagagcccccagagaccagggcagaagccccggcagaatgagcgccctgggcagaagcagcgtgatcctgctgacctacgtgctggccgccaccgagctgacctgcctgttcatgcagttcagcatcgtgccctacctgagcagaaagctgggcctggacagcatcgccttcggctacctgcagaccaccttcggcgtgctgcagctgctgggcggccccgtgttcggcagattcgccgaccagagaggcgccagagccgccctgaccctgagcttcctggccgccctggccctgtacctgctgctggccgccgccagcagccccgccctgcccggcgtgtacctgctgttcgccagcagactgcccggcgccctgatgcacaccctgccctag

SEQ ID NO: 22183 - DNA, 1644 bp, Artificial Sequence
  Description of Artificial Sequence: Synthetic coding sequence
atggccttccaggacctgctggaccaggtgggcggcctgggcagattccagatcctgcagatggtgttcctgatcatgttcaacgtgatcgtgtaccaccagacccagctggagaacttcgccgccttcatcctggaccacagatgctgggtgcacatcctggacaacgacaccatccccgacaacgaccccggcaccctgagccaggacgccctgctgagaatcagcatccccttcgacagcaacctgagacccgagaagtgcagaagattcgtgcacccccagtggaagctgatccacctgaacggcaccttccccaacaccagcgagcccgacaccgagccctgcgtggacggctgggtgtacgaccagagcagcttccccagcaccatcgtgaccaagtgggacctggtgtgcgagagccagcccctgaacagcgtggccaagttcctgttcatggccggcatgatggtgggcggcaacctgtacggccacctgagcgacagattcggcagaaagttcgtgctgagatggagctacctgcagctggccatcgtgggcacctgcgccgccttcgcccccaccatcctggtgtactgcagcctgagattcctggccggcgccgccaccttcagcatcatcgtgaacaccgtgctgctgatcgtggagtggatcacccaccagttctgcgccatggccctgaccctgaccctgtgcgccgccagcatcggccacatcaccctgggcagcctggccttcgtgatcagagaccagtgcatcctgcagctggtgatgagcgccccctgcttcgtgttcttcctgttcagcagatggctggccgagagcgccagatggctgatcatcaacaacaagcccgaggagggcctgaaggagctgagaaaggccgcccacagaaacggcatgaagaacgccgaggacatcctgaccatggaggtgctgaagagcaccatgaagcaggagctggaggccgcccagaagaagcacagcctgtgcgagctgctgagaatccccaacatctgcaagagaatctgcttcctgagcttcgtgagattcgccagcaccatccccttctggggcctgaccctgcacctgcagcacctgggcaacaacgtgttcctgctgcagaccctgttcggcgccgtgaccctgctggccaactgcgtggccccctgggccctgaaccacatgagcagaagactgagccagatgctgctgatgttcctgctggccacctgcctgctggccatcatcttcgtgccccaggagatgcagaccctgagagtggtgctggccaccctgggcgtgggcgccgccagcctgggcatcacctgcagcaccgcccaggagaacgagctgatccccagcatcatcagaggcagagccaccggcatcaccggcaacttcgccaacatcggcggcgccctggccagcctgatgatgatcctgagcatctacagcagacccctgccctggatcatctacggcgtgttcgccatcctgagcggcctggtggtgctgctgctgcccgagaccagaaaccagcccctgctggacagcatccaggacgtggagaacgagggcgtgaacagcctggccgccccccagagaagcagcgtgctgtag

SEQ ID NO: 22184 - DNA, 705 bp, Artificial Sequence
  Description of Artificial Sequence: Synthetic coding sequence
atgaacatgttcggcagaaagttcgtgctgagatggagctacctgcagctggccatcgtgggcacctgcgccgccttcgcccccaccatcctggtgtactgcagcctgagattcctggccggcgccgccaccttcagcatcatcgtgaacaccgtgctgctgatcgtggagtggatcacccaccagttctgcgccatggccctgaccctgaccctgtgcgccgccagcatcggccacatcaccctgggcagcctggccttcgtgatcagagaccagtgcatcctgcagctggtgatgagcgccccctgcttcgtgttcttcctgttcagcagatggctggccgagagcgccagatggctgatcatcaacaacaagcccgaggagggcctgaaggagctgagaaaggccgcccacagaaacggcatgaagaacgccgaggacatcctgaccatggaggtgctgaagagcaccatgaagcaggagctggaggccgcccagaagaagcacagcctgtgcgagctgctgagaatccccaacatctgcaagagaatctgcttcctgagcttcgtgagaagcgccggcgtgtgctggagaagcacccccgaccccgtgtgcctgggcatcaccagcggcggctgcagaaccgccaagatccccgcctgcagcttcctgtggaagctgcacttcagaggcgcccccgcctag

SEQ ID NO: 22185 - DNA, 609 bp, Artificial Sequence
  Description of Artificial Sequence: Synthetic coding sequence
atggccttccaggacctgctggaccaggtgggcggcctgggcagattccagatcctgcagatggtgttcctgatcatgttcaacgtgatcgtgtaccaccagacccagctggagaacttcgccgccttcatcctggaccacagatgctgggtgcacatcctggacaacgacaccatccccgacaacgaccccggcaccctgagccaggacgccctgctgagaatcagcatccccttcgacagcaacctgagacccgagaagtgcagaagattcgtgcacccccagtggaagctgatccacctgaacggcaccttccccaacaccagcgagcccgacaccgagccctgcgtggacggctgggtgtacgaccagagcagcttccccagcaccatcgtgaccaagtgggacctggtgtgcgagagccagcccctgaacagcgtggccaagttcctgttcatggccggcatgatggtgggcggcaacctgtacggccacctgagcgacagaaagcccctgagcagccccaaccacgtgagcaccgactgcgacgagggcctggaggtgcccatcgccatccaccagcaccacgtgttctggtacctgagctag

SEQ ID NO: 22186 - DNA, 1200 bp, Artificial Sequence
  Description of Artificial Sequence: Synthetic coding sequence
tgattccaggacctgctggaccaggtgggcggcctgggcagattccagatcctgcagatggtgttcctgatcatgttcaacgtgatcgtgtaccaccagacccagctggagaacttcgccgccttcatcctggaccacagatgctgggtgcacatcctggacaacgacaccatccccgacaacgaccccggcaccctgagccaggacgccctgctgagaatcagcatccccttcgacagcaacctgagacccgagaagtgcagaagattcgtgcacccccagtggaagctgatccacctgaacggcaccttccccaacaccagcgagcccgacaccgagccctgcgtggacggctgggtgtacgaccagagcagcttccccagcaccatcgtgaccaagtgggacctggtgtgcgagagccagcccctgaacagcgtggccaagttcctgttcatggccggcatgatggtgggcggcaacctgtacggccacctgagcgacagattcggcagaaagttcgtgctgagatggagctacctgcagctggccatcgtgggcacctgcgccgccttcgcccccaccatcctggtgtactgcagcctgagattcctggccggcgccgccaccttcagcatcatcgtgaacaccgtgctgctgatcgtggagtggatcacccaccagttctgcgccatggccctgaccctgaccctgtgcgccgccagcatcggccacatcaccctgggcagcctggccttcgtgatcagagaccagtgcatcctgcagctggtgatgagcgccccctgcttcgtgttcttcctgttcagcagatggctggccgagagcgccagatggctgatcatcaacaacaagcccgaggagggcctgaaggagctgagaaaggccgcccacagaaacggcatgaagaacgccgaggacatcctgaccatggaggtgctgaagagcaccatgaagcaggagctggaggccgcccagaagaagcacagcctgtgcgagctgctgagaatccccaacatctgcaagagaatctgcttcctgagcttcgtgagaagcgccggcgtgtgctggagaagcacccccgaccccgtgtgcctgggcatcaccagcggcggctgcagaaccgccaagatccccgcctgcagcttcctgtggaagctgcacttcagaggcgcccccgcctag

SEQ ID NO: 22187 - DNA, 1482 bp, Artificial Sequence
  Description of Artificial Sequence: Synthetic coding sequence
atgagcagaagccccctgaaccccagccagctgagaagcgtgggcagccaggacgccctggcccccctgcccccccccgccccccagaaccccagcacccacagctgggaccccctgtgcggcagcctgccctggggcctgagctgcctgctggccctgcagcacgtgctggtgatggccagcctgctgtgcgtgagccacctgctgctgctgtgcagcctgagccccggcggcctgagctacagccccagccagctgctggccagcagcttcttcagctgcggcatgagcaccatcctgcagacctggatgggcagcagactgcccctggtgcaggcccccagcctggagttcctgatccccgccctggtgctgaccagccagaagctgcccagagccatccagacccccggcaacagcagcctgatgctgcacctgtgcagaggccccagctgccacggcctgggccactggaacaccagcctgcaggaggtgagcggcgccgtggtggtgagcggcctgctgcagggcatgatgggcctgctgggcagccccggccacgtgttcccccactgcggccccctggtgctggcccccagcctggtggtggccggcctgagcgcccacagagaggtggcccagttctgcttcacccactggggcctggccctgctgacctgggcccccgccagcttcatgtgcgcccccggcggcgagctgcagagacaccagctgaccctgctgagcctgagcagcggcagcttcagaaactgcctgcccccccccagacaccacggcttcggctgcctgacccaggccggcagccagcaggtggcccacctggtgggcctgctgtgcgtgggcctgggcctgagccccagactggcccagctgctgaccaccatccccctgcccgtggtgggcggcgtgctgggcgtgacccaggccgtggtgctgagcgccggcttcagcagcttctacctggccgacatcgacagcggcagaaacatcttcatcgtgggcttcagcatcttcatggccctgctgctgcccagatggttcagagaggcccccgtgctgttcagcaccggctggagccccctggacgtgctgctgcacagcctgctgacccagcccatcttcctggccggcctgagcggcttcctgctggagaacaccatccccggcacccagctggagagaggcctgggccagggcctgcccagccccttcaccgcccaggaggccagaatgccccagaagcccagagagaaggccgcccaggtgtacagactgcccttccccatccagaacctgtgcccctgcatcccccagcccctgcactgcctgtgccccctgcccgaggaccccggcgacgaggagggcggcagcagcgagcccgaggagatggccgacctgctgcccggcagcggcgagccctgccccgagagcagcagagagggcttcagaagccagaagtag

SEQ ID NO: 22188 - DNA, 585 bp, Artificial Sequence
  Description of Artificial Sequence: Synthetic coding sequence
atggccagcctgctgtgcgtgagccacctgctgctgctgtgcagcctgagccccggcggcctgagctacagccccagccagctgctggccagcagcttcttcagctgcggcatgagcaccatcctgcagacctggatgggcagcagactgcccctggtgcaggcccccagcctggagttcctgatccccgccctggtgctgaccagccagaagctgcccagagccatccagacccccggcaacagcagcctgatgctgcacctgtgcagaggccccagctgccacggcctgggccactggaacaccagcctgcaggagggctaccccgcccacggcggcctgttcagcgcccccggcctgctgcccgtgagctgcgtgcccctggaggccagcttcaacgtgatcaacagccacagcagcccctgcctgcccgcccccttcggcgccgaccccagcggcctgtgcgtggactgcttctgcctgtgcggcatccagtgctacccccccggcaccgtgtgcccccaccagggcaccatggacctggccgccagccccagactggacctgagcaagtggctgacctag

SEQ ID NO: 22189 - DNA, 1833 bp, Artificial Sequence
  Description of Artificial Sequence: Synthetic coding sequence
atgagcagaagccccctgaaccccagccagctgagaagcgtgggcagccaggacgccctggcccccctgcccccccccgccccccagaaccccagcacccacagctgggaccccctgtgcggcagcctgccctggggcctgagctgcctgctggccctgcagcacgtgctggtgatggccagcctgctgtgcgtgagccacctgctgctgctgtgcagcctgagccccggcggcctgagctacagccccagccagctgctggccagcagcttcttcagctgcggcatgagcaccatcctgcagacctggatgggcagcagactgcccctggtgcaggcccccagcctggagttcctgatccccgccctggtgctgaccagccagaagctgcccagagccatccagacccccggcaacagcagcctgatgctgcacctgtgcagaggccccagctgccacggcctgggccactggaacaccagcctgcaggaggtgagcggcgccgtggtggtgagcggcctgctgcagggcatgatgggcctgctgggcagccccggccacgtgttcccccactgcggccccctggtgctggcccccagcctggtggtggccggcctgagcgcccacagagaggtggcccagttctgcttcacccactggggcctggccctgctggtgatcctgctgatggtggtgtgcagccagcacctgggcagctgccagttccacgtgtgcccctggagaagagccagcaccagcagcacccacacccccctgcccgtgttcagactgctgagcgtgctgatccccgtggcctgcgtgtggatcgtgagcgccttcgtgggcttcagcgtgatcccccaggagctgagcgcccccaccaaggccccctggatctggctgccccaccccggcgagtggaactggcccctgctgacccccagagccctggccgccggcatcagcatggccctggccgccagcaccagcagcctgggctgctacgccctgtgcggcagactgctgcacctgccccccccccccccccacgcctgcagcagaggcctgagcctggagggcctgggcagcgtgctggccggcctgctgggcagccccatgggcaccgccagcagcttccccaacgtgggcaaggtgggcctgatccaggccggcagccagcaggtggcccacctggtgggcctgctgtgcgtgggcctgggcctgagccccagactggcccagctgctgaccaccatccccctgcccgtggtgggcggcgtgctgggcgtgacccaggccgtggtgctgagcgccggcttcagcagcttctacctggccgacatcgacagcggcagaaacatcttcatcgtgggcttcagcatcttcatggccctgctgctgcccagatggttcagagaggcccccgtgctgttcagcaccggctggagccccctggacgtgctgctgcacagcctgctgacccagcccatcttcctggccggcctgagcggcttcctgctggagaacaccatccccggcacccagctggagagaggcctgggccagggcctgcccagccccttcaccgcccaggaggccagaatgccccagaagcccagagagaaggccgcccaggtgtacagactgcccttccccatccagaacctgtgcccctgcatcccccagcccctgcactgcctgtgccccctgcccgaggaccccggcgacgaggagggcggcagcagcgagcccgaggagatggccgacctgctgcccggcagcggcgagccctgccccgagagcagcagagagggcttcagaagccagaagtag

SEQ ID NO: 22190 - DNA, 1857 bp, Artificial Sequence
  Description of Artificial Sequence: Synthetic coding sequence
atgagcagaagccccctgaaccccagccagctgagaagcgtgggcagccaggacgccctggcccccctgcccccccccgccccccagaaccccagcacccacagctgggaccccctgtgcggcagcctgccctggggcctgagctgcctgctggccctgcagcacgtgctggtgatggccagcctgctgtgcgtgagccacctgctgctgctgtgcagcctgagccccggcggcctgagctacagccccagccagctgctggccagcagcttcttcagctgcggcatgagcaccatcctgcagacctggatgggcagcagactgcccctggtgcaggcccccagcctggagttcctgatccccgccctggtgctgaccagccagaagctgcccagagccatccagacccccggcaactgcgagcacagagccagagccagagccagcctgatgctgcacctgtgcagaggccccagctgccacggcctgggccactggaacaccagcctgcaggaggtgagcggcgccgtggtggtgagcggcctgctgcagggcatgatgggcctgctgggcagccccggccacgtgttcccccactgcggccccctggtgctggcccccagcctggtggtggccggcctgagcgcccacagagaggtggcccagttctgcttcacccactggggcctggccctgctggtgatcctgctgatggtggtgtgcagccagcacctgggcagctgccagttccacgtgtgcccctggagaagagccagcaccagcagcacccacacccccctgcccgtgttcagactgctgagcgtgctgatccccgtggcctgcgtgtggatcgtgagcgccttcgtgggcttcagcgtgatcccccaggagctgagcgcccccaccaaggccccctggatctggctgccccaccccggcgagtggaactggcccctgctgacccccagagccctggccgccggcatcagcatggccctggccgccagcaccagcagcctgggctgctacgccctgtgcggcagactgctgcacctgccccccccccccccccacgcctgcagcagaggcctgagcctggagggcctgggcagcgtgctggccggcctgctgggcagccccatgggcaccgccagcagcttccccaacgtgggcaaggtgggcctgatccaggccggcagccagcaggtggcccacctggtgggcctgctgtgcgtgggcctgggcctgagccccagactggcccagctgctgaccaccatccccctgcccgtggtgggcggcgtgctgggcgtgacccaggccgtggtgctgagcgccggcttcagcagcttctacctggccgacatcgacagcggcagaaacatcttcatcgtgggcttcagcatcttcatggccctgctgctgcccagatggttcagagaggcccccgtgctgttcagcaccggctggagccccctggacgtgctgctgcacagcctgctgacccagcccatcttcctggccggcctgagcggcttcctgctggagaacaccatccccggcacccagctggagagaggcctgggccagggcctgcccagccccttcaccgcccaggaggccagaatgccccagaagcccagagagaaggccgcccaggtgtacagactgcccttccccatccagaacctgtgcccctgcatcccccagcccctgcactgcctgtgccccctgcccgaggaccccggcgacgaggagggcggcagcagcgagcccgaggagatggccgacctgctgcccggcagcggcgagccctgccccgagagcagcagagagggcttcagaagccagaagtag

SEQ ID NO: 22191 - DNA, 1434 bp, Artificial Sequence
  Description of Artificial Sequence: Synthetic coding sequence
atgctgagatggctgagagacttcgtgctgcccaccgccgcctgccaggacgccgagcagcccaccagatacgagaccctgttccaggccctggacagaaacggcgacggcgtggtggacatcggcgagctgcaggagggcctgagaaacctgggcatccccctgggccaggacgccgaggagaagatcttcaccaccggcgacgtgaacaaggacggcaagctggacttcgaggagttcatgaagtacctgaaggaccacgagaagaagatgaagctggccttcaagagcctggacaagaacaacgacggcaagatcgaggccagcgagatcgtgcagagcctgcagaccctgggcctgaccatcagcgagcagcaggccgagctgatcctgcagagcatcgacgtggacggcaccatgaccgtggactggaacgagtggagagactacttcctgttcaaccccgtgaccgacatcgaggagatcatcagattctggaagcacagcaccggcatcgacatcggcgacagcctgaccatccccgacgagttcaccgaggacgagaagaagagcggccagtggtggagacagctgctggccggcggcatcgccggcgccgtgagcagaaccagcaccgcccccctggacagactgaagatcatgatgcaggtgcacggcagcaagagcgacaagatgaacatcttcggcggcttcagacagatggtgaaggagggcggcatcagaagcctgtggagaggcaacggcaccaacgtgatcaagatcgcccccgagaccgccgtgaagttctgggcctacgagcagtacaagaagctgctgaccgaggagggccagaagatcggcaccttcgagagattcatcagcggcagcatggccggcgccaccgcccagaccttcatctaccccatggaggtgatgaagaccagactggccgtgggcaagaccggccagtacagcggcatctacgactgcgccaagaagatcctgaagcacgagggcctgggcgccttctacaagggctacgtgcccaacctgctgggcatcatcccctacgccggcatcgacctggccgtgtacgagctgctgaagagctactggctggacaacttcgccaaggacagcgtgaaccccggcgtgatggtgctgctgggctgcggcgccctgagcagcacctgcggccagctggccagctaccccctggccctggtgagaaccagaatgcaggcccaggccatgctggagggcagcccccagctgaacatggtgggcctgttcagaagaatcatcagcaaggagggcatccccggcctgtacagaggcatcacccccaacttcatgaaggtgctgcccgccgtgggcatcagctacgtggtgtacgagaacatgaagcagaccctgggcgtgacccagaagtag

SEQ ID NO: 22192 - DNA, 1449 bp, Artificial Sequence
  Description of Artificial Sequence: Synthetic coding sequence
atgagaggcagccccggcgacgccgagagaagacagagatggggcagactgttcgaggagctggacagcaacaaggacggcagagtggacgtgcacgagctgagacagggcctggccagactgggcggcggcaaccccgaccccggcgcccagcagggcatcagcagcgagggcgacgccgaccccgacggcggcctggacctggaggagttcagcagatacctgcaggagagagagcagagactgctgctgatgttccacagcctggacagaaaccaggacggccacatcgacgtgagcgagatccagcagagcttcagagccctgggcatcagcatcagcctggagcaggccgagaagatcctgcacagcatggacagagacggcaccatgaccatcgactggcaggagtggagagaccacttcctgctgcacagcctggagaacgtggaggacgtgctgtacttctggaagcacagcaccctgagcagcgccggcttcagcgcctggatcaaggacagcaccgccgagcagaacagaagcaagaccaccgtgctggccagaagaagcggcagccacctgaagagccagcacttcggcagacccaagtgggccgaccacgaggtgctggacatcggcgagtgcctgaccgtgcccgacgagttcagcaagcaggagaagctgaccggcatgtggtggaagcagctggtggccggcgccgtggccggcgccgtgagcagaaccggcaccgcccccctggacagactgaaggtgttcatgcaggtgcacgccagcaagaccaacagactgaacatcctgggcggcctgagaagcatggtgctggagggcggcatcagaagcctgtggagaggcaacggcatcaacgtgctgaagatcgcccccgagagcgccatcaagttcatggcctacgagcagatcaagagagccatcctgggccagcaggagaccctgcacgtgcaggagagattcgtggccggcagcctggccggcgccaccgcccagaccatcatctaccccatggaggtgctgaagaccagactgaccctgagaagaaccggccagtacaagggcctgctggactgcgccagaagaatcctggagagagagggccccagagccttctacagaggctacctgcccaacgtgctgggcatcatcccctacgccggcatcgacctggccgtgtacgagaccctgaagaactggtggctgcagcagtacagccacgacagcgccgaccccggcatcctggtgctgctggcctgcggcaccatcagcagcacctgcggccagatcgccagctaccccctggccctggtgagaaccagaatgcaggcccagggctggagcaccgtggccagattccagatcaccgccaccagcgccttccaggtgcaggccatcctgctgccccagccccccgagtag

SEQ ID NO: 22193 - DNA, 1407 bp, Artificial Sequence
  Description of Artificial Sequence: Synthetic coding sequence
atgagaggcagccccggcgacgccgagagaagacagagatggggcagactgttcgaggagctggacagcaacaaggacggcagagtggacgtgcacgagctgagacagggcctggccagactgggcggcggcaaccccgaccccggcgcccagcagggcatcagcagcgagggcgacgccgaccccgacggcggcctggacctggaggagttcagcagatacctgcaggagagagagcagagactgctgctgatgttccacagcctggacagaaaccaggacggccacatcgacgtgagcgagatccagcagagcttcagagccctgggcatcagcatcagcctggagcaggccgagaagatcctgcacagcatggacagagacggcaccatgaccatcgactggcaggagtggagagaccacttcctgctgcacagcctggagaacgtggaggacgtgctgtacttctggaagcacagcaccgtgctggacatcggcgagtgcctgaccgtgcccgacgagttcagcaagcaggagaagctgaccggcatgtggtggaagcagctggtggccggcgccgtggccggcgccgtgagcagaaccggcaccgcccccctggacagactgaaggtgttcatgcaggtgcacgccagcaagaccaacagactgaacatcctgggcggcctgagaagcatggtgctggagggcggcatcagaagcctgtggagaggcaacggcatcaacgtgctgaagatcgcccccgagagcgccatcaagttcatggcctacgagcagatcaagagagccatcctgggccagcaggagaccctgcacgtgcaggagagattcgtggccggcagcctggccggcgccaccgcccagaccatcatctaccccatggaggtgctgaagaccagactgaccctgagaagaaccggccagtacaagggcctgctggactgcgccagaagaatcctggagagagagggccccagagccttctacagaggctacctgcccaacgtgctgggcatcatcccctacgccggcatcgacctggccgtgtacgagaccctgaagaactggtggctgcagcagtacagccacgacagcgccgaccccggcatcctggtgctgctggcctgcggcaccatcagcagcacctgcggccagatcgccagctaccccctggccctggtgagaaccagaatgcaggcccaggccagcatcgagggcggcccccagctgagcatgctgggcctgctgagacacatcctgagccaggagggcatgagaggcctgtacagaggcatcgcccccaacttcatgaaggtgatccccgccgtgagcatcagctacgtggtgtacgagaacatgaagcaggccctgggcgtgaccagcagatag

SEQ ID NO: 22194 - DNA, 1317 bp, Artificial Sequence
  Description of Artificial Sequence: Synthetic coding sequence
atgagaggcagccccggcgacgccgagagaagacagagatggggcagactgttcgaggagctggacagcaacaaggacggcagagtggacgtgcacgagctgagacagggcctggccagactgggcggcggcaaccccgaccccggcgcccagcagggcatcagcagcgagggcgacgccgaccccgacggcggcctggacctggaggagttcagcagatacctgcaggagagagagcagagactgctgctgatgttccacagcctggacagaaaccaggacggccacatcgacgtgagcgagatccagcagagcttcagagccctgggcatcagcatcagcctggagcaggccgagaagatcctgcacagcatggacagagacggcaccatgaccatcgactggcaggagtggagagaccacttcctgctgcacagcctggagaacgtggaggacgtgctgtacttctggaagcacagcaccgtgctggacatcggcgagtgcctgaccgtgcccgacgagttcagcaagcaggagaagctgaccggcatgtggtggaagcagctggtggccggcgccgtggccggcgccgtgagcagaaccggcaccgcccccctggacagactgaaggtgttcatgcaggtgcacgccagcaagaccaacagactgaacatcctgggcggcctgagaagcatggtgctggagggcggcatcagaagcctgtggagaggcaacggcatcaacgtgctgaagatcgcccccgagagcgccatcaagttcatggcctacgagcagatcaagagagccatcctgggccagcaggagaccctgcacgtgcaggagagattcgtggccggcagcctggccggcgccaccgcccagaccatcatctaccccatggaggtgctgaagaccagactgaccctgagaagaaccggccagtacaagggcctgctggactgcgccagaagaatcctggagagagagggccccagagccttctacagaggctacctgcccaacgtgctgggcatcatcccctacgccggcatcgacctggccgtgtacgagaccctgaagaactggtggctgcagcagtacagccacgacagcgccgaccccggcatcctggtgctgctggcctgcggcaccatcagcagcacctgcggccagatcgccagctaccccctggccctggtgagaaccagaatgcaggcccaggacgtgagcgtgtacaagaccgacaccgtgcccaccctgatcgagctgaccggcagaagaggcagaaagatgctgaacaagagcttctggaactag

SEQ ID NO: 22195 - DNA, 690 bp, Artificial Sequence
  Description of Artificial Sequence: Synthetic coding sequence
atgtggtggaagcagctggtggccggcgccgtggccggcgccgtgagcagaaccggcaccgcccccctggacagactgaaggtgttcatgcaggtgcacgccagcaagaccaacagactgaacatcctgggcggcctgagaagcatggtgctggagggcggcatcagaagcctgtggagaggcaacggcatcaacgtgctgaagatcgcccccgagagcgccatcaagttcatggcctacgagcagatcaagagagccatcctgggccagcaggagaccctgcacgtgcaggagagattcgtggccggcagcctggccggcgccaccgcccagaccatcatctaccccatggagaccctgaagaactggtggctgcagcagtacagccacgacagcgccgaccccggcatcctggtgctgctggcctgcggcaccatcagcagcacctgcggccagatcgccagctaccccctggccctggtgagaaccagaatgcaggcccaggccagcatcgagggcggcccccagctgagcatgctgggcctgctgagacacatcctgagccaggagggcatgagaggcctgtacagaggcatcgcccccaacttcatgaaggtgatccccgccgtgagcatcagctacgtggtgtacgagaacatgaagcaggccctgggcgtgaccagcagatag

SEQ ID NO: 22196 - DNA, 372 bp, Artificial Sequence
  Description of Artificial Sequence: Synthetic coding sequence
atggaggtgctgaagaccagactgaccctgagaagaaccggccagtacaagggcctgctggactgcgccagaagaatcctggagagagagggccccagagccttctacagaggctacctgcccaacgtgctgggcatcatcccctacgccggcatcgacctggccgtgtacgagaccctgaagaactggtggctgcagcagtacagccacgacagcgccgaccccggcatcctggtgctgctggcctgcggcaccatcagcagcacctgcggccagatcgccagctaccccctggccctggtgagaaccagaatgcaggcccaggccggcggccacgccatgagcagcctgatggagagaaccatgtggtag

SEQ ID NO: 22197 - DNA, 1434 bp, Artificial Sequence; identical to SEQ ID NO: 22191
  Description of Artificial Sequence: Synthetic coding sequence

SEQ ID NO: 22198 - DNA, 1377 bp, Artificial Sequence
  Description of Artificial Sequence: Synthetic coding sequence
atggacagcctgtacggcgacctgttctggtacctggactacaacaaggacggcaccctggacatcttcgagctgcaggagggcctggaggacgtgggcgccatccagagcctggaggaggccaagaagatcttcaccaccggcgacgtgaacaaggacggcaagctggacttcgaggagttcatgaagtacctgaaggaccacgagaagaagatgaagctggccttcaagagcctggacaagaacaacgacggcaagatcgaggccagcgagatcgtgcagagcctgcagaccctgggcctgaccatcagcgagcagcaggccgagctgatcctgcagagcatcgacgtggacggcaccatgaccgtggactggaacgagtggagagactacttcctgttcaaccccgtgaccgacatcgaggagatcatcagattctggaagcacagcaccggcatcgacatcggcgacagcctgaccatccccgacgagttcaccgaggacgagaagaagagcggccagtggtggagacagctgctggccggcggcatcgccggcgccgtgagcagaaccagcaccgcccccctggacagactgaagatcatgatgcaggtgcacggcagcaagagcgacaagatgaacatcttcggcggcttcagacagatggtgaaggagggcggcatcagaagcctgtggagaggcaacggcaccaacgtgatcaagatcgcccccgagaccgccgtgaagttctgggcctacgagcagtacaagaagctgctgaccgaggagggccagaagatcggcaccttcgagagattcatcagcggcagcatggccggcgccaccgcccagaccttcatctaccccatggaggtgatgaagaccagactggccgtgggcaagaccggccagtacagcggcatctacgactgcgccaagaagatcctgaagcacgagggcctgggcgccttctacaagggctacgtgcccaacctgctgggcatcatcccctacgccggcatcgacctggccgtgtacgagctgctgaagagctactggctggacaacttcgccaaggacagcgtgaaccccggcgtgatggtgctgctgggctgcggcgccctgagcagcacctgcggccagctggccagctaccccctggccctggtgagaaccagaatgcaggcccaggccatgctggagggcagcccccagctgaacatggtgggcctgttcagaagaatcatcagcaaggagggcatccccggcctgtacagaggcatcacccccaacttcatgaaggtgctgcccgccgtgggcatcagctacgtggtgtacgagaacatgaagcagaccctgggcgtgacccagaagtag

SEQ ID NO: 22199 - DNA, 1410 bp, Artificial Sequence
  Description of Artificial Sequence: Synthetic coding sequence
atgctgtgcctgtgcctgtacgtgcccgtgatcggcgaggcccagaccgagttccagtacttcgagagcaagggcctgcccgccgagctgaagagcatcttcaagctgagcgtgttcatccccagccaggagttcagcacctacagacagtggaagcagaagatcgtgcaggccggcgacaaggacctggacggccagctggacttcgaggagttcgtgcactacctgcaggaccacgagaagaagctgagactggtgttcaagagcctggacaagaagaacgacggcagaatcgacgcccaggagatcatgcagagcctgagagacctgggcgtgaagatcagcgagcagcaggccgagaagatcctgaagagcatggacaagaacggcaccatgaccatcgactggaacgagtggagagactaccacctgctgcaccccgtggagaacatccccgagatcatcctgtactggaagcacagcaccatcttcgacgtgggcgagaacctgaccgtgcccgacgagttcaccgtggaggagagacagaccggcatgtggtggagacacctggtggccggcggcggcgccggcgccgtgagcagaacctgcaccgcccccctggacagactgaaggtgctgatgcaggtgcacgccagcagaagcaacaacatgggcatcgtgggcggcttcacccagatgatcagagagggcggcgccagaagcctgtggagaggcaacggcatcaacgtgctgaagatcgcccccgagagcgccatcaagttcatggcctacgagcagatcaagagactggtgggcagcgaccaggagaccctgagaatccacgagagactggtggccggcagcctggccggcgccatcgcccagagcagcatctaccccatggaggtgctgaagaccagaatggccctgagaaagaccggccagtacagcggcatgctggactgcgccagaagaatcctggccagagagggcgtggccgccttctacaagggctacgtgcccaacatgctgggcatcatcccctacgccggcatcgacctggccgtgtacgagaccctgaagaacgcctggctgcagcactacgccgtgaacagcgccgaccccggcgtgttcgtgctgctggcctgcggcaccatgagcagcacctgcggccagctggccagctaccccctggccctggtgagaaccagaatgcaggcccaggccagcatcgagggcgcccccgaggtgaccatgagcagcctgttcaagcacatcctgagaaccgagggcgccttcggcctgtacagaggcctggcccccaacttcatgaaggtgatccccgccgtgagcatcagctacgtggtgtacgagaacctgaagatcaccctgggcgtgcagagcagatag

SEQ ID NO: 22200 - DNA, 1506 bp, Artificial Sequence
  Description of Artificial Sequence: Synthetic coding sequence
atgctgcagatgctgtggcacttcctggccagcttcttccccagagccggctgccacggcagcagagagggcgacgacagagaggtgagaggcacccccgcccccgcctggagagaccagatggccagcttcctgggcaagcaggacggcagagccgaggccaccgagaagagacccaccatcctgctggtggtgggccccgccgagcagttccccaagaagatcgtgcaggccggcgacaaggacctggacggccagctggacttcgaggagttcgtgcactacctgcaggaccacgagaagaagctgagactggtgttcaagagcctggacaagaagaacgacggcagaatcgacgcccaggagatcatgcagagcctgagagacctgggcgtgaagatcagcgagcagcaggccgagaagatcctgaagagaatcagaaccggccacttctggggccccgtgacctacatggacaagaacggcaccatgaccatcgactggaacgagtggagagactaccacctgctgcaccccgtggagaacatccccgagatcatcctgtactggaagcacagcaccatcttcgacgtgggcgagaacctgaccgtgcccgacgagttcaccgtggaggagagacagaccggcatgtggtggagacacctggtggccggcggcggcgccggcgccgtgagcagaacctgcaccgcccccctggacagactgaaggtgctgatgcaggtgcacgccagcagaagcaacaacatgggcatcgtgggcggcttcacccagatgatcagagagggcggcgccagaagcctgtggagaggcaacggcatcaacgtgctgaagatcgcccccgagagcgccatcaagttcatggcctacgagcagatcaagagactggtgggcagcgaccaggagaccctgagaatccacgagagactggtggccggcagcctggccggcgccatcgcccagagcagcatctaccccatggaggtgctgaagaccagaatggccctgagaaagaccggccagtacagcggcatgctggactgcgccagaagaatcctggccagagagggcgtggccgccttctacaagggctacgtgcccaacatgctgggcatcatcccctacgccggcatcgacctggccgtgtacgagaccctgaagaacgcctggctgcagcactacgccgtgaacagcgccgaccccggcgtgttcgtgctgctggcctgcggcaccatgagcagcacctgcggccagctggccagctaccccctggccctggtgagaaccagaatgcaggcccaggccagcatcgagggcgcccccgaggtgaccatgagcagcctgttcaagcacatcctgagaaccgagggcgccttcggcctgtacagaggcctggcccccaacttcatgaaggtgatccccgccgtgagcatcagctacgtggtgtacgagaacctgaagatcaccctgggcgtgcagagcagatag

SEQ ID NO: 22201 - DNA, 1512 bp, Artificial Sequence
  Description of Artificial Sequence: Synthetic coding sequence
atggtgagcagcgtgctgtgcagatgcgtggccagccccccccccgacgccgccgccaccgccgccagcagcagcgccagcagccccgccagcgtgggcgacccctgcggcggcgccatctgcggcggccccgaccacagactgagactgtggagactgttccagaccctggacgtgaacagagacggcggcctgtgcgtgaacgacctggccgtgggcctgagaagactgggcctgcacagaaccgagggcgagctgcagaagatcgtgcaggccggcgacaaggacctggacggccagctggacttcgaggagttcgtgcactacctgcaggaccacgagaagaagctgagactggtgttcaagagcctggacaagaagaacgacggcagaatcgacgcccaggagatcatgcagagcctgagagacctgggcgtgaagatcagcgagcagcaggccgagaagatcctgaagagcatggacaagaacggcaccatgaccatcgactggaacgagtggagagactaccacctgctgcaccccgtggagaacatccccgagatcatcctgtactggaagcacagcaccatcttcgacgtgggcgagaacctgaccgtgcccgacgagttcaccgtggaggagagacagaccggcatgtggtggagacacctggtggccggcggcggcgccggcgccgtgagcagaacctgcaccgcccccctggacagactgaaggtgctgatgcaggtgcacgccagcagaagcaacaacatgggcatcgtgggcggcttcacccagatgatcagagagggcggcgccagaagcctgtggagaggcaacggcatcaacgtgctgaagatcgcccccgagagcgccatcaagttcatggcctacgagcagatcaagagactggtgggcagcgaccaggagaccctgagaatccacgagagactggtggccggcagcctggccggcgccatcgcccagagcagcatctaccccatggaggtgctgaagaccagaatggccctgagaaagaccggccagtacagcggcatgctggactgcgccagaagaatcctggccagagagggcgtggccgccttctacaagggctacgtgcccaacatgctgggcatcatcccctacgccggcatcgacctggccgtgtacgagaccctgaagaacgcctggctgcagcactacgccgtgaacagcgccgaccccggcgtgttcgtgctgctggcctgcggcaccatgagcagcacctgcggccagctggccagctaccccctggccctggtgagaaccagaatgcaggcccaggccagcatcgagggcgcccccgaggtgaccatgagcagcctgttcaagcacatcctgagaaccgagggcgccttcggcctgtacagaggcctggcccccaacttcatgaaggtgatccccgccgtgagcatcagctacgtggtgtacgagaacctgaagatcaccctgggcgtgcagagcagatag

SEQ ID NO: 22202 - DNA, 1548 bp, Artificial Sequence
  Description of Artificial Sequence: Synthetic coding sequence
atggtgagcagcgtgctgtgcagatgcgtggccagccccccccccgacgccgccgccaccgccgccagcagcagcgccagcagccccgccagcgtgggcgacccctgcggcggcgccatctgcggcggccccgaccacagactgagactgtggagactgttccagaccctggacgtgaacagagacggcggcctgtgcgtgaacgacctggccgtgggcctgagaagactgggcctgcacagaaccgagggcgagctgcagaagatcgtgcaggccggcgacaaggacctggacggccagctggacttcgaggagttcgtgcactacctgcaggaccacgagaagaagctgagactggtgttcaagagcctggacaagaagaacgacggcagaatcgacgcccaggagatcatgcagagcctgagagacctgggcgtgaagatcagcgagcagcaggccgagaagatcctgaagagaatcagaaccggccacttctggggccccgtgacctacatggacaagaacggcaccatgaccatcgactggaacgagtggagagactaccacctgctgcaccccgtggagaacatccccgagatcatcctgtactggaagcacagcaccatcttcgacgtgggcgagaacctgaccgtgcccgacgagttcaccgtggaggagagacagaccggcatgtggtggagacacctggtggccggcggcggcgccggcgccgtgagcagaacctgcaccgcccccctggacagactgaaggtgctgatgcaggtgcacgccagcagaagcaacaacatgggcatcgtgggcggcttcacccagatgatcagagagggcggcgccagaagcctgtggagaggcaacggcatcaacgtgctgaagatcgcccccgagagcgccatcaagttcatggcctacgagcagatcaagagactggtgggcagcgaccaggagaccctgagaatccacgagagactggtggccggcagcctggccggcgccatcgcccagagcagcatctaccccatggaggtgctgaagaccagaatggccctgagaaagaccggccagtacagcggcatgctggactgcgccagaagaatcctggccagagagggcgtggccgccttctacaagggctacgtgcccaacatgctgggcatcatcccctacgccggcatcgacctggccgtgtacgagaccctgaagaacgcctggctgcagcactacgccgtgaacagcgccgaccccggcgtgttcgtgctgctggcctgcggcaccatgagcagcacctgcggccagctggccagctaccccctggccctggtgagaaccagaatgcaggcccaggccagcatcgagggcgcccccgaggtgaccatgagcagcctgttcaagcacatcctgagaaccgagggcgccttcggcctgtacagaggcctggcccccaacttcatgaaggtgatccccgccgtgagcatcagctacgtggtgtacgagaacctgaagatcaccctgggcgtgcagagcagatag

SEQ ID NO: 22203 - DNA, 1470 bp, Artificial Sequence
  Description of Artificial Sequence: Synthetic coding sequence
atgctgcagatgctgtggcacttcctggccagcttcttccccagagccggctgccacggcagcagagagggcgacgacagagaggtgagaggcacccccgcccccgcctggagagaccagatggccagcttcctgggcaagcaggacggcagagccgaggccaccgagaagagacccaccatcctgctggtggtgggccccgccgagcagttccccaagaagatcgtgcaggccggcgacaaggacctggacggccagctggacttcgaggagttcgtgcactacctgcaggaccacgagaagaagctgagactggtgttcaagagcctggacaagaagaacgacggcagaatcgacgcccaggagatcatgcagagcctgagagacctgggcgtgaagatcagcgagcagcaggccgagaagatcctgaagagcatggacaagaacggcaccatgaccatcgactggaacgagtggagagactaccacctgctgcaccccgtggagaacatccccgagatcatcctgtactggaagcacagcaccatcttcgacgtgggcgagaacctgaccgtgcccgacgagttcaccgtggaggagagacagaccggcatgtggtggagacacctggtggccggcggcggcgccggcgccgtgagcagaacctgcaccgcccccctggacagactgaaggtgctgatgcaggtgcacgccagcagaagcaacaacatgggcatcgtgggcggcttcacccagatgatcagagagggcggcgccagaagcctgtggagaggcaacggcatcaacgtgctgaagatcgcccccgagagcgccatcaagttcatggcctacgagcagatcaagagactggtgggcagcgaccaggagaccctgagaatccacgagagactggtggccggcagcctggccggcgccatcgcccagagcagcatctaccccatggaggtgctgaagaccagaatggccctgagaaagaccggccagtacagcggcatgctggactgcgccagaagaatcctggccagagagggcgtggccgccttctacaagggctacgtgcccaacatgctgggcatcatcccctacgccggcatcgacctggccgtgtacgagaccctgaagaacgcctggctgcagcactacgccgtgaacagcgccgaccccggcgtgttcgtgctgctggcctgcggcaccatgagcagcacctgcggccagctggccagctaccccctggccctggtgagaaccagaatgcaggcccaggccagcatcgagggcgcccccgaggtgaccatgagcagcctgttcaagcacatcctgagaaccgagggcgccttcggcctgtacagaggcctggcccccaacttcatgaaggtgatccccgccgtgagcatcagctacgtggtgtacgagaacctgaagatcaccctgggcgtgcagagcagatag

SEQ ID NO: 22204 - DNA, 1101 bp, Artificial Sequence
  Description of Artificial Sequence: Synthetic coding sequence
atgcagagcctgagagacctgggcgtgaagatcagcgagcagcaggccgagaagatcctgaagagcatggacaagaacggcaccatgaccatcgactggaacgagtggagagactaccacctgctgcaccccgtggagaacatccccgagatcatcctgtactggaagcacagcaccatcttcgacgtgggcgagaacctgaccgtgcccgacgagttcaccgtggaggagagacagaccggcatgtggtggagacacctggtggccggcggcggcgccggcgccgtgagcagaacctgcaccgcccccctggacagactgaaggtgctgatgcaggtgcacgccagcagaagcaacaacatgggcatcgtgggcggcttcacccagatgatcagagagggcggcgccagaagcctgtggagaggcaacggcatcaacgtgctgaagatcgcccccgagagcgccatcaagttcatggcctacgagcagatcaagagactggtgggcagcgaccaggagaccctgagaatccacgagagactggtggccggcagcctggccggcgccatcgcccagagcagcatctaccccatggaggtgctgaagaccagaatggccctgagaaagaccggccagtacagcggcatgctggactgcgccagaagaatcctggccagagagggcgtggccgccttctacaagggctacgtgcccaacatgctgggcatcatcccctacgccggcatcgacctggccgtgtacgagaccctgaagaacgcctggctgcagcactacgccgtgaacagcgccgaccccggcgtgttcgtgctgctggcctgcggcaccatgagcagcacctgcggccagctggccagctaccccctggccctggtgagaaccagaatgcaggcccaggccagcatcgagggcgcccccgaggtgaccatgagcagcctgttcaagcacatcctgagaaccgagggcgccttcggcctgtacagaggcctggcccccaacttcatgaaggtgatccccgccgtgagcatcagctacgtggtgtacgagaacctgaagatcaccctgggcgtgcagagcagatag

SEQ ID NO: 22205 - DNA, 894 bp, Artificial Sequence; identical to SEQ ID NO: 19810
  Description of Artificial Sequence: Synthetic coding sequence

SEQ ID NO: 22206 - DNA, 912 bp, Artificial Sequence
  Description of Artificial Sequence: Synthetic coding sequence
atggccctggacttcctggccggctgcgccggcggcgtggccggcgtgctggtgggccaccccttcgacaccgtgaaggtgagactgcaggtgcagagcgtggagaagccccagtacagaggcaccctgcactgcttcaagagcatcatcaagcaggagagcgtgctgggcctgtacaagggcctgggcagccccctgatgggcctgaccttcatcaacgccctggtgttcggcgtgcagggcaacaccctgagagccctgggccacgacagccccctgaaccagttcctggccggcgccgccgccggcgccatccagtgcgtgatctgctgccccatggagctggccaagaccagactgcagctgcaggacgccggccccgccagaacctacaagggcagcctggactgcctggcccagatctacggccacgagggcctgagaggcgtgaacagaggcatggtgagcaccctgctgagagagacccccagcttcggcgtgtacttcctgacctacgacgccctgaccagagccctgggctgcgagcccggcgacagactgctggtgcccaagctgctgctggccggcggcaccagcggcatcgtgagctggctgagcacctaccccgtggacgtggtgaagagcagactgcaggccgacggcctgagaggcgcccccagatacagaggcatcctggactgcgtgcaccagagctacagagccgagggctggagagtgttcaccagaggcctggccagcaccctgctgagagccttccccgtgaacgccgccaccttcgccaccgtgaccgtggtgctgacctacgccagaggcgaggaggccggccccgagggcgaggccgtgcccgccgcccccgccggccccgccctggcccagcccagcagcctgtag

SEQ ID NO: 22207 - DNA, 714 bp, Artificial Sequence
  Description of Artificial Sequence: Synthetic coding sequence
atgggcctgaccttcatcaacgccctggtgttcggcgtgcagggcaacaccctgagagccctgggccacgacagccccctgaaccagttcctggccggcgccgccgccggcgccatccagtgcgtgatctgctgccccatggagctggccaagaccagactgcagctgcaggacgccggccccgccagaacctacaagggcagcctggactgcctggcccagatctacggccacgagggcctgagaggcgtgaacagaggcatggtgagcaccctgctgagagagacccccagcttcggcgtgtacttcctgacctacgacgccctgaccagagccctgggctgcgagcccggcgacagactgctggtgcccaagctgctgctggccggcggcaccagcggcatcgtgagctggctgagcacctaccccgtggacgtggtgaagagcagactgcaggccgacggcctgagaggcgcccccagatacagaggcatcctggactgcgtgcaccagagctacagagccgagggctggagagtgttcaccagaggcctggccagcaccctgctgagagccttccccgtgaacgccgccaccttcgccaccgtgaccgtggtgctgacctacgccagaggcgaggaggccggccccgagggcgaggccgtgcccgccgcccccgccggccccgccctggcccagcccagcagcctgtag

SEQ ID NO: 22208 - DNA, 714 bp, Artificial Sequence; identical to SEQ ID NO: 22207
  Description of Artificial Sequence: Synthetic coding sequence

SEQ ID NO: 22209 - DNA, 714 bp, Artificial Sequence; identical to SEQ ID NO: 22207
  Description of Artificial Sequence: Synthetic coding sequence

SEQ ID NO: 22210 - DNA, 714 bp, Artificial Sequence; identical to SEQ ID NO: 22207
  Description of Artificial Sequence: Synthetic coding sequence

SEQ ID NO: 22211 - DNA, 936 bp, Artificial Sequence
  Description of Artificial Sequence: Synthetic coding sequence
atgagccagagagacaccctggtgcacctgttcgccggcggctgcggcggcaccgtgggcgccatcctgacctgccccctggaggtggtgaagaccagactgcagagcagcagcgtgaccctgtacatcagcgaggtgcagctgaacaccatggccggcgccagcgtgaacagagtggtgagccccggccccctgcactgcctgaaggtgatcctggagaaggagggccccagaagcctgttcagaggcctgggccccaacctggtgggcgtggcccccagcagagccatctacttcgccgcctacagcaactgcaaggagaagctgaacgacgtgttcgaccccgacagcacccaggtgcacatgatcagcgccgccatggccggcttcaccgccatcaccgccaccaaccccatctggctgatcaagaccagactgcagctggacgccagaaacagaggcgagagaagaatgggcgccttcgagtgcgtgagaaaggtgtaccagaccgacggcctgaagggcttctacagaggcatgagcgccagctacgccggcatcagcgagaccgtgatccacttcgtgatctacgagagcatcaagcagaagctgctggagtacaagaccgccagcaccatggagaacgacgaggagagcgtgaaggaggccagcgacttcgtgggcatgatgctggccgccgccaccagcaagacctgcgccaccaccatcgcctacccccacgaggtggtgagaaccagactgagagaggagggcaccaagtacagaagcttcttccagaccctgagcctgctggtgcaggaggagggctacggcagcctgtacagaggcctgaccacccacctggtgagacagatccccaacaccgccatcatgatggccacctacgagctggtggtgtacctgctgaacggctag

SEQ ID NO: 22212 - DNA, 933 bp, Artificial Sequence
  Description of Artificial Sequence: Synthetic coding sequence
atgagccagagagacaccctggtgcacctgttcgccggcggctgcggcggcaccgtgggcgccatcctgacctgccccctggaggtggtgaagaccagactgcagagcagcagcgtgaccctgtacatcagcgaggtgcagctgaacaccatggccggcgccagcgtgaacagagtggtgagccccggccccctgcactgcctgaaggtgatcctggagaaggagggccccagaagcctgttcagaggcctgggccccaacctggtgggcgtggcccccagcagagccatctacttcgccgcctacagcaactgcaaggagaagctgaacgacgtgttcgaccccgacagcacccaggtgcacatgatcagcgccgccatggccggcttcaccgccatcaccgccaccaaccccatctggctgatcaagaccagactgcagctggacgccagaaacagaggcgagagaagaatgggcgccttcgagtgcgtgagaaaggtgtaccagaccgacggcctgaagggcttctacagaggcatgagcgccagctacgccggcatcagcgagaccgtgatccacttcgtgatctacgagagcatcaagcagaagctgctggagtacaagaccgccagcaccatggagaacgacgaggagagcgtgaaggaggccagcgacttcgtgggcatgatgctggccgccgccaccagcaagacctgcgccaccaccatcgcctacccccacgtggtgagaaccagactgagagaggagggcaccaagtacagaagcttcttccagaccctgagcctgctggtgcaggaggagggctacggcagcctgtacagaggcctgaccacccacctggtgagacagatccccaacaccgccatcatgatggccacctacgagctggtggtgtacctgctgaacggctag

SEQ ID NO: 22213 - DNA, 927 bp, Artificial Sequence
  Description of Artificial Sequence: Synthetic coding sequence
atggacttcgtggccggcgccatcggcggcgtgtgcggcgtggccgtgggctaccccctggacaccgtgaaggtgagaatccagaccgagcccaagtacaccggcatctggcactgcgtgagagacacctaccacagagagagagtgtggggcttctacagaggcctgagcctgcccgtgtgcaccgtgagcctggtgagcagcgtgagcttcggcacctacagacactgcctggcccacatctgcagactgagatacggcaaccccgacgccaagcccaccaaggccgacatcaccctgagcggctgcgccagcggcctggtgagagtgttcctgaccagccccaccgaggtggccaaggtgagactgcagacccagacccaggcccagaagcagcagagaagactgagcgccagcggccccctggccgtgccccccatgtgccccgtgccccccgcctgccccgagcccaagtacagaggccccctgcactgcctggccaccgtggccagagaggagggcctgtgcggcctgtacaagggcagcagcgccctggtgctgagagacggccacagcttcgccacctacttcctgagctacgccgtgctgtgcgagtggctgagccccgccggccacagcagacccgacgtgcccggcgtgctggtggccggcggctgcgccggcgtgctggcctgggccgtggccacccccatggacgtgatcaagagcagactgcaggccgacggccagggccagagaagatacagaggcctgctgcactgcatggtgaccagcgtgagagaggagggccccagagtgctgttcaagggcctggtgctgaactgctgcagagccttccccgtgaacatggtggtgttcgtggcctacgaggccgtgctgagactggccagaggcctgctgacctag

SEQ ID NO: 22214 - DNA, 876 bp, Artificial Sequence
  Description of Artificial Sequence: Synthetic coding sequence
atgggcagcttccagctggaggacttcgccgccggctggatcggcggcgccgccagcgtgatcgtgggccaccccctggacaccgtgaagaccagactgcaggccggcgtgggctacggcaacaccctgagctgcatcagagtggtgtacagaagagagagcatgttcggcttcttcaagggcatgagcttccccctggccagcatcgccgtgtacaacagcgtggtgttcggcgtgttcagcaacacccagagattcctgagccagcacagatgcggcgagcccgaggccagcccccccagaaccctgagcgacctgctgctggccagcatggtggccggcgtggtgagcgtgggcctgggcggccccgtggacctgatcaagatcagactgcagatgcagacccagcccttcagagacgccaacctgggcctgaagagcagagccgtggcccccgccgagcagcccgcctaccagggccccgtgcactgcatcaccaccatcgtgagaaacgagggcctggccggcctgtacagaggcgccagcgccatgctgctgagagacgtgcccggctactgcctgtacttcatcccctacgtgttcctgagcgagtggatcacccccgaggcctgcaccggccccagcccctgcgccgtgtggctggccggcggcatggccggcaagggcagcagcagctggagcagaacccccgtgcaggccaccgccgtgggccagctgggcaactgccacgccctgctgagccccggcggcggccaggacaccttcagatacagccccaacaacagcctgctgggcacctacagcgtgcccggccccctgcccccccagagccaccccttccccatgcagctgtag

SEQ ID NO: 22215 - DNA, 474 bp, Artificial Sequence
  Description of Artificial Sequence: Synthetic coding sequence
atgggcagcttccagctggaggacttcgccgccggctggatcggcggcgccgccagcgtgatcgtgggccaccccctggacaccgtgaagaccagactgcaggccggcgtgggctacggcaacaccctgagctgcatcagagtggtgtacagaagagagagcatgttcggcttcttcaagggcatgagcttccccctggccagcatcgccgtgtacaacagcgtggtgttcggcgtgttcagcaacacccagagattcctgagccagcacagatgcggcgagcccgaggccagcccccccagaaccctgagcgacctgctgctggccagcatggtggccggcgtggtgagcgtgggcctgggcggccccgtggacctgatcaagatcagactgcagatgcagacccagcccttcagagacggcggcgagcacagaatgaccaccgtgttccccggcccccacctgtgcatgtag

SEQ ID NO: 22216 - DNA, 936 bp, Artificial Sequence
  Description of Artificial Sequence: Synthetic coding sequence
atgggcagcttccagctggaggacttcgccgccggctggatcggcggcgccgccagcgtgatcgtgggccaccccctggacaccgtgaagaccagactgcaggccggcgtgggctacggcaacaccctgagctgcatcagagtggtgtacagaagagagagcatgttcggcttcttcaagggcatgagcttccccctggccagcatcgccgtgtacaacagcgtggtgttcggcgtgttcagcaacacccagagattcctgagccagcacagatgcggcgagcccgaggccagcccccccagaaccctgagcgacctgctgctggccagcatggtggccggcgtggtgagcgtgggcctgggcggccccgtggacctgatcaagatcagactgcagatgcagacccagcccttcagagacgccaacctgggcctgaagagcagagccgtggcccccgccgagcagcccgcctaccagggccccgtgcactgcatcaccaccatcgtgagaaacgagggcctggccggcctgtacagaggcgccagcgccatgctgctgagagacgtgcccggctactgcctgtacttcatcccctacgtgttcctgagcgagtggatcacccccgaggcctgcaccggccccagcccctgcgccgtgtggctggccggcggcatggccggcgccatcagctggggcaccgccacccccatggacgtggtgaagagcagactgcaggccgacggcgtgtacctgaacaagtacaagggcgtgctggactgcatcagccagagctaccagaaggagggcctgaaggtgttcttcagaggcatcaccgtgaacgccgtgagaggcttccccatgagcgccgccatgttcctgggctacgagctgagcctgcaggccatcagaggcgaccacgccgtgaccagcccctag

SEQ ID NO: 22217 - DNA, 774 bp, Artificial Sequence
  Description of Artificial Sequence: Synthetic coding sequence
atgttcggcttcttcaagggcatgagcttccccctggccagcatcgccgtgtacaacagcgtggtgttcggcgtgttcagcaacacccagagattcctgagccagcacagatgcggcgagcccgaggccagcccccccagaaccctgagcgacctgctgctggccagcatggtggccggcgtggtgagcgtgggcctgggcggccccgtggacctgatcaagatcagactgcagatgcagacccagcccttcagagacgccaacctgggcctgaagagcagagccgtggcccccgccgagcagcccgcctaccagggccccgtgcactgcatcaccaccatcgtgagaaacgagggcctggccggcctgtacagaggcgccagcgccatgctgctgagagacgtgcccggctactgcctgtacttcatcccctacgtgttcctgagcgagtggatcacccccgaggcctgcaccggccccagcccctgcgccgtgtggctggccggcggcatggccggcgccatcagctggggcaccgccacccccatggacgtggtgaagagcagactgcaggccgacggcgtgtacctgaacaagtacaagggcgtgctggactgcatcagccagagctaccagaaggagggcctgaaggtgttcttcagaggcatcaccgtgaacgccgtgagaggcttccccatgagcgccgccatgttcctgggctacgagctgagcctgcaggccatcagaggcgaccacgccgtgaccagcccctag

SEQ ID NO: 22218 - DNA, 2106 bp, Artificial Sequence
  Description of Artificial Sequence: Synthetic coding sequence
atggacgagagccccgagcccctgcagcagggcagaggccccgtgcccgtgagaagacagagacccgcccccagaggcctgagagagatgctgaaggccagactgtggtgcagctgcagctgcagcgtgctgtgcgtgagagccctggtgcaggacctgctgcccgccaccagatggctgagacagtacagacccagagagtacctggccggcgacgtgatgagcggcctggtgatcggcatcatcctggtgccccaggccatcgcctacagcctgctggccggcctgcagcccatctacagcctgtacaccagcttcttcgccaacctgatctacttcctgatgggcaccagcagacacgtgagcgtgggcatcttcagcctgctgtgcctgatggtgggccaggtggtggacagagagctgcagctggccggcttcgaccccagccaggacggcctgcagcccggcgccaacagcagcaccctgaacggcagcgccgccatgctggactgcggcagagactgctacgccatcagagtggccaccgccctgaccctgatgaccggcctgtaccaggtgctgatgggcgtgctgagactgggcttcgtgagcgcctacctgagccagcccctgctggacggcttcgccatgggcgccagcgtgaccatcctgaccagccagctgaagcacctgctgggcgtgagaatccccagacaccagggccccggcatggtggtgctgacctggctgagcctgctgagaggcgccggccaggccaacgtgtgcgacgtggtgaccagcaccgtgtgcctggccgtgctgctggccgccaaggagctgagcgacagatacagacacagactgagagtgcccctgcccaccgagctgctggtgatcgtggtggccaccctggtgagccacttcggccagctgcacaagagattcggcagcagcgtggccggcgacatccccaccggcttcatgcccccccaggtgcccgagcccagactgatgcagagagtggccctggacgccgtggccctggccctggtggccgccgccttcagcatcagcctggccgagatgttcgccagaagccacggctacagcgtgagagccaaccaggagctgctggccgtgggctgctgcaacgtgctgcccgccttcctgcactgcttcgccaccagcgccgccctggccaagagcctggtgaagaccgccaccggctgcagaacccagctgagcagcgtggtgagcgccaccgtggtgctgctggtgctgctggccctggcccccctgttccacgacctgcagagaagcgtgctggcctgcgtgatcgtggtgagcctgagaggcgccctgagaaaggtgtgggacctgcccagactgtggagaatgagccccgccgacgccctggtgtgggccggcaccgccgccacctgcatgctggtgagcaccgaggccggcctgctggccggcgtgatcctgagcctgctgagcctggccggcagaacccagagacccagaaccgccctgctggccagaatcggcgacaccgccttctacgaggacgccaccgagttcgagggcctggtgcccgagcccggcgtgagagtgttcagattcggcggccccctgtactacgccaacaaggacttcttcctgcagagcctgtacagcctgaccggcctggacgccggctgcatggccgccagaagaaaggagggcggcagcgagaccggcgtgggcgagggcggccccgcccagggcgaggacctgggccccgtgagcaccagagccgccctggtgcccgccgccgccggcttccacaccgtggtgatcgactgcgcccccctgctgttcctggacgccgccggcgtgagcaccctgcaggacctgagaagagactacggcgccctgggcatcagcctgctgctggcctgctgcagcccccccgtgagagacatcctgagcagaggcggcttcctgggcgagggccccggcgacaccgccgaggaggagcagctgttcctgagcgtgcacgacgccgtgcagaccgccagagccagacacagagagctggaggccaccgacgcccacctgtag

SEQ ID NO: 22219 - DNA, 2106 bp, Artificial Sequence; identical to SEQ ID NO: 22218
  Description of Artificial Sequence: Synthetic coding sequence

SEQ ID NO: 22220 - DNA, 675 bp, Artificial Sequence
  Description of Artificial Sequence: Synthetic coding sequence
atggacgagagccccgagcccctgcagcagggcagaggccccgtgcccgtgagaagacagagacccgcccccagaggcctgagagagatgctgaaggccagactgtggtgcagctgcagctgcagcgtgctgtgcgtgagagccctggtgcaggacctgctgcccgccaccagatggctgagacagtacagacccagagagtacctggccggcgacgtgatgagcggcctggtgatcggcatcatcctggtgccccaggccatcgcctacagcctgctggccggcctgcagcccatctacagcctgtacaccagcttcttcgccaacctgatctacttcctgatgggcaccagcagacacgtgagcgtgggcatcttcagcctgctgtgcctgatggtgggccaggtggtggacagagagctgcagctggccggcttcgaccccagccaggacggcctgcagcccggcgccaacagcagcaccctgaacggcagcgccgccatgctggactgcggcagagactgctacgccatcagagtggccaccgccctgaccctgatgaccggcctgtaccagaccagctggggcagaaacagcttccagcagcacccctggcagctgacccagagaagcgacagccaggagctgctggaggaggaggagagaagctgctag

SEQ ID NO: 22221 - DNA, 1365 bp, Artificial Sequence
  Description of Artificial Sequence: Synthetic coding sequence
atgagactggacctggccagcctgatgagcgcccccaagagcctgggcagcgccttcaagagctggagactggacaaggcccccagcccccagcacaccttccccagcaccagcatccccggcatggccttcgccctgctggccagcgtgccccccgtgttcggcctgtacaccagcttcttccccgtgctgatctacagcctgctgggcaccggcagacacctgagcaccggcaccttcgccatcctgagcctgatgaccggcagcgccgtggagagactggtgcccgagcccctggtgggcaacctgagcggcatcgagaaggagcagctggacgcccagagagtgggcgtggccgccgccgtggccttcggcagcggcgccctgatgctgggcatgttcgtgctgcagctgggcgtgctgagcaccttcctgagcgagcccgtggtgaaggccctgaccagcggcgccgccctgcacgtgctgctgagccagctgcccagcctgctgggcctgagcctgcccagacagatcggctgcttcagcctgttcaagaccctggccagcctgctgaccgccctgcccagaagcagccccgccgagctgaccatcagcgccctgagcctggccctgctggtgcccgtgaaggagctgaacgtgagattcagagacagactgcccacccccatccccggcgaggtggtgctggtgctgctggccagcgtgctgtgcttcaccagcagcgtggacaccagataccaggtgcagatcgtgggcctgctgcccggcggcttcccccagcccctgctgcccaacctggccgagctgcccagaatcctggccgacagcctgcccatcgccctggtgagcttcgccgtgagcgccagcctggccagcatccacgccgacaagtacagctacaccatcgacagcaaccaggagttcctggcccacggcgccagcaacctgatcagcagcctgttcagctgcttccccaacagcgccaccctggccaccaccaacctgctggtggacgccggcggcaagacccagctggccggcctgttcagctgcaccgtggtgctgagcgtgctgctgtggctgggccccttcttctactacctgcccaaggccgtgctggcctgcatcaacatcagcagcatgagacaggtgttctgccagatgcaggagctgccccagctgtggcacatcagcagagtggacttcgccgtgtggatggtgacctgggtggccgtggtgaccctgagcgtggacctgggcctggccgtgggcgtggtgttcagcatgatgaccgtggtgtgcagaaccagaagcagcagcagaagcagaggcagcgccagctag

SEQ ID NO: 22222 - DNA, 1821 bp, Artificial Sequence
  Description of Artificial Sequence: Synthetic coding sequence
atgcccagcagcgtgaccgccctgggccaggccagaagcagcggccccggcatggcccccagcgcctgctgctgcagccccgccgccctgcagagaagactgcccatcctggcctggctgcccagctacagcctgcagtggctgaagatggacttcgtggccggcctgagcgtgggcctgaccgccatcccccaggccctggcctacgccgaggtggccggcctgcccccccagtacggcctgtacagcgccttcatgggctgcttcgtgtacttcttcctgggcaccagcagagacgtgaccctgggccccaccgccatcatgagcctgctggtgagcttctacaccttccacgagcccgcctacgccgtgctgctggccttcctgagcggctgcatccagctggccatgggcgtgctgagactgggcttcctgctggacttcatcagctaccccgtgatcaagggcttcaccagcgccgccgccgtgaccatcggcttcggccagatcaagaacctgctgggcctgcagaacatccccagacccttcttcctgcaggtgtaccacaccttcctgagaatcgccgagaccagagtgggcgacgccgtgctgggcctggtgtgcatgctgctgctgctggtgctgaagctgatgagagaccacgtgccccccgtgcaccccgagatgccccccggcgtgagactgagcagaggcctggtgtgggccgccaccaccgccagaaacgccctggtggtgagcttcgccgccctggtggcctacagcttcgaggtgaccggctaccagcccttcatcctgaccggcgagaccgccgagggcctgccccccgtgagaatcccccccttcagcgtgaccaccgccaacggcaccatcagcttcaccgagatggtgcaggacatgggcgccggcctggccgtggtgcccctgatgggcctgctggagagcatcgccgtggccaaggccttcgccagccagaacaactacagaatcgacgccaaccaggagctgctggccatcggcctgaccaacatgctgggcagcctggtgagcagctaccccgtgaccggcagcttcggcagaaccgccgtgaacgcccagagcggcgtgtgcacccccgccggcggcctggtgaccggcgtgctggtgctgctgagcctggactacctgaccagcctgttctactacatccccaagagcgccctggccgccgtgatcatcatggccgtggcccccctgttcgacaccaagatcttcagaaccctgtggagagtgaagagactggacctgctgcccctgtgcgtgaccttcctgctgtgcttctgggaggtgcagtacggcatcctggccggcgccctggtgagcctgctgatgctgctgcacagcgccgccagacccgagaccaaggtgagcgagggccccgtgctggtgctgcagcccgccagcggcctgagcttccccgccatggaggccctgagagaggagatcctgagcagagccctggaggtgagcccccccagatgcctggtgctggagtgcacccacgtgtgcagcatcgactacaccgtggtgctgggcctgggcgagctgctgcaggacttccagaagcagggcgtggccctggccttcgtgggcctgcaggtgcccgtgctgagagtgctgctgagcgccgacctgaagggcttccagtacttcagcaccctggaggaggccgagaagcacctgagacaggagcccggcacccagccctacaacatcagagaggacagcatcctggaccagaaggtggccctgctgaaggcctag

SEQ ID NO: 22223 - DNA, 1821 bp, Artificial Sequence; identical to SEQ ID NO: 22222
  Description of Artificial Sequence: Synthetic coding sequence

SEQ ID NO: 22224 - DNA, 1821 bp, Artificial Sequence; identical to SEQ ID NO: 22222
  Description of Artificial Sequence: Synthetic coding sequence

SEQ ID NO: 22225 - DNA, 1971 bp, Artificial Sequence
  Description of Artificial Sequence: Synthetic coding sequence
atgaccggcgccaagagaaagaagaagagcatgctgtggagcaagatgcacaccccccagtgcgaggacatcatccagtggtgcagaagaagactgcccatcctggactgggccccccactacaacctgaaggagaacctgctgcccgacaccgtgagcggcatcatgctggccgtgcagcaggtgacccagggcctggccttcgccgtgctgagcagcgtgcaccccgtgttcggcctgtacggcagcctgttccccgccatcatctacgccatcttcggcatgggccaccacgtggccaccggcaccttcgccctgaccagcctgatcagcgccaacgccgtggagagaatcgtgccccagaacatgcagaacctgaccacccagagcaacaccagcgtgctgggcctgagcgacttcgagatgcagagaatccacgtggccgccgccgtgagcttcctgggcggcgtgatccaggtggccatgttcgtgctgcagctgggcagcgccaccttcgtggtgaccgagcccgtgatcagcgccatgaccaccggcgccgccacccacgtggtgaccagccaggtgaagtacctgctgggcatgaagatgccctacatcagcggccccctgggcttcttctacatctacgcctacgtgttcgagaacatcaagagcgtgagactggaggccctgctgctgagcctgctgagcatcgtggtgctggtgctggtgaaggagctgaacgagcagttcaagagaaagatcaaggtggtgctgcccgtggacctggtgctgatcatcgccgccagcttcgcctgctactgcaccaacatggagaacacctacggcctggaggtggtgggccacatcccccagggcatccccagccccagagccccccccatgaacatcctgagcgccgtgatcaccgaggccttcggcgtggccctggtgggctacgtggccagcctggccctggcccagggcagcgccaagaagttcaagtacagcatcgacgacaaccaggagttcctggcccacggcctgagcaacatcgtgagcagcttcttcttctgcatccccagcgccgccgccatgggcagaaccgccggcctgtacagcaccggcgccaagacccaggtggcctgcctgatcagctgcatcttcgtgctgatcgtgatctacgccatcggccccctgctgtactggctgcccatgtgcgtgctggccagcatcatcgtggtgggcctgaagggcatgctgatccagttcagagacctgaagaagtactggaacgtggacaagatcgactggggcatctgggtgagcacctacgtgttcaccatctgcttcgccgccaacgtgggcctgctgttcggcgtggtgtgcaccatcgccatcgtgatcggcagattccccagagccatgaccgtgagcatcaagaacatgaaggagatggagttcaaggtgaagaccgagatggacagcgagaccctgcagcaggtgaagatcatcagcatcaacaaccccctggtgttcctgaacgccaagaagttctacaccgacctgatgaacatgatccagaaggagaacgcctgcaaccagcccctggacgacatcagcaagtgcgagcagaacaccctgctgaacagcctgagcaacggcaactgcaacgaggaggccagccagagctgccccaacgagaagtgctacctgatcctggactgcagcggcttcaccttcttcgactacagcggcgtgagcatgctggtggaggtgtacatggactgcaagggcagaagcgtggacgtgctgctggcccactgcaccgccagcctgatcaaggccatgacctactacggcaacctggacagcgagaagcccatcttcttcgagagcgtgagcgccgccatcagccacatccacagcaacaagaacctgagcaagctgagcgaccacagcgaggtgtag

SEQ ID NO: 22226 - DNA, 1992 bp, Artificial Sequence
  Description of Artificial Sequence: Synthetic coding sequence
atgaccggcgccaagagaaagaagaagagcatgctgtggagcaagatgcacaccccccagtgcgaggacatcatccagtggtgcagaagaagactgcccatcctggactgggccccccactacaacctgaaggagaacctgctgcccgacaccgtgagcggcatcatgctggccgtgcagcaggtgacccagggcctggccttcgccgtgctgagcagcgtgcaccccgtgttcggcctgtacggcagcctgttccccgccatcatctacgccatcttcggcatgggccaccacgtggccaccggcaccttcgccctgaccagcctgatcagcgccaacgccgtggagagaatcgtgccccagaacatgcagaacctgaccacccagagcaacaccagcgtgctgggcctgagcgacttcgagatgcagagaatccacgtggccgccgccgtgagcttcctgggcggcgtgatccaggtggccatgttcgtgctgcagctgggcagcgccaccttcgtggtgaccgagcccgtgatcagcgccatgaccaccggcgccgccacccacgtggtgaccagccaggtgaagtacctgctgggcatgaagatgccctacatcagcggccccctgggcttcttctacatctacgcctacgtgttcgagaacatcaagagcgtgagactggaggccctgctgctgagcctgctgagcatcgtggtgctggtgctggtgaaggagctgaacgagcagttcaagagaaagatcaaggtggtgctgcccgtggacctggtgctgatcatcgccgccagcttcgcctgctactgcaccaacatggagaacacctacggcctggaggtggtgggccacatcccccagggcatccccagccccagagccccccccatgaacatcctgagcgccgtgatcaccgaggccttcggcgtggccctggtgggctacgtggccagcctggccctggcccagggcagcgccaagaagttcaagtacagcatcgacgacaaccaggagttcctggcccacggcctgagcaacatcgtgagcagcttcttcttctgcatccccagcgccgccgccatgggcagaaccgccggcctgtacagcaccggcgccaagacccaggtggcctgcctgatcagctgcatcttcgtgctgatcgtgatctacgccatcggccccctgctgtactggctgcccatgtgcgtgctggccagcatcatcgtggtgggcctgaagggcatgctgatccagttcagagacctgaagaagtactggaacgtggacaagatcgactggggcatctgggtgagcacctacgtgttcaccatctgcttcgccgccaacgtgggcctgctgttcggcgtggtgtgcaccatcgccatcgtgatcggcagattccccagagccatgaccgtgagcatcaagaacatgaaggagatggagttcaaggtgaagaccgagatggacagcgagaccctgcagcaggtgaagatcatcagcatcaacaaccccctggtgttcctgaacgccaagaagttctacaccgacctgatgaacatgatccagaaggagaacgcctgcaaccagcccctggacgacatcagcaagtgcgagcagaacaccctgctgaacagcctgagcaacggcaactgcaacgaggaggccagccagagctgccccaacgagaagtgctacctgatcctggactgcagcggcttcaccttcttcgactacagcggcgtgagcatgctggtggaggtgtacatggactgcaagggcagaagcgtggacgtgctgctggcccactgcaccgccagcctgatcaaggccatgacctactacggcaacctggacagcgagaagcccatcttcttcgagagcgtgagcgccgccatcagccacatccacagcaacaaggccagctacaagctgctgttcgacaacctggacctgcccaccatgccccccctgtag

SEQ ID NO: 22227 - DNA, 624 bp, Artificial Sequence
  Description of Artificial Sequence: Synthetic coding sequence
atgaccggcgccaagagaaagaagaagagcatgctgtggagcaagatgcacaccccccagtgcgaggacatcatccagtggtgcagaagaagactgcccatcctggactgggccccccactacaacctgaaggagaacctgctgcccgacaccgtgagcggcatcatgctggccgtgcagcaggtgacccagggcctggccttcgccgtgctgagcagcgtgcaccccgtgttcggcctgtacggcagcctgttccccgccatcatctacgccatcttcggcatgggccaccacgtggccaccggcaccttcgccctgaccagcctgatcagcgccaacgccgtggagagaatcgtgccccagaacatgcagaacctgaccacccagagcaacaccagcgtgctgggcctgagcgacttcgagatgcagagaatccacgtggccgccgccgtgagcttcctgggcggcgtgatccaggtggccatgttcgtgctgcagctgggcagcgccaccttcgtggtgaccgagcccgtgatcagcgccatgaccaccggcgccgccacccacgtggtgaccagccaggtgaagtacctgctgggcatgaagatgccctacatcagctag

SEQ ID NO: 22228 - DNA, 1971 bp, Artificial Sequence; identical to SEQ ID NO: 22225
  Description of Artificial Sequence: Synthetic coding sequence

SEQ ID NO: 22229 - DNA, 2913 bp, Artificial Sequence
  Description of Artificial Sequence: Synthetic coding sequence
atggcccagctggagagaagcgccatcagcggcttcagcagcaagagcagaagaaacagcttcgcctacgacgtgaagagagaggtgtacaacgaggagaccttccagcaggagcacaagagaaaggccagcagcagcggcaacatgaacatcaacatcaccaccttcagacaccacgtgcagtgcagatgcagctggcacagattcctgagatgcgtgctgaccatcttccccttcctggagtggatgtgcatgtacagactgaaggactggctgctgggcgacctgctggccggcatcagcgtgggcctggtgcaggtgccccagggcctgaccctgagcctgctggccagacagctgatcccccccctgaacatcgcctacgccgccttctgcagcagcgtgatctacgtgatcttcggcagctgccaccagatgagcatcggcagcttcttcctggtgagcgccctgctgatcaacgtgctgaaggtgagccccttcaacaacggccagctggtgatgggcagcttcgtgaagaacgagttcagcgcccccagctacctgatgggctacaacaagagcctgagcgtggtggccaccaccaccttcctgaccggcatcatccagctgatcatgggcgtgctgggcctgggcttcatcgccacctacctgcccgagagcgccatgagcgcctacctggccgccgtggccctgcacatcatgctgagccagctgaccttcatcttcggcatcatgatcagcttccacgccggccccatcagcttcttctacgacatcatcaactactgcgtggccctgcccaaggccaacagcaccagcatcctggtgttcctgaccgtggtggtggccctgagaatcaacaagtgcatcagaatcagcttcaaccagtaccccatcgagttccccatggagctgttcctgatcatcggcttcaccgtgatcgccaacaagatcagcatggccaccgagaccagccagaccctgatcgacatgatcccctacagcttcctgctgcccgtgacccccgacttcagcctgctgcccaagatcatcctgcaggccttcagcctgagcctggtgagcagcttcctgctgatcttcctgggcaagaagatcgccagcctgcacaactacagcgtgaacagcaaccaggacctgatcgccatcggcctgtgcaacgtggtgagcagcttcttcagaagctgcgtgttcaccggcgccatcgccagaaccatcatccaggacaagagcggcggcagacagcagttcgccagcctggtgggcgccggcgtgatgctgctgctgatggtgaagatgggccacttcttctacaccctgcccaacgccgtgctggccggcatcatcctgagcaacgtgatcccctacctggagaccatcagcaacctgcccagcctgtggagacaggaccagtacgactgcgccctgtggatgatgaccttcagcagcagcatcttcctgggcctggacatcggcctgatcatcagcgtggtgagcgccttcttcatcaccaccgtgagaagccacagagccaagatcctgctgctgggccagatccccaacaccaacatctacagaagcatcaacgactacagagagatcatcaccatccccggcgtgaagatcttccagtgctgcagcagcatcaccttcgtgaacgtgtactacctgaagcacaagctgctgaaggaggtggacatggtgaaggtgcccctgaaggaggaggagatcttcagcctgttcaacagcagcgacaccaacctgcagggcggcaagatctgcagatgcttctgcaactgcgacgacctggagcccctgcccagaatcctgtacaccgagagattcgagaacaagctggaccccgaggccagcagcatcaacctgatccactgcagccacttcgagagcatgaacaccagccagaccgccagcgaggaccaggtgccctacaccgtgagcagcgtgagccagaagaaccagggccagcagtacgaggaggtggaggaggtgtggctgcccaacaacagcagcagaaacagcagccccggcctgcccgacgtggccgagagccagggcagaagaagcctgatcccctacagcgacgccagcctgctgcccagcgtgcacaccatcatcctggacttcagcatggtgcactacgtggacagcagaggcctggtggtgctgagacagatctgcaacgccttccagaacgccaacatcctgatcctgatcgccggctgccacagcagcatcgtgagagccttcgagagaaacgacttcttcgacgccggcatcaccaagacccagctgttcctgagcgtgcacgacgccgtgctgttcgccctgagcagaaaggtgatcggcagcagcgagctgagcatcgacgagagcgagaccgtgatcagagagacctacagcgagaccgacaagaacgacaacagcagatacaagatgagcagcagcttcctgggcagccagaagaacgtgagccccggcttcatcaagatccagcagcccgtggaggaggagagcgagctggacctggagctggagagcgagcaggaggccggcctgggcctggacctggacctggacagagagctggagcccgagatggagcccaaggccgagaccgagaccaagacccagaccgagatggagccccagcccgagaccgagcccgagatggagcccaaccccaagagcagacccagagcccacaccttcccccagcagagatactggcccatgtaccaccccagcatggccagcacccagagccagacccagaccagaacctggagcgtggagagaagaagacaccccatggacagctacagccccgagggcaacagcaacgaggacgtgtag

SEQ ID NO: 22230 - DNA, 2598 bp, Artificial Sequence
  Description of Artificial Sequence: Synthetic coding sequence
atggcccagctggagagaagcgccatcagcggcttcagcagcaagagcagaagaaacagcttcgcctacgacgtgaagagagaggtgtacaacgaggagaccttccagcaggagcacaagagaaaggccagcagcagcggcaacatgaacatcaacatcaccaccttcagacaccacgtgcagtgcagatgcagctggcacagattcctgagatgcgtgctgaccatcttccccttcctggagtggatgtgcatgtacagactgaaggactggctgctgggcgacctgctggccggcatcagcgtgggcctggtgcaggtgccccagggcctgaccctgagcctgctggccagacagctgatcccccccctgaacatcgcctacgccgccttctgcagcagcgtgatctacgtgatcttcggcagctgccaccagatgagcatcggcagcttcttcctggtgagcgccctgctgatcaacgtgctgaaggtgagccccttcaacaacggccagctggtgatgggcagcttcgtgaagaacgagttcagcgcccccagctacctgatgggctacaacaagagcctgagcgtggtggccaccaccaccttcctgaccggcatcatccagatcatcggcttcaccgtgatcgccaacaagatcagcatggccaccgagaccagccagaccctgatcgacatgatcccctacagcttcctgctgcccgtgacccccgacttcagcctgctgcccaagatcatcctgcaggccttcagcctgagcctggtgagcagcttcctgctgatcttcctgggcaagaagatcgccagcctgcacaactacagcgtgaacagcaaccaggacctgatcgccatcggcctgtgcaacgtggtgagcagcttcttcagaagctgcgtgttcaccggcgccatcgccagaaccatcatccaggacaagagcggcggcagacagcagttcgccagcctggtgggcgccggcgtgatgctgctgctgatggtgaagatgggccacttcttctacaccctgcccaacgccgtgctggccggcatcatcctgagcaacgtgatcccctacctggagaccatcagcaacctgcccagcctgtggagacaggaccagtacgactgcgccctgtggatgatgaccttcagcagcagcatcttcctgggcctggacatcggcctgatcatcagcgtggtgagcgccttcttcatcaccaccgtgagaagccacagagccaagatcctgctgctgggccagatccccaacaccaacatctacagaagcatcaacgactacagagagatcatcaccatccccggcgtgaagatcttccagtgctgcagcagcatcaccttcgtgaacgtgtactacctgaagcacaagctgctgaaggaggtggacatggtgaaggtgcccctgaaggaggaggagatcttcagcctgttcaacagcagcgacaccaacctgcagggcggcaagatctgcagatgcttctgcaactgcgacgacctggagcccctgcccagaatcctgtacaccgagagattcgagaacaagctggaccccgaggccagcagcatcaacctgatccactgcagccacttcgagagcatgaacaccagccagaccgccagcgaggaccaggtgccctacaccgtgagcagcgtgagccagaagaaccagggccagcagtacgaggaggtggaggaggtgtggctgcccaacaacagcagcagaaacagcagccccggcctgcccgacgtggccgagagccagggcagaagaagcctgatcccctacagcgacgccagcctgctgcccagcgtgcacaccatcatcctggacttcagcatggtgcactacgtggacagcagaggcctggtggtgctgagacagatctgcaacgccttccagaacgccaacatcctgatcctgatcgccggctgccacagcagcatcgtgagagccttcgagagaaacgacttcttcgacgccggcatcaccaagacccagctgttcctgagcgtgcacgacgccgtgctgttcgccctgagcagaaaggtgatcggcagcagcgagctgagcatcgacgagagcgagaccgtgatcagagagacctacagcgagaccgacaagaacgacaacagcagatacaagatgagcagcagcttcctgggcagccagaagaacgtgagccccggcttcatcaagatccagcagcccgtggaggaggagagcgagctggacctggagctggagagcgagcaggaggccggcctgggcctggacctggacctggacagagagctggagcccgagatggagcccaaggccgagaccgagaccaagacccagaccgagatggagccccagcccgagaccgagcccgagatggagcccaaccccaagagcagacccagagcccacaccttcccccagcagagatactggcccatgtaccaccccagcatggccagcacccagagccagacccagaccagaacctggagcgtggagagaagaagacaccccatggacagctacagccccgagggcaacagcaacgaggacgtgtag

SEQ ID NO: 22231 - DNA, 2913 bp, Artificial Sequence; identical to SEQ ID NO: 22229
  Description of Artificial Sequence: Synthetic coding sequence

SEQ ID NO: 22232 - DNA, 2664 bp, Artificial Sequence
  Description of Artificial Sequence: Synthetic coding sequence
atgagccagcccagacccagatacgtggtggacagagccgcctacagcctgaccctgttcgacgacgagttcgagaagaaggacagaacctaccccgtgggcgagaagctgagaaacgccttcagatgcagcagcgccaagatcaaggccgtggtgttcggcctgctgcccgtgctgagctggctgcccaagtacaagatcaaggactacatcatccccgacctgctgggcggcctgagcggcggcagcatccaggtgccccagggcatggccttcgccctgctggccaacctgcccgccgtgaacggcctgtacagcagcttcttccccctgctgacctacttcttcctgggcggcgtgcaccagatggtgcccggcaccttcgccgtgatcagcatcctggtgggcaacatctgcctgcagctggcccccgagagcaagttccaggtgttcaacaacgccaccaacgagagctacgtggacaccgccgccatggaggccgagagactgcacgtgagcgccaccctggcctgcctgaccgccatcatccagatgggcctgggcttcatgcagttcggcttcgtggccatctacctgagcgagagcttcatcagaggcttcatgaccgccgccggcctgcagatcctgatcagcgtgctgaagtacatcttcggcctgaccatccccagctacaccggccccggcagcatcgtgttcaccttcatcgacatctgcaagaacctgccccacaccaacatcgccagcctgatcttcgccctgatcagcggcgccttcctggtgctggtgaaggagctgaacgccagatacatgcacaagatcagattccccatccccaccgagatgatcgtggtggtggtggccaccgccatcagcggcggctgcaagatgcccaagaagtaccacatgcagatcgtgggcgagatccagagaggcttccccacccccgtgagccccgtggtgagccagtggaaggacatgatcggcaccgccttcagcctggccatcgtgagctacgtgatcaacctggccatgggcagaaccctggccaacaagcacggctacgacgtggacagcaaccaggagatgatcgccctgggctgcagcaacttcttcggcagcttcttcaagatccacgtgatctgctgcgccctgagcgtgaccctggccgtggacggcgccggcggcaagagccaggtggccagcctgtgcgtgagcctggtggtgatgatcaccatgctggtgctgggcatctacctgtaccccctgcccaagagcgtgctgggcgccctgatcgccgtgaacctgaagaacagcctgaagcagctgaccgacccctactacctgtggagaaagagcaagctggactgctgcatctgggtggtgagcttcctgagcagcttcttcctgagcctgccctacggcgtggccgtgggcgtggccttcagcgtgctggtggtggtgttccagacccagttcagaaacggctacgccctggcccaggtgatggacaccgacatctacgtgaaccccaagacctacaacagagcccaggacatccagggcatcaagatcatcacctactgcagccccctgtacttcgccaacagcgagatcttcagacagaaggtgatcgccaagaccggcatggacccccagaaggtgctgctggccaagcagaagtacctgaagaagcaggagaagagaagaatgagacccacccagcagagaagaagcctgttcatgaagaccaagaccgtgagcctgcaggagctgcagcaggacttcgagaacgccccccccaccgaccccaacaacaaccagacccccgccaacggcaccagcgtgagctacatcaccttcagccccgacagcagcagccccgcccagagcgagccccccgccagcgccgaggcccccggcgagcccagcgacatgctggccagcgtgccccccttcgtgaccttccacaccctgatcctggacatgagcggcgtgagcttcgtggacctgatgggcatcaaggccctggccaagctgagcagcacctacggcaagatcggcgtgaaggtgttcctggtgaacatccacgcccaggtgtacaacgacatcagccacggcggcgtgttcgaggacggcagcctggagtgcaagcacgtgttccccagcatccacgacgccgtgctgttcgcccaggccaacgccagagacgtgacccccggccacaacttccagggcgcccccggcgacgccgagctgagcctgtacgacagcgaggaggacatcagaagctactgggacctggagcaggagatgttcggcagcatgttccacgccgagaccctgaccgccctggagagcctgagcgccgccggcggctgctacccctacagaagcgagagcctggtgagccccctgttcaccagacaggccctggccgccatggacaagccccccgcccacagcaccccccccaccagcgccctgagcctggccgccgagggccacctggacttccagctgctgagagtgagccagaagcagaaggacaagtacaactgcgccggcctgctgtacaagctgcagaaggtgagccagagcccccacggcagcgtgagcgacggcgtgagactgagcagaacctag

SEQ ID NO: 22233 - DNA, 2664 bp, Artificial Sequence; identical to SEQ ID NO: 22232
  Description of Artificial Sequence: Synthetic coding sequence

SEQ ID NO: 22234 - DNA, 2376 bp, Artificial Sequence
  Description of Artificial Sequence: Synthetic coding sequence
atgagccagcccagacccagatacgtggtggacagagccgcctacagcctgaccctgttcgacgacgagttcgagaagaaggacagaacctaccccgtgggcgagaagctgagaaacgccttcagatgcagcagcgccaagatcaaggccgtggtgttcggcctgctgcccgtgctgagctggctgcccaagtacaagatcaaggactacatcatccccgacctgctgggcggcctgagcggcggcagcatccaggtgccccagggcatggccttcgccctgctggccaacctgcccgccgtgaacggcctgtacagcagcttcttccccctgctgacctacttcttcctgggcggcgtgcaccagatggtgcccggcaccttcgccgtgatcagcatcctggtgggcaacatctgcctgcagctggcccccgagagcaagttccaggtgttcaacaacgccaccaacgagagctacgtggacaccgccgccatggaggccgagagactgcacgtgagcgccaccctggcctgcctgaccgccatcatccagatgggcctgggcttcatgcagttcggcttcgtggccatctacctgagcgagagcttcatcagaggcttcatgaccgccgccggcctgcagatcctgatcagcgtgctgaagtacatcttcggcctgaccatccccagctacaccggccccggcagcatcgtgttcaccttcatcgacatctgcaagaacctgccccacaccaacatcgccagcctgatcttcgccctgatcagcggcgccttcctggtgctggtgaaggagctgaacgccagatacatgcacaagatcagattccccatccccaccgagatgatcgtggtggtggtggccaccgccatcagcggcggctgcaagatgcccaagaagtaccacatgcagatcgtgggcgagatccagagaggcttccccacccccgtgagccccgtggtgagccagtggaaggacatgatcggcaccgccttcagcctggccatcgtgagctacgtgatcaacctggccatgggcagaaccctggccaacaagcacggctacgacgtggacagcaaccaggagatgatcgccctgggctgcagcaacttcttcggcagcttcttcaagatccacgtgatctgctgcgccctgagcgtgaccctggccgtggacggcgccggcggcaagagccaggtggccagcctgtgcgtgagcctggtggtgatgatcaccatgctggtgctgggcatctacctgtaccccctgcccaagagcgtgctgggcgccctgatcgccgtgaacctgaagaacagcctgaagcagctgaccgacccctactacctgtggagaaagagcaagctggactgctgcatctgggtggtgagcttcctgagcagcttcttcctgagcctgccctacggcgtggccgtgggcgtggccttcagcgtgctggtggtggtgttccagacccagttcagaaacggctacgccctggcccaggtgatggacaccgacatctacgtgaaccccaagacctacaacagagcccaggacatccagggcatcaagatcatcacctactgcagccccctgtacttcgccaacagcgagatcttcagacagaaggtgatcgccaagaccggcatggacccccagaaggtgctgctggccaagcagaagtacctgaagaagcaggagaagagaagaatgagacccacccagcagagaagaagcctgttcatgaagaccaagaccgtgagcctgcaggagctgcagcaggacttcgagaacgccccccccaccgaccccaacaacaaccagacccccgccaacggcaccagcgtgagctacatcaccttcagccccgacagcagcagccccgcccagagcgagccccccgccagcgccgaggcccccggcgagcccagcgacatgctggccagcgtgccccccttcgtgaccttccacaccctgatcctggacatgagcggcgtgagcttcgtggacctgatgggcatcaaggccctggccaagctgagcagcacctacggcaagatcggcgtgaaggtgttcctggtgaacatccacgcccaggtgtacaacgacatcagccacggcggcgtgttcgaggacggcagcctggagtgcaagcacgtgttccccagcatccacgacgccgtgctgttcgcccaggccaacgccagagacgtgacccccggccacaacttccagggcgcccccggcgacgccgagctgagcctgtacgacagcgaggaggacatcagaagctactgggacctggagcaggagatgttcggcagcatgttccacgccgagaccctgaccgccctgtag

SEQ ID NO: 22235 - DNA, 1860 bp, Artificial Sequence
  Description of Artificial Sequence: Synthetic coding sequence
atgctgctgagctggctgaccgtgctgggcgccggcatggtggtgctgcacttcctgcagaagctgctgttcccctacttctgggacgacttctggttcgtgctgaaggtggtgctgatcatcatcagactgaagaagtacgagaagagaggcgagctggtgaccgtgctggacaagttcctgagccacgccaagagacagcccagaaagcccttcatcatctacgagggcgacatctacacctaccaggacgtggacaagagaagcagcagagtggcccacgtgttcctgaaccacagcagcctgaagaagggcgacaccgtggccctgctgatgagcaacgagcccgacttcgtgcacgtgtggttcggcctggccaagctgggctgcgtggtggccttcctgaacaccaacatcagaagcaacagcctgctgaactgcatcagagcctgcggccccagagccctggtggtgggcgccgacctgctgggcaccgtggaggagatcctgcccagcctgagcgagaacatcagcgtgtggggcatgaaggacagcgtgccccagggcgtgatcagcctgaaggagaagctgagcaccagccccgacgagcccgtgcccagaagccaccacgtggtgagcctgctgaagagcacctgcctgtacatcttcaccagcggcaccaccggcctgcccaaggccgccgtgatcagccagctgcaggtgctgagaggcagcgccgtgctgtgggccttcggctgcaccgcccacgacatcgtgtacatcaccctgcccctgtaccacagcagcgccgccatcctgggcatcagcggctgcgtggagctgggcgccacctgcgtgctgaagaagaagttcagcgccagccagttctggagcgactgcaagaagtacgacgtgaccgtgttccagtacatcggcgagctgtgcagatacctgtgcaagcagagcaagagagagggcgagaaggaccacaaggtgagactggccatcggcaacggcatcagaagcgacgtgtggagagagttcctggacagattcggcaacatcaaggtgtgcgagctgtacgccgccaccgagagcagcatcagcttcatgaactacaccggcagaatcggcgccatcggcagaaccaacctgttctacaagctgctgagcaccttcgacctgatcaagtacgacttccagaaggacgagcccatgagaaacgagcagggctggtgcatccacgtgaagaagggcgagcccggcctgctgatcagcagagtgaacgccaagaaccccttcttcggctacgccggcccctacaagcacaccaaggacaagctgctgtgcgacgtgttcaagaagggcgacgtgtacctgaacaccggcgacctgatcgtgcaggaccaggacaacttcctgtacttctgggacagaaccggcgacaccttcagatggaagggcgagaacgtggccaccaccgaggtggccgacgtgatcggcatgctggacttcatccaggaggccaacgtgtacggcgtggccatcagcggctacgagggcagagccggcatggccagcatcatcctgaagcccaacaccagcctggacctggagaaggtgtacgagcaggtggtgaccttcctgcccgcctacgcctgccccagattcctgagaatccaggagaagatggaggccaccggcaccttcaagctgctgaagcaccagctggtggaggacggcttcaaccccctgaagatcagcgagcccctgtacttcatggacaacctgaagaagagctacgtgctgctgaccagagagctgtacgaccagatcatgctgggcgagatcaagctgtag

SEQ ID NO: 22236 - DNA, 1860 bp, Artificial Sequence; identical to SEQ ID NO: 22235
  Description of Artificial Sequence: Synthetic coding sequence

SEQ ID NO: 22237 - DNA, 1860 bp, Artificial Sequence; identical to SEQ ID NO: 22235
  Description of Artificial Sequence: Synthetic coding sequence

SEQ ID NO: 22238 - DNA, 1593 bp, Artificial Sequence
  Description of Artificial Sequence: Synthetic coding sequence
atgggcagcgtgggcagccagagactggaggagcccagcgtggccggcacccccgaccccggcgtggtgatgagcttcaccttcgacagccaccagctggaggaggccgccgaggccgcccagggccagggcctgagagccagaggcgtgcccgccttcaccgacaccaccctggacgagcccgtgcccgacgacagataccacgccatctacttcgccatgctgctggccggcgtgggcttcctgctgccctacaacagcttcatcaccgacgtggactacctgcaccacaagtaccccggcaccagcatcgtgttcgacatgagcctgacctacatcctggtggccctggccgccgtgctgctgaacaacgtgctggtggagagactgaccctgcacaccagaatcaccgccggctacctgctggccctgggccccctgctgttcatcagcatctgcgacgtgtggctgcagctgttcagcagagaccaggcctacgccatcaacctggccgccgtgggcaccgtggccttcggctgcaccgtgcagcagagcagcttctacggctacaccggcatgctgcccaagagatacacccagggcgtgatgaccggcgagagcaccgccggcgtgatgatcagcctgagcagaatcctgaccaagctgctgctgcccgacgagagagccagcaccctgatcttcttcctggtgagcgtggccctggagctgctgtgcttcctgctgcacctgctggtgagaagaagcagattcgtgctgttctacaccaccagacccagagacagccacagaggcagacccggcctgggcagaggctacggctacagagtgcaccacgacgtggtggccggcgacgtgcacttcgagcaccccgcccccgccctggcccccaacgagagccccaaggacagccccgcccacgaggtgaccggcagcggcggcgcctacatgagattcgacgtgcccagacccagagtgcagagaagctggcccaccttcagagccctgctgctgcacagatacgtggtggccagagtgatctgggccgacatgctgagcatcgccgtgacctacttcatcaccctgtgcctgttccccggcctggagagcgagatcagacactgcatcctgggcgagtggctgcccatcctgatcatggccgtgttcaacctgagcgacttcgtgggcaagatcctggccgccctgcccgtggactggagaggcacccacctgctggcctgcagctgcctgagagtggtgttcatccccctgttcatcctgtgcgtgtaccccagcggcatgcccgccctgagacaccccgcctggccctgcatcttcagcctgctgatgggcatcagcaacggctacttcggcagcgtgcccatgatcctggccgccggcaaggtgagccccaagcagagagagctggccggcaacaccatgaccgtgagctacatgagcggcctgaccctgggcagcgccgtggcctactgcacctacagcctgaccagagacgcccacggcagctgcctgcacgccagcaccgccaacggcagcatcctggccggcctgtag

SEQ ID NO: 22239 - DNA, 1593 bp, Artificial Sequence; identical to SEQ ID NO: 22238
  Description of Artificial Sequence: Synthetic coding sequence

SEQ ID NO: 22240 - DNA, 492 bp, Artificial Sequence
  Description of Artificial Sequence: Synthetic coding sequence
atgggcagcgtgggcagccagagactggaggagcccagcgtggccggcacccccgaccccggcgtggtgatgagcttcaccttcgacagccaccagctggaggaggccgccgaggccgcccagggccagggcctgagagccagaggcgtgcccgccttcaccgacaccaccctggacgagcccgtgcccgacgacagataccacgccatctacttcgccatgctgctggccggcgtgggcttcctgctgccctacaacagcttcatcaccgacgtggactacctgcaccacaagtaccccggcaccagcatcgtgttcgacatgagcctgacctacatcctggtggccctggccgccgtgctgctgaacaacgtgctggtggagagactgaccctgcacaccagaatcaccgccggctacctgctggccctgggccccctgctgttcatcagcatctgcgacgtgtggctgcagctgttcagcagagactag

SEQ ID NO: 22241 - DNA, 1707 bp, Artificial Sequence
  Description of Artificial Sequence: Synthetic coding sequence
atgctgcccggcctggccgccgccgccgcccacagatgcagctggagcagcctgtgcagactgagactgagatgcagagccgccgcctgcaaccccagcgacagacaggagtggcagaacctggtgaccttcggcagcttcagcaacatggtgccctgcagccacccctacatcggcaccctgagccaggtgaagctgtacagcaccaacgtgcagaaggagggccagggcagccagaccctgagagtggagaaggtgcccagcttcgagaccgccgagggcatcggcaccgagctgaaggcccccctgaagcaggagcccctgcaggtgagagtgaaggccgtgctgaagaagagagagtacggcagcaagtacacccagaacaacttcatcaccggcgtgagagccatcaacgagttctgcctgaagagcagcgacctggagcagctgagaaagatcagaagaagaagcccccacgaggacaccgagagcttcaccgtgtacctgagaagcgacgtggaggccaagagcctggaggtgtggggcagccccgaggccctggccagagagaagaagctgagaaaggaggccgagatcgagtacagagagagactgttcagaaaccagaagatcctgagagagtacagagacttcctgggcaacaccaagcccagaagcagaaccgccagcgtgttcttcaagggccccggcaaggtggtgatggtggccatctgcatcaacggcctgaactgcttcttcaagttcctggcctggatctacaccggcagcgccagcatgttcagcgaggccatccacagcctgagcgacacctgcaaccagggcctgctggccctgggcatcagcaagagcgtgcagacccccgaccccagccacccctacggcttcagcaacatgagatacatcagcagcctgatcagcggcgtgggcatcttcatgatgggcgccggcctgagctggtaccacggcgtgatgggcctgctgcacccccagcccatcgagagcctgctgtgggcctactgcatcctggccggcagcctggtgagcgagggcgccaccctgctggtggccgtgaacgagctgagaagaaacgccagagccaagggcatgagcttctacaagtacgtgatggagagcagagaccccagcaccaacgtgatcctgctggaggacaccgccgccgtgctgggcgtgatcatcgccgccacctgcatgggcctgaccagcatcaccggcaaccccctgtacgacagcctgggcagcctgggcgtgggcaccctgctgggcatggtgagcgccttcctgatctacaccaacaccgaggccctgctgggcagaagcatccagcccgagcaggtgcagagactgaccgagctgctggagaacgaccccagcgtgagagccatccacgacgtgaaggccaccgacctgggcctgggcaaggtgagattcaaggccgaggtggacttcgacggcagagtggtgaccagaagctacctggagaagcaggacttcgaccagatgctgcaggagatccaggaggtgaagacccccgaggagctggagaccttcatgctgaagcacggcgagaacatcatcgacaccctgggcgccgaggtggacagactggagaaggagctgaagaagagaaaccccgaggtgagacacgtggacctggagatcctgtag

SEQ ID NO: 22242 - DNA, 1191 bp, Artificial Sequence
  Description of Artificial Sequence: Synthetic coding sequence
atgtggaagcagaacctgtggaagttcggcgaggccctgaagctgctgcccgagaagaagctgagaaaggaggccgagatcgagtacagagagagactgttcagaaaccagaagatcctgagagagtacagagacttcctgggcaacaccaagcccagaagcagaaccgccagcgtgttcttcaagggccccggcaaggtggtgatggtggccatctgcatcaacggcctgaactgcttcttcaagttcctggcctggatctacaccggcagcgccagcatgttcagcgaggccatccacagcctgagcgacacctgcaaccagggcctgctggccctgggcatcagcaagagcgtgcagacccccgaccccagccacccctacggcttcagcaacatgagatacatcagcagcctgatcagcggcgtgggcatcttcatgatgggcgccggcctgagctggtaccacggcgtgatgggcctgctgcacccccagcccatcgagagcctgctgtgggcctactgcatcctggccggcagcctggtgagcgagggcgccaccctgctggtggccgtgaacgagctgagaagaaacgccagagccaagggcatgagcttctacaagtacgtgatggagagcagagaccccagcaccaacgtgatcctgctggaggacaccgccgccgtgctgggcgtgatcatcgccgccacctgcatgggcctgaccagcatcaccggcaaccccctgtacgacagcctgggcagcctgggcgtgggcaccctgctgggcatggtgagcgccttcctgatctacaccaacaccgaggccctgctgggcagaagcatccagcccgagcaggtgcagagactgaccgagctgctggagaacgaccccagcgtgagagccatccacgacgtgaaggccaccgacctgggcctgggcaaggtgagattcaaggccgaggtggacttcgacggcagagtggtgaccagaagctacctggagaagcaggacttcgaccagatgctgcaggagatccaggaggtgaagacccccgaggagctggagaccttcatgctgaagcacggcgagaacatcatcgacaccctgggcgccgaggtggacagactggagaaggagctgaagaagagaaaccccgaggtgagacacgtggacctggagatcctgtag

SEQ ID NO: 22243 - DNA, 1446 bp, Artificial Sequence
  Description of Artificial Sequence: Synthetic coding sequence
atgggcgccctggccagagccctgcccagcatcctgctggccctgctgctgaccagcacccccgaggccctgggcgccaaccccggcctggtggccagaatcaccgacaagggcctgcagtacgccgcccaggagggcctgctggccctgcagagcgagctgctgagaatcaccctgcccgacttcaccggcgacctgagaatcccccacgtgggcagaggcagatacgagttccacagcctgaacatccacagctgcgagctgctgcacagcgccctgagacccgtgcccggccagggcctgagcctgagcatcagcgacagcagcatcagagtgcagggcagatggaaggtgagaaagagcttcttcaagctgcagggcagcttcgacgtgagcgtgaagggcatcagcatcagcgtgaacctgctgctgggcagcgagagcagcggcagacccaccgtgaccgccagcagctgcagcagcgacatcgccgacgtggaggtggacatgagcggcgacctgggctggctgctgaacctgttccacaaccagatcgagagcaagttccagaaggtgctggagagcagaatctgcgagatgatccagaagagcgtgagcagcgacctgcagccctacctgcagaccctgcccgtgaccaccgagatcgacagcttcgccgacatcgactacagcctggtggaggcccccagagccaccgcccagatgctggaggtgatgttcaagggcgagatcttccacagaaaccacagaagccccgtgaccctgctggccgccgtgatgagcctgcccgaggagcacaacaagatggtgtacttcgccatcagcgactacgtgttcaacaccgccagcctggtgtaccacgaggagggctacctgaacttcagcatcaccgacgacatgatcccccccgacagcaacatcagactgaccaccaagagcttcagacccttcgtgcccagactggccagactgtaccccaacatgaacctggagctgcagggcagcgtgcccagcgcccccctgctgaacttcagccccggcaacctgagcgtggacccctacatggagatcgacgccttcgtgctgctgcccagcagcagcaaggagcccgtgttcagactgagcgtggccaccaacgtgagcgccaccctgaccttcaacaccagcaagatcaccggcttcctgaagcccggcaaggtgaaggtggagctgaaggagagcaaggtgggcctgttcaacgccgagctgctggaggccctgctgaactactacatcctgaacaccttctaccccaagttcaacgacaagctggccgagggcttccccctgcccctgctgaagagagtgcagctgtacgacctgggcctgcagatccacaaggacttcctgttcctgggcgccaacgtgcagtacatgagagtgtag

SEQ ID NO: 22244 - DNA, 1233 bp, Artificial Sequence
  Description of Artificial Sequence: Synthetic coding sequence
atggccgccgccgccgtgggcgccggccacggcgccggcggccccggcgccgccagcagcagcggcggcgccagagagggcgccagagtggccgccctgtgcctgctgtggtacgccctgagcgccggcggcaacgtggtgaacaaggtgatcctgagcgccttccccttccccgtgaccgtgagcctgtgccacatcctggccctgtgcgccggcctgccccccctgctgagagcctggagagtgccccccgccccccccgtgagcggccccggccccagcccccaccccagcagcggccccctgctgccccccagattctaccccagatacgtgctgcccctggccttcggcaagtacttcgccagcgtgagcgcccacgtgagcatctggaaggtgcccgtgagctacgcccacaccgtgaaggccaccatgcccatctgggtggtgctgctgagcagaatcatcatgaaggagaagcagagcaccaaggtgtacctgagcctgatccccatcatcagcggcgtgctgctggccaccgtgaccgagctgagcttcgacatgtggggcctggtgagcgccctggccgccaccctgtgcttcagcctgcagaacatcttcagcaagaaggtgctgagagacagcagaatccaccacctgagactgctgaacatcctgggctgccacgccgtgttcttcatgatccccacctgggtgctggtggacctgagcgccttcctggtgagcagcgacctgacctacgtgtaccagtggccctggaccctgctgctgctggccgtgagcggcttctgcaacttcgcccagaacgtgatcgccttcagcatcctgaacctggtgagccccctgagctacagcgtggccaacgccaccaagagaatcatggtgatcaccgtgagcctgatcatgctgagaaaccccgtgaccagcaccaacgtgctgggcatgatgaccgccatcctgggcgtgttcctgtacaacaagaccaagtacgacgccaaccagcaggccagaaagcacctgctgcccgtgaccaccgccgacctgagcagcaaggagagacacagaagccccctggagaagccccacaacggcctgctgttcccccagcacggcgactaccagtacggcagaaacaacatcctgaccgaccacttccagtacagcagacagagctaccccaacagctacagcctgaacagatacgacgtgtag

SEQ ID NO: 22245 - DNA, 1458 bp, Artificial Sequence
  Description of Artificial Sequence: Synthetic coding sequence
atggacgtgaaggccgcccccaacggcgtggccaccatcgaggacagaatcctgagaatcaccggctactacggctactaccccggctacagcagccagaagagcaccagcagaagcagcgtgaccagatgcaagcccggcgccaactgccccagcagccacagcggcatcagcagacagctgagccccctgagcgtgaccgaggacagcagcgcccccatcctggagctgcagaaccagggcagcagcggcgtgtgcggccacagagtggagagacagaacagaagcgccgacgacggcacccagacccacagcgagaacagcagccaggagaacagaatcaaggccagatgcctgagctgcaccagcatggtgctgaagggcatctggggcctgctgatcatcctgagcgtgagcagcagctgggtgggcaccacccagatcgtgaagatcacctacaagaacttctactgccccttcttcatgacctggttcagcaccaactggaacatcatgttcttccccgtgtactacagcggccacctggccaccgcccaggagaagcagagccccatgaagaagttcagagagtgcagcagaatcttcggcgaggacggcctgaccctgaagctgttcctgaagagaaccgcccccttcagcatcctgtggaccctgaccaactacctgtacctgctggccctgaagaagctgaccgccaccgacgtgagcgccctgttctgctgcaacaaggccttcgtgttcctgctgagctggatcgtgctgaaggacagattcatgggcgtgagaatcgtggccgccatcatggccatcaccggcatcgtgatgatggcctacgccgacaacttccacgccgacagcatcatcggcgtggccttcgccgtgggcagcgccagcaccagcgccctgtacaaggtgctgttcaagatgttcctgggcagcgccaacttcggcgaggccgcccacttcgtgagcaccctgggcttcttcaacctgatcttcatcagcttcacccccgtgatcctgtacttcaccaaggtggagcactggagcagcttcgccgccctgccctggggctgcctgtgcggcatggccggcctgtggctggccttcaacatcctggtgaacgtgggcgtggtgctgacctaccccatcctgatcagcatcggcaccgtgctgagcgtgcccggcaacgccgccgtggacctgctgaagcaggaggtgatcttcaacgtggtgagactggccgccaccatcatcatctgcatcggcttcctgctgatgctgctgcccgaggagtgggacgagatcaccctgagattcatcaacagcctgaaggagaagaagagcgaggagcacgtggacgacgtgaccgaccccagcatccacctgagaggcagaggcagagccaacggcaccgtgagcatccccctggcctag

SEQ ID NO: 22246 - DNA, 975 bp, Artificial Sequence
  Description of Artificial Sequence: Synthetic coding sequence
atgagcgtggaggacggcggcatgcccggcctgggcagacccagacaggccagatggaccctgatgctgctgctgagcaccgccatgtacggcgcccacgcccccctgctggccctgtgccacgtggacggcagagtgcccttcagacccagcagcgccgtgctgctgaccgagctgaccaagctgctgctgtgcgccttcagcctgctggtgggctggcaggcctggccccagggcccccccccctggagacaggccgcccccttcgccctgagcgccctgctgtacggcgccaacaacaacctggtgatctacctgcagagatacatggaccccagcacctaccaggtgctgagcaacctgaagatcggcagcaccgccgtgctgtactgcctgtgcctgagacacagactgagcgtgagacagggcctggccctgctgctgctgatggccgccggcgcctgctacgccgccggcggcctgcaggtgcccggcaacaccctgcccagccccccccccgccgccgccgccagccccatgcccctgcacatcacccccctgggcctgctgctgctgatcctgtactgcctgatcagcggcctgagcagcgtgtacaccgagctgctgatgaagagacagagactgcccctggccctgcagaacctgttcctgtacaccttcggcgtgctgctgaacctgggcctgcacgccggcggcggcagcggccccggcctgctggagggcttcagcggctgggccgccctggtggtgctgagccaggccctgaacggcctgctgatgagcgccgtgatgaagcacggcagcagcatcaccagactgttcgtggtgagctgcagcctggtggtgaacgccgtgctgagcgccgtgctgctgagactgcagctgaccgccgccttcttcctggccaccctgctgatcggcctggccatgagactgtactacggcagcagatag

SEQ ID NO: 22247 - DNA, 537 bp, Artificial Sequence
  Description of Artificial Sequence: Synthetic coding sequence
atgcccctgatcctgagcatcctgagcggcaacgtgcccagactgctgctgcccggcagctggctgcacaacctgatcttccccaagagagtggccatccccgccgcccccggcaccagcgagcccctgcccctgcacttctggtgcgccagcgagagcagaagcgcctgctggagaagactgtggcccagaccccccggcagattcctgagaatgggcagcaccagaggcgccgagcccggcaccaagtggaccgcccacgtgtgctgccacgaggcctggcagcagcaccacacccccctgtgcggcgtgctgctggccggcggccagagaagagccctgagcagccccgccaccgccgccgcccacagcagactgctgcccggccacatcgcccactggcccggccacgcccccgtgctgtggcagcccctggtgcccgacaacttccaccccgacagcggcccctgcagactgggcgccaccaccagaagccccagccaggccttcctgcccctgcccagcgccgccctgtag

SEQ ID NO: 22248 - DNA, 975 bp, Artificial Sequence; identical to SEQ ID NO: 22246
  Description of Artificial Sequence: Synthetic coding sequence

SEQ ID NO: 22249 - DNA, 267 bp, Artificial Sequence
  Description of Artificial Sequence: Synthetic coding sequence
atggagaagcagtgctgcagccaccccgtgatctgcagcctgagcaccatgtacaccttcctgctgggcgccatcttcatcgccctgagcagcagcagaatcctgctggtgaagtacagcgccaacgaggagaacaagtacgactacctgcccaccaccgtgaacgtgtgcagcgagctggtgaagctggtgttctgcgtgctggtgagcttctgcgtgatcaagaaggaccaccagagcagaaacctgaagtacgccagctggtag

SEQ ID NO: 22250 - DNA, 444 bp, Artificial Sequence
  Description of Artificial Sequence: Synthetic coding sequence
atggagaagcagtgctgcagccaccccgtgatctgcagcctgagcaccatgtacaccttcctgctgggcgccatcttcatcgccctgagcagcagcagaatcctgctggtgaagtacagcgccaacgaggagaacaagtacgactacctgcccaccaccgtgaacgtgtgcagcgagctggtgaagctggtgttctgcgtgctggtgagcttctgcgtgatcaagaaggaccaccagagcagaaacctgaagtacgccagctggaaggagttcagcgacttcatgaagtggagcatccccgccttcctgtacttcctggacaacctgatcgtgttctacgtgctgagctacctgcagcccgccatggccgtgatcttcagcaacttcagcatcatcaccaccgccctgctgttcagaatcgtgctgaagagaagactgaactag

SEQ ID NO: 22251 - DNA, 1275 bp, Artificial Sequence
  Description of Artificial Sequence: Synthetic coding sequence
atggagaagcagtgctgcagccaccccgtgatctgcagcctgagcaccatgtacaccttcctgctgggcgccatcttcatcgccctgagcagcagcagaatcctgctggtgaagtacagcgccaacgaggagaacaagtacgactacctgcccaccaccgtgaacgtgtgcagcgagctggtgaagctggtgttctgcgtgctggtgagcttctgcgtgatcaagaaggaccaccagagcagaaacctgaagtacgccagctggaaggagttcagcgacttcatgaagtggagcatccccgccttcctgtacttcctggacaacctgatcgtgttctacgtgctgagctacctgcagcccgccatggccgtgatcttcagcaacttcagcatcatcaccaccgccctgctgttcagaatcgtgctgaagagaagactgaactggatccagtgggccagcctgctgaccctgttcctgagcatcgtggccctgaccgccggcaccaagaccctgcagcacaacctggccggcagaggcttccaccacgacgccttcttcagccccagcaacagctgcctgctgttcagaagcgagtgccccagaaaggacaactgcaccgccaaggagtggaccttccccgaggccaagtggaacaccaccgccagagtgttcagccacatcagactgggcatgggccacgtgctgatcatcgtgcagtgcttcatcagcagcatggccaacatctacaacgagaagatcctgaaggagggcaaccagctgaccgagagcatcttcatccagaacagcaagctgtacttcttcggcatcctgttcaacggcctgaccctgggcctgcagagaagcaacagagaccagatcaagaactgcggcttcttctacggccacagcgccttcagcgtggccctgatcttcgtgaccgccttccagggcctgagcgtggccttcatcctgaagttcctggacaacatgttccacgtgctgatggcccaggtgaccaccgtgatcatcaccaccgtgagcgtgctggtgttcgacttcagacccagcctggagttcttcctggaggcccccagcgtgctgctgagcatcttcatctacaacgccagcaagccccaggtgcccgagtacgcccccagacaggagagaatcagagacctgagcggcaacctgtgggagagaagcagcggcgacggcgaggagctggagagactgaccaagcccaagagcgacgagagcgacgaggacaccttctag

SEQ ID NO: 22252 - DNA, 1098 bp, Artificial Sequence
  Description of Artificial Sequence: Synthetic coding sequence
atgggcagatgggccctggacgtggccttcctgtggaaggccgtgctgaccctgggcctggtgctgctgtactactgcttcagcatcggcatcaccttctacaacaagtggctgaccaagagcttccacttccccctgttcatgaccatgctgcacctggccgtgatcttcctgttcagcgccctgagcagagccctggtgcagtgcagcagccacagagccagagtggtgctgagctgggccgactacctgagaagagtggcccccaccgccctggccaccgccctggacgtgggcctgagcaactggagcttcctgtacgtgaccgtgagcctgtacaccatgaccaagagcagcgccgtgctgttcatcctgatcttcagcctgatcttcaagctggaggagctgagagccgccctggtgctggtggtgctgctgatcgccggcggcctgttcatgttcacctacaagagcacccagttcaacgtggagggcttcgccctggtgctgggcgccagcttcatcggcggcatcagatggaccctgacccagatgctgctgcagaaggccgagctgggcctgcagaaccccatcgacaccatgttccacctgcagcccctgatgttcctgggcctgttccccctgttcgccgtgttcgagggcctgcacctgagcaccagcgagaagatcttcagattccaggacaccggcctgctgctgagagtgctgggcagcctgttcctgggcggcatcctggccttcggcctgggcttcagcgagttcctgctggtgagcagaaccagcagcctgaccctgagcatcgccggcatcttcaaggaggtgtgcaccctgctgctggccgcccacctgctgggcgaccagatcagcctgctgaactggctgggcttcgccctgtgcctgagcggcatcagcctgcacgtggccctgaaggccctgcacagcagaggcgacggcggccccaaggccctgaagggcctgggcagcagccccgacctggagctgctgctgagaagcagccagagagaggagggcgacaacgaggaggaggagtacttcgtggcccagggccagcagtag

SEQ ID NO: 22253 - DNA, 1035 bp, Artificial Sequence
  Description of Artificial Sequence: Synthetic coding sequence
atgggcagatgggccctggacgtggccttcctgtggaaggccgtgctgaccctgggcctggtgctgctgtactactgcttcagcatcggcatcaccttctacaacaagtggctgaccaagagcttccacttccccctgttcatgaccatgctgcacctggccgtgatcttcctgttcagcgccctgagcagagccctggtgcagtgcagcagccacagagccagagtggtgctgagctgggccgactacctgagaagagtggcccccaccgccctggccaccgccctggacgtgggcctgagcaactggagcttcctgtacgtgaccgtgagcctgtacaccatgaccaagagcagcgccgtgctgttcatcctgatcttcagcctgatcttcaagctggaggagctgagcacccagttcaacgtggagggcttcgccctggtgctgggcgccagcttcatcggcggcatcagatggaccctgacccagatgctgctgcagaaggccgagctgggcctgcagaaccccatcgacaccatgttccacctgcagcccctgatgttcctgggcctgttccccctgttcgccgtgttcgagggcctgcacctgagcaccagcgagaagatcttcagattccaggacaccggcctgctgctgagagtgctgggcagcctgttcctgggcggcatcctggccttcggcctgggcttcagcgagttcctgctggtgagcagaaccagcagcctgaccctgagcatcgccggcatcttcaaggaggtgtgcaccctgctgctggccgcccacctgctgggcgaccagatcagcctgctgaactggctgggcttcgccctgtgcctgagcggcatcagcctgcacgtggccctgaaggccctgcacagcagaggcgacggcggccccaaggccctgaagggcctgggcagcagccccgacctggagctgctgctgagaagcagccagagagaggagggcgacaacgaggaggaggagtacttcgtggcccagggccagcagtag

SEQ ID NO: 22254 - DNA, 477 bp, Artificial Sequence
  Description of Artificial Sequence: Synthetic coding sequence
atgggcagatgggccctggacgtggccttcctgtggaaggccgtgctgaccctgggcctggtgctgctgtactactgcttcagcatcggcatcaccttctacaacaagtggctgaccaagagcttccacttccccctgttcatgaccatgctgcacctggccgtgatcttcctgttcagcgccctgagcagagccctggtgcagtgcagcagccacagagccagagtggtgctgagctgggccgactacctgagaagagtggcccccaccgccctggccaccgccctggacgtgggcctgagcaactggagcttcctgtacgtgaccgtgagcctggccagacactggagctggtggagcagcagcagccccggcgtgagcagctgcagccccaccagcccccacagcagcacctggagagccagcccctggtgctggggccccagaagcagcgtggccttcgccggccccagctag

SEQ ID NO: 22255 - DNA, 702 bp, Artificial Sequence
  Description of Artificial Sequence: Synthetic coding sequence
atggagctgaagagagccgccctggtgctggtggtgctgctgatcgccggcggcctgttcatgttcacctacaagagcacccagttcaacgtggagggcttcgccctggtgctgggcgccagcttcatcggcggcatcagatggaccctgacccagatgctgctgcagaaggccgagctgggcctgcagaaccccatcgacaccatgttccacctgcagcccctgatgttcctgggcctgttccccctgttcgccgtgttcgagggcctgcacctgagcaccagcgagaagatcttcagattccaggacaccggcctgctgctgagagtgctgggcagcctgttcctgggcggcatcctggccttcggcctgggcttcagcgagttcctgctggtgagcagaaccagcagcctgaccctgagcatcgccggcatcttcaaggaggtgtgcaccctgctgctggccgcccacctgctgggcgaccagatcagcctgctgaactggctgggcttcgccctgtgcctgagcggcatcagcctgcacgtggccctgaaggccctgcacagcagaggcgacggcggccccaaggccctgaagggcctgggcagcagccccgacctggagctgctgctgagaagcagccagagagaggagggcgacaacgaggaggaggagtacttcgtggcccagggccagcagtag

SEQ ID NO: 22256 - DNA, 1098 bp, Artificial Sequence; identical to SEQ ID NO: 22252
  Description of Artificial Sequence: Synthetic coding sequence

SEQ ID NO: 22257 - DNA, 699 bp, Artificial Sequence
  Description of Artificial Sequence: Synthetic coding sequence
atggagctgagagccgccctggtgctggtggtgctgctgatcgccggcggcctgttcatgttcacctacaagagcacccagttcaacgtggagggcttcgccctggtgctgggcgccagcttcatcggcggcatcagatggaccctgacccagatgctgctgcagaaggccgagctgggcctgcagaaccccatcgacaccatgttccacctgcagcccctgatgttcctgggcctgttccccctgttcgccgtgttcgagggcctgcacctgagcaccagcgagaagatcttcagattccaggacaccggcctgctgctgagagtgctgggcagcctgttcctgggcggcatcctggccttcggcctgggcttcagcgagttcctgctggtgagcagaaccagcagcctgaccctgagcatcgccggcatcttcaaggaggtgtgcaccctgctgctggccgcccacctgctgggcgaccagatcagcctgctgaactggctgggcttcgccctgtgcctgagcggcatcagcctgcacgtggccctgaaggccctgcacagcagaggcgacggcggccccaaggccctgaagggcctgggcagcagccccgacctggagctgctgctgagaagcagccagagagaggagggcgacaacgaggaggaggagtacttcgtggcccagggccagcagtag

SEQ ID NO: 22258 - DNA, 1098 bp, Artificial Sequence; identical to SEQ ID NO: 22252
  Description of Artificial Sequence: Synthetic coding sequence

SEQ ID NO: 22259 - DNA, 591 bp, Artificial Sequence
  Description of Artificial Sequence: Synthetic coding sequence
atgggcagatgggccctggacgtggccttcctgtggaaggccgtgctgaccctgggcctggtgctgctgtactactgcttcagcatcggcatcaccttctacaacaagtggctgaccaagagcttccacttccccctgttcatgaccatgctgcacctggccgtgatcttcctgttcagcgccctgagcagagccctggtgcagtgcagcagccacagagccagagtggtgctgagctgggccgactacctgagaagagtggcccccaccgccctggccaccgccctggacgtgggcctgagcaactggagcttcctgtacgtgaccgtgagcctgccccacagcagcacctggagagccagcccctggtgctggggccccagaagcagcgtggccttcgccggccccagccccagatgcagctgcagaagactgaacagcgccagcagaatccccagcaccccctgcagcacctgcagccacagctgcagctggggcagcagcctgagcctgctgtacctgaaggtgagcatctgcccccacctgagaaagagcagcgtgagcagaacccagggctgcagctgcggctag

SEQ ID NO: 22260 - DNA, 477 bp, Artificial Sequence; identical to SEQ ID NO: 22254
  Description of Artificial Sequence: Synthetic coding sequence

SEQ ID NO: 22261 - DNA, 1185 bp, Artificial Sequence
  Description of Artificial Sequence: Synthetic coding sequence
atgggcagagtgagcaccagccaccagcccctgagaggcgtgcccgcccccgccgacagcggcgcccccgtgctgcagccccccagaatgggcagatgggccctggacgtggccttcctgtggaaggccgtgctgaccctgggcctggtgctgctgtactactgcttcagcatcggcatcaccttctacaacaagtggctgaccaagagcttccacttccccctgttcatgaccatgctgcacctggccgtgatcttcctgttcagcgccctgagcagagccctggtgcagtgcagcagccacagagccagagtggtgctgagctgggccgactacctgagaagagtggcccccaccgccctggccaccgccctggacgtgggcctgagcaactggagcttcctgtacgtgaccgtgagcctgtacaccatgaccaagagcagcgccgtgctgttcatcctgatcttcagcctgatcttcaagctggaggagctgagagccgccctggtgctggtggtgctgctgatcgccggcggcctgttcatgttcacctacaagagcacccagttcaacgtggagggcttcgccctggtgctgggcgccagcttcatcggcggcatcagatggaccctgacccagatgctgctgcagaaggccgagctgggcctgcagaaccccatcgacaccatgttccacctgcagcccctgatgttcctgggcctgttccccctgttcgccgtgttcgagggcctgcacctgagcaccagcgagaagatcttcagattccaggacaccggcctgctgctgagagtgctgggcagcctgttcctgggcggcatcctggccttcggcctgggcttcagcgagttcctgctggtgagcagaaccagcagcctgaccctgagcatcgccggcatcttcaaggaggtgtgcaccctgctgctggccgcccacctgctgggcgaccagatcagcctgctgaactggctgggcttcgccctgtgcctgagcggcatcagcctgcacgtggccctgaaggccctgcacagcagaggcgacggcggccccaaggccctgaagggcctgggcagcagccccgacctggagctgctgctgagaagcagccagagagaggagggcgacaacgaggaggaggagtacttcgtggcccagggccagcagtag

SEQ ID NO: 22262 - DNA, 1233 bp, Artificial Sequence; identical to SEQ ID NO: 22244
  Description of Artificial Sequence: Synthetic coding sequence

SEQ ID NO: 22263 - DNA, 315 bp, Artificial Sequence
  Description of Artificial Sequence: Synthetic coding sequence
atgaaggagaagcagagcaccaaggtgtacctgagcctgatccccatcatcagcggcgtgctgctggccaccgtgaccgagctgagcttcgacatgtggggcctggtgagcgccctggccgccaccctgtgcttcagcctgcagaacatcttcagcaagaaggtgctgagagacagcagaatccaccacctgagactgctgaacatcctgggctgccacgccgtgttcttcatgatccccacctgggtgctggtggacctgagcgccttcctggtgagcagcgacctgggcctgcccagcgagaacgtgctgtag

SEQ ID NO: 22264 - DNA, 801 bp, Artificial Sequence
  Description of Artificial Sequence: Synthetic coding sequence
atgagcagcagcgtgaagacccccgccctggaggagctggtgcccggcagcgaggagaagcccaagggcagaagccccctgagctggggcagcctgttcggccacagaagcgagaagatcgtgttcgccaagagcgacggcggcaccgacgagaacgtgctgaccgtgaccatcaccgagaccaccgtgatcgagagcgacctgggcgtgtggagcagcagagccctgctgtacctgaccctgtggttcttcttcagcttctgcaccctgttcctgaacaagtacatcctgagcctgctgggcggcgagcccagcatgctgggcgccgtgcagatgctgagcaccaccgtgatcggctgcgtgaagaccctggtgccctgctgcctgtaccagcacaaggccagactgagctacccccccaacttcctgatgaccatgctgttcgtgggcctgatgagattcgccaccgtggtgctgggcctggtgagcctgaagaacgtggccgtgagcttcgccgagaccgtgaagagcagcgcccccatcttcaccgtgatcatgagcagaatgatcctgggcgagtacaccggcagacccagcgacagagaggagagagaggagctgcagctgcagcccggcagaggcgccgccgccagcgacagaagaagccccgtgccccccagcgagagacacggcgtgagaccccacggcgagaacctgcccggcgacttccaggtgccccaggccctgcacagagtggccctgagcatggccctgccctgccccatgctgcccgccagctag

SEQ ID NO: 22265 - DNA, 741 bp, Artificial Sequence
  Description of Artificial Sequence: Synthetic coding sequence
atgagcagcagcgtgaagacccccgccctggaggagctggtgcccggcagcgaggagaagcccaagggcagaagccccctgagctggggcagcctgttcggccacagaagcgagaagatcgtgttcgccaagagcgacggcggcaccgacgagaacgtgctgaccgtgaccatcaccgagaccaccgtgatcgagagcgacctgggcgtgtggagcagcagagccctgctgtacctgaccctgtggttcttcttcagcttctgcaccctgttcctgaacaagtacatcctgagcctgctgggcggcgagcccagcatgctgggcgccgtgcagatgctgagcaccaccgtgatcggctgcgtgaagaccctggtgccctgctgcctgtaccagcacaaggccagactgagctacccccccaacttcctgatgaccatgctgttcgtgggcctgatgagattcgccaccgtggtgctgggcctggtgagcctgaagaacgtggccgtgagcttcgccgagaccgtgaagagcagcgcccccatcttcaccgtgatcatgagcagaatgatcctgggcgagtacaccggcagacccagcgacagagaggagagagaggagctgcagctgcagcccggcagaggcgccgccgccagcgacagaagaagccccgtgccccccagcgagagacacggcgtgagaccccacggcgagaacctgcccggcgacttccaggcccagtag

SEQ ID NO: 22266 - DNA, 741 bp, Artificial Sequence; identical to SEQ ID NO: 22265
  Description of Artificial Sequence: Synthetic coding sequence

SEQ ID NO: 22267 - DNA, 966 bp, Artificial Sequence
  Description of Artificial Sequence: Synthetic coding sequence
atggccctgggcgcctgcggcctgctgctgctgctggccgtgcccggcgtgagcctgagaaccctgcagcccggctgcggcagaccccaggtgagcgacgccggcggcagaatcgtgggcggccacgccgcccccgccggcgcctggccctggcaggccagcctgagactgagaagagtgcacgtgtgcggcggcagcctgctgagcccccagtgggtgctgaccgccgcccactgcttcagcggcagcctgaacagcagcgactaccaggtgcacctgggcgagctggagatcaccctgagcccccacttcagcaccgtgagacagatcatcctgcacagcagccccagcggccagcccggcaccagcggcgacatcgccctggtggagctgagcgtgcccgtgaccctgagcagcagaatcctgcccgtgtgcctgcccgaggccagcgacgacttctgccccggcatcagatgctgggtgaccggctggggctacaccagagagggcgagcccctgccccccccctacagcctgagagaggtgaaggtgagcgtggtggacaccgagacctgcagaagagactaccccggccccggcggcagcatcctgcagcccgacatgctgtgcgccagaggccccggcgacgcctgccaggacgacagcggcggccccctggtgtgccaggtgaacggcgcctgggtgcaggccggcaccgtgagctggggcgagggctgcggcagacccaacagacccggcgtgtacaccagagtgcccgcctacgtgaactggatcagaagacacatcaccgccagcggcggcagcgagagcggctaccccagactgcccctgctggccggcttcttcctgcccggcctgttcctgctgctggtgagctgcgtgctgctggccaagtgcctgctgcaccccagcgccgacggcacccccttccccgcccccgactag

SEQ ID NO: 22268 - DNA, 1218 bp, Artificial Sequence
  Description of Artificial Sequence: Synthetic coding sequence
atgagcagcagcgtgaagacccccgccctggaggagctggtgcccggcagcgaggagaagcccaagggcagaagccccctgagctggggcagcctgttcggccacagaagcgagaagatcgtgttcgccaagagcgacggcggcaccgacgagaacgtgctgaccgtgaccatcaccgagaccaccgtgatcgagagcgacctgggcgtgtggagcagcagagccctgctgtacctgaccctgtggttcttcttcagcttctgcaccctgttcctgaacaagtacatcctgagcctgctgggcggcgagcccagcatgctgggcgccgtgcagatgctgagcaccaccgtgatcggctgcgtgaagaccctggtgccctgctgcctgtaccagcacaaggccagactgagctacccccccaacttcctgatgaccatgctgttcgtgggcctgatgagattcgccaccgtggtgctgggcctggtgagcctgaagaacgtggccgtgagcttcgccgagaccgtgaagagcagcgcccccatcttcaccgtgatcatgagcagaatgatcctgggcgagtacaccggcctgctggtgaacctgagcctgatccccgtgatgggcggcctggccctgtgcaccgccaccgagatcagcttcaacgtgctgggcttcagcgccgccctgagcaccaacatcatggactgcctgcagaacgtgttcagcaagaagctgctgagcggcgacaagtacagattcagcgcccccgagctgcagttctacaccagcgccgccgccgtggccatgctggtgcccgccagagtgttcttcaccgacgtgcccgtgatcggcagaagcggcaagagcttcagctacaaccaggacgtggtgctgctgctgctgaccgacggcgtgctgttccacctgcagagcgtgaccgcctacgccctgatgggcaagatcagccccgtgaccttcagcgtggccagcaccgtgaagcacgccctgagcatctggctgagcgtgatcgtgttcggcaacaagatcaccagcctgagcgccgtgggcaccgccctggtgaccgtgggcgtgctgctgtacaacaaggccagacagcaccagcaggaggccctgcagagcctggccgccgccaccggcagagcccccgacgacaccgtggagcccctgctgccccaggaccccagacagcacccctag

SEQ ID NO: 22269 - DNA, 942 bp, Artificial Sequence
  Description of Artificial Sequence: Synthetic coding sequence
atggccctgctggtggacagagtgagaggccactggagaatcgccgccggcctgctgttcaacctgctggtgagcatctgcatcgtgttcctgaacaagtggatctacgtgtaccacggcttccccaacatgagcctgaccctggtgcacttcgtggtgacctggctgggcctgtacatctgccagaagctggacatcttcgcccccaagagcctgccccccagcagactgctgctgctggccctgagcttctgcggcttcgtggtgttcaccaacctgagcctgcagaacaacaccatcggcacctaccagctggccaaggccatgaccacccccgtgatcatcgccatccagaccttctgctaccagaagaccttcagcaccagaatccagctgaccctgatccccatcaccctgggcgtgatcctgaacagctactacgacgtgaagttcaacttcctgggcatggtgttcgccgccctgggcgtgctggtgaccagcctgtaccaggtgtgggtgggcgccaagcagcacgagctgcaggtgaacagcatgcagctgctgtactaccaggcccccatgagcagcgccatgctgctggtggccgtgcccttcttcgagcccgtgttcggcgagggcggcatcttcggcccctggagcgtgagcgccctgctgatggtgctgctgagcggcgtgatcgccttcatggtgaacctgagcatctactggatcatcggcaacaccagccccgtgacctacaacatgttcggccacttcaagttctgcatcaccctgttcggcggctacgtgctgttcaaggaccccctgagcatcaaccaggccctgggcatcctgtgcaccctgttcggcatcctggcctacacccacttcaagctgagcgagcaggagggcagcagaagcaagctggcccagagaccctag

SEQ ID NO: 22270 - DNA, 705 bp, Artificial Sequence
  Description of Artificial Sequence: Synthetic coding sequence
atgtgcagatgcccccccgagcaccacgacggcagaatgaccagcgccgaggtgggcgccgccgccggcggcgcccaggccgccggcccccccgagtggccccccggcagcccccaggccctgagacagcccggcagagccagagtggccatggccgccctggtgtggctgctggccggcgccagcatgagcagcctgaacaagtggatcttcaccgtgcacggcttcggcagacccctgctgctgagcgccctgcacatgctggtggccgccctggcctgccacagaggcgccagaagacccatgcccggcggcaccagatgcagagtgctgctgctgagcctgaccttcggcaccagcatggcctgcggcaacgtgggcctgagagccgtgcccctggacctggcccagctggtgaccaccaccacccccctgttcaccctggccctgagcgccctgctgctgggcagaagacaccaccccctgcagctggccgccatgggccccctgtgcctgggcgccgcctgcagcctggccggcgagttcagaaccccccccaccggctgcggcttcctgctggccgccacctgcctgagaggcctgaagagcgtgcagcagagcctgagcttccagatctgcaagatggagctgatgatccccatggagagagtgagaatgagaagcgccggccagggccaggagtag

SEQ ID NO: 22271 - DNA, 1053 bp, Artificial Sequence
  Description of Artificial Sequence: Synthetic coding sequence
atgtgcagatgcccccccgagcaccacgacggcagaatgaccagcgccgaggtgggcgccgccgccggcggcgcccaggccgccggcccccccgagtggccccccggcagcccccaggccctgagacagcccggcagagccagagtggccatggccgccctggtgtggctgctggccggcgccagcatgagcagcctgaacaagtggatcttcaccgtgcacggcttcggcagacccctgctgctgagcgccctgcacatgctggtggccgccctggcctgccacagaggcgccagaagacccatgcccggcggcaccagatgcagagtgctgctgctgagcctgaccttcggcaccagcatggcctgcggcaacgtgggcctgagagccgtgcccctggacctggcccagctggtgaccaccaccacccccctgttcaccctggccctgagcgccctgctgctgggcagaagacaccaccccctgcagctggccgccatgggccccctgtgcctgggcgccgcctgcagcctggccggcgagttcagaaccccccccaccggctgcggcttcctgctggccgccacctgcctgagaggcctgaagagcgtgcagcagagcgccctgctgcaggaggagagactggacgccgtgaccctgctgtacgccaccagcctgcccagcttctgcctgctggccggcgccgccctggtgctggaggccggcgtggcccccccccccaccgccggcgacagcagactgtgggcctgcatcctgctgagctgcctgctgagcgtgctgtacaacctggccagcttcagcctgctggccctgaccagcgccctgaccgtgcacgtgctgggcaacctgaccgtggtgggcaacctgatcctgagcagactgctgttcggcagcagactgagcgccctgagctacgtgggcatcgccctgaccctgagcggcatgttcctgtaccacaactgcgagttcgtggccagctgggccgccagaagaggcctgtggagaagagaccagcccagcaagggcctgtag

SEQ ID NO: 22272 - DNA, 705 bp, Artificial Sequence; identical to SEQ ID NO: 22270
  Description of Artificial Sequence: Synthetic coding sequence

SEQ ID NO: 22273 - DNA, 1227 bp, Artificial Sequence
  Description of Artificial Sequence: Synthetic coding sequence
atgatcccccccgagcagccccagcagcagctgcagccccccagccccgccccccccaaccacgtggtgaccaccatcgagaacctgcccgccgagggcagcggcggcggcggcagcctgagcgccagcagcagagccggcgtgagacagagaatcagaaaggtgctgaacagagagatgctgatcagcgtggccctgggccaggtgctgagcctgctgatctgcggcatcggcctgaccagcaagtacctgagcgaggacttccacgccaacacccccgtgttccagagcttcctgaactacatcctgctgttcctggtgtacaccaccaccctggccgtgagacagggcgaggagaacctgctggccatcctgagaagaagatggtggaagtacatgatcctgggcctgatcgacctggaggccaactacctggtggtgaaggcctaccagtacaccaccctgaccagcatccagctgctggactgcttcgtgatccccgtggtgatcctgctgagctggttcttcctgctgatcagatacaaggccgtgcacttcatcggcatcgtggtgtgcatcctgggcatgggctgcatggtgggcgccgacgtgctggtgggcagacaccagggcgccggcgagaacaagctggtgggcgacctgctggtgctgggcggcgccaccctgtacggcatcagcaacgtgtgggaggagtacatcatcagaaccctgagcagagtggagttcctgggcatgatcggcctgttcggcgccttcttcagcggcatccagctggccatcatggagcacaaggagctgctgaaggtgccctgggactggcagatcggcctgctgtacgtgggcttcagcgcctgcatgttcggcctgtacagcttcatgcccgtggtgatcaagaagaccagcgccaccagcgtgaacctgagcctgctgaccgccgacctgtacagcctgttctgcggcctgttcctgttccactacaagttcagcggcctgtacctgctgagcttcttcaccatcctgatcggcctggtgctgtacagcagcaccagcacctacatcgcccaggaccccagagtgtacaagcagttcagaaaccccagcggccccgtggtggacctgcccaccaccgcccaggtggagcccagcgtgacctacaccagcctgggccaggagaccgaggaggagccccacgtgagagtggcctag

SEQ ID NO: 22274 - DNA, 681 bp, Artificial Sequence
  Description of Artificial Sequence: Synthetic coding sequence
atggccctgagctggttcatcctgcacgccagatacagagtgatccacttcatcgccgtggccgtgtgcctgctgggcgtgggcaccatggtgggcgccgacatcctggccggcagagaggacaacagcggcagcgacgtgctgatcggcgacatcctggtgctgctgggcgccagcctgtacgccatcagcaacgtgtgcgaggagtacatcgtgaagaagctgagcagacaggagttcctgggcatggtgggcctgttcggcaccatcatcagcggcatccagctgctgatcgtggagtacaaggacatcgccagcatccactgggactggaagatcgccctgctgttcgtggccttcgccctgtgcatgttctgcctgtacagcttcatgcccctggtgatcaaggtgaccagcgccaccagcgtgaacctgggcatcctgaccgccgacctgtacagcctgttcgtgggcctgttcctgttcggctacaagttcagcggcctgtacatcctgagcttcaccgtgatcatggtgggcttcatcctgtactgcagcacccccaccagaaccgccgagcccgccgagagcagcgtgccccccgtgaccagcatcggcatcgacaacctgggcctgaagctggaggagaacctgcaggagacccacagcgccgtgctgtag

SEQ ID NO: 22275 - DNA, 984 bp, Artificial Sequence
  Description of Artificial Sequence: Synthetic coding sequence
atgctgagcctgtgcatctgcggcaccgccatcaccagccagtacctggccgagagatacaaggtgaacacccccatgctgcagagcttcatcaactactgcctgctgttcctgatctacaccgtgatgctggccttcagaagcggcagcgacaacctgctggtgatcctgaagagaaagtggtggaagtacatcctgctgggcctggccgacgtggaggccaactacgtgatcgtgagagcctaccagtacaccaccctgaccagcgtgcagctgctggactgcttcggcatccccgtgctgatggccctgagctggttcatcctgcacgccagatacagagtgatccacttcatcgccgtggccgtgtgcctgctgggcgtgggcaccatggtgggcgccgacatcctggccggcagagaggacaacagcggcagcgacgtgctgatcggcgacatcctggtgctgctgggcgccagcctgtacgccatcagcaacgtgtgcgaggagtacatcgtgaagaagctgagcagacaggagttcctgggcatggtgggcctgttcggcaccatcatcagcggcatccagctgctgatcgtggagtacaaggacatcgccagcatccactgggactggaagatcgccctgctgttcgtggccttcgccctgtgcatgttctgcctgtacagcttcatgcccctggtgatcaaggtgaccagcgccaccagcgtgaacctgggcatcctgaccgccgacctgtacagcctgttcgtgggcctgttcctgttcggctacaagttcagcggcctgtacatcctgagcttcaccgtgatcatggtgggcttcatcctgtactgcagcacccccaccagaaccgccgagcccgccgagagcagcgtgccccccgtgaccagcatcggcatcgacaacctgggcctgaagctggaggagaacctgcaggagacccacagcgccgtgctgtag

SEQ ID NO: 22276 - DNA, 1125 bp, Artificial Sequence
  Description of Artificial Sequence: Synthetic coding sequence
atggaggccgacagccccgccggccccggcgcccccgagcccctggccgagggcgccgccgccgagttcagcagcctgctgagaagaatcaagggcaagctgttcacctggaacatcctgaagaccatcgccctgggccagatgctgagcctgtgcatctgcggcaccgccatcaccagccagtacctggccgagagatacaaggtgaacacccccatgctgcagagcttcatcaactactgcctgctgttcctgatctacaccgtgatgctggccttcagaagcggcagcgacaacctgctggtgatcctgaagagaaagtggtggaagtacatcctgctgggcctggccgacgtggaggccaactacgtgatcgtgagagcctaccagtacaccaccctgaccagcgtgcagctgctggactgcttcggcatccccgtgctgatggccctgagctggttcatcctgcacgccagatacagagtgatccacttcatcgccgtggccgtgtgcctgctgggcgtgggcaccatggtgggcgccgacatcctggccggcagagaggacaacagcggcagcgacgtgctgatcggcgacatcctggtgctgctgggcgccagcctgtacgccatcagcaacgtgtgcgaggagtacatcgtgaagaagctgagcagacaggagttcctgggcatggtgggcctgttcggcaccatcatcagcggcatccagctgctgatcgtggagtacaaggacatcgccagcatccactgggactggaagatcgccctgctgttcgtggccttcgccctgtgcatgttctgcctgtacagcttcatgcccctggtgatcaaggtgaccagcgccaccagcgtgaacctgggcatcctgaccgccgacctgtacagcctgttcgtgggcctgttcctgttcggctacaagttcagcggcctgtacatcctgagcttcaccgtgatcatggtgggcttcatcctgtactgcagcacccccaccagaaccgccgagcccgccgagagcagcgtgccccccgtgaccagcatcggcatcgacaacctgggcctgaagctggaggagaacctgcaggagacccacagcgccgtgctgtag

SEQ ID NO: 22277 - DNA, 1074 bp, Artificial Sequence
  Description of Artificial Sequence: Synthetic coding sequence
atggaggccgacagccccgccggccccggcgcccccgagcccctggccgagggcgccgccgccgagttcagcagcctgctgagaagaatcaagggcaagctgttcacctggaacatcctgaagaccatcgccctgggccagatgctgagcctgtgcatctgcggcaccgccatcaccagccagtacctggccgagagatacaaggtgaacacccccatgctgcagagcttcatcaactactgcctgctgttcctgatctacaccgtgatgctggccttcagaagcggcagcgacaacctgctggtgatcctgaagagaaagtggtggaagtacatcctgctgggcctggccgacgtggaggccaactacgtgatcgtgagagcctaccagtacaccaccctgaccagcgtgcagctgctggactgcttcggcatccccgtgctgatggccctgagctggttcatcctgcacgccagatacagagtgatccacttcatcgccgtggccgtgtgcctgctgggcgtgggcaccatggtgggcgccgacatcctggccggcagagaggacaacagcggcagcgacgtgctgatcggcgacatcctggtgctgctgggcgccagcctgtacgccatcagcaacgtgtgcgaggagtacatcgtgaagaagctgagcagacaggagttcctgggcatggtgggcctgttcggcaccatcatcagcggcatccagctgctgatcgtggagtacaaggacatcgccagcatccactgggactggaagatcgccctgctgttcgtggccttcgccctgtgcatgttctgcctgtacagcttcatgcccctggtgatcaaggtgaccagcgccaccagcgtgaacctgggcatcctgaccgccgacctgtacagcctgttcgtgggcctgttcctgttcggctacaaggacagcaccagctgccccagcctgagcagctggtggggcctgagctgcaccgccccccccctgctggccagacccagcagactgaaggccgcctgcctgcagagccccgccctgggcctgaccacctggggctag

SEQ ID NO: 22278 - DNA, 1125 bp, Artificial Sequence; identical to SEQ ID NO: 22276
  Description of Artificial Sequence: Synthetic coding sequence

SEQ ID NO: 22279 - DNA, 1266 bp, Artificial Sequence
  Description of Artificial Sequence: Synthetic coding sequence
atgaagaagcacagcgccagagtggcccccctgagcgcctgcaacagccccgtgctgaccctgaccaaggtggagggcgaggagagacccagagacagccccggccccgccgaggcccaggcccccgccggcgtggaggccggcggcagagccagcagaagatgctggacctgcagcagagcccagctgaagaagatcttctggggcgtggccgtggtgctgtgcgtgtgcagcagctgggccggcagcacccagctggccaagctgaccttcagaaagttcgacgcccccttcaccctgacctggttcgccaccaactggaacttcctgttcttccccctgtactacgtgggccacgtgtgcaagagcaccgagaagcagagcgtgaagcagagatacagagagtgctgcagattcttcggcgacaacggcctgaccctgaaggtgttcttcaccaaggccgcccccttcggcgtgctgtggaccctgaccaactacctgtacctgcacgccatcaagaagatcaacaccaccgacgtgagcgtgctgttctgctgcaacaaggccttcgtgttcctgctgagctggatcgtgctgagagacagattcatgggcgtgagaatcgtggccgccatcctggccatcgccggcatcgtgatgatgacctacgccgacggcttccacagccacagcgtgatcggcatcgccctggtggtggccagcgccagcatgagcgccctgtacaaggtgctgttcaagctgctgctgggcagcgccaagttcggcgaggccgccctgttcctgagcatcctgggcgtgttcaacatcctgttcatcacctgcatccccatcatcctgtacttcaccaaggtggagtactggagcagcttcgacgacatcccctggggcaacctgtgcggcttcagcgtgctgctgctgaccttcaacatcgtgctgaacttcggcatcgccgtgacctaccccaccctgatgagcctgggcatcgtgctgagcatccccgtgaacgccgtgatcgaccactacaccagccagatcgtgttcaacggcgtgagagtgatcgccatcatcatcatcggcctgggcttcctgctgctgctgctgcccgaggagtgggacgtgtggctgatcaagctgctgaccagactgaaggtgagaaagaaggaggagcccgccgagggcgccgccgacctgagcagcggcccccagagcaagaacagaagagccagacccagcttcgccagatag

SEQ ID NO: 22280 - DNA, 1473 bp, Artificial Sequence
  Description of Artificial Sequence: Synthetic coding sequence
atgggcatcagagagttccccagcggcgcccccagaggcaagagcatcgccgtgggcatgagaagaagccccgacgtgagccccagaagactgagcgacatcagcccccagctgagacagctgaagtacctggtggtggacgaggccatcaaggaggacctgaagtggagcagaagcgtggaggacctgaccagcggccccgtgggcctgaccagcatcgaggagagaatcctgagaatcaccggctactacggctaccagccctgggccgccagctgcaagagagaggagagacccagagacagccccggccccgccgaggcccaggcccccgccggcgtggaggccggcggcagagccagcagaagatgctggacctgcagcagagcccagctgaagaagatcttctggggcgtggccgtggtgctgtgcgtgtgcagcagctgggccggcagcacccagctggccaagctgaccttcagaaagttcgacgcccccttcaccctgacctggttcgccaccaactggaacttcctgttcttccccctgtactacgtgggccacgtgtgcaagagcaccgagaagcagagcgtgaagcagagatacagagagtgctgcagattcttcggcgacaacggcctgaccctgaaggtgttcttcaccaaggccgcccccttcggcgtgctgtggaccctgaccaactacctgtacctgcacgccatcaagaagatcaacaccaccgacgtgagcgtgctgttctgctgcaacaaggccttcgtgttcctgctgagctggatcgtgctgagagacagattcatgggcgtgagaatcgtggccgccatcctggccatcgccggcatcgtgatgatgacctacgccgacggcttccacagccacagcgtgatcggcatcgccctggtggtggccagcgccagcatgagcgccctgtacaaggtgctgttcaagctgctgctgggcagcgccaagttcggcgaggccgccctgttcctgagcatcctgggcgtgttcaacatcctgttcatcacctgcatccccatcatcctgtacttcaccaaggtggagtactggagcagcttcgacgacatcccctggggcaacctgtgcggcttcagcgtgctgctgctgaccttcaacatcgtgctgaacttcggcatcgccgtgacctaccccaccctgatgagcctgggcatcgtgctgagcatccccgtgaacgccgtgatcgaccactacaccagccagatcgtgttcaacggcgtgagagtgatcgccatcatcatcatcggcctgggcttcctgctgctgctgctgcccgaggagtgggacgtgtggctgatcaagctgctgaccagactgaaggtgagaaagaaggaggagcccgccgagggcgccgccgacctgagcagcggcccccagagcaagaacagaagagccagacccagcttcgccagatag

SEQ ID NO: 22281 - DNA, 1566 bp, Artificial Sequence
  Description of Artificial Sequence: Synthetic coding sequence
atggacgagctgctgctggacctgttccacaagctgaccagcggcagacagctggccgccggcaacggcctgtgcggcatcagccacaaggagcaggaggtgtggaagcccggccacaacatcctggtgaagatgagaaaggaggacaagagcctggtgtggctgatccacagcaccctggccagatacacccaggtgaccaacttcctgggcaccagcagaagcagcgtgaccagatgcaagcccggcgccaactgccccagcagccacagcggcatcagcagacagctgagccccctgagcgtgaccgaggacagcagcgcccccatcctggagctgcagaaccagggcagcagcggcgtgtgcggccacagagtggagagacagaacagaagcgccgacgacggcacccagacccacagcgagaacagcagccaggagaacagaatcaaggccagatgcctgagctgcaccagcatggtgctgaagggcatctggggcctgctgatcatcctgagcgtgagcagcagctgggtgggcaccacccagatcgtgaagatcacctacaagaacttctactgccccttcttcatgacctggttcagcaccaactggaacatcatgttcttccccgtgtactacagcggccacctggccaccgcccaggagaagcagagccccatgaagaagttcagagagtgcagcagaatcttcggcgaggacggcctgaccctgaagctgttcctgaagagaaccgcccccttcagcatcctgtggaccctgaccaactacctgtacctgctggccctgaagaagctgaccgccaccgacgtgagcgccctgttctgctgcaacaaggccttcgtgttcctgctgagctggatcgtgctgaaggacagattcatgggcgtgagaatcgtggccgccatcatggccatcaccggcatcgtgatgatggcctacgccgacaacttccacgccgacagcatcatcggcgtggccttcgccgtgggcagcgccagcaccagcgccctgtacaaggtgctgttcaagatgttcctgggcagcgccaacttcggcgaggccgcccacttcgtgagcaccctgggcttcttcaacctgatcttcatcagcttcacccccgtgatcctgtacttcaccaaggtggagcactggagcagcttcgccgccctgccctggggctgcctgtgcggcatggccggcctgtggctggccttcaacatcctggtgaacgtgggcgtggtgctgacctaccccatcctgatcagcatcggcaccgtgctgagcgtgcccggcaacgccgccgtggacctgctgaagcaggaggtgatcttcaacgtggtgagactggccgccaccatcatcatctgcatcggcttcctgctgatgctgctgcccgaggagtgggacgagatcaccctgagattcatcaacagcctgaaggagaagaagagcgaggagcacgtggacgacgtgaccgaccccagcatccacctgagaggcagaggcagagccaacggcaccgtgagcatccccctggcctag

SEQ ID NO: 22282 - DNA, 1572 bp, Artificial Sequence
  Description of Artificial Sequence: Synthetic coding sequence
atggtgccccccagaagacacagaggcgccggcagacccggcgtgctgagcagcagcccccccttcagactgagaagcgccaagttcagcggcatcgccctggaggacctgagaagagccctgaagaccagactgcagatggtgtgcgtgttcgtgatgaacagaatgaacagccagaacagcggcttcacccagagaagaagaatggccctgggcatcgtgatcctgctgctggtggacgtgatctgggtggccagcagcgagctgaccagctacgtgttcacccagtacaacaagcccttcttcagcaccttcgccaagaccagcatgttcgtgctgtacctgctgggcttcatcatctggaagccctggagacagcagtgcaccagaggcctgagaggcaagcacgccgccttcttcgccgacgccgagggctacttcgccgcctgcaccaccgacaccaccatgaacagcagcctgagcgagcccctgtacgtgcccgtgaagttccacgacctgcccagcgagaagcccgagagcaccaacatcgacaccgagaagacccccaagaagagcagagtgagattcagcaacatcatggagatcagacagctgcccagcagccacgccctggaggccaagctgagcagaatgagctaccccgtgaaggagcaggagagcatcctgaagaccgtgggcaagctgaccgccacccaggtggccaagatcagcttcttcttctgcttcgtgtggttcctggccaacctgagctaccaggaggccctgagcgacacccaggtggccatcgtgaacatcctgagcagcaccagcggcctgttcaccctgatcctggccgccgtgttccccagcaacagcggcgacagattcaccctgagcaagctgctggccgtgatcctgagcatcggcggcgtggtgctggtgaacctggccggcagcgagaagcccgccggcagagacaccgtgggcagcatctggagcctggccggcgccatgctgtacgccgtgtacatcgtgatgatcaagagaaaggtggacagagaggacaagctggacatccccatgttcttcggcttcgtgggcctgttcaacctgctgctgctgtggcccggcttcttcctgctgcactacaccggcttcgaggacttcgagttccccaacaaggtggtgctgatgtgcatcatcatcaacggcctgatcggcaccgtgctgagcgagttcctgtggctgtggggctgcttcctgaccagcagcctgatcggcaccctggccctgagcctgaccatccccctgagcatcatcgccgacatgtgcatgcagaaggtgcagttcagctggctgttcttcgccggcgccatccccgtgttcttcagcttcttcatcgtgaccctgctgtgccactacaacaactgggaccccgtgatggtgggcatcagaagaatcttcgccttcatctgcagaaagcacagaatccagagagtgcccgaggacagcgagcagtgcgagagcctgatcagcatgcacagcgtgagccaggaggacggcgccagctag

SEQ ID NO: 22283 - DNA, 1554 bp, Artificial Sequence
  Description of Artificial Sequence: Synthetic coding sequence
atggacagcagcggctggagaggcgtgctgagcagcagcccccccttcagactgagaagcgccaagttcagcggcatcgccctggaggacctgagaagagccctgaagaccagactgcagatggtgtgcgtgttcgtgatgaacagaatgaacagccagaacagcggcttcacccagagaagaagaatggccctgggcatcgtgatcctgctgctggtggacgtgatctgggtggccagcagcgagctgaccagctacgtgttcacccagtacaacaagcccttcttcagcaccttcgccaagaccagcatgttcgtgctgtacctgctgggcttcatcatctggaagccctggagacagcagtgcaccagaggcctgagaggcaagcacgccgccttcttcgccgacgccgagggctacttcgccgcctgcaccaccgacaccaccatgaacagcagcctgagcgagcccctgtacgtgcccgtgaagttccacgacctgcccagcgagaagcccgagagcaccaacatcgacaccgagaagacccccaagaagagcagagtgagattcagcaacatcatggagatcagacagctgcccagcagccacgccctggaggccaagctgagcagaatgagctaccccgtgaaggagcaggagagcatcctgaagaccgtgggcaagctgaccgccacccaggtggccaagatcagcttcttcttctgcttcgtgtggttcctggccaacctgagctaccaggaggccctgagcgacacccaggtggccatcgtgaacatcctgagcagcaccagcggcctgttcaccctgatcctggccgccgtgttccccagcaacagcggcgacagattcaccctgagcaagctgctggccgtgatcctgagcatcggcggcgtggtgctggtgaacctggccggcagcgagaagcccgccggcagagacaccgtgggcagcatctggagcctggccggcgccatgctgtacgccgtgtacatcgtgatgatcaagagaaaggtggacagagaggacaagctggacatccccatgttcttcggcttcgtgggcctgttcaacctgctgctgctgtggcccggcttcttcctgctgcactacaccggcttcgaggacttcgagttccccaacaaggtggtgctgatgtgcatcatcatcaacggcctgatcggcaccgtgctgagcgagttcctgtggctgtggggctgcttcctgaccagcagcctgatcggcaccctggccctgagcctgaccatccccctgagcatcatcgccgacatgtgcatgcagaaggtgcagttcagctggctgttcttcgccggcgccatccccgtgttcttcagcttcttcatcgtgaccctgctgtgccactacaacaactgggaccccgtgatggtgggcatcagaagaatcttcgccttcatctgcagaaagcacagaatccagagagtgcccgaggacagcgagcagtgcgagagcctgatcagcatgcacagcgtgagccaggaggacggcgccagctag

SEQ ID NO: 22284 - DNA, 1095 bp, Artificial Sequence
  Description of Artificial Sequence: Synthetic coding sequence
atgagaccccaggacagcaccggcgtggccgagctgcaggagcccggcctgcccctgaccgacgacgccccccccggcgccaccgaggagcccgccgccgccgaggccgccggcgcccccgacagaggcagatgctggctgtgcctgagcagcccctgctgcagcagaaccgagcccgccaagaagaaggccccctgccccggcctgggcctgttctacaccctgctgagcgccttcctgttcagcgtgggcagcctgttcgtgaagaaggtgcaggacgtgcacgccgtggagatcagcgccttcagatgcgtgttccagatgctggtggtgatcccctgcctgatctacagaaagaccggcttcatcggccccaagggccagagaatcttcctgatcctgagaggcgtgctgggcagcaccgccatgatgctgatctactacgcctaccagaccatgagcctggccgacgccaccgtgatcaccttcagcagccccgtgttcaccagcatcttcgcctggatctgcctgaaggagaagtacagcccctgggacgccctgttcaccgtgttcaccatcaccggcgtgatcctgatcgtgagaccccccttcctgttcggcagcgacaccagcggcatggaggagagctacagcggccacctgaagggcaccttcgccgccatcggcagcgccgtgttcgccgccagcaccctggtgatcctgagaaagatgggcaagagcgtggactacttcctgagcatctggtactacgtggtgctgggcctggtggagagcgtgatcatcctgagcgtgctgggcgagtggagcctgccctactgcggcctggacagactgttcctgatcttcatcggcctgttcggcctgggcggccagatcttcatcaccaaggccctgcagatcgagaaggccggccccgtggccatcatgaagaccatggacgtggtgttcgccttcatcttccagatcatcttcttcaacaacgtgcccacctggtggaccgtgggcggcgccctgtgcgtggtggccagcaacgtgggcgccgccatcagaaagtggtaccagagcagcaagtag

SEQ ID NO: 22285 - DNA, 1098 bp, Artificial Sequence
  Description of Artificial Sequence: Synthetic coding sequence
atgagaccccaggacagcaccggcgtggccgagctgcaggagcccggcctgcccctgaccgacgacgccccccccggcgccaccgaggagcccgccgccgccgaggccgccggcgcccccgacagaggcagatgctggctgtgcctgagcagcccctgctgcagcagaaccgagcccgaggccaagaagaaggccccctgccccggcctgggcctgttctacaccctgctgagcgccttcctgttcagcgtgggcagcctgttcgtgaagaaggtgcaggacgtgcacgccgtggagatcagcgccttcagatgcgtgttccagatgctggtggtgatcccctgcctgatctacagaaagaccggcttcatcggccccaagggccagagaatcttcctgatcctgagaggcgtgctgggcagcaccgccatgatgctgatctactacgcctaccagaccatgagcctggccgacgccaccgtgatcaccttcagcagccccgtgttcaccagcatcttcgcctggatctgcctgaaggagaagtacagcccctgggacgccctgttcaccgtgttcaccatcaccggcgtgatcctgatcgtgagaccccccttcctgttcggcagcgacaccagcggcatggaggagagctacagcggccacctgaagggcaccttcgccgccatcggcagcgccgtgttcgccgccagcaccctggtgatcctgagaaagatgggcaagagcgtggactacttcctgagcatctggtactacgtggtgctgggcctggtggagagcgtgatcatcctgagcgtgctgggcgagtggagcctgccctactgcggcctggacagactgttcctgatcttcatcggcctgttcggcctgggcggccagatcttcatcaccaaggccctgcagatcgagaaggccggccccgtggccatcatgaagaccatggacgtggtgttcgccttcatcttccagatcatcttcttcaacaacgtgcccacctggtggaccgtgggcggcgccctgtgcgtggtggccagcaacgtgggcgccgccatcagaaagtggtaccagagcagcaagtag

SEQ ID NO: 22286 - DNA, 1017 bp, Artificial Sequence
  Description of Artificial Sequence: Synthetic coding sequence
atggccggcagccacccctacttcaaccagcccgacagcacccaccccagcccccccagcgccccccccagcctgagatggtaccagagatgccagcccagcgacgccaccagcggcctgctggtggccctgctgggcggcggcctgcccgccggcttcgtgggccccctgagcagaatggcctaccaggccagcaacctgcccagcctggagctgctgatctggagatgcctgttccacctgcccatcgccctgctgctgaagctgagaggcgaccccctgctgggcacccccgacatcagaagcagagccttcttctgcgccctgctgaacatcctgagcatcggctgcgcctacagcgccgtgcaggtggtgcccgccggcaacgccgccaccgtgagaaagggcagcagcaccgtgtgcagcgccgtgctgaccctgtgcctggagagccagggcctgagcggctacgactggtgcggcctgctgggctgcatcctgggcctgatcatcatcgtgggccccggcctgtggaccctgcaggagggcaccaccggcgtgtacaccgccctgggctacgtggaggccttcctgggcggcctggccctgagcctgagactgctggtgtacagaagcctgcacttccccccctgcctgcccaccgtggccttcctgagcggcctggtgggcctgctgggcagcgtgcccggcctgttcgtgctgcaggcccccgtgctgcccagcgacctgctgagctggagctgcgtgggcgccgtgggcatcctggccctggtgagcttcacctgcgtgggctacgccgtgaccaaggcccaccccgccctggtgtgcgccgtgctgcacagcgaggtggtggtggccctgatcctgcagtactacatgctgcacgagaccgtggcccccagcgacatcgtggccgccggcgtggtgctgggcagcatcgccatcatcaccgcccagaacctgagctgcgagagaaccggcagagtggaggagtag

SEQ ID NO: 22287 - DNA, 1017 bp, Artificial Sequence
  Description of Artificial Sequence: Synthetic coding sequence
atggccggcagccacccctacttcaacctgcccgacagcacccaccccagcccccccagcgccccccccagcctgagatggcaccagagatgccagcccagcggcgccaccaacggcctgctggtggccctgctgggcggcggcctgcccgccggcttcgtgggccccctgagcagaatggcctaccagggcagcaacctgcccagcctggagctgctgatctgcagatgcctgttccacctgcccatcgccctgctgctgaagctgagaggcgaccccctgctgggcccccccgacatcagaggctgggcctgcttctgcgccctgctgaacgtgctgagcatcggctgcgcctacagcgccgtgcaggtggtgcccgccggcaacgccgccaccgtgagaaagggcagcagcaccgtgtgcagcgccgtgctgaccctgtgcctggagagccagggcctgggcggctacgagtggtgcggcctgctgggcagcatcctgggcctgatcatcatcctgggccccggcctgtggaccctgcaggagggcaccaccggcgtgtacaccaccctgggctacgtgcaggccttcctgggcggcctggccctgagcctgggcctgctggtgtacagaagcctgcacttccccagctgcctgcccaccgtggccttcctgagcggcctggtgggcctgctgggctgcgtgcccggcctgttcgtgctgcagacccccgtgctgcccagcgacctgctgagctggagctgcgtgggcgccgagggcatcctggccctggtgagcttcacctgcgtgggctacgccgtgaccaaggcccaccccgccctggtgtgcgccgtgctgcacagcgaggtggtggtggccctgatcctgcagtactacatgctgcacgagaccgtggccctgagcgacatcatgggcgccggcgtggtgctgggcagcatcgccatcatcaccgccagaaacctgagctgcgagagaaccggcaaggtggaggagtag

SEQ ID NO: 22288 - DNA, 1158 bp, Artificial Sequence
  Description of Artificial Sequence: Synthetic coding sequence
atgagaagcagcctggcccccggcgtgtggttcttcagagccttcagcagagacagctggttcagaggcctgatcctgctgctgaccttcctgatctacgcctgctaccacatgagcagaaagcccatcagcatcgtgaagagcagactgcaccagaactgcagcgagcagatcaagcccatcaacgacacccacagcctgaacgacaccatgtggtgcagctgggcccccttcgacaaggacaactacaaggagctgctgggcggcgtggacaacgccttcctgatcgcctacgccatcggcatgttcatcagcggcgtgttcggcgagagactgcccctgagatactacctgagcgccggcatgctgctgagcggcctgttcaccagcctgttcggcctgggctacttctggaacatccacgagctgtggtacttcgtggtgatccaggtgtgcaacggcctggtgcagaccaccggctggcccagcgtggtgacctgcgtgggcaactggttcggcaagggcaagagaggcttcatcatgggcatctggaacagccacaccagcgtgggcaacatcctgggcagcctgatcgccggcatctgggtgaacggccagtggggcctgagcttcatcgtgcccggcatcatcaccgccgtgatgggcgtgatcaccttcctgttcctgatcgagcaccccgaggacgtggactgcgcccccccccagcaccacggcgagcccgccgagaaccaggacaaccccgaggaccccggcaacagcccctgcagcatcagagagagcggcctggagaccgtggccaagtgcagcaagggcccctgcgaggagcccgccgccatcagcttcttcggcgccctgagaatccccggcgtggtggagttcagcctgtgcctgctgttcgccaagctggtgagctacaccttcctgtactggctgcccctgtacatcgccaacgtggcccacttcagcgccaaggaggccggcgacctgagcaccctgttcgacgtgggcggcatcatcgacgtgcccgtgcagctgcactggcccggcagagactgccagctgcacagcgacgccgaccacctgtggggccccggccagtggcccatcagagcccaccaccactgctgcctgtgctag

SEQ ID NO: 22289 - DNA, 1518 bp, Artificial Sequence
  Description of Artificial Sequence: Synthetic coding sequence
atgagaagcagcctggcccccggcgtgtggttcttcagagccttcagcagagacagctggttcagaggcctgatcctgctgctgaccttcctgatctacgcctgctaccacatgagcagaaagcccatcagcatcgtgaagagcagactgcaccagaactgcagcgagcagatcaagcccatcaacgacacccacagcctgaacgacaccatgtggtgcagctgggcccccttcgacaaggacaactacaaggagctgctgggcggcgtggacaacgccttcctgatcgcctacgccatcggcatgttcatcagcggcgtgttcggcgagagactgcccctgagatactacctgagcgccggcatgctgctgagcggcctgttcaccagcctgttcggcctgggctacttctggaacatccacgagctgtggtacttcgtggtgatccaggtgtgcaacggcctggtgcagaccaccggctggcccagcgtggtgacctgcgtgggcaactggttcggcaagggcaagagaggcttcatcatgggcatctggaacagccacaccagcgtgggcaacatcctgggcagcctgatcgccggcatctgggtgaacggccagtggggcctgagcttcatcgtgcccggcatcatcaccgccgtgatgggcgtgatcaccttcctgttcctgatcgagcaccccgaggacgtggactgcgcccccccccagcaccacggcgagcccgccgagaaccaggacaaccccgaggaccccggcaacagcccctgcagcatcagagagagcggcctggagaccgtggccaagtgcagcaagggcccctgcgaggagcccgccgccatcagcttcttcggcgccctgagaatccccggcgtggtggagttcagcctgtgcctgctgttcgccaagctggtgagctacaccttcctgtactggctgcccctgtacatcgccaacgtggcccacttcagcgccaaggaggccggcgacctgagcaccctgttcgacgtgggcggcatcatcggcggcatcgtggccggcctggtgagcgactacaccaacggcagagccaccacctgctgcgtgatgctgatcctggccgcccccatgatgttcctgtacaactacatcggccaggacggcatcgccagcagcatcgtgatgctgatcatctgcggcggcctggtgaacggcccctacgccctgatcaccaccgccgtgagcgccgacctgggcacccacaagagcctgaagggcaacgccaaggccctgagcaccgtgaccgccatcatcgacggcaccggcagcatcggcgccgccctgggccccctgctggccggcctgatcagccccaccggctggaacaacgtgttctacatgctgatcagcgccgacgtgctggcctgcctgctgctgtgcagactggtgtacaaggagatcctggcctggaaggtgagcctgagcagaggcagcggcagcagcatggtgctgacccaccagtag

SEQ ID NO: 22290 - DNA, 1506 bp, Artificial Sequence
  Description of Artificial Sequence: Synthetic coding sequence
atgagaagcagcctggcccccggcgtgtggttcttcagagccttcagcagagacagctggttcagaggcctgatcctgctgctgaccttcctgatctacgcctgctaccacatgagcagaaagcccatcagcatcgtgaagagcagactgcaccagaactgcagcgagcagatcaagcccatcaacgacacccacagcctgaacgacaccatgtggtgcagctgggcccccttcgacaaggacaactacaaggagctgctgggcggcgtggacaacgccttcctgatcgcctacgccatcggcatgttcatcagcggcgtgttcggcgagagactgcccctgagatactacctgagcgccggcatgctgctgagcggcctgttcaccagcctgttcggcctgggctacttctggaacatccacgagctgtggtacttcgtggtgatccaggtgtgcaacggcctggtgcagaccaccggctggcccagcgtggtgacctgcgtgggcaactggttcggcaagggcaagagaggcttcatcatgggcatctggaacagccacaccagcgtgggcaacatcctgggcagcctgatcgccggcatctgggtgaacggccagtggggcctgagcttcatcgtgcccggcatcatcaccgccgtgatgggcgtgatcaccttcctgttcctgatcgagcaccccgaggacgtggactgcgcccccccccagcaccacggcgagcccgccgagaaccaggacaaccccgaggaccccggcaacagcccctgcagcatcagagagagcggcctggagaccgtggccaagtgcagcaagggcccctgcgaggagcccgccgccatcagcttcttcggcgccctgagaatccccggcgtggtggagttcagcctgtgcctgctgttcgccaagctggtgagctacaccttcctgtactggctgcccctgtacatcgccaacgtggcccacttcagcgccaaggaggccggcgacctgagcaccctgttcgacgtgggcggcatcatcggcggcatcgtggccggcctggtgagcgactacaccaacggcagagccaccacctgctgcgtgatgctgatcctggccgcccccatgatgttcctgtacaactacatcggccaggacggcatcgccagcagcatcgtgatgctgatcatctgcggcggcctggtgaacggcccctacgccctgatcaccaccgccgtgagcgccgacctgggcacccacaagagcctgaagggcaacgccaaggccctgagcaccgtgaccgccatcatcgacggcaccggcagcatcggcgccgccctgggccccctgctggccggcctgatcagccccaccggctggaacaacgtgttctacatgctgatcagcgccgacgtgctggcctgcctgctgctgtgcagactggtgtacaaggagatcctggcctggaaggtgagcctgagcagaggcagcggctacaaggagatctag

SEQ ID NO: 22291 - DNA, 1518 bp, Artificial Sequence; identical to SEQ ID NO: 22289
  Description of Artificial Sequence: Synthetic coding sequence

SEQ ID NO: 22292 - DNA, 1485 bp, Artificial Sequence
  Description of Artificial Sequence: Synthetic coding sequence
atggcctggcccaacgtgttccagagaggcagcctgctgagccagttcagccaccaccacgtggtggtgttcctgctgaccttcttcagctacagcctgctgcacgccagcagaaagaccttcagcaacgtgaaggtgagcatcagcgagcagtggacccccagcgccttcaacaccagcgtggagctgcccgtggagatctggagcagcaaccacctgttccccagcgccgagaaggccaccctgttcctgggcaccctggacaccatcttcctgttcagctacgccgtgggcctgttcatcagcggcatcgtgggcgacagactgaacctgagatgggtgctgagcttcggcatgtgcagcagcgccctggtggtgttcgtgttcggcgccctgaccgagtggctgagattctacaacaagtggctgtactgctgcctgtggatcgtgaacggcctgctgcagagcaccggctggccctgcgtggtggccgtgatgggcaactggttcggcaaggccggcagaggcgtggtgttcggcctgtggagcgcctgcgccagcgtgggcaacatcctgggcgcctgcctggccagcagcgtgctgcagtacggctacgagtacgccttcctggtgaccgccagcgtgcagttcgccggcggcatcgtgatcttcttcggcctgctggtgagccccgaggagatcggcctgagcggcatcgaggccgaggagaacttcgaggaggacagccacagacccctgatcaacggcggcgagaacgaggacgagtacgagcccaactacagcatccaggacgacagcagcgtggcccaggtgaaggccatcagcttctaccaggcctgctgcctgcccggcgtgatcccctacagcctggcctacgcctgcctgaagctggtgaactacagcttcttcttctggctgcccttctacctgagcaacaacttcggctggaaggaggccgaggccgacaagctgagcatctggtacgacgtgggcggcatcatcggcggcaccctgcagggcttcatcagcgacgtgctgcagaagagagcccccgtgctggccctgagcctgctgctggccgtgggcagcctgatcggctacagcagaagccccaacgacaagagcatcaacgccctgctgatgaccgtgaccggcttcttcatcggcggccccagcaacatgatcagcagcgccatcagcgccgacctgggcagacaggagctgatccagagaagcagcgaggccctggccaccgtgaccggcatcgtggacggcagcggcagcatcggcgccgccgtgggccagtacctggtgagcctgatcagagacaagctgggctggatgtgggtgttctacttcttcatcctgatgaccagctgcaccatcgtgttcatcagccccctgatcgtgagagagatcttcagcctggtgctgagaagacaggcccacatcctgagagagtag

SEQ ID NO: 22293 - DNA, 1332 bp, Artificial Sequence
  Description of Artificial Sequence: Synthetic coding sequence
atggcctggcccaacgtgttccagagaggcagcctgctgagccagttcagccaccaccacgtggtggtgttcctgctgaccttcttcagctacagcctgctgcacgccagcagaaagaccttcagcaacgtgaaggtgagcatcagcgagcagtggacccccagcgccttcaacaccagcgtggagctgcccgtggagatctggagcagcaaccacctgttccccagcgccgagaaggccaccctgttcctgggcaccctggacaccatcttcctgttcagctacgccgtgggcctgttcatcagcggcatcgtgggcgacagactgaacctgagatgggtgctgagcttcggcatgtgcagcagcgccctggtggtgttcgtgttcggcgccctgaccgagtggctgagattctacaacaagtggctgtactgctgcctgtggatcgtgaacggcctgctgcagagcaccggctggccctgcgtggtggccgtgatgggcaactggttcggcaaggccggcagaggcgtggtgttcggcctgtggagcgcctgcgccagcgtgggcaacatcctgggcgcctgcctggccagcagcgtgctgcagtacggctacgagtacgccttcctggtgaccgccagcgtgcagttcgccggcggcatcgtgatcttcttcggcctgctggtgagccccgaggagatcggcctgagcggcatcgaggccgaggagaacttcgaggaggacagccacagacccctgatcaacggcggcgagaacgaggacgagtacgagcccaactacagcatccaggacgacagcagcgtggcccaggtgaaggccatcagcttctaccaggcctgctgcctgcccggcgtgatcccctacagcctggcctacgcctgcctgaagctggtgaactacagcttcttcttctggctgcccttctacctgagcaacaacttcggctggaaggaggccgaggccgacaagctgagcatctggtacgacgtgggcggcatcatcgtgttcagcgtgagcgaccccggccaggccagaatggacgtgggcttcctgctgttccacagccacgacaagctgtacaactgcgtgtacctggccatcaacagcgagggcaacatcctgagcagagccaaggagaccggcagccacatcgagggcgtgaccggcgccagagagaccgagagaaccatgagcgccaccagcggccccctgggcctgagagtgtgccccaacctgggcctgagcagaagcagcagcctgatcctggactgccaggccagcctgaacaccgccagccacctgagatgctag

SEQ ID NO: 22294 - DNA, 471 bp, Artificial Sequence
  Description of Artificial Sequence: Synthetic coding sequence
atggcctggcccaacgtgttccagagaggcagcctgctgagccagttcagccaccaccacgtggtggtgttcctgctgaccttcttcagctacagcctgctgcacgccagcagaaagaccttcagcaacgtgaaggtgagcatcagcgagcagtggacccccagcgccttcaacaccagcgtggagctgcccgtggagatctggagcagcaaccacctgttccccagcgccgagaaggccaccctgttcctgggcaccctggacaccatcttcctgttcagctacgccgtgggcctgttcatcagcggcatcgtgggcgacagactgaacctgagatgggtgctgagcttcggcatgtgcagcagcgccctggtgaccagaagctgcttctggagcctggagtgcctgtgcttcggcggccagcacttcggcagcgtgcccagcttcttctgcagcagcgtgtggctgtag

SEQ ID NO: 22295 - DNA, 1437 bp, Artificial Sequence
  Description of Artificial Sequence: Synthetic coding sequence
atggcctggcccaacgtgttccagagaggcagcctgctgagccagttcagccaccaccacgtggtggtgttcctgctgaccttcttcagctacagcctgctgcacgccagcagaaagaccttcagcaacgtgaaggtgagcatcagcgagcagtggacccccagcgccttcaacaccagcgtggagctgcccgtggagatctggagcagcaaccacctgttccccagcgccgagaaggccaccctgttcctgggcaccctggacaccatcttcctgttcagctacgccgtgggcctgttcatcagcggcatcgtgggcgacagactgaacctgagatgggtgctgagcttcggcatgtgcagcagcgccctggtggtgttcgtgttcggcgccctgaccgagtggctgagattctacaacaagtggctgtactgctgcctgtggatcgtgaacggcctgctgcagagcaccggctggccctgcgtggtggccgtgatgggcaactggttcggcaaggccggcagaggcgtggtgttcggcctgtggagcgcctgcgccagcgtgggcaacatcctgggcgcctgcctggccagcagcgtgctgcagtacggctacgagtacgccttcctggtgaccgccagcgtgcagttcgccggcggcatcgtgatcttcttcggcctgctggtgagccccgaggagatcggcctgagcggcatcgaggccgaggagaacttcgaggaggacagccacagacccctgatcaacggcggcgagaacgaggacgagtacgagcccaactacagcatccaggacgacagcagcgtggcccaggtgaaggccatcagcttctaccaggcctgctgcctgcccggcgtgatcccctacagcctggcctacgcctgcctgaagctggtgaactacagcttcttcttctggctgcccttctacctgagcaacaacttcggctggaaggaggccgaggccgacaagctgagcatctggtacgacgtgggcggcatcatcggcggcaccctgcagggcttcatcagcgacgtgctgcagaagagagcccccgtgctggccctgagcctgctgctggccgtgggcagcctgatcggctacagcagattcttcatcggcggccccagcaacatgatcagcagcgccatcagcgccgacctgggcagacaggagctgatccagagaagcagcgaggccctggccaccgtgaccggcatcgtggacggcagcggcagcatcggcgccgccgtgggccagtacctggtgagcctgatcagagacaagctgggctggatgtgggtgttctacttcttcatcctgatgaccagctgcaccatcgtgttcatcagccccctgatcgtgagagagatcttcagcctggtgctgagaagacaggcccacatcctgagagagtag

SEQ ID NO: 22296 - DNA, 45 bp, Artificial Sequence
  Description of Artificial Sequence: Synthetic coding sequence
atggcctggcccaacgtgttccagagaggcagcctgctgagctag

SEQ ID NO: 22297 - DNA, 714 bp, Artificial Sequence
  Description of Artificial Sequence: Synthetic coding sequence
atggcctggcccaacgtgttccagagaggcagcctgctgagccagttcagccaccaccacgtggtggtgttcctgctgaccttcttcagctacagcctgctgcacgccagcagaaagaccttcagcaacgtgaaggtgagcatcagcgagcagtggacccccagcgccttcaacaccagcgtggagctgcccgtggagatctggagcagcaaccacctgttccccagcgccgagaaggccaccctgttcctgggcaccctggacaccatcttcctgttcagctacgccgtgggcctgttcatcagcggcatcgtgggcgacagactgaacctgagatgggtgctgagcttcggcatgtgcagcagcgccctggtggtgttcgtgttcggcgccctgaccgagtggctgagattctacaacaagtggctgtactgctgcctgtggatcgtgaacggcctgctgcagagcaccggctggccctgcgtggtggccgtgatgggcaactggttcggcaaggccggcagaggcgtggtgttcggcctgtggagcgcctgcgccagcgtgggcaacatcctgggcgcctgcctggccagcagcgtgctgcagtacggctacgagtacgccttcctggtgaccgccagcgtgcagttcgccggcggcatcgtgatcttcttcggcctgctggtgagccccgaggagatcggcaagctgtag

SEQ ID NO: 22298 - DNA, 2343 bp, Artificial Sequence
  Description of Artificial Sequence: Synthetic coding sequence
atgaccgccgccgccgccagcaactggggcctgatcaccaacatcgtgaacagcatcgtgggcgtgagcgtgctgaccatgcccttctgcttcaagcagtgcggcatcgtgctgggcgccctgctgctggtgttctgcagctggatgacccaccagagctgcatgttcctggtgaagagcgccagcctgagcaagagaagaacctacgccggcctggccttccacgcctacggcaaggccggcaagatgctggtggagaccagcatgatcggcctgatgctgggcacctgcatcgccttctacgtggtgatcggcgacctgggcagcaacttcttcgccagactgttcggcttccaggtgggcggcaccttcagaatgttcctgctgttcgccgtgagcctgtgcatcgtgctgcccctgagcctgcagagaaacatgatggccagcatccagagcttcagcgccatggccctgctgttctacaccgtgttcatgttcgtgatcgtgctgagcagcctgaagcacggcctgttcagcggccagtggctgagaagagtgagctacgtgagatgggagggcgtgttcagatgcatccccatcttcggcatgagcttcgcctgccagagccaggtgctgcccacctacgacagcctggacgagcccagcgtgaagaccatgagcagcatcttcgccagcagcctgaacgtggtgaccaccttctacgtgatggtgggcttcttcggctacgtgagcttcaccgaggccaccgccggcaacgtgctgatgcacttccccagcaacctggtgaccgagatgctgagagtgggcttcatgatgagcgtggccgtgggcttccccatgatgatcctgccctgcagacaggccctgagcaccctgctgtgcgagcagcagcagaaggacggcaccttcgccgccggcggctacatgccccccctgagattcaaggccctgaccctgagcgtggtgttcggcaccatggtgggcggcatcctgatccccaacgtggagaccatcctgggcctgaccggcgccaccatgggcagcctgatctgcttcatctgccccgccctgatctacaagaagatccacaagaacgccctgagcagccaggtggtgctgtgggtgggcctgggcgtgctggtggtgagcaccgtgaccaccctgagcgtgagcgaggaggtgcccgaggacctggccgaggaggcccccggcggcagactgggcgaggccgagggcctgatgaaggtggaggccgccagactgagcgcccaggaccccgtggtggccgtggccgaggacggcagagagaagcccaagctgcccaaggagagagaggagctggagcaggcccagatcaagggccccgtggacgtgcccggcagagaggacggcaaggaggcccccgaggaggcccagctggacagacccggccagggcatcgccgtgcccgtgggcgaggcccacagacacgagccccccgtgccccacgacaaggtggtggtggacgagggccaggacagagaggtgcccgaggagaacaagccccccagcagacacgccggcggcaaggcccccggcgtgcagggccagatggccccccccctgcccgacagcgagagagagaagcaggagcccgagcagggcgaggtgggcaagagacccggccaggcccaggccctggaggaggccggcgacctgcccgaggacccccagaaggtgcccgaggccgacggccagcccgccgtgcagcccgccaaggaggacctgggccccggcgacagaggcctgcaccccagaccccaggccgtgctgagcgagcagcagaacggcctggccgtgggcggcggcgagaaggccaagggcggccccccccccggcaacgccgccggcgacaccggccagcccgccgaggacagcgaccacggcggcaagccccccctgcccgccgagaagcccgcccccggccccggcctgccccccgagcccagagagcagagagacgtggagagagccggcggcaaccaggccgccagccagctggagggcaaggccagcgccctgcagccccccgccagcggccccggcagcggcagccccctgccccagccctggggcgacgcccaggtgatcctgggcagccccgccagaccccccttcagcttccagccccccgccgagcagacccccagaagagccttctgcagcctgcccatcagcagcctgctgagcggcaacctgctgagcgccctgctgcccttcaagcacctgagacacagacacatggcctgcgactacagattcatcagcctggcccccctgtag

SEQ ID NO: 22299 - DNA, 3360 bp, Artificial Sequence
  Description of Artificial Sequence: Synthetic coding sequence
atgaccgccgccgccgccagcaactggggcctgatcaccaacatcgtgaacagcatcgtgggcgtgagcgtgctgaccatgcccttctgcttcaagcagtgcggcatcgtgctgggcgccctgctgctggtgttctgcagctggatgacccaccagagctgcatgttcctggtgaagagcgccagcctgagcaagagaagaacctacgccggcctggccttccacgcctacggcaaggccggcaagatgctggtggagaccagcatgatcggcctgatgctgggcacctgcatcgccttctacgtggtgatcggcgacctgggcagcaacttcttcgccagactgttcggcttccaggtgggcggcaccttcagaatgttcctgctgttcgccgtgagcctgtgcatcgtgctgcccctgagcctgcagagaaacatgatggccagcatccagagcttcagcgccatggccctgctgttctacaccgtgttcatgttcgtgatcgtgctgagcagcctgaagcacggcctgttcagcggccagtggctgagaagagtgagctacgtgagatgggagggcgtgttcagatgcatccccatcttcggcatgagcttcgcctgccagagccaggtgctgcccacctacgacagcctggacgagcccagcgtgaagaccatgagcagcatcttcgccagcagcctgaacgtggtgaccaccttctacgtgatggtgggcttcttcggctacgtgagcttcaccgaggccaccgccggcaacgtgctgatgcacttccccagcaacctggtgaccgagatgctgagagtgggcttcatgatgagcgtggccgtgggcttccccatgatgatcctgccctgcagacaggccctgagcaccctgctgtgcgagcagcagcagaaggacggcaccttcgccgccggcggctacatgccccccctgagattcaaggccctgaccctgagcgtggtgttcggcaccatggtgggcggcatcctgatccccaacgtggagaccatcctgggcctgaccggcgccaccatgggcagcctgatctgcttcatctgccccgccctgatctacaagaagatccacaagaacgccctgagcagccaggtggtgctgtgggtgggcctgggcgtgctggtggtgagcaccgtgaccaccctgagcgtgagcgaggaggtgcccgaggacctggccgaggaggcccccggcggcagactgggcgaggccgagggcctgatgaaggtggaggccgccagactgagcgcccaggaccccgtggtggccgtggccgaggacggcagagagaagcccaagctgcccaaggagagagaggagctggagcaggcccagatcaagggccccgtggacgtgcccggcagagaggacggcaaggaggcccccgaggaggcccagctggacagacccggccagggcatcgccgtgcccgtgggcgaggcccacagacacgagccccccgtgccccacgacaaggtggtggtggacgagggccaggacagagaggtgcccgaggagaacaagccccccagcagacacgccggcggcaaggcccccggcgtgcagggccagatggccccccccctgcccgacagcgagagagagaagcaggagcccgagcagggcgaggtgggcaagagacccggccaggcccaggccctggaggaggccggcgacctgcccgaggacccccagaaggtgcccgaggccgacggccagcccgccgtgcagcccgccaaggaggacctgggccccggcgacagaggcctgcaccccagaccccaggccgtgctgagcgagcagcagaacggcctggccgtgggcggcggcgagaaggccaagggcggccccccccccggcaacgccgccggcgacaccggccagcccgccgaggacagcgaccacggcggcaagccccccctgcccgccgagaagcccgcccccggccccggcctgccccccgagcccagagagcagagagacgtggagagagccggcggcaaccaggccgccagccagctggaggaggccggcagagccgagatgctggaccacgccgtgctgctgcaggtgatcaaggagcagcaggtgcagcagaagagactgctggaccagcaggagaagctgctggccgtgatcgaggagcagcacaaggagatccaccagcagagacaggaggacgaggaggacaagcccagacaggtggaggtgcaccaggagcccggcgccgccgtgcccagaggccaggaggcccccgagggcaaggccagagagaccgtggagaacctgccccccctgcccctggaccccgtgctgagagcccccggcggcagacccgcccccagccaggacctgaaccagagaagcctggagcacagcgagggccccgtgggcagagaccccgccggcccccccgacggcggccccgacaccgagcccagagccgcccaggccaagctgagagacggccagaaggacgccgcccccagagccgccggcaccgtgaaggagctgcccaagggccccgagcaggtgcccgtgcccgaccccgccagagaggccggcggccccgaggagagactggccgaggagttccccggccagagccaggacgtgaccggcggcagccaggacagaaagaagcccggcaaggaggtggccgccaccggcaccagcatcctgaaggaggccaactggctggtggccggccccggcgccgagaccggcgaccccagaatgaagcccaagcaggtgagcagagacctgggcctggccgccgacctgcccggcggcgccgagggcgccgccgcccagccccaggccgtgctgagacagcccgagctgagagtgatcagcgacggcgagcagggcggccagcagggccacagactggaccacggcggccacctggagatgagaaaggccagaggcggcgaccacgtgcccgtgagccacgagcagcccagaggcggcgaggacgccgccgtgcaggagcccagacagagacccgagcccgagctgggcctgaagagagccgtgcccggcggccagagacccgacaacgccaagcccaacagagacctgaagctgcaggccggcagcgacctgagaagaagaagaagagacctgggcccccacgccgagggccagctggcccccagagacggcgtgatcatcggcctgaaccccctgcccgacgtgcaggtgaacgacctgagaggcgccctggacgcccagctgagacaggccgccggcggcgccctgcaggtggtgcacagcagacagctgagacaggcccccggcccccccgaggagagctag

SEQ ID NO: 22300 - DNA, 1155 bp, Artificial Sequence
  Description of Artificial Sequence: Synthetic coding sequence
atgaagcaggccggcttccccctgggcatcctgctgctgttctgggtgagctacgtgaccgacttcagcctggtgctgctgatcaagggcggcgccctgagcggcaccgacacctaccagagcctggtgaacaagaccttcggcttccccggctacctgctgctgagcgtgctgcagttcctgtaccccttcatcgtggaccccgagaacgtgttcatcggcagacacttcatcatcggcctgagcaccgtgaccttcaccctgcccctgagcctgtacagaaacatcgccaagctgggcaaggtgagcctgatcagcaccggcctgaccaccctgatcctgggcatcgtgatggccagagccatcagcctgggcccccacatccccaagaccgaggacgcctgggtgttcgccaagcccaacgccatccaggccgtgggcgtgatgagcttcgccttcatctgccaccacaacagcttcctggtgtacagcagcctggaggagcccaccgtggccaagtggagcagactgatccacatgagcatcgtgatcagcgtgttcatctgcatcttcttcgccacctgcggctacctgaccttcaccggcttcacccagggcgacctgttcgagaactactgcagaaacgacgacctggtgaccttcggcagattctgctacggcgtgaccgtgatcctgacctaccccatggagtgcttcgtgaccagagaggtgatcgccaacgtgttcttcggcggcaacctgagcagcgtgttccacatcgtggtgaccgtgatggtgatcaccgtggccaccctggtgagcctgctgatcgactgcctgggcatcgtgctggagctgaacggcgtgctgtgcgccacccccctgatcttcatcatccccagcgcctgctacctgaagctgagcgaggagcccagaacccacagcgacaagatcatgagctgcgtgatgctgcccatcggcgccgtggtgatggtgttcggcttcgtgatggccatcaccaacacccaggactgcacccacggccaggagatgttctactgcttccccgacaacttcagcctgaccaacaccagcgagagccacgtgcagcagaccacccagctgagcaccctgaacatcagcatcttccagtag

SEQ ID NO: 22301 - DNA, 1221 bp, Artificial Sequence
  Description of Artificial Sequence: Synthetic coding sequence
atgaagcaggccggcttccccctgggcatcctgctgctgttctgggtgagctacgtgaccgacttcagcctggtgctgctgatcaagggcggcgccctgagcggcaccgacacctaccagagcctggtgaacaagaccttcggcttccccggctacctgctgctgagcgtgctgcagttcctgtaccccttcatcgccatgatcagctacaacatcatcgccggcgacaccctgagcaaggtgttccagagaatccccggcgtggaccccgagaacgtgttcatcggcagacacttcatcatcggcctgagcaccgtgaccttcaccctgcccctgagcctgtacagaaacatcgccaagctgggcaaggtgagcctgatcagcaccggcctgaccaccctgatcctgggcatcgtgatggccagagccatcagcctgggcccccacatccccaagaccgaggacgcctgggtgttcgccaagcccaacgccatccaggccgtgggcgtgatgagcttcgccttcatctgccaccacaacagcttcctggtgtacagcagcctggaggagcccaccgtggccaagtggagcagactgatccacatgagcatcgtgatcagcgtgttcatctgcatcttcttcgccacctgcggctacctgaccttcaccggcttcacccagggcgacctgttcgagaactactgcagaaacgacgacctggtgaccttcggcagattctgctacggcgtgaccgtgatcctgacctaccccatggagtgcttcgtgaccagagaggtgatcgccaacgtgttcttcggcggcaacctgagcagcgtgttccacatcgtggtgaccgtgatggtgatcaccgtggccaccctggtgagcctgctgatcgactgcctgggcatcgtgctggagctgaacggcgtgctgtgcgccacccccctgatcttcatcatccccagcgcctgctacctgaagctgagcgaggagcccagaacccacagcgacaagatcatgagctgcgtgatgctgcccatcggcgccgtggtgatggtgttcggcttcgtgatggccatcaccaacacccaggactgcacccacggccaggagatgttctactgcttccccgacaacttcagcctgaccaacaccagcgagagccacgtgcagcagaccacccagctgagcaccctgaacatcagcatcttccagtag

SEQ ID NO: 22302 - DNA, 1221 bp, Artificial Sequence; identical to SEQ ID NO: 22301
  Description of Artificial Sequence: Synthetic coding sequence

SEQ ID NO: 22303 - DNA, 1371 bp, Artificial Sequence
  Description of Artificial Sequence: Synthetic coding sequence
atggaggccagctggggcagcttcaacgccgagagaggctggtacgtgagcgtgcagcagcccgaggaggccgaggccgaggagctgagccccctgctgagcaacgagctgcacagacagagaagccccggcgtgagcttcggcctgagcgtgttcaacctgatgaacgccatcatgggcagcggcatcctgggcctggcctacgtgctggccaacaccggcgtgttcggcttcagcttcctgctgctgaccgtggccctgctggccagctacagcgtgcacctgctgctgagcatgtgcatccagaccgccgtgaccagctacgaggacctgggcctgttcgccttcggcctgcccggcaagctggtggtggccggcaccatcatcatccagaacatcggcgccatgagcagctacctgctgatcatcaagaccgagctgcccgccgccatcgccgagttcctgaccggcgactacagcagatactggtacctggacggccagaccctgctgatcatcatctgcgtgggcatcgtgttccccctggccctgctgcccaagatcggcttcctgggctacaccagcagcctgagcttcttcttcatgatgttcttcgccctggtggtgatcatcaagaagtggagcatcccctgccccctgaccctgaactacgtggagaagggcttccagatcagcaacgtgaccgacgactgcaagcccaagctgttccacttcagcaaggagagcgcctacgccctgcccaccatggccttcagcttcctgtgccacaccagcatcctgcccatctactgcgagctgcagagccccagcaagaagagaatgcagaacgtgaccaacaccgccatcgccctgagcttcctgatctacttcatcagcgccctgttcggctacctgaccttctacgacaaggtggagagcgagctgctgaagggctacagcaagtacctgagccacgacgtggtggtgatgaccgtgaagctgtgcatcctgttcgccgtgctgctgaccgtgcccctgatccacttccccgccagaaaggccgtgaccatgatgttcttcagcaacttccccttcagctggatcagacacttcctgatcaccctggccctgaacatcatcatcgtgctgctggccatctacgtgcccgacatcagaaacgtgttcggcgtggtgggcgccagcaccagcacctgcctgatcttcatcttccccggcctgttctacctgaagctgagcagagaggacttcctgagctggaagaagctgggcgccttcgtgctgctgatcttcggcatcctggtgggcaacttcagcctggccctgatcatcttcgactggatcaacaagtag

SEQ ID NO: 22304 - DNA, 1566 bp, Artificial Sequence
  Description of Artificial Sequence: Synthetic coding sequence
atggaggccagctggggcagcttcaacgccgagagaggctggtacgtgagcgtgcagcagcccgaggaggccgaggccgaggagctgagccccctgctgagcaacgagctgcacagacagagaagccccggcgtgagcttcggcctgagcgtgttcaacctgatgaacgccatcatgggcagcggcatcctgggcctggcctacgtgctggccaacaccggcgtgttcggcttcagcttcctgctgctgaccgtggccctgctggccagctacagcgtgcacctgctgctgagcatgtgcatccagaccgccgtgaccagctacgaggacctgggcctgttcgccttcggcctgcccggcaagctggtggtggccggcaccatcatcatccagaacatcggcgccatgagcagctacctgctgatcatcaagaccgagctgcccgccgccatcgccgagttcctgaccggcgactacagcagatactggtacctggacggccagaccctgctgatcatcatctgcgtgggcatcgtgttccccctggccctgctgcccaagatcggcttcctgggctacaccagcagcctgagcttcttcttcatgatgttcttcgccctggtggtgatcatcaagaagtggagcatcccctgccccctgaccctgaactacgtggagaagggcttccagatcagcaacgtgaccgacgactgcaagcccaagctgttccacttcagcaaggagagcgcctacgccctgcccaccatggccttcagcttcctgtgccacaccagcatcctgcccatctactgcgagctgcagagccccagcaagaagagaatgcagaacgtgaccaacaccgccatcgccctgagcttcctgatctacttcatcagcgccctgttcggctacctgaccttctacgacaaggtggagagcgagctgctgaagggctacagcaagtacctgagccacgacgtggtggtgatgaccgtgaagctgtgcatcctgttcgccgtgctgctgaccgtgcccctgatccacttccccgccagaaaggccgtgaccatgatgttcttcagcaacttccccttcagctggatcagacacttcctgatcaccctggccctgaacatcatcatcgtgctgctggccatctacgtgcccgacatcagaaacgtgttcggcgtggtgggcgccagcaccagcacctgcctgatcttcatcttccccggcctgttctacctgaagctgagcagagaggacttcctgagctggaagaagctgggcggcctgatcctgagccacagactggcctgcagcggcgtgatcagcgcccactgcaacctgtgcctgcccgacagcagcaacccccccaccagcgccagcagagtggccgagaccaccggcagagacaccatggagatgtgcacccagagaaagggccacgccagaacccagcaggagggcaactgcctgcaggccaagggcagaggcctgagaagaaccaagagagtgcacaccctgatcctgcacttccccaccagcagaaccgtgagcaagtag

SEQ ID NO: 22305 - DNA, 1551 bp, Artificial Sequence
  Description of Artificial Sequence: Synthetic coding sequence
ggcagcttcaacgccgagagaggctggtacgtgagcgtgcagcagcccgaggaggccgaggccgaggagctgagccccctgctgagcaacgagctgcacagacagagaagccccggcgtgagcttcggcctgagcgtgttcaacctgatgaacgccatcatgggcagcggcatcctgggcctggcctacgtgctggccaacaccggcgtgttcggcttcagcttcctgctgctgaccgtggccctgctggccagctacagcgtgcacctgctgctgagcatgtgcatccagaccgccgtgaccagctacgaggacctgggcctgttcgccttcggcctgcccggcaagctggtggtggccggcaccatcatcatccagaacatcggcgccatgagcagctacctgctgatcatcaagaccgagctgcccgccgccatcgccgagttcctgaccggcgactacagcagatactggtacctggacggccagaccctgctgatcatcatctgcgtgggcatcgtgttccccctggccctgctgcccaagatcggcttcctgggctacaccagcagcctgagcttcttcttcatgatgttcttcgccctggtggtgatcatcaagaagtggagcatcccctgccccctgaccctgaactacgtggagaagggcttccagatcagcaacgtgaccgacgactgcaagcccaagctgttccacttcagcaaggagagcgcctacgccctgcccaccatggccttcagcttcctgtgccacaccagcatcctgcccatctactgcgagctgcagagccccagcaagaagagaatgcagaacgtgaccaacaccgccatcgccctgagcttcctgatctacttcatcagcgccctgttcggctacctgaccttctacgacaaggtggagagcgagctgctgaagggctacagcaagtacctgagccacgacgtggtggtgatgaccgtgaagctgtgcatcctgttcgccgtgctgctgaccgtgcccctgatccacttccccgccagaaaggccgtgaccatgatgttcttcagcaacttccccttcagctggatcagacacttcctgatcaccctggccctgaacatcatcatcgtgctgctggccatctacgtgcccgacatcagaaacgtgttcggcgtggtgggcgccagcaccagcacctgcctgatcttcatcttccccggcctgttctacctgaagctgagcagagaggacttcctgagctggaagaagctgggcggcctgatcctgagccacagactggcctgcagcggcgtgatcagcgcccactgcaacctgtgcctgcccgacagcagcaacccccccaccagcgccagcagagtggccgagaccaccggcagagacaccatggagatgtgcacccagagaaagggccacgccagaacccagcaggagggcaactgcctgcaggccaagggcagaggcctgagaagaaccaagagagtgcacaccctgatcctgcacttccccaccagcagaaccgtgagcaagtag

SEQ ID NO: 22306 - DNA, 1464 bp, Artificial Sequence
  Description of Artificial Sequence: Synthetic coding sequence
atgagcggccccagaatcatgtacagcctgctgctggagctgcacagacagagaagccccggcgtgagcttcggcctgagcgtgttcaacctgatgaacgccatcatgggcagcggcatcctgggcctggcctacgtgctggccaacaccggcgtgttcggcttcagcttcctgctgctgaccgtggccctgctggccagctacagcgtgcacctgctgctgagcatgtgcatccagaccgccgtgaccagctacgaggacctgggcctgttcgccttcggcctgcccggcaagctggtggtggccggcaccatcatcatccagaacatcggcgccatgagcagctacctgctgatcatcaagaccgagctgcccgccgccatcgccgagttcctgaccggcgactacagcagatactggtacctggacggccagaccctgctgatcatcatctgcgtgggcatcgtgttccccctggccctgctgcccaagatcggcttcctgggctacaccagcagcctgagcttcttcttcatgatgttcttcgccctggtggtgatcatcaagaagtggagcatcccctgccccctgaccctgaactacgtggagaagggcttccagatcagcaacgtgaccgacgactgcaagcccaagctgttccacttcagcaaggagagcgcctacgccctgcccaccatggccttcagcttcctgtgccacaccagcatcctgcccatctactgcgagctgcagagccccagcaagaagagaatgcagaacgtgaccaacaccgccatcgccctgagcttcctgatctacttcatcagcgccctgttcggctacctgaccttctacgacaaggtggagagcgagctgctgaagggctacagcaagtacctgagccacgacgtggtggtgatgaccgtgaagctgtgcatcctgttcgccgtgctgctgaccgtgcccctgatccacttccccgccagaaaggccgtgaccatgatgttcttcagcaacttccccttcagctggatcagacacttcctgatcaccctggccctgaacatcatcatcgtgctgctggccatctacgtgcccgacatcagaaacgtgttcggcgtggtgggcgccagcaccagcacctgcctgatcttcatcttccccggcctgttctacctgaagctgagcagagaggacttcctgagctggaagaagctgggcggcctgatcctgagccacagactggcctgcagcggcgtgatcagcgcccactgcaacctgtgcctgcccgacagcagcaacccccccaccagcgccagcagagtggccgagaccaccgagaaggaggagatcccctggagatgcgcccccagaggcaaggccacccagggccacagcaagaaggccaccgtgtacaagcccagagaggaggccagcggcgagcccaacgtgagcaccccctag

SEQ ID NO: 22307 - DNA, 1686 bp, Artificial Sequence
  Description of Artificial Sequence: Synthetic coding sequence
atggccaacatgaacagcgacagcagacacctgggcaccagcgaggtggaccacgagagagaccccggccccatgaacatccagttcgagcccagcgacctgagaagcaagagacccttctgcatcgagcccaccaacatcgtgaacgtgaaccacgtgatccagagagtgagcgaccacgccagcgccatgaacaagagaatccactactacagcagactgaccacccccgccgacaaggccctgatcgcccccgaccacgtggtgcccgcccccgaggagtgctacgtgtacagccccctgggcagcgcctacaagctgcagagctacaccgagggctacggcaagaacaccagcctggtgaccatcttcatgatctggaacaccatgatgggcaccagcatcctgagcatcccctggggcatcaagcaggccggcttcaccaccggcatgtgcgtgatcatcctgatgggcctgctgaccctgtactgctgctacagagtggtgaagagcagaaccatgatgttcagcctggacaccaccagctgggagtaccccgacgtgtgcagacactacttcggcagcttcggccagtggagcagcctgctgttcagcctggtgagcctgatcggcgccatgatcgtgtactgggtgctgatgagcaacttcctgttcaacaccggcaagttcatcttcaacttcatccaccacatcaacgacaccgacaccatcctgagcaccaacaacagcaaccccgtgatctgccccagcgccggcagcggcggccaccccgacaacagcagcatgatcttctacgccaacgacaccggcgcccagcagttcgagaagtggtgggacaagagcagaaccgtgcccttctacctggtgggcctgctgctgcccctgctgaacttcaagagccccagcttcttcagcaagttcaacatcctgggcaccgtgagcgtgctgtacctgatcttcctggtgaccttcaaggccgtgagactgggcttccacctggagttccactggttcatccccaccgagttcttcgtgcccgagatcagattccagttcccccagctgaccggcgtgctgaccctggccttcttcatccacaactgcatcatcaccctgctgaagaacaacaagaagcaggagaacaacgtgagagacctgtgcatcgcctacatgctggtgaccctgacctacctgtacatcggcgtgctggtgttcgccagcttccccagcccccccctgagcaaggactgcatcgagcagaacttcctggacaacttccccagcagcgacaccctgagcttcatcgccagaatcttcctgctgttccagatgatgaccgtgtaccccctgctgggctacctggccagagtgcagctgctgggccacatcttcggcgacatctaccccagcatcttccacgtgctgatcctgaacctgatcatcgtgggcgccggcgtgatcatggcctgcttctaccccaacatcggcggcatcatcagatacagcggcgccgcctgcggcctggccttcgtgttcatctaccccagcctgatctacatcatcagcctgcaccaggaggagagactgacctggcccaagctgatcttccacgtgttcatcatcatcctgggcgtggccaacctgatcgtgcagttcttcatgtag

SEQ ID NO: 22308 - DNA, 1686 bp, Artificial Sequence; identical to SEQ ID NO: 22307
  Description of Artificial Sequence: Synthetic coding sequence

SEQ ID NO: 22309 - DNA, 1314 bp, Artificial Sequence
  Description of Artificial Sequence: Synthetic coding sequence
atgatctggaacaccatgatgggcaccagcatcctgagcatcccctggggcatcaagcaggccggcttcaccaccggcatgtgcgtgatcatcctgatgggcctgctgaccctgtactgctgctacagagtggtgaagagcagaaccatgatgttcagcctggacaccaccagctgggagtaccccgacgtgtgcagacactacttcggcagcttcggccagtggagcagcctgctgttcagcctggtgagcctgatcggcgccatgatcgtgtactgggtgctgatgagcaacttcctgttcaacaccggcaagttcatcttcaacttcatccaccacatcaacgacaccgacaccatcctgagcaccaacaacagcaaccccgtgatctgccccagcgccggcagcggcggccaccccgacaacagcagcatgatcttctacgccaacgacaccggcgcccagcagttcgagaagtggtgggacaagagcagaaccgtgcccttctacctggtgggcctgctgctgcccctgctgaacttcaagagccccagcttcttcagcaagttcaacatcctgggcaccgtgagcgtgctgtacctgatcttcctggtgaccttcaaggccgtgagactgggcttccacctggagttccactggttcatccccaccgagttcttcgtgcccgagatcagattccagttcccccagctgaccggcgtgctgaccctggccttcttcatccacaactgcatcatcaccctgctgaagaacaacaagaagcaggagaacaacgtgagagacctgtgcatcgcctacatgctggtgaccctgacctacctgtacatcggcgtgctggtgttcgccagcttccccagcccccccctgagcaaggactgcatcgagcagaacttcctggacaacttccccagcagcgacaccctgagcttcatcgccagaatcttcctgctgttccagatgatgaccgtgtaccccctgctgggctacctggccagagtgcagctgctgggccacatcttcggcgacatctaccccagcatcttccacgtgctgatcctgaacctgatcatcgtgggcgccggcgtgatcatggcctgcttctaccccaacatcggcggcatcatcagatacagcggcgccgcctgcggcctggccttcgtgttcatctaccccagcctgatctacatcatcagcctgcaccaggaggagagactgacctggcccaagctgatcttccacgtgttcatcatcatcctgggcgtggccaacctgatcgtgcagttcttcatgtag

SEQ ID NO: 22310 - DNA, 396 bp, Artificial Sequence
  Description of Artificial Sequence: Synthetic coding sequence
atggccaacatgaacagcgacagcagacacctgggcaccagcgaggtggaccacgagagagaccccggccccatgaacatccagttcgagcccagcgacctgagaagcaagagacccttctgcatcgagcccaccaacatcgtgaacgtgaaccacgtgatccagagagtgagcgaccacgccagcgccatgaacaagagaatccactactacagcagactgaccacccccgccgacaaggccctgatcgcccccgaccacgtggtgcccgcccccgaggagtgctacgtgtacagccccctgggcagcgcctacaagctgcagagctacaccgagggctacggcaagaacaccagcctggtgaccatcttcatgatctggaacaccatgatgtag

SEQ ID NO: 22311 - DNA, 114 bp, Artificial Sequence
  Description of Artificial Sequence: Synthetic coding sequence
atggccaacatgaacagcgacagcagacacctgggcaccagcgaggtggaccacgagagagaccccggccccatgaacatccagttcgagcccagcgacctgagaagcaagtag

SEQ ID NO: 22312 - DNA, 114 bp, Artificial Sequence; identical to SEQ ID NO: 22311
  Description of Artificial Sequence: Synthetic coding sequence

SEQ ID NO: 22313 - DNA, 1497 bp, Artificial Sequence
  Description of Artificial Sequence: Synthetic coding sequence
atggccatctgcatcctgacctggagaatcagacccttctgcatcgagcccaccaacatcgtgaacgtgaaccacgtgatccagagagtgagcgaccacgccagcgccatgaacaagagaatccactactacagcagactgaccacccccgccgacaaggccctgatcgcccccgaccacgtggtgcccgcccccgaggagtgctacgtgtacagccccctgggcagcgcctacaagctgcagagctacaccgagggctacggcaagaacaccagcctggtgaccatcttcatgatctggaacaccatgatgggcaccagcatcctgagcatcccctggggcatcaagcaggccggcttcaccaccggcatgtgcgtgatcatcctgatgggcctgctgaccctgtactgctgctacagagtggtgaagagcagaaccatgatgttcagcctggacaccaccagctgggagtaccccgacgtgtgcagacactacttcggcagcttcggccagtggagcagcctgctgttcagcctggtgagcctgatcggcgccatgatcgtgtactgggtgctgatgagcaacttcctgttcaacaccggcaagttcatcttcaacttcatccaccacatcaacgacaccgacaccatcctgagcaccaacaacagcaaccccgtgatctgccccagcgccggcagcggcggccaccccgacaacagcagcatgatcttctacgccaacgacaccggcgcccagcagttcgagaagtggtgggacaagagcagaaccgtgcccttctacctggtgggcctgctgctgcccctgctgaacttcaagagccccagcttcttcagcaagttcaacatcctggagatcagattccagttcccccagctgaccggcgtgctgaccctggccttcttcatccacaactgcatcatcaccctgctgaagaacaacaagaagcaggagaacaacgtgagagacctgtgcatcgcctacatgctggtgaccctgacctacctgtacatcggcgtgctggtgttcgccagcttccccagcccccccctgagcaaggactgcatcgagcagaacttcctggacaacttccccagcagcgacaccctgagcttcatcgccagaatcttcctgctgttccagatgatgaccgtgtaccccctgctgggctacctggccagagtgcagctgctgggccacatcttcggcgacatctaccccagcatcttccacgtgctgatcctgaacctgatcatcgtgggcgccggcgtgatcatggcctgcttctaccccaacatcggcggcatcatcagatacagcggcgccgcctgcggcctggccttcgtgttcatctaccccagcctgatctacatcatcagcctgcaccaggaggagagactgacctggcccaagctgatcttccacgtgttcatcatcatcctgggcgtggccaacctgatcgtgcagttcttcatgtag

SEQ ID NO: 22314 - DNA, 81 bp, Artificial Sequence
  Description of Artificial Sequence: Synthetic coding sequence
atggccaacatgaacagcgacagcagacacctgggcaccagcgaggtggaccacgagagagaccccggccccatgaactag

SEQ ID NO: 22315 - DNA, 294 bp, Artificial Sequence
  Description of Artificial Sequence: Synthetic coding sequence
atggccaacatgaacagcgacagcagacacctgggcaccagcgaggtggaccacgagagagaccccggccccatgaacatccagttcgagcccagcgacctgagaagcaagagacccttctgcatcgagcccaccaacatcgtgaacgtgaaccacgtgatccagagagtgagcgaccacgccagcgccatgaacaagagaatccactactacagcagactgaccacccccgccgacaaggccctgatcgcccccgaccacgtggtgcccgcccccgaggagtgctacgtgtag

SEQ ID NO: 22316 - DNA, 1497 bp, Artificial Sequence
  Description of Artificial Sequence: Synthetic coding sequence
atgaacaagagaatccactactacagcagactgaccacccccgccgacaaggccctgatcgcccccgaccacgtggtgcccgcccccgaggagtgctacgtgtacagccccctgggcagcgcctacaagctgcagagctacaccgagggctacggcaagaacaccagcctggtgaccatcttcatgatctggaacaccatgatgggcaccagcatcctgagcatcccctggggcatcaagcaggccggcttcaccaccggcatgtgcgtgatcatcctgatgggcctgctgaccctgtactgctgctacagagtggtgaagagcagaaccatgatgttcagcctggacaccaccagctgggagtaccccgacgtgtgcagacactacttcggcagcttcggccagtggagcagcctgctgttcagcctggtgagcctgatcggcgccatgatcgtgtactgggtgctgatgagcaacttcctgttcaacaccggcaagttcatcttcaacttcatccaccacatcaacgacaccgacaccatcctgagcaccaacaacagcaaccccgtgatctgccccagcgccggcagcggcggccaccccgacaacagcagcatgatcttctacgccaacgacaccggcgcccagcagttcgagaagtggtgggacaagagcagaaccgtgcccttctacctggtgggcctgctgctgcccctgctgaacttcaagagccccagcttcttcagcaagttcaacatcctgggcaccgtgagcgtgctgtacctgatcttcctggtgaccttcaaggccgtgagactgggcttccacctggagttccactggttcatccccaccgagttcttcgtgcccgagatcagattccagttcccccagctgaccggcgtgctgaccctggccttcttcatccacaactgcatcatcaccctgctgaagaacaacaagaagcaggagaacaacgtgagagacctgtgcatcgcctacatgctggtgaccctgacctacctgtacatcggcgtgctggtgttcgccagcttccccagcccccccctgagcaaggactgcatcgagcagaacttcctggacaacttccccagcagcgacaccctgagcttcatcgccagaatcttcctgctgttccagatgatgaccgtgtaccccctgctgggctacctggccagagtgcagctgctgggccacatcttcggcgacatctaccccagcatcttccacgtgctgatcctgaacctgatcatcgtgggcgccggcgtgatcatggcctgcttctaccccaacatcggcggcatcatcagatacagcggcgccgcctgcggcctggccttcgtgttcatctaccccagcctgatctacatcatcagcctgcaccaggaggagagactgacctggcccaagctgatcttccacgtgttcatcatcatcctgggcgtggccaacctgatcgtgcagttcttcatgtag

SEQ ID NO: 22317 - DNA, 1389 bp, Artificial Sequence
  Description of Artificial Sequence: Synthetic coding sequence
atggccaacatgaacagcgacagcagacacctgggcaccagcgaggtggaccacgagagagaccccggccccatgaacatccagttcgagcccagcgacctgagaagcaagagacccttctgcatcgagcccaccaacatcgtgaacgtgaaccacgtgatccagagagtgagcgaccacgccagcgccatgaacaagagaatccactactacagcagactgaccacccccgccgacaaggccctgatcgcccccgaccacgtggtgcccgcccccgaggagtgctacgtgtacagccccctgggcagcgcctacaagctgcagagctacaccgagggctacggcaagaacaccagcctggtgaccatcttcatgatctggaacaccatgatgggcaccagcatcctgagcatcccctggggcatcaagcaggccggcttcaccaccggcatgtgcgtgatcatcctgatgggcctgctgaccctgtactgctgctacagagtggtgaagagcagaaccatgatgttcagcctggacaccaccagctgggagtaccccgacgtgtgcagacactacttcggcagcttcggccagtggagcagcctgctgttcagcctggtgagcctgatcggcgccatgatcgtgtactgggtgctgatgagcaacttcctgttcaacaccggcaagttcatcttcaacttcatccaccacatcaacgacaccgacaccatcctgagcaccaacaacagcaaccccgtgatctgccccagcgccggcagcggcggccaccccgacaacagcagcatgatcttctacgccaacgacaccggcgcccagcagttcgagaagtggtgggacaagagcagaaccgtgcccttctacctggtgggcctgctgctgcccctgctgaacttcaagagccccagcttcttcagcaagttcaacatcctgggcaccgtgagcgtgctgtacctgatcttcctggtgaccttcaaggccgtgagactgggcttccacctggagttccactggttcatccccaccgagttcttcgtgcccgagatcagattccagttcccccagctgaccggcgtgctgaccctggccttcttcatccacaactgcatcatcaccctgctgaagaacaacaagaagcaggagaacaacgtgagagacctgtgcatcgcctacatgctggtgaccctgacctacctgtacatcggcgtgctggtgttcgccagcttccccagcccccccctgagcaaggactgcatcgagcaggtgagacacagagtgcccagcctgtgcgactgcgtgcacttccacgtgttcatcgtgggcagagtgatccagtggcaggacatcaccagcgacagacccggcttctag

SEQ ID NO: 22318 - DNA, 1008 bp, Artificial Sequence
  Description of Artificial Sequence: Synthetic coding sequence
atgctgcagggccacagcagcgtgttccaggccctgctgggcaccttcttcacctggggcatgaccgccgccggcgccgccctggtgttcgtgttcagcagcggccagagaagaatcctggacggcagcctgggcttcgccgccggcgtgatgctggccgccagctactggagcctgctggcccccgccgtggagatggccaccagcagcggcggcttcggcgccttcgccttcttccccgtggccgtgggcttcaccctgggcgccgccttcgtgtacctggccgacctgctgatgccccacctgggcgccgccgaggacccccagaccaccctggccctgaacttcggcagcaccctgatgaagaagaagagcgaccccgagggccccgccctgctgttccccgagagcgagctgagcatcagaatcgacaagagcgagaacggcgaggcctaccagagaaagaaggccgccgccaccggcctgcccgagggccccgccgtgcccgtgcccagcagaggcaacctggcccagcccggcggcagcagctggagaagaatcgccctgctgatcctggccatcaccatccacaacgtgcccgagggcctggccgtgggcgtgggcttcggcgccatcgagaagaccgccagcgccaccttcgagagcgccagaaacctggccatcggcatcggcatccagaacttccccgagggcctggccgtgagcctgcccctgagaggcgccggcttcagcacctggagagccttctggtacggccagctgagcggcatggtggagcccctggccggcgtgttcggcgccttcgccgtggtgctggccgagcccatcctgccctacgccctggccttcgccgccggcgccatggtgtacgtggtgatggacgacatcatccccgaggcccagatcagcggcaacggcaagctggccagctgggccagcatcctgggcttcgtggtgatgatgagcctggacgtgggcctgggctag

SEQ ID NO: 22319 - DNA, 1029 bp, Artificial Sequence
  Description of Artificial Sequence: Synthetic coding sequence
atgctgcagggccacagcagcgtgttccaggccctgctgggcaccttcttcacctggggcatgaccgccgccggcgccgccctggtgttcgtgttcagcagcggccagagaagaatcctggacggcagcctgggcttcgccgccggcgtgatgctggccgccagctactggagcctgctggcccccgccgtggagatggccaccagcagcggcggcttcggcgccttcgccttcttccccgtggccgtgggcttcaccctgggcgccgccttcgtgtacctggccgacctgctgatgccccacctgggcgccgccgaggacccccagaccaccctggccctgaacttcggcagcaccctgatgaagaagaagagcgaccccgagggccccgccctgctgttccccgagagcgagctgagcatcagaatcggcagagccggcctgctgagcgacaagagcgagaacggcgaggcctaccagagaaagaaggccgccgccaccggcctgcccgagggccccgccgtgcccgtgcccagcagaggcaacctggcccagcccggcggcagcagctggagaagaatcgccctgctgatcctggccatcaccatccacaacgtgcccgagggcctggccgtgggcgtgggcttcggcgccatcgagaagaccgccagcgccaccttcgagagcgccagaaacctggccatcggcatcggcatccagaacttccccgagggcctggccgtgagcctgcccctgagaggcgccggcttcagcacctggagagccttctggtacggccagctgagcggcatggtggagcccctggccggcgtgttcggcgccttcgccgtggtgctggccgagcccatcctgccctacgccctggccttcgccgccggcgccatggtgtacgtggtgatggacgacatcatccccgaggcccagatcagcggcaacggcaagctggccagctgggccagcatcctgggcttcgtggtgatgatgagcctggacgtgggcctgggctag

SEQ ID NO: 22320 - DNA, 1623 bp, Artificial Sequence
  Description of Artificial Sequence: Synthetic coding sequence
atgatgggcagccccgtgagccacctgctggccggcttctgcgtgtgggtggtgctgggctgggtgggcggcagcgtgcccaacctgggccccgccgagcaggagcagaaccactacctggcccagctgttcggcctgtacggcgagaacggcaccctgaccgccggcggcctggccagactgctgcacagcctgggcctgggcagagtgcagggcctgagactgggccagcacggccccctgaccggcagagccgccagccccgccgccgacaacagcacccacagaccccagaaccccgagctgagcgtggacgtgtgggccggcatgcccctgggccccagcggctggggcgacctggaggagagcaaggccccccacctgcccagaggccccgcccccagcggcctggacctgctgcacagactgctgctgctggaccacagcctggccgaccacctgaacgaggactgcctgaacggcagccagctgctggtgaacttcggcctgagccccgccgcccccctgacccccagacagttcgccctgctgtgccccgccctgctgtaccagatcgacagcagagtgtgcatcggcgcccccgcccccgccccccccggcgacctgctgagcgccctgctgcagagcgccctggccgtgctgctgctgagcctgcccagccccctgagcctgctgctgctgagactgctgggccccagactgctgagacccctgctgggcttcctgggcgccctggccgtgggcaccctgtgcggcgacgccctgctgcacctgctgccccacgcccaggagggcagacacgccggccccggcggcctgcccgagaaggacctgggccccggcctgagcgtgctgggcggcctgttcctgctgttcgtgctggagaacatgctgggcctgctgagacacagaggcctgagacccagatgctgcagaagaaagagaagaaacctggagaccagaaacctggaccccgagaacggcagcggcatggccctgcagcccctgcaggccgcccccgagcccggcgcccagggccagagagagaagaacagccagcacccccccgccctggccccccccggccaccagggccacagccacggccaccagggcggcaccgacatcacctggatggtgctgctgggcgacggcctgcacaacctgaccgacggcctggccatcggcgccgccttcagcgacggcttcagcagcggcctgagcaccaccctggccgtgttctgccacgagctgccccacgagctgggcgacttcgccatgctgctgcagagcggcctgagcttcagaagactgctgctgctgagcctggtgagcggcgccctgggcctgggcggcgccgtgctgggcgtgggcctgagcctgggccccgtgcccctgaccccctgggtgttcggcgtgaccgccggcgtgttcctgtacgtggccctggtggacatgctgcccgccctgctgagaccccccgagcccctgcccaccccccacgtgctgctgcagggcctgggcctgctgctgggcggcggcctgatgctggccatcaccctgctggaggagagactgctgcccgtgaccaccgagggctag

SEQ ID NO: 22321 - DNA, 390 bp, Artificial Sequence
  Description of Artificial Sequence: Synthetic coding sequence
atgatgggcagccccgtgagccacctgctggccggcttctgcgtgtgggtggtgctgggctgggtgggcggcagcgtgcccaacctgggccccgccgagcaggagcagaaccactacctggcccagctgttcggcctgtacggcgagaacggcaccctgaccgccggcggcctggccagactgctgcacagcctgggcctgggcagagtgcagggcctgagactgggccagcacggccccctgaccggcagagccgccagccccgccgccgacaacagcacccacagaccccagaaccccgagctgagcgtggacgtgtgggccggcatgcccctgggccccagcggctggggcgacctggaggagagcaaggccccccacctgccctag

SEQ ID NO: 22322 - DNA, 471 bp, Artificial Sequence
  Description of Artificial Sequence: Synthetic coding sequence
atgatgggcagccccgtgagccacctgctggccggcttctgcgtgtgggtggtgctgggctgggtgggcggcagcgtgcccaacctgggccccgccgagcaggagcagaaccactacctggcccagctgttcggcctgtacggcgagaacggcaccctgaccgccggcggcctggccagactgctgcacagcctgggcctgggcagagtgcagggcctgagactgggccagcacggccccctgaccggcagagccgccagccccgccgccgacaacagcacccacagaccccagaaccccgagctgagcgtggacgtgtgggccggcatgcccctgggccccagcggctggggcgacctggaggagagcaaggccccccacctgcccagaggccccgcccccagcggcctggacctgctgcacagactgctgctgctggaccacagcctggccgaccacctgaacgagtag

SEQ ID NO: 22323 - DNA, 372 bp, Artificial Sequence
  Description of Artificial Sequence: Synthetic coding sequence
atgatgggcagccccgtgagccacctgctggccggcttctgcgtgtgggtggtgctgggctgggtgggcggcagcgtgcccaacctgggccccgccgagcaggagcagaaccactacctggcccagctgttcggcctgtacggcgagaacggcaccctgaccgccggcggcctggccagactgctgcacagcctgggcctgggcagagtgcagggcctgagactgggccagcacggccccctgaccggcagagccgccagccccgccgccgacaacagcacccacagaccccagaaccccgagctgagcgtggacgtgtgggccggcatgcccctgggccccagcggctggggcgacctggaggagagctag

SEQ ID NO: 22324 - DNA, 381 bp, Artificial Sequence
  Description of Artificial Sequence: Synthetic coding sequence
atgatgggcagccccgtgagccacctgctggccggcttctgcgtgtgggtggtgctgggctgggtgggcggcagcgtgcccaacctgggccccgccgagcaggagcagaaccactacctggcccagctgttcggcctgtacggcgagaacggcaccctgaccgccggcggcctggccagactgctgcacagcctgggcctgggcagagtgcagggcctgagactgggccagcacggccccctgaccggcagagccgccagccccgccgccgacaacagcacccacagaccccagaaccccgagctgagcgtggacgtgtgggccggcatgcccctgggccccagcggctggggcgacctggaggagagcaaggccccctag

SEQ ID NO: 22325 - DNA, 1623 bp, Artificial Sequence; identical to SEQ ID NO: 22320
  Description of Artificial Sequence: Synthetic coding sequence

SEQ ID NO: 22326 - DNA, 699 bp, Artificial Sequence
  Description of Artificial Sequence: Synthetic coding sequence
atggacgacttcatcagcatcagcctgctgagcctggccatgctggtgggctgctacgtggccggcatcatccccctggccgtgaacttcagcgaggagagactgaagctggtgaccgtgctgggcgccggcctgctgtgcggcaccgccctggccgtgatcgtgcccgagggcgtgcacgccctgtacgaggacatcctggagggcaagcaccaccaggccagcgagacccacaacgtgatcgccagcgacaaggccgccgagaagagcgtggtgcacgagcacgagcacagccacgaccacacccagctgcacgcctacatcggcgtgagcctggtgctgggcttcgtgttcatgctgctggtggaccagatcggcaacagccacgtgcacagcaccgacgaccccgaggccgccagaagcagcaacagcaagatcaccaccaccctgggcctggtggtgcacgccgccgccgacggcgtggccctgggcgccgccgccagcaccagccagaccagcgtgcagctgatcgtgttcgtggccatcatgctgcacaaggcccccgccgccttcggcctggtgagcttcctgatgcacgccggcctggagagaaacagaatcagaaagcacctgctggtgttcgccctggccgcccccgtgatgagcatggtgacctacctgggcctgagcaaggactag

SEQ ID NO: 22327 - DNA, 2496 bp, Artificial Sequence
  Description of Artificial Sequence: Synthetic coding sequence
atgaaggtgcacatgcacaccaagttctgcctgatctgcctgctgaccttcatcttccaccactgcaaccactgccacgaggagcacgaccacggccccgaggccctgcacagacagcacagaggcatgaccgagctggagcccagcaagttcagcaagcaggccgccgagaacgagaagaagtactacatcgagaagctgttcgagagatacggcgagaacggcagactgagcttcttcggcctggagaagctgctgaccaacctgggcctgggcgagagaaaggtggtggagatcaaccacgaggacctgggccacgaccacgtgagccacctggacatcctggccgtgcaggagggcaagcacttccacagccacaaccaccagcacagccacaaccacctgaacagcgagaaccagaccgtgaccagcgtgagcaccaagagaaaccacaagtgcgaccccgagaaggagaccgtggaggtgagcgtgaagagcgacgacaagcacatgcacgaccacaaccacagactgagacaccaccacagactgcaccaccacctggaccacaacaacacccaccacttccacaacgacagcatcacccccagcgagagaggcgagcccagcaacgagcccagcaccgagaccaacaagacccaggagcagagcgacgtgaagctgcccaagggcaagagaaagaagaagggcagaaagagcaacgagaacagcgaggtgatcacccccggcttcccccccaaccacgaccagggcgagcagtacgagcacaacagagtgcacaagcccgacagagtgcacaaccccggccacagccacgtgcacctgcccgagagaaacggccacgaccccggcagaggccaccaggacctggaccccgacaacgagggcgagctgagacacaccagaaagagagaggccccccacgtgaagaacaacgccatcatcagcctgagaaaggacctgaacgaggacgaccaccaccacgagtgcctgaacgtgacccagctgctgaagtactacggccacggcgccaacagccccatcagcaccgacctgttcacctacctgtgccccgccctgctgtaccagatcgacagcagactgtgcatcgagcacttcgacaagctgctggtggaggacatcaacaaggacaagaacctggtgcccgaggacgaggccaacatcggcgccagcgcctggatctgcggcatcatcagcatcaccgtgatcagcctgctgagcctgctgggcgtgatcctggtgcccatcatcaaccagggctgcttcaagttcctgctgaccttcctggtggccctggccgtgggcaccatgagcggcgacgccctgctgcacctgctgccccacagccagggcggccacgaccacagccaccagcacgcccacggccacggccacagccacggccacgagagcaacaagttcctggaggagtacgacgccgtgctgaagggcctggtggccctgggcggcatctacctgctgttcatcatcgagcactgcatcagaatgttcaagcactacaagcagcagagaggcaagcagaagtggttcatgaagcagaacaccgaggagagcaccatcggcagaaagctgagcgaccacaagctgaacaacacccccgacagcgactggctgcagctgaagcccctggccggcaccgacgacagcgtggtgagcgaggacagactgaacgagaccgagctgaccgacctggagggccagcaggagagcccccccaagaactacctgtgcatcgaggaggagaagatcatcgaccacagccacagcgacggcctgcacaccatccacgagcacgacctgcacgccgccgcccacaaccaccacggcgagaacaagaccgtgctgagaaagcacaaccaccagtggcaccacaagcacagccaccacagccacggcccctgccacagcggcagcgacctgaaggagaccggcatcgccaacatcgcctggatggtgatcatgggcgacggcatccacaacttcagcgacggcctggccatcggcgccgccttcagcgccggcctgaccggcggcatcagcaccagcatcgccgtgttctgccacgagctgccccacgagctgggcgacttcgccgtgctgctgaaggccggcatgaccgtgaagcaggccatcgtgtacaacctgctgagcgccatgatggcctacatcggcatgctgatcggcaccgccgtgggccagtacgccaacaacatcaccctgtggatcttcgccgtgaccgccggcatgttcctgtacgtggccctggtggacatgctgcccgagatgctgcacggcgacggcgacaacgaggagcacggcttctgccccgtgggccagttcatcctgcagaacctgggcctgctgttcggcttcgccatcatgctggtgatcgccctgtacgaggacaagatcgtgttcgacatccagttctag

SEQ ID NO: 22328 - DNA, 2496 bp, Artificial Sequence; identical to SEQ ID NO: 22327
  Description of Artificial Sequence: Synthetic coding sequence

SEQ ID NO: 22329 - DNA, 117 bp, Artificial Sequence
  Description of Artificial Sequence: Synthetic coding sequence
atgaaggtgcacatgcacaccaagttctgcctgatctgcctgctgaccttcatcttccaccactgcaaccactgccacgaggagcacgaccacggccccgaggccctgcacagatag

SEQ ID NO: 22330 - DNA, 393 bp, Artificial Sequence
  Description of Artificial Sequence: Synthetic coding sequence
atgaaggtgcacatgcacaccaagttctgcctgatctgcctgctgaccttcatcttccaccactgcaaccactgccacgaggagcacgaccacggccccgaggccctgcacagacagcacagaggcatgaccgagctggagcccagcaagttcagcaagcaggccgccgagaacgagaagaagtactacatcgagaagctgttcgagagatacggcgagaacggcagactgagcttcttcggcctggagaagctgctgaccaacctgggcctgggcgagagaaaggtggtggagatcaaccacgaggacctgggccacgaccacgtgagccacctggacatcctggccgtgcaggagggcaagcacttccacagccacaaccaccagcactag

SEQ ID NO: 22331 - DNA, 381 bp, Artificial Sequence
  Description of Artificial Sequence: Synthetic coding sequence
atgaaggtgcacatgcacaccaagttctgcctgatctgcctgctgaccttcatcttccaccactgcaaccactgccacgaggagcacgaccacggccccgaggccctgcacagacagcacagaggcatgaccgagctggagcccagcaagttcagcaagcaggccgccgagaacgagaagaagtactacatcgagaagctgttcgagagatacggcgagaacggcagactgagcttcttcggcctggagaagctgctgaccaacctgggcctgggcgagagaaaggtggtggagatcaaccacgaggacctgggccacgaccacgtgagccacctggacatcctggccgtgcaggagggcaagcacttccacagccactag

SEQ ID NO: 22332 - DNA, 1146 bp, Artificial Sequence
  Description of Artificial Sequence: Synthetic coding sequence
atgagcggcgacgccctgctgcacctgctgccccacagccagggcggccacgaccacagccaccagcacgcccacggccacggccacagccacggccacgagagcaacaagttcctggaggagtacgacgccgtgctgaagggcctggtggccctgggcggcatctacctgctgttcatcatcgagcactgcatcagaatgttcaagcactacaagcagcagagaggcaagcagaagtggttcatgaagcagaacaccgaggagagcaccatcggcagaaagctgagcgaccacaagctgaacaacacccccgacagcgactggctgcagctgaagcccctggccggcaccgacgacagcgtggtgagcgaggacagactgaacgagaccgagctgaccgacctggagggccagcaggagagcccccccaagaactacctgtgcatcgaggaggagaagatcatcgaccacagccacagcgacggcctgcacaccatccacgagcacgacctgcacgccgccgcccacaaccaccacggcgagaacaagaccgtgctgagaaagcacaaccaccagtggcaccacaagcacagccaccacagccacggcccctgccacagcggcagcgacctgaaggagaccggcatcgccaacatcgcctggatggtgatcatgggcgacggcatccacaacttcagcgacggcctggccatcggcgccgccttcagcgccggcctgaccggcggcatcagcaccagcatcgccgtgttctgccacgagctgccccacgagctgggcgacttcgccgtgctgctgaaggccggcatgaccgtgaagcaggccatcgtgtacaacctgctgagcgccatgatggcctacatcggcatgctgatcggcaccgccgtgggccagtacgccaacaacatcaccctgtggatcttcgccgtgaccgccggcatgttcctgtacgtggccctggtggacatgctgcccgagatgctgcacggcgacggcgacaacgaggagcacggcttctgccccgtgggccagttcatcctgcagaacctgggcctgctgttcggcttcgccatcatgctggtgatcgccctgtacgaggacaagatcgtgttcgacatccagttctag

SEQ ID NO: 22333 - DNA, 2076 bp, Artificial Sequence
  Description of Artificial Sequence: Synthetic coding sequence
atgtgcttcagaaccaagctgagcgtgagctgggtgcccctgttcctgctgctgagcagagtgttcagcaccgagaccgacaagcccagcgcccaggacagcagaagcagaggcagcagcggccagcccgccgacctgctgcaggtgctgagcgccggcgaccaccccccccacaaccacagcagaagcctgatcaagaccctgctggagaagaccggctgccccagaagaagaaacggcatgcagggcgactgcaacctgtgcttcgagcccgacgccctgctgctgatcgccggcggcaacttcgaggaccagctgagagaggaggtggtgcagagagtgagcctgctgctgctgtactacatcatccaccaggaggagatctgcagcagcaagctgaacatgagcaacaaggagtacaagttctacctgcacagcctgctgagcctgagacaggacgaggacagcagcttcctgagccagaacgagaccgaggacatcctggccttcaccagacagtacttcgacaccagccagagccagtgcatggagaccaagaccctgcagaagaagagcggcatcgtgagcagcgagggcgccaacgagagcaccctgccccagctggccgccatgatcatcaccctgagcctgcagggcgtgtgcctgggccagggcaacctgcccagccccgactacttcaccgagtacatcttcagcagcctgaacagaaccaacaccctgagactgagcgagctggaccagctgctgaacaccctgtggaccagaagcacctgcatcaagaacgagaagatccaccagttccagagaaagcagaacaacatcatcacccacgaccaggactacagcaacttcagcagcagcatggagaaggagagcgaggacggccccgtgagctgggaccagacctgcttcagcgccagacagctggtggagatcttcctgcagaagggcctgagcctgatcagcaaggaggacttcaagcagatgagccccggcatcatccagcagctgctgagctgcagctgccacctgcccaaggaccagcaggccaagctgccccccaccaccctggagaagtacggctacagcaccgtggccgtgaccctgctgaccctgggcagcatgctgggcaccgccctggtgctgttccacagctgcgaggagaactacagactgatcctgcagctgttcgtgggcctggccgtgggcaccctgagcggcgacgccctgctgcacctgatcccccaggtgctgggcctgcacaagcaggaggcccccgagttcggccacttccacgagagcaagggccacatctggaagctgatgggcctgatcggcggcatccacggcttcttcctgatcgagaagtgcttcatcctgctggtgagccccaacgacaagcagggcctgagcctggtgaacggccacgtgggccacagccaccacctggccctgaacagcgagctgagcgaccaggccggcagaggcaagagcgccagcaccatccagctgaagagccccgaggacagccaggccgccgagatgcccatcggcagcatgaccgccagcaacagaaagtgcaaggccatcagcctgctggccatcatgatcctggtgggcgacagcctgcacaacttcgccgacggcctggccatcggcgccgccttcagcagcagcagcgagagcggcgtgaccaccaccatcgccatcctgtgccacgagatcccccacgagatgggcgacttcgccgtgctgctgagcagcggcctgagcatgaagaccgccatcctgatgaacttcatcagcagcctgaccgccttcatgggcctgtacatcggcctgagcgtgagcgccgacccctgcgtgcaggactggatcttcaccgtgaccgccggcatgttcctgtacctgagcctggtggagatgctgcccgagatgacccacgtgcagacccagagaccctggatgatgttcctgctgcagaacttcggcctgatcctgggctggctgagcctgctgctgctggccatctacgagcagaacatcaagatctag

SEQ ID NO: 22334 - DNA, 2073 bp, Artificial Sequence
  Description of Artificial Sequence: Synthetic coding sequence
atgtgcttcagaaccaagctgagcgtgagctgggtgcccctgttcctgctgctgagcagagtgttcagcaccgagaccgacaagcccagcgcccaggacagcagaagcagaggcagcagcggccagcccgccgacctgctgcaggtgctgagcgccggcgaccaccccccccacaaccacagcagaagcctgatcaagaccctgctggagaagaccggctgccccagaagaagaaacggcatgcagggcgactgcaacctgtgcttcgagcccgacgccctgctgctgatcgccggcggcaacttcgaggaccagctgagagaggaggtggtgcagagagtgagcctgctgctgctgtactacatcatccaccaggaggagatctgcagcagcaagctgaacatgagcaacaaggagtacaagttctacctgcacagcctgctgagcctgagacaggacgaggacagcagcttcctgagccagaacgagaccgaggacatcctggccttcaccagacagtacttcgacaccagccagagccagtgcatggagaccaagaccctgcagaagaagagcggcatcgtgagcagcgagggcgccaacgagagcaccctgccccagctggccgccatgatcatcaccctgagcctgcagggcgtgtgcctgggccagggcaacctgcccagccccgactacttcaccgagtacatcttcagcagcctgaacagaaccaacaccctgagactgagcgagctggaccagctgctgaacaccctgtggaccagaagcacctgcatcaagaacgagaagatccaccagttccagagaaagcagaacaacatcatcacccacgaccaggactacagcaacttcagcagcagcatggagaaggagagcgaggacggccccgtgagctgggaccagacctgcttcagcgccagacagctggtggagatcttcctgcagaagggcctgagcctgatcagcaaggaggacttcaagcagatgagccccggcatcatccagcagctgctgagctgcagctgccacctgcccaaggaccagcaggccaagctgccccccaccaccctggagaagtacggctacagcaccgtggccgtgaccctgctgaccctgggcagcatgctgggcaccgccctggtgctgttccacagctgcgaggagaactacagactgatcctgcagctgttcgtgggcctggccgtgggcaccctgagcggcgacgccctgctgcacctgatcccccaggtgctgggcctgcacaagcaggaggcccccgagttcggccacttccacgagagcaagggccacatctggaagctgatgggcctgatcggcggcatccacggcttcttcctgatcgagaagtgcttcatcctgctggtgagccccaacgacaagggcctgagcctggtgaacggccacgtgggccacagccaccacctggccctgaacagcgagctgagcgaccaggccggcagaggcaagagcgccagcaccatccagctgaagagccccgaggacagccaggccgccgagatgcccatcggcagcatgaccgccagcaacagaaagtgcaaggccatcagcctgctggccatcatgatcctggtgggcgacagcctgcacaacttcgccgacggcctggccatcggcgccgccttcagcagcagcagcgagagcggcgtgaccaccaccatcgccatcctgtgccacgagatcccccacgagatgggcgacttcgccgtgctgctgagcagcggcctgagcatgaagaccgccatcctgatgaacttcatcagcagcctgaccgccttcatgggcctgtacatcggcctgagcgtgagcgccgacccctgcgtgcaggactggatcttcaccgtgaccgccggcatgttcctgtacctgagcctggtggagatgctgcccgagatgacccacgtgcagacccagagaccctggatgatgttcctgctgcagaacttcggcctgatcctgggctggctgagcctgctgctgctggccatctacgagcagaacatcaagatctag

SEQ ID NO: 22335 - DNA, 1965 bp, Artificial Sequence
  Description of Artificial Sequence: Synthetic coding sequence
atgtgcttcagaaccaagctgagcgtgagctgggtgcccctgttcctgctgctgagcagagtgttcagcaccgagaccgacaagcccagcgcccaggacagcagaagcagaggcagcagcggccagcccgccgacctgctgcaggtgctgagcgccggcgaccaccccccccacaaccacagcagaagcctgatcaagaccctgctggagaagaccggctgccccagaagaagaaacggcatgcagggcgactgcaacctgtgcttcgagcccgacgccctgctgctgatcgccggcggcaacttcgaggaccagctgagagaggaggtggtgcagagagtgagcctgctgctgctgtactacatcatccaccaggaggagatctgcagcagcaagctgaacatgagcaacaaggagtacaagttctacctgcacagcctgctgagcctgagacaggacgaggacagcagcttcctgagccagaacgagaccgaggacatcctggccttcaccagacagtacttcgacaccagccagagccagtgcatggagaccaagaccctgcagaagaagagcggcatcgtgagcagcgagggcgccaacgagagcaccctgccccagctggccgccatgatcatcaccctgagcctgcagggcgtgtgcctgggccagggcaacctgcccagccccgactacttcaccgagtacatcttcagcagcctgaacagaaccaacaccctgagactgagcgagctggaccagctgctgaacaccctgtggaccagaagcacctgcatcaagaacgagaagatccaccagttccagagaaagcagaacaacatcatcacccacgaccaggactacagcaacttcagcagcagcatggagaaggagagcgaggacggccccgtgagctgggaccagacctgcttcagcgccagacagctggtggagatcttcctgcagaagggcctgagcctgatcagcaaggaggacttcaagcagatgagccccggcatcatccagcagctgctgagctgcagctgccacctgcccaaggaccagcaggccaagctgccccccaccaccctggagaagtacggctacagcaccgtggccgtgaccctgctgaccctgggcagcatgctgggcaccgccctggtgctgttccacagctgcgaggagaactacagactgatcctgcagctgttcgtgggcctggccgtgggcaccctgagcggcgacgccctgctgcacctgatcccccaggtgctgggcctgcacaagcaggaggcccccgagttcggccacttccacgagagcaagggccacatctggaagctgatgggcctgatcggcggcatccacggcttcttcctgatcgagaagtgcttcatcctgctggtgagccccaacgacaagaagagccccgaggacagccaggccgccgagatgcccatcggcagcatgaccgccagcaacagaaagtgcaaggccatcagcctgctggccatcatgatcctggtgggcgacagcctgcacaacttcgccgacggcctggccatcggcgccgccttcagcagcagcagcgagagcggcgtgaccaccaccatcgccatcctgtgccacgagatcccccacgagatgggcgacttcgccgtgctgctgagcagcggcctgagcatgaagaccgccatcctgatgaacttcatcagcagcctgaccgccttcatgggcctgtacatcggcctgagcgtgagcgccgacccctgcgtgcaggactggatcttcaccgtgaccgccggcatgttcctgtacctgagcctggtggagatgctgcccgagatgacccacgtgcagacccagagaccctggatgatgttcctgctgcagaacttcggcctgatcctgggctggctgagcctgctgctgctggccatctacgagcagaacatcaagatctag

SEQ ID NO: 22336 - DNA, 1836 bp, Artificial Sequence
  Description of Artificial Sequence: Synthetic coding sequence
atgcagggcgactgcaacctgtgcttcgagcccgacgccctgctgctgatcgccggcggcaacttcgaggaccagctgagagaggaggtggtgcagagagtgagcctgctgctgctgtactacatcatccaccaggaggagatctgcagcagcaagctgaacatgagcaacaaggagtacaagttctacctgcacagcctgctgagcctgagacaggacgaggacagcagcttcctgagccagaacgagaccgaggacatcctggccttcaccagacagtacttcgacaccagccagagccagtgcatggagaccaagaccctgcagaagaagagcggcatcgtgagcagcgagggcgccaacgagagcaccctgccccagctggccgccatgatcatcaccctgagcctgcagggcgtgtgcctgggccagggcaacctgcccagccccgactacttcaccgagtacatcttcagcagcctgaacagaaccaacaccctgagactgagcgagctggaccagctgctgaacaccctgtggaccagaagcacctgcatcaagaacgagaagatccaccagttccagagaaagcagaacaacatcatcacccacgaccaggactacagcaacttcagcagcagcatggagaaggagagcgaggacggccccgtgagctgggaccagacctgcttcagcgccagacagctggtggagatcttcctgcagaagggcctgagcctgatcagcaaggaggacttcaagcagatgagccccggcatcatccagcagctgctgagctgcagctgccacctgcccaaggaccagcaggccaagctgccccccaccaccctggagaagtacggctacagcaccgtggccgtgaccctgctgaccctgggcagcatgctgggcaccgccctggtgctgttccacagctgcgaggagaactacagactgatcctgcagctgttcgtgggcctggccgtgggcaccctgagcggcgacgccctgctgcacctgatcccccaggtgctgggcctgcacaagcaggaggcccccgagttcggccacttccacgagagcaagggccacatctggaagctgatgggcctgatcggcggcatccacggcttcttcctgatcgagaagtgcttcatcctgctggtgagccccaacgacaagcagggcctgagcctggtgaacggccacgtgggccacagccaccacctggccctgaacagcgagctgagcgaccaggccggcagaggcaagagcgccagcaccatccagctgaagagccccgaggacagccaggccgccgagatgcccatcggcagcatgaccgccagcaacagaaagtgcaaggccatcagcctgctggccatcatgatcctggtgggcgacagcctgcacaacttcgccgacggcctggccatcggcgccgccttcagcagcagcagcgagagcggcgtgaccaccaccatcgccatcctgtgccacgagatcccccacgagatgggcgacttcgccgtgctgctgagcagcggcctgagcatgaagaccgccatcctgatgaacttcatcagcagcctgaccgccttcatgggcctgtacatcggcctgagcgtgagcgccgacccctgcgtgcaggactggatcttcaccgtgaccgccggcatgttcctgtacctgagcctggtggagatgctgcccgagatgacccacgtgcagacccagagaccctggatgatgttcctgctgcagaacttcggcctgatcctgggctggctgagcctgctgctgctggccatctacgagcagaacatcaagatctag

SEQ ID NO: 22337 - DNA, 1674 bp, Artificial Sequence
  Description of Artificial Sequence: Synthetic coding sequence
atgagcaacaaggagtacaagttctacctgcacagcctgctgagcctgagacaggacgaggacagcagcttcctgagccagaacgagaccgaggacatcctggccttcaccagacagtacttcgacaccagccagagccagtgcatggagaccaagaccctgcagaagaagagcggcatcgtgagcagcgagggcgccaacgagagcaccctgccccagctggccgccatgatcatcaccctgagcctgcagggcgtgtgcctgggccagggcaacctgcccagccccgactacttcaccgagtacatcttcagcagcctgaacagaaccaacaccctgagactgagcgagctggaccagctgctgaacaccctgtggaccagaagcacctgcatcaagaacgagaagatccaccagttccagagaaagcagaacaacatcatcacccacgaccaggactacagcaacttcagcagcagcatggagaaggagagcgaggacggccccgtgagctgggaccagacctgcttcagcgccagacagctggtggagatcttcctgcagaagggcctgagcctgatcagcaaggaggacttcaagcagatgagccccggcatcatccagcagctgctgagctgcagctgccacctgcccaaggaccagcaggccaagctgccccccaccaccctggagaagtacggctacagcaccgtggccgtgaccctgctgaccctgggcagcatgctgggcaccgccctggtgctgttccacagctgcgaggagaactacagactgatcctgcagctgttcgtgggcctggccgtgggcaccctgagcggcgacgccctgctgcacctgatcccccaggtgctgggcctgcacaagcaggaggcccccgagttcggccacttccacgagagcaagggccacatctggaagctgatgggcctgatcggcggcatccacggcttcttcctgatcgagaagtgcttcatcctgctggtgagccccaacgacaagcagggcctgagcctggtgaacggccacgtgggccacagccaccacctggccctgaacagcgagctgagcgaccaggccggcagaggcaagagcgccagcaccatccagctgaagagccccgaggacagccaggccgccgagatgcccatcggcagcatgaccgccagcaacagaaagtgcaaggccatcagcctgctggccatcatgatcctggtgggcgacagcctgcacaacttcgccgacggcctggccatcggcgccgccttcagcagcagcagcgagagcggcgtgaccaccaccatcgccatcctgtgccacgagatcccccacgagatgggcgacttcgccgtgctgctgagcagcggcctgagcatgaagaccgccatcctgatgaacttcatcagcagcctgaccgccttcatgggcctgtacatcggcctgagcgtgagcgccgacccctgcgtgcaggactggatcttcaccgtgaccgccggcatgttcctgtacctgagcctggtggagatgctgcccgagatgacccacgtgcagacccagagaccctggatgatgttcctgctgcagaacttcggcctgatcctgggctggctgagcctgctgctgctggccatctacgagcagaacatcaagatctag

SEQ ID NO: 22338 - DNA, 1446 bp, Artificial Sequence
  Description of Artificial Sequence: Synthetic coding sequence
atgaagctgctgctgctgcaccccgccttccagagctgcctgctgctgaccctgctgggcctgtggagaaccacccccgaggcccacgccagcagcctgggcgcccccgccatcagcgccgccagcttcctgcaggacctgatccacagatacggcgagggcgacagcctgaccctgcagcagctgaaggccctgctgaaccacctggacgtgggcgtgggcagaggcaacgtgacccagcacgtgcagggccacagaaacctgagcacctgcttcagcagcggcgacctgttcaccgcccacaacttcagcgagcagagcagaatcggcagcagcgagctgcaggagttctgccccaccatcctgcagcagctggacagcagagcctgcaccagcgagaaccaggagaacgaggagaacgagcagaccgaggagggcagacccagcgccgtggaggtgtggggctacggcctgctgtgcgtgaccgtgatcagcctgtgcagcctgctgggcgccagcgtggtgcccttcatgaagaagaccttctacaagagactgctgctgtacttcatcgccctggccatcggcaccctgtacagcaacgccctgttccagctgatccccgaggccttcggcttcaaccccctggaggactactacgtgagcaagagcgccgtggtgttcggcggcttctacctgttcttcttcaccgagaagatcctgaagatcctgctgaagcagaagaacgagcaccaccacggccacagccactacgccagcgagagcctgcccagcaagaaggaccaggaggagggcgtgatggagaagctgcagaacggcgacctggaccacatgatcccccagcactgcagcagcgagctggacggcaaggcccccatggtggacgagaaggtgatcgtgggcagcctgagcgtgcaggacctgcaggccagccagagcgcctgctactggctgaagggcgtgagatacagcgacatcggcaccctggcctggatgatcaccctgagcgacggcctgcacaacttcatcgacggcctggccatcggcgccagcttcaccgtgagcgtgttccagggcatcagcaccagcgtggccatcctgtgcgaggagttcccccacgagctgggcgacttcgtgatcctgctgaacgccggcatgagcatccagcaggccctgttcttcaacttcctgagcgcctgctgctgctacctgggcctggccttcggcatcctggccggcagccacttcagcgccaactggatcttcgccctggccggcggcatgttcctgtacatcagcctggccgacatgatggagttctgcagcgtggcccaggccggcgtgcagtggtgccacctgagcagcctgcagcccctgcccctgggcctgaagagactgagctgcctgagcctgcccagcaactag

SEQ ID NO: 22339 - DNA, 1479 bp, Artificial Sequence
  Description of Artificial Sequence: Synthetic coding sequence
atgaagctgctgctgctgcaccccgccttccagagctgcctgctgctgaccctgctgggcctgtggagaaccacccccgaggcccacgccagcagcctgggcgcccccgccatcagcgccgccagcttcctgcaggacctgatccacagatacggcgagggcgacagcctgaccctgcagcagctgaaggccctgctgaaccacctggacgtgggcgtgggcagaggcaacgtgacccagcacgtgcagggccacagaaacctgagcacctgcttcagcagcggcgacctgttcaccgcccacaacttcagcgagcagagcagaatcggcagcagcgagctgcaggagttctgccccaccatcctgcagcagctggacagcagagcctgcaccagcgagaaccaggagaacgaggagaacgagcagaccgaggagggcagacccagcgccgtggaggtgtggggctacggcctgctgtgcgtgaccgtgatcagcctgtgcagcctgctgggcgccagcgtggtgcccttcatgaagaagaccttctacaagagactgctgctgtacttcatcgccctggccatcggcaccctgtacagcaacgccctgttccagctgatccccgaggccttcggcttcaaccccctggaggactactacgtgagcaagagcgccgtggtgttcggcggcttctacctgttcttcttcaccgagaagatcctgaagatcctgctgaagcagaagaacgagcaccaccacggccacagccactacgccagcgagagcctgcccagcaagaaggaccaggaggagggcgtgatggagaagctgcagaacggcgacctggaccacatgatcccccagcactgcagcagcgagctggacggcaaggcccccatggtggacgagaaggtgatcgtgggcagcctgagcgtgcaggacctgcaggccagccagagcgcctgctactggctgaagggcgtgagatacagcgacatcggcaccctggcctggatgatcaccctgagcgacggcctgcacaacttcatcgacggcctggccatcggcgccagcttcaccgtgagcgtgttccagggcatcagcaccagcgtggccatcctgtgcgaggagttcccccacgagctgggcgacttcgtgatcctgctgaacgccggcatgagcatccagcaggccctgttcttcaacttcctgagcgcctgctgctgctacctgggcctggccttcggcatcctggccggcagccacttcagcgccaactggatcttcgccctggccggcggcatgttcctgtacatcagcctggccgacatgttccccgagatgaacgaggtgtgccaggaggacgagagaaagggcagcatcctgatccccttcatcatccagaacctgggcctgctgaccggcttcaccatcatggtggtgctgaccatgtacagcggccagatccagatcggctag

SEQ ID NO: 22340 - DNA, 1479 bp, Artificial Sequence
  Description of Artificial Sequence: Synthetic coding sequence
atgaagctgctgctgctgcaccccgccttccagagctgcctgctgctgaccctgctgggcctgtggagaaccacccccgaggcccacgccagcagcctgggcgcccccgccatcagcgccgccagcttcctgcaggacctgatccacagatacggcgagggcgacagcctgaccctgcagcagctgaaggccctgctgaaccacctggacgtgggcgtgggcagaggcaacgtgacccagcacgtgcagggccacagaaacctgagcacctgcttcagcagcggcgacctgttcaccgcccacaacttcagcgagcagagcagaatcggcagcagcgagctgcaggagttctgccccaccatcctgcagcagctggacagcagagcctgcaccagcgagaaccaggagaacgaggagaacgagcagaccgaggagggcagacccagcgccgtggaggtgtggggcttcggcttcctgagcgtgagcctgatcaacctggccagcctgctgggcgtgctggtgctgccctgcaccgagaaggccttcttcagcagagtgctgacctacttcatcgccctgagcatcggcaccctgctgagcaacgccctgttccagctgatccccgaggccttcggcttcaaccccctggaggactactacgtgagcaagagcgccgtggtgttcggcggcttctacctgttcttcttcaccgagaagatcctgaagatcctgctgaagcagaagaacgagcaccaccacggccacagccactacgccagcgagagcctgcccagcaagaaggaccaggaggagggcgtgatggagaagctgcagaacggcgacctggaccacatgatcccccagcactgcagcagcgagctggacggcaaggcccccatggtggacgagaaggtgatcgtgggcagcctgagcgtgcaggacctgcaggccagccagagcgcctgctactggctgaagggcgtgagatacagcgacatcggcaccctggcctggatgatcaccctgagcgacggcctgcacaacttcatcgacggcctggccatcggcgccagcttcaccgtgagcgtgttccagggcatcagcaccagcgtggccatcctgtgcgaggagttcccccacgagctgggcgacttcgtgatcctgctgaacgccggcatgagcatccagcaggccctgttcttcaacttcctgagcgcctgctgctgctacctgggcctggccttcggcatcctggccggcagccacttcagcgccaactggatcttcgccctggccggcggcatgttcctgtacatcagcctggccgacatgttccccgagatgaacgaggtgtgccaggaggacgagagaaagggcagcatcctgatccccttcatcatccagaacctgggcctgctgaccggcttcaccatcatggtggtgctgaccatgtacagcggccagatccagatcggctag

SEQ ID NO: 22341 - DNA, 1479 bp, Artificial Sequence; identical to SEQ ID NO: 22339
  Description of Artificial Sequence: Synthetic coding sequence

SEQ ID NO: 22342 - DNA, 1383 bp, Artificial Sequence
  Description of Artificial Sequence: Synthetic coding sequence
atggcccccggcagagccgtggccggcctgctgctgctggccgccgccggcctgggcggcgtggccgagggccccggcctggccttcagcgaggacgtgctgagcgtgttcggcgccaacctgagcctgagcgccgcccagctgcagcacctgctggagcagatgggcgccgccagcagagtgggcgtgcccgagcccggccagctgcacttcaaccagtgcctgaccgccgaggagatcttcagcctgcacggcttcagcaacgccacccagatcaccagcagcaagttcagcgtgatctgccccgccgtgctgcagcagctgaacttccacccctgcgaggacagacccaagcacaagaccagacccagccacagcgaggtgtggggctacggcttcctgagcgtgaccatcatcaacctggccagcctgctgggcctgatcctgacccccctgatcaagaagagctacttccccaagatcctgaccttcttcgtgggcctggccatcggcaccctgttcagcaacgccatcttccagctgatccccgaggccttcggcttcgaccccaaggtggacagctacgtggagaaggccgtggccgtgttcggcggcttctacctgctgttcttcttcgagagaatgctgaagatgctgctgaagacctacggccagaacggccacacccacttcggcaacgacaacttcggcccccaggagaagacccaccagcccaaggccctgcccgccatcaacggcgtgacctgctacgccaaccccgccgtgaccgaggccaacggccacatccacttcgacaacgtgagcgtggtgagcctgcaggacggcaagaaggagcccagcagctgcacctgcctgaagggccccaagctgagcgagatcggcaccatcgcctggatgatcaccctgtgcgacgccctgcacaacttcatcgacggcctggccatcggcgccagctgcaccctgagcctgctgcagggcctgagcaccagcatcgccatcctgtgcgaggagttcccccacgagctgggcgacttcgtgatcctgctgaacgccggcatgagcaccagacaggccctgctgttcaacttcctgagcgcctgcagctgctacgtgggcctggccttcggcatcctggtgggcaacaacttcgcccccaacatcatcttcgccctggccggcggcatgttcctgtacatcagcctggccgacatgttccccgagatgaacgacatgctgagagagaaggtgaccggcagaaagaccgacttcaccttcttcatgatccagaacgccggcatgctgaccggcttcaccgccatcctgctgatcaccctgtacgccggcgagatcgagctggagtag

SEQ ID NO: 22343 - DNA, 1383 bp, Artificial Sequence; identical to SEQ ID NO: 22342
  Description of Artificial Sequence: Synthetic coding sequence

SEQ ID NO: 22344 - DNA, 1335 bp, Artificial Sequence
  Description of Artificial Sequence: Synthetic coding sequence
atggcccccggcagagccgtggccggcctgctgctgctggccgccgccggcctgggcggcgtggccgagggccccggcctggccttcagcgaggacgtgctgagcgtgttcggcgccaacctgagcctgagcgccgcccagctgcagcacctgctggagcagatgggcgccgccagcagagtgggcgtgcccgagcccggccagctgcacttcaaccagtgcctgaccgccgaggagatcttcagcctgcacggcttcagcaacgccacccagatcaccagcagcaagttcagcgtgatctgccccgccgtgctgcagcagctgaacttccacccctgcgaggacagacccaagcacaagaccagacccagccacagcgaggtgtggggctacggcttcctgagcgtgaccatcatcaacctggccagcctgctgggcctgatcctgacccccctgatcaagaagagctacttccccaagatcctgaccttcttcgtgggcctggccatcggcaccctgttcagcaacgccatcttccagctgatccccgaggccttcggcttcgaccccaaggtggacagctacgtggagaaggccgtggccgtgttcggcggcttctacctgctgttcttcttcgagagaatgctgaagatgctgctgaagacctacggccagaacggccacacccacttcggcaacgacaacttcggcccccaggagaagacccaccagcccaaggccctgcccgccatcaacggcgtgacctgctacgccaaccccgccgtgaccgaggccaacggccacatccacttcgacaacgtgagcgtggtgagcctgcaggacggcaagaaggagcccagcagctgcacctgcctgaagggccccaagctgagcgagatcggcaccatcgcctggatgatcaccctgtgcgacgccctgcacaacttcatcgacggcctggccatcggcgccagctgcaccctgagcctgctgcagggcctgagcaccagcatcgccatcctgtgcgaggagttcccccacgagctgggcgacttcgtgatcctgctgaacgccggcatgagcaccagacaggccctgctgttcaacttcctgagcgcctgcagctgctacgtgggcctggccttcggcatcctggtgggcaacaacttcgcccccaacatcatcttcgccctggccggcggcatgttcctgtacatcagcctggccgacatgttccccgagatgaacgacatgctgagagagaagatcatcaagtgggccaccgacgacatcaagagccagctgcacctgctgtggatctacaccgccagatag

SEQ ID NO: 22345 - DNA, 924 bp, Artificial Sequence
  Description of Artificial Sequence: Synthetic coding sequence
atggacgacttcatcagcatcagcctgctgagcctggccatgctggtgggctgctacgtggccggcatcatccccctggccgtgaacttcagcgaggagagactgaagctggtgaccgtgctgggcgccggcctgctgtgcggcaccgccctggccgtgatcgtgcccgagggcgtgcacgccctgtacgaggacatcctggagggcaagcaccaccaggccagcgagacccacaacgtgatcgccagcgacaaggccgccgagaagagcgtggtgcacgagcacgagcacagccacgaccacacccagctgcacgcctacatcggcgtgagcctggtgctgggcttcgtgttcatgctgctggtggaccagatcggcaacagccacgtgcacagcaccgacgaccccgaggccgccagaagcagcaacagcaagatcaccaccaccctgggcctggtggtgcacgccgccgccgacggcgtggccctgggcgccgccgccagcaccagccagaccagcgtgcagctgatcgtgttcgtggccatcatgctgcacaaggcccccgccgccttcggcctggtgagcttcctgatgcacgccggcctggagagaaacagaatcagaaagcacctgctggtgttcgccctggccgcccccgtgatgagcatggtgacctacctgggcctgagcaagagcagcaaggaggccctgagcgaggtgaacgccaccggcgtggccatgctgttcagcgccggcaccttcctgtacgtggccaccgtgcacgtgctgcccgaggtgggcggcatcggccacagccacaagcccgacgccaccggcggcagaggcctgagcagactggaggtggccgccctggtgctgggctgcctgatccccctgatcctgagcgtgggccaccagcactag

SEQ ID NO: 22346 - DNA, 924 bp, Artificial Sequence; identical to SEQ ID NO: 22345
  Description of Artificial Sequence: Synthetic coding sequence

SEQ ID NO: 22347 - DNA, 2691 bp, Artificial Sequence
  Description of Artificial Sequence: Synthetic coding sequence
atggagatgaagctgcccggccaggagggcttcgaggccagcagcgcccccagaaacatccccagcggcgagctggacagcaaccccgaccccggcaccggccccagccccgacggccccagcgacaccgagagcaaggagctgggcgtgcccaaggaccccctgctgttcatccagctgaacgagctgctgggctggccccaggccctggagtggagagagaccggcagatgggtgctgttcgaggagaagctggaggtggccgccggcagatggagcgccccccacgtgcccaccctggccctgcccagcctgcagaagctgagaagcctgctggccgagggcctggtgctgctggactgccccgcccagagcctgctggagctggtggagcaggtgaccagagtggagagcctgagccccgagctgagaggccagctgcaggccctgctgctgcagagaccccagcactacaaccagaccaccggcaccagaccctgctggggcagcacccaccccagaaaggccagcgacaacgaggaggcccccctgagagagcagtgccagaaccccctgagacagaagctgccccccggcgccgaggccggcaccgtgctggccggcgagctgggcttcctggcccagcccctgggcgccttcgtgagactgagaaaccccgtggtgctgggcagcctgaccgaggtgagcctgcccagcagattcttctgcctgctgctgggcccctgcatgctgggcaagggctaccacgagatgggcagagccgccgccgtgctgctgagcgacccccagttccagtggagcgtgagaagagccagcaacctgcacgacctgctggccgccctggacgccttcctggaggaggtgaccgtgctgccccccggcagatgggaccccaccgccagaatccccccccccaagtgcctgcccagccagcacaagagactgcccagccagcagagagagatcagaggccccgccgtgcccagactgaccagcgccgaggacagacacagacacggcccccacgcccacagccccgagctgcagagaaccggcagactgttcggcggcctgatccaggacgtgagaagaaaggtgccctggtaccccagcgacttcctggacgccctgcacctgcagtgcttcagcgccgtgctgtacatctacctggccaccgtgaccaacgccatcaccttcggcggcctgctgggcgacgccaccgacggcgcccagggcgtgctggagagcttcctgggcaccgccgtggccggcgccgccttctgcctgatggccggccagcccctgaccatcctgagcagcaccggccccgtgctggtgttcgagagactgctgttcagcttcagcagagactacagcctggactacctgcccttcagactgtgggtgggcatctgggtggccaccttctgcctggtgctggtggccaccgaggccagcgtgctggtgagatacttcaccagattcaccgaggagggcttctgcgccctgatcagcctgatcttcatctacgacgccgtgggcaagatgctgaacctgacccacacctaccccatccagaagcccggcagcagcgcctacggctgcctgtgccagtaccccggccccggcggcaacgagagccagtggatcagaaccagacccaaggacagagacgacatcgtgagcatggtgagaaagggcctgagcgacttcagcagcgtgctggccatcctgctgggctgcggcctggacgccttcctgggcctggccacccccaagctgatggtgcccagagagttcaagcccaccctgcccggcagaggctggctggtgagccccttcggcgccaacccctggtggtggagcgtggccgccgccctgcccgccctgctgctgagcatcctgatcttcatggaccagcagatcaccgccgtgatcctgaacagaatggagtacagactgcagaagggcgccggcttccacctggacctgttctgcgtggccgtgctgatgctgctgaccagcgccctgggcctgccctggtacgtgagcgccaccgtgatcagcctggcccacatggacagcctgagaagagagagcagagcctgcgcccccggcgagagacccaacttcctgggcatcagagagcagagactgaccggcctggtggtgttcatcctgaccggcgccagcatcttcctggcccccgtgctgaagttcatccccatgcccgtgctgtacggcatcttcctgtacatgggcgtggccgccctgagcagcatccagttcaccaacagagtgaagctgctgctgatgcccgccaagcaccagcccgacctgctgctgctgagacacgtgcccctgaccagagtgcacctgttcaccgccatccagctggcctgcctgggcctgctgtggatcatcaagagcacccccgccgccatcatcttccccctgatgctgctgggcctggtgggcgtgagaaaggccctggagagagtgttcagcccccaggagctgctgtggctggacgagctgatgcccgaggaggagagaagcatccccgagaagggcctggagcccgagcacagcttcagcggcagcgacagcgaggacagcgagctgatgtaccagcccaaggcccccgagatcaacatcagcgtgaactag

SEQ ID NO: 22348 - DNA, 3780 bp, Artificial Sequence
  Description of Artificial Sequence: Synthetic coding sequence
atggccaacggcgtgatccccccccccggcggcgccagccccctgccccaggtgagagtgcccctggaggagccccccctgagccccgacgtggaggaggaggacgacgacctgggcaagaccctggccgtgagcagattcggcgacctgatcagcaagccccccgcctgggaccccgagaagcccagcagaagctacagcgagagagacttcgagttccacagacacaccagccaccacacccaccaccccctgagcgccagactgccccccccccacaagctgagaagactgccccccaccagcgccagacacaccagaagaaagagaaagaaggagaagaccagcgccccccccagcgagggcaccccccccatccaggaggagggcggcgccggcgtggacgaggaggaggaggaggaggaggaggaggagggcgagagcgaggccgagcccgtggagcccccccacagcggcaccccccagaaggccaagttcagcatcggcagcgacgaggacgacagccccggcctgcccggcagagccgccgtgaccaagcccctgcccagcgtgggcccccacaccgacaagagcccccagcacagcagcagaccctgcagcgagctgagagacggcgacggcaccaccgacctggccctgagcagccccagactgctgtgctgcctgcccagcagccccagccccagagccagagccagcagactggccggcgagaagagcagaccctggagccccagcgccagctacgacctgagagagagactgtgccccggcagcgccctgggcaaccccggcggccccgagcagcaggtgcccaccgacgaggccgaggcccagatgctgggcagcgccgacctggacgacatgaagagccacagactggaggacaaccccggcgtgagaagacacctggtgaagaagcccagcagaacccagggcggcagaggcagccccagcggcctggcccccatcctgagaagaaagaagaagaagaagaagctggacagaagaccccacgaggtgttcgtggagctgaacgagctgatgctggacagaagccaggagccccactggagagagaccgccagatggatcaagttcgaggaggacgtggaggaggagaccgagagatggggcaagccccacgtggccagcctgagcttcagaagcctgctggagctgagaagaaccatcgcccacggcgccgccctgctggacctggagcagaccaccctgcccggcatcgcccacctggtggtggagaccatgatcgtgagcgaccagatcagacccgaggacagagccagcgtgctgagaaccctgctgctgaagcacagccaccccaacgacgacaaggacagcggcttcttccccagaaaccccagcagcagcagcatgaacagcgtgctgggcaaccaccaccccacccccagccacggccccgacggcgccgtgcccaccatggccgacgacctgggcgagcccgcccccctgtggccccacgaccccgacgccaaggagaagcccctgcacatgcccggcggcgacggccacagaggcaagagcctgaagctgctggagaagatccccgaggacgccgaggccaccgtggtgctggtgggctgcgtgcccttcctggagcagcccgccgccgccttcgtgagactgaacgaggccgtgctgctggagagcgtgctggaggtgcccgtgcccgtgagattcctgttcgtgatgctgggccccagccacaccagcaccgactaccacgagctgggcagaagcatcgccaccctgatgagcgacaagctgttccacgaggccgcctaccaggccgacgacagacaggacctgctgagcgccatcagcgagttcctggacggcagcatcgtgatcccccccagcgaggtggagggcagagacctgctgagaagcgtggccgccttccagagagagctgctgagaaagagaagagagagagagcagaccaaggtggagatgaccaccagaggcggctacaccgcccccggcaaggagctgagcctggagctgggcggcagcgaggccacccccgaggacgaccccctgctgagaaccggcagcgtgttcggcggcctggtgagagacgtgagaagaagatacccccactaccccagcgacctgagagacgccctgcacagccagtgcgtggccgccgtgctgttcatctacttcgccgccctgagccccgccatcaccttcggcggcctgctgggcgagaagaccgagggcctgatgggcgtgagcgagctgatcgtgagcaccgccgtgctgggcgtgctgttcagcctgctgggcgcccagcccctgctggtggtgggcttcagcggccccctgctggtgttcgaggaggccttcttcaagttctgcagagcccaggacctggagtacctgaccggcagagtgtgggtgggcctgtggctggtggtgttcgtgctggccctggtggccgccgagggcagcttcctggtgagatacatcagccccttcacccaggagatcttcgccttcctgatcagcctgatcttcatctacgagaccttctacaagctgtacaaggtgttcaccgagcaccccctgctgcccttctacccccccgagggcgccctggagggcagcctggacgccggcctggagcccaacggcagcgccctgccccccaccgagggcccccccagccccagaaaccagcccaacaccgccctgctgagcctgatcctgatgctgggcaccttcttcatcgccttcttcctgagaaagttcagaaacagcagattcctgggcggcaaggccagaagaatcatcggcgacttcggcatccccatcagcatcctggtgatggtgctggtggactacagcatcaccgacacctacacccagaagctgaccgtgcccaccggcctgagcgtgaccagccccgacaagagaagctggttcatcccccccctgggcagcgccagacccttccccccctggatgatggtggccgccgccgtgcccgccctgctggtgctgatcctgatcttcatggagacccagatcaccgccctgatcgtgagccagaaggccagaagactgctgaagggcagcggcttccacctggacctgctgctgatcggcagcctgggcggcctgtgcggcctgttcggcctgccctggctgaccgccgccaccgtgagaagcgtgacccacgtgaacgccctgaccgtgatgagaaccgccatcgcccccggcgacaagccccagatccaggaggtgagagagcagagagtgaccggcgtgctgatcgccagcctggtgggcctgagcatcgtgatgggcgccgtgctgagaagaatccccctggccgtgctgttcggcatcttcctgtacatgggcgtgaccagcctgagcggcatccagctgagccagagactgctgctgatcctgatgcccgccaagcaccaccccgagcagccctacgtgaccaaggtgaagacctggagaatgcacctgttcacctgcatccagctgggctgcatcgccctgctgtgggtggtgaagagcaccgccgccagcctggccttccccttcctgctgctgctgaccgtgcccctgagacactgcctgctgcccagactgttccaggacagagagctgcaggccctggacagcgaggacgccgagcccaacttcgacgaggacggccaggacgagtacaacgagctgcacatgcccgtgtag

SEQ ID NO: 22349 - DNA, 3699 bp, Artificial Sequence
  Description of Artificial Sequence: Synthetic coding sequence
atggccaacggcgtgatccccccccccggcggcgccagccccctgccccaggtgagagtgcccctggaggagccccccctgagccccgacgtggaggaggaggacgacgacctgggcaagaccctggccgtgagcagattcggcgacctgatcagcaagccccccgcctgggaccccgagaagcccagcagaagctacagcgagagagacttcgagttccacagacacaccagccaccacacccaccaccccctgagcgccagactgccccccccccacaagctgagaagactgccccccaccagcgccagacacaccagaagaaagagaaagaaggagaagaccagcgccccccccagcgagggcaccccccccatccaggaggagggcggcgccggcgtggacgaggaggaggaggaggaggaggaggaggagggcgagagcgaggccgagcccgtggagcccccccacagcggcaccccccagaaggccaagttcagcatcggcagcgacgaggacgacagccccggcctgcccggcagagccgccgtgaccaagcccctgcccagcgtgggcccccacaccgacaagagcccccagcacagcagcagcagccccagccccagagccagagccagcagactggccggcgagaagagcagaccctggagccccagcgccagctacgacctgagagagagactgtgccccggcagcgccctgggcaaccccggcggccccgagcagcaggtgcccaccgacgaggccgaggcccagatgctgggcagcgccgacctggacgacatgaagagccacagactggaggacaaccccggcgtgagaagacacctggtgaagaagcccagcagaacccagggcggcagaggcagccccagcggcctggcccccatcctgagaagaaagaagaagaagaagaagctggacagaagaccccacgaggtgttcgtggagctgaacgagctgatgctggacagaagccaggagccccactggagagagaccgccagatggatcaagttcgaggaggacgtggaggaggagaccgagagatggggcaagccccacgtggccagcctgagcttcagaagcctgctggagctgagaagaaccatcgcccacggcgccgccctgctggacctggagcagaccaccctgcccggcatcgcccacctggtggtggagaccatgatcgtgagcgaccagatcagacccgaggacagagccagcgtgctgagaaccctgctgctgaagcacagccaccccaacgacgacaaggacagcggcttcttccccagaaaccccagcagcagcagcatgaacagcgtgctgggcaaccaccaccccacccccagccacggccccgacggcgccgtgcccaccatggccgacgacctgggcgagcccgcccccctgtggccccacgaccccgacgccaaggagaagcccctgcacatgcccggcggcgacggccacagaggcaagagcctgaagctgctggagaagatccccgaggacgccgaggccaccgtggtgctggtgggctgcgtgcccttcctggagcagcccgccgccgccttcgtgagactgaacgaggccgtgctgctggagagcgtgctggaggtgcccgtgcccgtgagattcctgttcgtgatgctgggccccagccacaccagcaccgactaccacgagctgggcagaagcatcgccaccctgatgagcgacaagctgttccacgaggccgcctaccaggccgacgacagacaggacctgctgagcgccatcagcgagttcctggacggcagcatcgtgatcccccccagcgaggtggagggcagagacctgctgagaagcgtggccgccttccagagagagctgctgagaaagagaagagagagagagcagaccaaggtggagatgaccaccagaggcggctacaccgcccccggcaaggagctgagcctggagctgggcggcagcgaggccacccccgaggacgaccccctgctgagaaccggcagcgtgttcggcggcctggtgagagacgtgagaagaagatacccccactaccccagcgacctgagagacgccctgcacagccagtgcgtggccgccgtgctgttcatctacttcgccgccctgagccccgccatcaccttcggcggcctgctgggcgagaagaccgagggcctgatgggcgtgagcgagctgatcgtgagcaccgccgtgctgggcgtgctgttcagcctgctgggcgcccagcccctgctggtggtgggcttcagcggccccctgctggtgttcgaggaggccttcttcaagttctgcagagcccaggacctggagtacctgaccggcagagtgtgggtgggcctgtggctggtggtgttcgtgctggccctggtggccgccgagggcagcttcctggtgagatacatcagccccttcacccaggagatcttcgccttcctgatcagcctgatcttcatctacgagaccttctacaagctgtacaaggtgttcaccgagcaccccctgctgcccttctacccccccgagggcgccctggagggcagcctggacgccggcctggagcccaacggcagcgccctgccccccaccgagggcccccccagccccagaaaccagcccaacaccgccctgctgagcctgatcctgatgctgggcaccttcttcatcgccttcttcctgagaaagttcagaaacagcagattcctgggcggcaaggccagaagaatcatcggcgacttcggcatccccatcagcatcctggtgatggtgctggtggactacagcatcaccgacacctacacccagaagctgaccgtgcccaccggcctgagcgtgaccagccccgacaagagaagctggttcatcccccccctgggcagcgccagacccttccccccctggatgatggtggccgccgccgtgcccgccctgctggtgctgatcctgatcttcatggagacccagatcaccgccctgatcgtgagccagaaggccagaagactgctgaagggcagcggcttccacctggacctgctgctgatcggcagcctgggcggcctgtgcggcctgttcggcctgccctggctgaccgccgccaccgtgagaagcgtgacccacgtgaacgccctgaccgtgatgagaaccgccatcgcccccggcgacaagccccagatccaggaggtgagagagcagagagtgaccggcgtgctgatcgccagcctggtgggcctgagcatcgtgatgggcgccgtgctgagaagaatccccctggccgtgctgttcggcatcttcctgtacatgggcgtgaccagcctgagcggcatccagctgagccagagactgctgctgatcctgatgcccgccaagcaccaccccgagcagccctacgtgaccaaggtgaagacctggagaatgcacctgttcacctgcatccagctgggctgcatcgccctgctgtgggtggtgaagagcaccgccgccagcctggccttccccttcctgctgctgctgaccgtgcccctgagacactgcctgctgcccagactgttccaggacagagagctgcaggccctggacagcgaggacgccgagcccaacttcgacgaggacggccaggacgagtacaacgagctgcacatgcccgtgtag

SEQ ID NO: 22350 - DNA, 1203 bp, Artificial Sequence
  Description of Artificial Sequence: Synthetic coding sequence
atgggcgtgagcgagctgatcgtgagcaccgccgtgctgggcgtgctgttcagcctgctgggcgcccagcccctgctggtggtgggcttcagcggccccctgctggtgttcgaggaggccttcttcaagttctgcagagcccaggacctggagtacctgaccggcagagtgtgggtgggcctgtggctggtggtgttcgtgctggccctggtggccgccgagggcagcttcctggtgagatacatcagccccttcacccaggagatcttcgccttcctgatcagcctgatcttcatctacgagaccttctacaagctgtacaaggtgttcaccgagcaccccctgctgcccttctacccccccgagcccggcggcgtgcccggctgctggagcggcgccaagtggcagctgccccccaccgagggcccccccagccccagaaaccagcccaacaccgccctgctgagcctgatcctgatgctgggcaccttcttcatcgccttcttcctgagaaagttcagaaacagcagattcctgggcggcaaggccagaagaatcatcggcgacttcggcatccccatcagcatcctggtgatggtgctggtggactacagcatcaccgacacctacacccagaagctgaccgtgcccaccggcctgagcgtgaccagccccgacaagagaagctggttcatcccccccctgggcagcgccagacccttccccccctggatgatggtggccgccgccgtgcccgccctgctggtgctgatcctgatcttcatggagacccagatcaccgccctgatcgtgagccagaaggccagaagactgctgaagggcagcggcttccacctggacctgctgctgatcggcagcctgggcggcctgtgcggcctgttcggcctgccctggctgaccgccgccaccgtgagaagcgtgacccacgtgaacgccctgaccgtgatgagaaccgccatcgcccccggcgacaagccccagatccaggaggtgagagagcagagagtgaccggcgtgctgatcgccagcctggtgggcctgagcatcgtgatgggcgccgtgctgagaagaatccccctggccgtgctgttcggcatcttcctgtacatgggcgtgaccagcctgagcggcatccagctgagccagagactgctgctgatcctgatgcccgccaagcactag

SEQ ID NO: 22351 - DNA, 3699 bp, Artificial Sequence; identical to SEQ ID NO: 22349
  Description of Artificial Sequence: Synthetic coding sequence

SEQ ID NO: 22352 - DNA, 3699 bp, Artificial Sequence; identical to SEQ ID NO: 22349
  Description of Artificial Sequence: Synthetic coding sequence

SEQ ID NO: 22353 - DNA, 3780 bp, Artificial Sequence; identical to SEQ ID NO: 22348
  Description of Artificial Sequence: Synthetic coding sequence

SEQ ID NO: 22354 - DNA, 684 bp, Artificial Sequence
  Description of Artificial Sequence: Synthetic coding sequence
atgaccagccccctggagaaggaccccgagcccaacggcgccctgagccccggccccggcgacaccaacagctggggcttcggcagagaccccgcccccagccccagagacagcctggcccccgaggacctggagatgttcgtgctggacttcgaggacggcgacctgtgggagagcatcagaggccagctgggccccatggccggcccccccacctgccacagactggaggacaaccccggcgtgagaagacacctggtgaagaagcccagcagaacccagggcggcagaggcagccccagcggcctggcccccatcctgagaagaaagaagaagaagaagaagctggacagaagaccccacgaggtgttcgtggagctgaacgagctgatgctggacagaagccaggagccccactggagagagaccgccagatggatcaagttcgaggaggacgtggaggaggagaccgagagatggggcaagccccacgtggccagcctgagcttcagaagcctgctggagctgagaagaaccatcgcccacggcgccgccctgctggacctggagcagaccaccctgcccggcatcgcccacctggtggtggagaccatgatcgtgagcgaccagatcagacccgaggacagagccagcgtgctgagaaccctgctgctgaagcactag

SEQ ID NO: 22355 - DNA, 627 bp, Artificial Sequence
  Description of Artificial Sequence: Synthetic coding sequence
atgaagctgctgcccagcgtggtgctgaagctgttcctggccgccgtgctgagcgccctggtgaccggcgagagcctggagagactgagaagaggcctggccgccggcaccagcaaccccgacccccccaccgtgagcaccgaccagctgctgcccctgggcggcggcagagacagaaaggtgagagacctgcaggaggccgacctggacctgctgagagtgaccctgagcagcaagccccaggccctggccacccccaacaaggaggagcacggcaagagaaagaagaagggcaagggcctgggcaagaagagagacccctgcctgagaaagtacaaggacttctgcatccacggcgagtgcaagtacgtgaaggagctgagagcccccagctgcatctgccaccccggctaccacggcgagagatgccacggcctgagcctgcccgtggagaacagactgtacacctacgaccacaccaccatcctggccgtggtggccgtggtgctgagcagcgtgtgcctgctggtgatcgtgggcctgctgatgttcagataccacagaagaggcggctacgacgtggagaacgaggagaaggtgaagctgggcatgaccaacagccactag

SEQ ID NO: 22356 - DNA, 2838 bp, Artificial Sequence
  Description of Artificial Sequence: Synthetic coding sequence
atggagatgaagctgcccggccaggagggcttcgaggccagcagcgcccccagaaacatccccagcggcgagctggacagcaaccccgaccccggcaccggccccagccccgacggccccagcgacaccgagagcaaggagctgggcgtgcccaaggaccccctgctgttcatccagctgaacgagctgctgggctggccccaggccctggagtggagagagaccggcagatgggtgctgttcgaggagaagctggaggtggccgccggcagatggagcgccccccacgtgcccaccctggccctgcccagcctgcagaagctgagaagcctgctggccgagggcctggtgctgctggactgccccgcccagagcctgctggagctggtggagcaggtgaccagagtggagagcctgagccccgagctgagaggccagctgcaggccctgctgctgcagagaccccagcactacaaccagaccaccggcaccagaccctgctggggcagcacccaccccagaaaggccagcgacaacgaggaggcccccctgagagagcagtgccagaaccccctgagacagaagctgccccccggcgccgaggccggcaccgtgctggccggcgagctgggcttcctggcccagcccctgggcgccttcgtgagactgagaaaccccgtggtgctgggcagcctgaccgaggtgagcctgcccagcagattcttctgcctgctgctgggcccctgcatgctgggcaagggctaccacgagatgggcagagccgccgccgtgctgctgagcgacccccagttccagtggagcgtgagaagagccagcaacctgcacgacctgctggccgccctggacgccttcctggaggaggtgaccgtgctgccccccggcagatgggaccccaccgccagaatccccccccccaagtgcctgcccagccagcacaagagactgcccagccagcagagagagatcagaggccccgccgtgcccagactgaccagcgccgaggacagacacagacacggcccccacgcccacagccccgagctgcagagaaccggcagaaaggtgccctggtaccccagcgacttcctggacgccctgcacctgcagtgcttcagcgccgtgctgtacatctacctggccaccgtgaccaacgccatcaccttcggcggcctgctgggcgacgccaccgacggcgcccagggcgtgctggagagcttcctgggcaccgccgtggccggcgccgccttctgcctgatggccggccagcccctgaccatcctgagcagcaccggccccgtgctggtgttcgagagactgctgttcagcttcagcagagactacagcctggactacctgcccttcagactgtgggtgggcatctgggtggccaccttctgcctggtgctggtggccaccgaggccagcgtgctggtgagatacttcaccagattcaccgaggagggcttctgcgccctgatcagcctgatcttcatctacgacgccgtgggcaagatgctgaacctgacccacacctaccccatccagaagcccggcagcagcgcctacggctgcctgtgccagtaccccggccccggcggcaacgagagccagtggatcagaaccagacccaaggacagagacgacatcgacctgggcctgatcaacgccagcctgctgcccccccccgagtgcaccagacagggcggccaccccagaggccccggctgccacaccgtgcccgacatcgccttcttcagcctgctgctgttcctgaccagcttcttcttcgccatggccctgaagtgcgtgaagaccagcagattcttccccagcgtggtgagaaagggcctgagcgacttcagcagcgtgctggccatcctgctgggctgcggcctggacgccttcctgggcctggccacccccaagctgatggtgcccagagagttcaagcccaccctgcccggcagaggctggctggtgagccccttcggcgccaacccctggtggtggagcgtggccgccgccctgcccgccctgctgctgagcatcctgatcttcatggaccagcagatcaccgccgtgatcctgaacagaatggagtacagactgcagaagggcgccggcttccacctggacctgttctgcgtggccgtgctgatgctgctgaccagcgccctgggcctgccctggtacgtgagcgccaccgtgatcagcctggcccacatggacagcctgagaagagagagcagagcctgcgcccccggcgagagacccaacttcctgggcatcagagagcagagactgaccggcctggtggtgttcatcctgaccggcgccagcatcttcctggcccccgtgctgaagttcatccccatgcccgtgctgtacggcatcttcctgtacatgggcgtggccgccctgagcagcatccagttcaccaacagagtgaagctgctgctgatgcccgccaagcaccagcccgacctgctgctgctgagacacgtgcccctgaccagagtgcacctgttcaccgccatccagctggcctgcctgggcctgctgtggatcatcaagagcacccccgccgccatcatcttccccctgatgctgctgggcctggtgggcgtgagaaaggccctggagagagtgttcagcccccaggagctgctgtggctggacgagctgatgcccgaggaggagagaagcatccccgagaagggcctggagcccgagcacagcttcagcggcagcgacagcgaggacagcgagctgatgtaccagcccaaggcccccgagatcaacatcagcgtgaactag

SEQ ID NO: 22357 - DNA, 2880 bp, Artificial Sequence
  Description of Artificial Sequence: Synthetic coding sequence
atggagatgaagctgcccggccaggagggcttcgaggccagcagcgcccccagaaacatccccagcggcgagctggacagcaaccccgaccccggcaccggccccagccccgacggccccagcgacaccgagagcaaggagctgggcgtgcccaaggaccccctgctgttcatccagctgaacgagctgctgggctggccccaggccctggagtggagagagaccggcagatgggtgctgttcgaggagaagctggaggtggccgccggcagatggagcgccccccacgtgcccaccctggccctgcccagcctgcagaagctgagaagcctgctggccgagggcctggtgctgctggactgccccgcccagagcctgctggagctggtggagcaggtgaccagagtggagagcctgagccccgagctgagaggccagctgcaggccctgctgctgcagagaccccagcactacaaccagaccaccggcaccagaccctgctggggcagcacccaccccagaaaggccagcgacaacgaggaggcccccctgagagagcagtgccagaaccccctgagacagaagctgccccccggcgccgaggccggcaccgtgctggccggcgagctgggcttcctggcccagcccctgggcgccttcgtgagactgagaaaccccgtggtgctgggcagcctgaccgaggtgagcctgcccagcagattcttctgcctgctgctgggcccctgcatgctgggcaagggctaccacgagatgggcagagccgccgccgtgctgctgagcgacccccagttccagtggagcgtgagaagagccagcaacctgcacgacctgctggccgccctggacgccttcctggaggaggtgaccgtgctgccccccggcagatgggaccccaccgccagaatccccccccccaagtgcctgcccagccagcacaagagactgcccagccagcagagagagatcagaggccccgccgtgcccagactgaccagcgccgaggacagacacagacacggcccccacgcccacagccccgagctgcagagaaccggcagactgttcggcggcctgatccaggacgtgagaagaaaggtgccctggtaccccagcgacttcctggacgccctgcacctgcagtgcttcagcgccgtgctgtacatctacctggccaccgtgaccaacgccatcaccttcggcggcctgctgggcgacgccaccgacggcgcccagggcgtgctggagagcttcctgggcaccgccgtggccggcgccgccttctgcctgatggccggccagcccctgaccatcctgagcagcaccggccccgtgctggtgttcgagagactgctgttcagcttcagcagagactacagcctggactacctgcccttcagactgtgggtgggcatctgggtggccaccttctgcctggtgctggtggccaccgaggccagcgtgctggtgagatacttcaccagattcaccgaggagggcttctgcgccctgatcagcctgatcttcatctacgacgccgtgggcaagatgctgaacctgacccacacctaccccatccagaagcccggcagcagcgcctacggctgcctgtgccagtaccccggccccggcggcaacgagagccagtggatcagaaccagacccaaggacagagacgacatcgtgagcatggacctgggcctgatcaacgccagcctgctgcccccccccgagtgcaccagacagggcggccaccccagaggccccggctgccacaccgtgcccgacatcgccttcttcagcctgctgctgttcctgaccagcttcttcttcgccatggccctgaagtgcgtgaagaccagcagattcttccccagcgtggtgagaaagggcctgagcgacttcagcagcgtgctggccatcctgctgggctgcggcctggacgccttcctgggcctggccacccccaagctgatggtgcccagagagttcaagcccaccctgcccggcagaggctggctggtgagccccttcggcgccaacccctggtggtggagcgtggccgccgccctgcccgccctgctgctgagcatcctgatcttcatggaccagcagatcaccgccgtgatcctgaacagaatggagtacagactgcagaagggcgccggcttccacctggacctgttctgcgtggccgtgctgatgctgctgaccagcgccctgggcctgccctggtacgtgagcgccaccgtgatcagcctggcccacatggacagcctgagaagagagagcagagcctgcgcccccggcgagagacccaacttcctgggcatcagagagcagagactgaccggcctggtggtgttcatcctgaccggcgccagcatcttcctggcccccgtgctgaagttcatccccatgcccgtgctgtacggcatcttcctgtacatgggcgtggccgccctgagcagcatccagttcaccaacagagtgaagctgctgctgatgcccgccaagcaccagcccgacctgctgctgctgagacacgtgcccctgaccagagtgcacctgttcaccgccatccagctggcctgcctgggcctgctgtggatcatcaagagcacccccgccgccatcatcttccccctgatgctgctgggcctggtgggcgtgagaaaggccctggagagagtgttcagcccccaggagctgctgtggctggacgagctgatgcccgaggaggagagaagcatccccgagaagggcctggagcccgagcacagcttcagcggcagcgacagcgaggacagcgagctgatgtaccagcccaaggcccccgagatcaacatcagcgtgaactag

SEQ ID NO: 22358 - DNA, 2952 bp, Artificial Sequence
  Description of Artificial Sequence: Synthetic coding sequence
atggagatgaagctgcccggccaggagggcttcgaggccagcagcgcccccagaaacatccccagcggcgagctggacagcaaccccgaccccggcaccggccccagccccgacggccccagcgacaccgagagcaaggagctgggcgtgcccaaggaccccctgctgttcatccagctgaacgagctgctgggctggccccaggccctggagtggagagagaccggcagcagcagcgccagcctgctgctggacatgggcgagatgcccagcatcaccctgagcacccacctgcaccacagatgggtgctgttcgaggagaagctggaggtggccgccggcagatggagcgccccccacgtgcccaccctggccctgcccagcctgcagaagctgagaagcctgctggccgagggcctggtgctgctggactgccccgcccagagcctgctggagctggtggagcaggtgaccagagtggagagcctgagccccgagctgagaggccagctgcaggccctgctgctgcagagaccccagcactacaaccagaccaccggcaccagaccctgctggggcagcacccaccccagaaaggccagcgacaacgaggaggcccccctgagagagcagtgccagaaccccctgagacagaagctgccccccggcgccgaggccggcaccgtgctggccggcgagctgggcttcctggcccagcccctgggcgccttcgtgagactgagaaaccccgtggtgctgggcagcctgaccgaggtgagcctgcccagcagattcttctgcctgctgctgggcccctgcatgctgggcaagggctaccacgagatgggcagagccgccgccgtgctgctgagcgacccccagttccagtggagcgtgagaagagccagcaacctgcacgacctgctggccgccctggacgccttcctggaggaggtgaccgtgctgccccccggcagatgggaccccaccgccagaatccccccccccaagtgcctgcccagccagcacaagagactgcccagccagcagagagagatcagaggccccgccgtgcccagactgaccagcgccgaggacagacacagacacggcccccacgcccacagccccgagctgcagagaaccggcagactgttcggcggcctgatccaggacgtgagaagaaaggtgccctggtaccccagcgacttcctggacgccctgcacctgcagtgcttcagcgccgtgctgtacatctacctggccaccgtgaccaacgccatcaccttcggcggcctgctgggcgacgccaccgacggcgcccagggcgtgctggagagcttcctgggcaccgccgtggccggcgccgccttctgcctgatggccggccagcccctgaccatcctgagcagcaccggccccgtgctggtgttcgagagactgctgttcagcttcagcagagactacagcctggactacctgcccttcagactgtgggtgggcatctgggtggccaccttctgcctggtgctggtggccaccgaggccagcgtgctggtgagatacttcaccagattcaccgaggagggcttctgcgccctgatcagcctgatcttcatctacgacgccgtgggcaagatgctgaacctgacccacacctaccccatccagaagcccggcagcagcgcctacggctgcctgtgccagtaccccggccccggcggcaacgagagccagtggatcagaaccagacccaaggacagagacgacatcgtgagcatggacctgggcctgatcaacgccagcctgctgcccccccccgagtgcaccagacagggcggccaccccagaggccccggctgccacaccgtgcccgacatcgccttcttcagcctgctgctgttcctgaccagcttcttcttcgccatggccctgaagtgcgtgaagaccagcagattcttccccagcgtggtgagaaagggcctgagcgacttcagcagcgtgctggccatcctgctgggctgcggcctggacgccttcctgggcctggccacccccaagctgatggtgcccagagagttcaagcccaccctgcccggcagaggctggctggtgagccccttcggcgccaacccctggtggtggagcgtggccgccgccctgcccgccctgctgctgagcatcctgatcttcatggaccagcagatcaccgccgtgatcctgaacagaatggagtacagactgcagaagggcgccggcttccacctggacctgttctgcgtggccgtgctgatgctgctgaccagcgccctgggcctgccctggtacgtgagcgccaccgtgatcagcctggcccacatggacagcctgagaagagagagcagagcctgcgcccccggcgagagacccaacttcctgggcatcagagagcagagactgaccggcctggtggtgttcatcctgaccggcgccagcatcttcctggcccccgtgctgaagttcatccccatgcccgtgctgtacggcatcttcctgtacatgggcgtggccgccctgagcagcatccagttcaccaacagagtgaagctgctgctgatgcccgccaagcaccagcccgacctgctgctgctgagacacgtgcccctgaccagagtgcacctgttcaccgccatccagctggcctgcctgggcctgctgtggatcatcaagagcacccccgccgccatcatcttccccctgatgctgctgggcctggtgggcgtgagaaaggccctggagagagtgttcagcccccaggagctgctgtggctggacgagctgatgcccgaggaggagagaagcatccccgagaagggcctggagcccgagcacagcttcagcggcagcgacagcgaggacagcgagctgatgtaccagcccaaggcccccgagatcaacatcagcgtgaactag

SEQ ID NO: 22359 - DNA, 1476 bp, Artificial Sequence
  Description of Artificial Sequence: Synthetic coding sequence
atggccggccagggcctgcccctgcacgtggccaccctgctgaccggcctgctggagtgcctgggcttcgccggcgtgctgttcggctggcccagcctggtgttcgtgttcaagaacgaggactacttcaaggacctgtgcggccccgacgccggccccatcggcaacgccaccggccaggccgactgcaaggcccaggacgagagattcagcctgatcttcaccctgggcagcttcatgaacaacttcatgaccttccccaccggctacatcttcgacagattcaagaccaccgtggccagactgatcgccatcttcttctacaccaccgccaccctgatcatcgccttcaccagcgccggcagcgccgtgctgctgttcctggccatgcccatgctgaccatcggcggcatcctgttcctgatcaccaacctgcagatcggcaacctgttcggccagcacagaagcaccatcatcaccctgtacaacggcgccttcgacagcagcagcgccgtgttcctgatcatcaagctgctgtacgagaagggcatcagcctgagagccagcttcatcttcatcagcgtgtgcagcacctggcacgtggccagaaccttcctgctgatgcccagaggccacatcccctaccccctgccccccaactacagctacggcctgtgccccggcaacggcaccaccaaggaggagaaggagaccgccgagcacgagaacagagagctgcagagcaaggagttcctgagcgccaaggaggagacccccggcgccggccagaagcaggagctgagaagcttctggagctacgccttcagcagaagattcgcctggcacctggtgtggctgagcgtgatccagctgtggcactacctgttcatcggcaccctgaacagcctgctgaccaacatggccggcggcgacatggccagagtgagcacctacaccaacgccttcgccttcacccagttcggcgtgctgtgcgccccctggaacggcctgctgatggacagactgaagcagaagtaccagaaggaggccagaaagaccggcagcagcaccctggccgtggccctgtgcagcaccgtgcccagcctggccctgaccagcctgctgtgcctgggcttcgccctgtgcgccagcgtgcccatcctgcccctgcagtacctgaccttcatcctgcaggtgatcagcagaagcttcctgtacggcagcaacgccgccttcctgaccctggccttccccagcgagcacttcggcaagctgttcggcctggtgatggccctgagcgccgtggtgagcctgctgcagttccccatcttcaccctgatcaagggcagcctgcagaacgaccccttctacgtgaacgtgatgttcatgctggccatcctgctgaccttcttccaccccttcctggtgtacagagagtgcagaacctggaaggagagccccagcgccatcgcctag

SEQ ID NO: 22360 - DNA, 1476 bp, Artificial Sequence; identical to SEQ ID NO: 22359
  Description of Artificial Sequence: Synthetic coding sequence

SEQ ID NO: 22361 - DNA, 1476 bp, Artificial Sequence; identical to SEQ ID NO: 22359
  Description of Artificial Sequence: Synthetic coding sequence

SEQ ID NO: 22362 - DNA, 309 bp, Artificial Sequence
  Description of Artificial Sequence: Synthetic coding sequence
atggccggccagggcctgcccctgcacgtggccaccctgctgaccggcctgctggagtgcctgggcttcgccggcgtgctgttcggctggcccagcctggtgttcgtgttcaagaacgaggactacttcaaggacctgtgcggccccgacgccggccccatcggcaacgccaccggccaggccgactgcaaggcccaggacgagagattcagcctgatcttcaccctgggcagcttcatgaacaacttcatgaccttccccaccggctacatcttcgacagattcaagaccaccgtggccagactgtag

SEQ ID NO: 22363 - DNA, 510 bp, Artificial Sequence
  Description of Artificial Sequence: Synthetic coding sequence
atggccggccagggcctgcccctgcacgtggccaccctgctgaccggcctgctggagtgcctgggcttcgccggcgtgctgttcggctggcccagcctggtgttcgtgttcaagaacgaggactacttcaaggacctgtgcggccccgacgccggccccatcggcaacgccaccggccaggccgactgcaaggcccaggacgagagattcagcctgatcttcaccctgggcagcttcatgaacaacttcatgaccttccccaccggctacatcttcgacagattcaagaccaccgtggccagactgatcgccatcttcttctacaccaccgccaccctgatcatcgccttcaccagcgccggcagcgccgtgctgctgttcctggccatgcccatgctgaccatcggcggcatcctgttcctgatcaccaacctgcagatcggcaacctgttcggccagcacagaagcaccatcatcaccctgtacaacggcgccttcgacagcagctag

SEQ ID NO: 22364 - DNA, 195 bp, Artificial Sequence
  Description of Artificial Sequence: Synthetic coding sequence
atggccggccagggcctgcccctgcacgtggccaccctgctgaccggcctgctggagtgcctgggcttcgccggcgtgctgttcggctggcccagcctggtgttcgtgttcaagaacgaggactacttcaaggacctgtgcggccccgacgccggccccatcggcaacgccaccggccaggccggcagactgtag

SEQ ID NO: 22365 - DNA, 447 bp, Artificial Sequence
  Description of Artificial Sequence: Synthetic coding sequence
atggccggccagggcctgcccctgcacgtggccaccctgctgaccggcctgctggagtgcctgggcttcgccggcgtgctgttcggctggcccagcctggtgttcgtgttcaagaacgaggactacttcaaggacctgtgcggccccgacgccggccccatcggcaacgccaccggccaggccgactgcaaggcccaggacgagagattcagcctgatcttcaccctgggcagcttcatgaacaacttcatgaccttccccaccggctacatcttcgacagattcaagaccaccgtggccagactgatcgccatcttcttctacaccaccgccaccctgatcatcgccttcaccagcgccggcagcgccgtgctgctgttcctggccatgcccatgctgaccatcggcggcatcctgttcctgatcaccaacctgcagatcggctag

SEQ ID NO: 22366 - DNA, 360 bp, Artificial Sequence
  Description of Artificial Sequence: Synthetic coding sequence
atggccggccagggcctgcccctgcacgtggccaccctgctgaccggcctgctggagtgcctgggcttcgccggcgtgctgttcggctggcccagcctggtgttcgtgttcaagaacgaggactacttcaaggacctgtgcggccccgacgccggccccatcggcaacgccaccggccaggccgactgcaaggcccaggacgagagattcagcctgatcttcaccctgggcagcttcatgaacaacttcatgaccttccccaccggctacatcttcgacagattcaagaccaccgtggccagactgatcgccatcttcttctacaccaccgccaccctgatcatcgccttcaccagctag

SEQ ID NO: 22367 - DNA, 1476 bp, Artificial Sequence; identical to SEQ ID NO: 22359
  Description of Artificial Sequence: Synthetic coding sequence

SEQ ID NO: 22368 - DNA, 69 bp, Artificial Sequence
  Description of Artificial Sequence: Synthetic coding sequence
atggccggccagggcctgcccctgcacgtggccaccctgctgaccggcctgctggagtgcctgggctag

SEQ ID NO: 22369 - DNA, 996 bp, Artificial Sequence
  Description of Artificial Sequence: Synthetic coding sequence
atggccggccagggcctgcccctgcacgtggccaccctgctgaccggcctgctggagtgcctgggcttcgccggcgtgctgttcggctggcccagcctggtgttcgtgttcaagaacgaggactacttcaaggacctgtgcggccccgacgccggccccatcggcaacgccaccggccaggccgactgcaaggcccaggacgagagattcagcctgatcttcaccctgggcagcttcatgaacaacttcatgaccttccccaccggctacatcttcgacagattcaagaccaccgtggccagactgatcgccatcttcttctacaccaccgccaccctgatcatcgccttcaccagcgccggcagcgccgtgctgctgttcctggccatgcccatgctgaccatcggcggcatcctgttcctgatcaccaacctgcagatcggcaacctgttcggccagcacagaagcaccatcatcaccctgtacaacggcgccttcgacagcagcagcgccgtgttcctgatcatcaagctgctgtacgagaagggcatcagcctgagagccagcttcatcttcatcagcgtgtgcagcacctggcacgtggccagaaccttcctgctgatgcccagaggccacatcccctaccccctgccccccaactacagctacggcctgtgccccggcaacggcaccaccaaggaggagaaggagaccgccgagcacgagaacagagagctgcagagcaaggagttcctgagcgccaaggaggagacccccggcgccggccagaagcaggagctgagaagcttctggagctacgccttcagcagaagattcgcctggcacctggtgtggctgagcgtgatccagctgtggcactacctgttcatcggcaccctgaacagcctgctgaccaacatggccggcggcgacatggccagagtgagcacctacaccaacgccttcgccttcacccagttcggcgtgctgtgctag

SEQ ID NO: 22370 - DNA, 135 bp, Artificial Sequence
  Description of Artificial Sequence: Synthetic coding sequence
atggccggccagggcctgcccctgcacgtggccaccctgctgaccggcctgctggagtgcctgggcttcgccggcgtgctgttcggctggcccagcctggtgttcgtgttcaagaacgaggactacttcaagtag

SEQ ID NO: 22371 - DNA, 9 bp, Artificial Sequence
  Description of Artificial Sequence: Synthetic coding sequence
atggcctag

SEQ ID NO: 22372 - DNA, 297 bp, Artificial Sequence
  Description of Artificial Sequence: Synthetic coding sequence
atggccggccagggcctgcccctgcacgtggccaccctgctgaccggcctgctggagtgcctgggcttcgccggcgtgctgttcggctggcccagcctggtgttcgtgttcaagaacgaggactacttcaaggacctgtgcggccccgacgccggccccatcggcaacgccaccggccaggccgactgcaaggcccaggacgagagattcagcctgatcttcaccctgggcagcttcatgaacaacttcatgaccttccccaccggctacatcttcgacagattcaagaccacctag

SEQ ID NO: 22373 - DNA, 237 bp, Artificial Sequence
  Description of Artificial Sequence: Synthetic coding sequence
atggccggccagggcctgcccctgcacgtggccaccctgctgaccggcctgctggagtgcctgggcttcgccggcgtgctgttcggctggcccagcctggtgttcgtgttcaagaacgaggactacttcaaggacctgtgcggccccgacgccggccccatcggcaacgccaccggccaggccgactgcaaggcccaggacgagagattcagcctgatcttcaccctgggcagctag

SEQ ID NO: 22374 - DNA, 324 bp, Artificial Sequence
  Description of Artificial Sequence: Synthetic coding sequence
atggccggccagggcctgcccctgcacgtggccaccctgctgaccggcctgctggagtgcctgggcttcgccggcgtgctgttcggctggcccagcctggtgttcgtgttcaagaacgaggactacttcaaggacctgtgcggccccgacgccggccccatcggcaacgccaccggccaggccgactgcaaggcccaggacgagagattcagcctgatcttcaccctgggcagcttcatgaacaacttcatgaccttccccaccggctacatcttcgacagattcaagaccaccgtggccagactgatcgccatcttcttctag

SEQ ID NO: 22375 - DNA, 333 bp, Artificial Sequence
  Description of Artificial Sequence: Synthetic coding sequence
atggccggccagggcctgcccctgcacgtggccaccctgctgaccggcctgctggagtgcctgggcttcgccggcgtgctgttcggctggcccagcctggtgttcgtgttcaagaacgaggactacttcaaggacctgtgcggccccgacgccggccccatcggcaacgccaccggccaggccgactgcaaggcccaggacgagagattcagcctgatcttcaccctgggcagcttcatgaacaacttcatgaccttccccaccggctacatcttcgacagattcaagaccaccgtggccagactgatcgccatcttcttctacaccacctag

SEQ ID NO: 22376 - DNA, 1758 bp, Artificial Sequence
  Description of Artificial Sequence: Synthetic coding sequence
atgcactgcctgggcgccgagtacctggtgttcatcatgggctacagcgtggtggccggcgccgccggcagactgctgttcggctacgacagcttcggcaacatgtgcggcaagaagaacagccccgtggagggcgcccccctgagcggccaggacatgaccctgaagaagcacgtgttcttcatgaacagctgcaacctggaggtgaagggcagcttcctgtgcgtgtacagcctgaacagcttcaactacacccacagccccaaggccgacagcctgtgccccagactgcccgtgccccccagcaagagcttccccctgttcaacagatgcgtgccccagacccccgagtgctacagcctgttcgccagcgtgctgatcaacgacgtggacaccctgcacagaatcctgagcggcatcatgagcggcagagacaccatcctgggcctgtgcatcctggccctggccctgagcctggccatgatgttcaccttcagattcatcaccaccctgctggtgcacatcttcatcagcctggtgatcctgggcctgctgttcgtgtgcggcgtgctgtggtggctgtactacgactacaccaacgacctgagcatcgagctggacaccgagagagagaacatgaagtgcgtgctgggcttcgccatcgtgagcaccggcatcaccgccgtgctgctggtgctgatcttcgtgctgagaaagagaatcaagctgaccgtggagctgttccagatcaccaacaaggccatcagcagcgcccccttcctgctgttccagcccctgtggaccttcgccatcctgatcttcttctgggtgctgtgggtggccgtgctgctgagcctgggcaccgccggcgccgcccaggtgatggagggcggccaggtggagtacaagcccctgagcggcatcagatacatgtggagctaccacctgatcggcctgatctggaccagcgagttcatcctggcctgccagcagatgaccatcgccggcgccgtggtgacctgctacttcaacagaagcaagaacgacccccccgaccaccccatcctgagcagcctgagcatcctgttcttctaccaccagggcaccgtggtgaagggcagcttcctgatcagcgtggtgagaatccccagaatcatcgtgatgtacatgcagaacgccctgaaggagcagcagcacggcgccctgagcagatacctgttcagatgctgctactgctgcttctggtgcctggacaagtacctgctgcacctgaaccagaacgcctacaccaccaccgccatcaacggcaccgacttctgcaccagcgccaaggacgccttcaagatcctgagcaagaacagcagccacttcaccagcatcaactgcttcggcgacttcatcatcttcctgggcaaggtgctggtggtgtgcttcaccgtgttcggcggcctgatggccttcaactacaacagagccttccaggtgtgggccgtgcccctgctgctggtggccttcttcgcctacctggtggcccacagcttcctgagcgtgttcgagaccgtgctggacgccctgttcctgtgcttcgccgtggacctggagaccaacgacggcagcagcgagaagccctacttcatggaccaggagttcctgagcttcgtgaagagaagcaacaagctgaacaacgccagagcccagcaggacaagcacagcctgagaaacgaggagggcaccgagctgcaggccatcgtgagatag

SEQ ID NO: 22377 - DNA, 1863 bp, Artificial Sequence
  Description of Artificial Sequence: Synthetic coding sequence
atgcactgcctgggcgccgagtacctggtgagcgccgagggcgcccccagacagagagagtggagaccccagatctacagaaagtgcaccgacaccgcctggctgttcctgttcttcctgttctggaccggcctggtgttcatcatgggctacagcgtggtggccggcgccgccggcagactgctgttcggctacgacagcttcggcaacatgtgcggcaagaagaacagccccgtggagggcgcccccctgagcggccaggacatgaccctgaagaagcacgtgttcttcatgaacagctgcaacctggaggtgaagggcagcttcctgtgcgtgtacagcctgaacagcttcaactacacccacagccccaaggccgacagcctgtgccccagactgcccgtgccccccagcaagagcttccccctgttcaacagatgcgtgccccagacccccgagtgctacagcctgttcgccagcgtgctgatcaacgacgtggacaccctgcacagaatcctgagcggcatcatgagcggcagagacaccatcctgggcctgtgcatcctggccctggccctgagcctggccatgatgttcaccttcagattcatcaccaccctgctggtgcacatcttcatcagcctggtgatcctgggcctgctgttcgtgtgcggcgtgctgtggtggctgtactacgactacaccaacgacctgagcatcgagctggacaccgagagagagaacatgaagtgcgtgctgggcttcgccatcgtgagcaccggcatcaccgccgtgctgctggtgctgatcttcgtgctgagaaagagaatcaagctgaccgtggagctgttccagatcaccaacaaggccatcagcagcgcccccttcctgctgttccagcccctgtggaccttcgccatcctgatcttcttctgggtgctgtgggtggccgtgctgctgagcctgggcaccgccggcgccgcccaggtgatggagggcggccaggtggagtacaagcccctgagcggcatcagatacatgtggagctaccacctgatcggcctgatctggaccagcgagttcatcctggcctgccagcagatgaccatcgccggcgccgtggtgacctgctacttcaacagaagcaagaacgacccccccgaccaccccatcctgagcagcctgagcatcctgttcttctaccaccagggcaccgtggtgaagggcagcttcctgatcagcgtggtgagaatccccagaatcatcgtgatgtacatgcagaacgccctgaaggagcagcacggcgccctgagcagatacctgttcagatgctgctactgctgcttctggtgcctggacaagtacctgctgcacctgaaccagaacgcctacaccaccaccgccatcaacggcaccgacttctgcaccagcgccaaggacgccttcaagatcctgagcaagaacagcagccacttcaccagcatcaactgcttcggcgacttcatcatcttcctgggcaaggtgctggtggtgtgcttcaccgtgttcggcggcctgatggccttcaactacaacagagccttccaggtgtgggccgtgcccctgctgctggtggccttcttcgcctacctggtggcccacagcttcctgagcgtgttcgagaccgtgctggacgccctgttcctgtgcttcgccgtggacctggagaccaacgacggcagcagcgagaagccctacttcatggaccaggagttcctgagcttcgtgaagagaagcaacaagctgaacaacgccagagcccagcaggacaagcacagcctgagaaacgaggagggcaccgagctgcaggccatcgtgagatag

SEQ ID NO: 22378 - DNA, 1962 bp, Artificial Sequence
  Description of Artificial Sequence: Synthetic coding sequence
atgcactgcctgggcgccgagtacctggtgagcgccgagggcgcccccagacagagagagtggagaccccagatctacagaaagtgcaccgacaccgcctggctgttcctgttcttcctgttctggaccggcctggtgttcatcatgggctacagcgtggtggccggcgccgccggcagactgctgttcggctacgacagcttcggcaacatgtgcggcaagaagaacagccccgtggagggcgcccccctgagcggccaggacatgaccctgaagaagcacgtgttcttcatgaacagctgcaacctggaggtgaagggcacccagctgaacagaatggccctgtgcgtgagcaactgccccgaggagcagctggacagcctggaggaggtgcagttcttcgccaacaccagcggcagcttcctgtgcgtgtacagcctgaacagcttcaactacacccacagccccaaggccgacagcctgtgccccagactgcccgtgccccccagcaagagcttccccctgttcaacagatgcgtgccccagacccccgagtgctacagcctgttcgccagcgtgctgatcaacgacgtggacaccctgcacagaatcctgagcggcatcatgagcggcagagacaccatcctgggcctgtgcatcctggccctggccctgagcctggccatgatgttcaccttcagattcatcaccaccctgctggtgcacatcttcatcagcctggtgatcctgggcctgctgttcgtgtgcggcgtgctgtggtggctgtactacgactacaccaacgacctgagcatcgagctggacaccgagagagagaacatgaagtgcgtgctgggcttcgccatcgtgagcaccggcatcaccgccgtgctgctggtgctgatcttcgtgctgagaaagagaatcaagctgaccgtggagctgttccagatcaccaacaaggccatcagcagcgcccccttcctgctgttccagcccctgtggaccttcgccatcctgatcttcttctgggtgctgtgggtggccgtgctgctgagcctgggcaccgccggcgccgcccaggtgatggagggcggccaggtggagtacaagcccctgagcggcatcagatacatgtggagctaccacctgatcggcctgatctggaccagcgagttcatcctggcctgccagcagatgaccatcgccggcgccgtggtgacctgctacttcaacagaagcaagaacgacccccccgaccaccccatcctgagcagcctgagcatcctgttcttctaccaccagggcaccgtggtgaagggcagcttcctgatcagcgtggtgagaatccccagaatcatcgtgatgtacatgcagaacgccctgaaggagcagcagcacggcgccctgagcagatacctgttcagatgctgctactgctgcttctggtgcctggacaagtacctgctgcacctgaaccagaacgcctacaccaccaccgccatcaacggcaccgacttctgcaccagcgccaaggacgccttcaagatcctgagcaagaacagcagccacttcaccagcatcaactgcttcggcgacttcatcatcttcctgggcaaggtgctggtggtgtgcttcaccgtgttcggcggcctgatggccttcaactacaacagagccttccaggtgtgggccgtgcccctgctgctggtggccttcttcgcctacctggtggcccacagcttcctgagcgtgttcgagaccgtgctggacgccctgttcctgtgcttcgccgtggacctggagaccaacgacggcagcagcgagaagccctacttcatggaccaggagttcctgagcttcgtgaagagaagcaacaagctgaacaacgccagagcccagcaggacaagcacagcctgagaaacgaggagggcaccgagctgcaggccatcgtgagatag

SEQ ID NO: 22379 - DNA, 492 bp, Artificial Sequence
  Description of Artificial Sequence: Synthetic coding sequence
atgggctacagcgtggtggccggcgccgccggcagactgctgttcggctacgacagcttcggcaacatgtgcggcaagaagaacagccccgtggagggcgcccccctgagcggccaggacatgaccctgaagaagcacgtgttcttcatgaacagctgcaacctggaggtgaagggcacccagctgaacagaatggccctgtgcgtgagcaactgccccgaggagcagctggacagcctggaggaggtgcagttcttcgccaacaccagcggcagcttcctgtgcgtgtacagcctgaacagcttcaactacacccacagccccaaggccgacagcctgtgccccagactgcccgtgccccccagcaagagcttccccctgttcaacagatgcgtgccccagacccccgagtgctacagcctgttcgccagcgtgctgatcaacgacgtggacaccctgcacagaatcctgagcggcatcatgagcggctag

SEQ ID NO: 22380 - DNA, 1854 bp, Artificial Sequence
  Description of Artificial Sequence: Synthetic coding sequence
atgcactgcctgggcgccgagtacctggtgttcatcatgggctacagcgtggtggccggcgccgccggcagactgctgttcggctacgacagcttcggcaacatgtgcggcaagaagaacagccccgtggagggcgcccccctgagcggccaggacatgaccctgaagaagcacgtgttcttcatgaacagctgcaacctggaggtgaagggcacccagctgaacagaatggccctgtgcgtgagcaactgccccgaggagcagctggacagcctggaggaggtgcagttcttcgccaacaccagcggcagcttcctgtgcgtgtacagcctgaacagcttcaactacacccacagccccaaggccgacagcctgtgccccagactgcccgtgccccccagcaagagcttccccctgttcaacagatgcgtgccccagacccccgagtgctacagcctgttcgccagcgtgctgatcaacgacgtggacaccctgcacagaatcctgagcggcatcatgagcggcagagacaccatcctgggcctgtgcatcctggccctggccctgagcctggccatgatgttcaccttcagattcatcaccaccctgctggtgcacatcttcatcagcctggtgatcctgggcctgctgttcgtgtgcggcgtgctgtggtggctgtactacgactacaccaacgacctgagcatcgagctggacaccgagagagagaacatgaagtgcgtgctgggcttcgccatcgtgagcaccggcatcaccgccgtgctgctggtgctgatcttcgtgctgagaaagagaatcaagctgaccgtggagctgttccagatcaccaacaaggccatcagcagcgcccccttcctgctgttccagcccctgtggaccttcgccatcctgatcttcttctgggtgctgtgggtggccgtgctgctgagcctgggcaccgccggcgccgcccaggtgatggagggcggccaggtggagtacaagcccctgagcggcatcagatacatgtggagctaccacctgatcggcctgatctggaccagcgagttcatcctggcctgccagcagatgaccatcgccggcgccgtggtgacctgctacttcaacagaagcaagaacgacccccccgaccaccccatcctgagcagcctgagcatcctgttcttctaccaccagggcaccgtggtgaagggcagcttcctgatcagcgtggtgagaatccccagaatcatcgtgatgtacatgcagaacgccctgaaggagcagcagcacggcgccctgagcagatacctgttcagatgctgctactgctgcttctggtgcctggacaagtacctgctgcacctgaaccagaacgcctacaccaccaccgccatcaacggcaccgacttctgcaccagcgccaaggacgccttcaagatcctgagcaagaacagcagccacttcaccagcatcaactgcttcggcgacttcatcatcttcctgggcaaggtgctggtggtgtgcttcaccgtgttcggcggcctgatggccttcaactacaacagagccttccaggtgtgggccgtgcccctgctgctggtggccttcttcgcctacctggtggcccacagcttcctgagcgtgttcgagaccgtgctggacgccctgttcctgtgcttcgccgtggacctggagaccaacgacggcagcagcgagaagccctacttcatggaccaggagttcctgagcttcgtgaagagaagcaacaagctgaacaacgccagagcccagcaggacaagcacagcctgagaaacgaggagggcaccgagctgcaggccatcgtgagatag

SEQ ID NO: 22381 - DNA, 1818 bp, Artificial Sequence
  Description of Artificial Sequence: Synthetic coding sequence
atgggctacagcgtggtggccggcgccgccggcagactgctgttcggctacgacagcttcggcaacatgtgcggcaagaagaacagccccgtggagggcgcccccctgagcggccaggacatgaccctgaagaagcacgtgttcttcatgaacagctgcaacctggaggtgaagggcacccagctgaacagaatggccctgtgcgtgagcaactgccccgaggagcagctggacagcctggaggaggtgcagttcttcgccaacaccagcggcagcttcctgtgcgtgtacagcctgaacagcttcaactacacccacagccccaaggccgacagcctgtgccccagactgcccgtgccccccagcaagagcttccccctgttcaacagatgcgtgccccagacccccgagtgctacagcctgttcgccagcgtgctgatcaacgacgtggacaccctgcacagaatcctgagcggcatcatgagcggcagagacaccatcctgggcctgtgcatcctggccctggccctgagcctggccatgatgttcaccttcagattcatcaccaccctgctggtgcacatcttcatcagcctggtgatcctgggcctgctgttcgtgtgcggcgtgctgtggtggctgtactacgactacaccaacgacctgagcatcgagctggacaccgagagagagaacatgaagtgcgtgctgggcttcgccatcgtgagcaccggcatcaccgccgtgctgctggtgctgatcttcgtgctgagaaagagaatcaagctgaccgtggagctgttccagatcaccaacaaggccatcagcagcgcccccttcctgctgttccagcccctgtggaccttcgccatcctgatcttcttctgggtgctgtgggtggccgtgctgctgagcctgggcaccgccggcgccgcccaggtgatggagggcggccaggtggagtacaagcccctgagcggcatcagatacatgtggagctaccacctgatcggcctgatctggaccagcgagttcatcctggcctgccagcagatgaccatcgccggcgccgtggtgacctgctacttcaacagaagcaagaacgacccccccgaccaccccatcctgagcagcctgagcatcctgttcttctaccaccagggcaccgtggtgaagggcagcttcctgatcagcgtggtgagaatccccagaatcatcgtgatgtacatgcagaacgccctgaaggagcagcagcacggcgccctgagcagatacctgttcagatgctgctactgctgcttctggtgcctggacaagtacctgctgcacctgaaccagaacgcctacaccaccaccgccatcaacggcaccgacttctgcaccagcgccaaggacgccttcaagatcctgagcaagaacagcagccacttcaccagcatcaactgcttcggcgacttcatcatcttcctgggcaaggtgctggtggtgtgcttcaccgtgttcggcggcctgatggccttcaactacaacagagccttccaggtgtgggccgtgcccctgctgctggtggccttcttcgcctacctggtggcccacagcttcctgagcgtgttcgagaccgtgctggacgccctgttcctgtgcttcgccgtggacctggagaccaacgacggcagcagcgagaagccctacttcatggaccaggagttcctgagcttcgtgaagagaagcaacaagctgaacaacgccagagcccagcaggacaagcacagcctgagaaacgaggagggcaccgagctgcaggccatcgtgagatag

SEQ ID NO: 22382 - DNA, 2160 bp, Artificial Sequence
  Description of Artificial Sequence: Synthetic coding sequence
atgaacgacaccgagaagcccgccgacacccccagcgaggaggaggacttcggcgaccccagaacctacgaccccgacttcaagggccccgtggccaacagaagctgcaccgacgtgctgtgctgcatgatcttcctgctgtgcatcatcggctacatcgtgctgggcctggtggcctgggtgcacggcgaccccagaagagccgcctaccccaccgacagccagggccacttctgcggccagaagggcacccccaacgagaacaagaccatcctgttctacttcaacctgctgagatgcaccagccccagcgtgctgctgaacctgcagtgccccaccacccagatctgcgtgagcaagtgccccgagaagttcctgacctacgtggagatgcagctgctgtacaccaaggacaagagctactgggaggactacagacagttctgcaagaccaccgccaagcccgtgaagagcctgacccagctgctgctggacgacgactgccccaccgccatcttccccagcaagcccttcctgcagagatgcttccccgacttcagcaccaagaacggcaccctgaccatcggcagcaagatgatgttccaggacggcaacggcggcaccagaagcgtggtggagctgggcatcgccgccaacggcatcaacaagctgctggacgccaagagcctgggcctgaaggtgttcgaggactacgccagaacctggtactggatcctgatcggcctgaccatcgccatggtgctgagctggatcttcctgatcctgctgagattcatcgccggctgcctgttctgggtgttcatgatcggcgtgatcggcatcatcggctacggcatctggcactgctaccagcagtacaccaacctgcaggagagacccagcagcgtgctgaccatctacgacatcggcatccagaccaacatcagcatgtacttcgagctgcagcagacctggttcaccttcatgatcatcctgtgcatcatcgaggtgatcgtgatcctgatgctgatcttcctgagaaacagaatcagagtggccatcatcctgctgaaggagggcagcaaggccatcggctacgtgcccagcaccctggtgtaccccgccctgaccttcatcctgctgagcatctgcatctgctactgggtggtgaccgccgtgttcctggccaccagcggcgtgcccgtgtacaaggtgatcgcccccggcggccactgcatccacgagaaccagacctgcgaccccgagatcttcaacaccaccgagatcgccaaggcctgccccggcgccctgtgcaacttcgccttctacggcggcaagagcctgtaccaccagtacatccccaccttccacgtgtacaacctgttcgtgttcctgtggctgatcaacttcgtgatcgccctgggccagtgcgccctggccggcgccttcgccacctactactgggccatgaagaagcccgacgacatccccagataccccctgttcaccgccttcggcagagccatcagataccacaccggcagcctggccttcggcagcctgatcatcgccctgatccagatgttcaagatcgtgctggagtacctggaccacagactgaagagaacccagaacaccctgagcaagttcctgcagtgctgcctgagatgctgcttctggtgcctggagaacgccatcaagttcctgaacagaaacgcctacatcatgatcgccatctacggcagaaacttctgcagaagcgccaaggacgccttcaacctgctgatgagaaacgtgctgaaggtggccgtgaccgacgaggtgacctacttcgtgctgttcctgggcaagctgctggtggccggcagcatcggcgtgctggccttcctgttcttcacccagagactgcccgtgatcgcccagggccccgccagcctgaactactactgggtgcccctgctgaccgtgatcttcggcagctacctgatcgcccacggcttcttcagcgtgtacgccatgtgcgtggagaccatcttcatctgcttctgcgaggacctggagagaaacgacggcagcaccgagaagccctacttcgtgacccccaacctgcacggcatcctgatcaagaagcagctggtgccccagaagcagaaggagtag

SEQ ID NO: 22383 - DNA, 2154 bp, Artificial Sequence
  Description of Artificial Sequence: Synthetic coding sequence
atgaacgacaccgagaagcccgccgacacccccagcgaggaggaggacttcggcgaccccagaacctacgaccccgacttcaagggccccgtggccaacagaagctgcaccgacgtgctgtgctgcatgatcttcctgctgtgcatcatcggctacatcgtgctgggcctggtggcctgggtgcacggcgaccccagaagagccgcctaccccaccgacagccagggccacttctgcggccagaagggcacccccaacgagaacaagaccatcctgttctacttcaacctgctgagatgcaccagccccagcgtgctgctgaacctgcagtgccccaccacccagatctgcgtgagcaagtgccccgagaagttcctgacctacgtggagatgcagctgctgtacaccaaggacaagagctactgggaggactacagacagttctgcaagaccaccgccaagcccgtgaagagcctgacccagctgctgctggacgacgactgccccaccgccatcttccccagcaagcccttcctgcagagatgcttccccgacttcagcaccaagaacggcaccctgaccatcggcagcaagatgatgttccaggacggcaacggcggcaccagaagcgtggtggagctgggcatcgccgccaacggcatcaacaagctgctggacgccaagagcctgggcctgaaggtgttcgaggactacgccagaacctggtactggatcctgatcggcctgaccatcgccatggtgctgagctggatcttcctgatcctgctgagattcatcgccggctgcctgttctgggtgttcatgatcggcgtgatcggcatcatcggctacggcatctggcactgctaccagcagtacaccaacctgcaggagagacccagcagcgtgctgaccatctacgacatcggcatccagaccaacatcagcatgtacttcgagctgcagcagacctggttcaccttcatgatcatcctgtgcatcatcgaggtgatcgtgatcctgatgctgatcttcctgagaaacagaatcagagtggccatcatcctgctgaaggagggcagcaaggccatcggctacgtgcccagcaccctggtgtaccccgccctgaccttcatcctgctgagcatctgcatctgctactgggtggtgaccgccgtgttcctggccaccagcggcgtgcccgtgtacaaggtgatcgcccccggcggccactgcatccacgagaaccagacctgcgaccccgagatcttcaacaccaccgagatcgccaaggcctgccccggcgccctgtgcaacttcgccttctacggcggcaagagcctgtaccaccagtacatccccaccttccacgtgtacaacctgttcgtgttcctgtggctgatcaacttcgtgatcgccctgggccagtgcgccctggccggcgccttcgccacctactactgggccatgaagaagcccgacgacatccccagataccccctgttcaccgccttcggcagagccatcagataccacaccggcagcctggccttcggcagcctgatcatcgccctgatccagatgttcaagatcgtgctggagtacctggaccacagactgaagagaacccagaacaccctgagcaagttcctgcagtgctgcctgagatgctgcttctggtgcctggagaacgccatcaagttcctgaacagaaacgcctacatcatgatcgccatctacggcagaaacttctgcagaagcgccaaggacgccttcaacctgctgatgagaaacgtgctgaaggtggccgtgaccgacgaggtgacctacttcgtgctgttcctgggcaagctgctggtggccggcagcatcggcgtgctggccttcctgttcttcacccagagactgcccgtgatcgcccagggccccgccagcctgaactactactgggtgcccctgctgaccgtgatcttcggcagctacctgatcgcccacggcttcttcagcgtgtacgccatgtgcgtggagaccatcttcatctgcttcctggaggacctggagagaaacgacggcagcaccgccagaccctactacgtgagccagcccctgctgaagatcttccaggaggagaacccccagaccagaaagcagtag

SEQ ID NO: 22384 - DNA, 1770 bp, Artificial Sequence
  Description of Artificial Sequence: Synthetic coding sequence
atgcagctgctgtacaccaaggacaagagctactgggaggactacagacagttctgcaagaccaccgccaagcccgtgaagagcctgacccagctgctgctggacgacgactgccccaccgccatcttccccagcaagcccttcctgcagagatgcttccccgacttcagcaccaagaacggcaccctgaccatcggcagcaagatgatgttccaggacggcaacggcggcaccagaagcgtggtggagctgggcatcgccgccaacggcatcaacaagctgctggacgccaagagcctgggcctgaaggtgttcgaggactacgccagaacctggtactggatcctgatcggcctgaccatcgccatggtgctgagctggatcttcctgatcctgctgagattcatcgccggctgcctgttctgggtgttcatgatcggcgtgatcggcatcatcggctacggcatctggcactgctaccagcagtacaccaacctgcaggagagacccagcagcgtgctgaccatctacgacatcggcatccagaccaacatcagcatgtacttcgagctgcagcagacctggttcaccttcatgatcatcctgtgcatcatcgaggtgatcgtgatcctgatgctgatcttcctgagaaacagaatcagagtggccatcatcctgctgaaggagggcagcaaggccatcggctacgtgcccagcaccctggtgtaccccgccctgaccttcatcctgctgagcatctgcatctgctactgggtggtgaccgccgtgttcctggccaccagcggcgtgcccgtgtacaaggtgatcgcccccggcggccactgcatccacgagaaccagacctgcgaccccgagatcttcaacaccaccgagatcgccaaggcctgccccggcgccctgtgcaacttcgccttctacggcggcaagagcctgtaccaccagtacatccccaccttccacgtgtacaacctgttcgtgttcctgtggctgatcaacttcgtgatcgccctgggccagtgcgccctggccggcgccttcgccacctactactgggccatgaagaagcccgacgacatccccagataccccctgttcaccgccttcggcagagccatcagataccacaccggcagcctggccttcggcagcctgatcatcgccctgatccagatgttcaagatcgtgctggagtacctggaccacagactgaagagaacccagaacaccctgagcaagttcctgcagtgctgcctgagatgctgcttctggtgcctggagaacgccatcaagttcctgaacagaaacgcctacatcatgatcgccatctacggcagaaacttctgcagaagcgccaaggacgccttcaacctgctgatgagaaacgtgctgaaggtggccgtgaccgacgaggtgacctacttcgtgctgttcctgggcaagctgctggtggccggcagcatcggcgtgctggccttcctgttcttcacccagagactgcccgtgatcgcccagggccccgccagcctgaactactactgggtgcccctgctgaccgtgatcttcggcagctacctgatcgcccacggcttcttcagcgtgtacgccatgtgcgtggagaccatcttcatctgcttctgcgaggacctggagagaaacgacggcagcaccgagaagccctacttcgtgacccccaacctgcacggcatcctgatcaagaagcagctggtgccccagaagcagaaggagtag

SEQ ID NO: 22385 - DNA, 2139 bp, Artificial Sequence
  Description of Artificial Sequence: Synthetic coding sequence
accaaggccaagaagagacccagcaacgccggcgaccccagaacctacgaccccgacttcaagggccccgtggccaacagaagctgcaccgacgtgctgtgctgcatgatcttcctgctgtgcatcatcggctacatcgtgctgggcctggtggcctgggtgcacggcgaccccagaagagccgcctaccccaccgacagccagggccacttctgcggccagaagggcacccccaacgagaacaagaccatcctgttctacttcaacctgctgagatgcaccagccccagcgtgctgctgaacctgcagtgccccaccacccagatctgcgtgagcaagtgccccgagaagttcctgacctacgtggagatgcagctgctgtacaccaaggacaagagctactgggaggactacagacagttctgcaagaccaccgccaagcccgtgaagagcctgacccagctgctgctggacgacgactgccccaccgccatcttccccagcaagcccttcctgcagagatgcttccccgacttcagcaccaagaacggcaccctgaccatcggcagcaagatgatgttccaggacggcaacggcggcaccagaagcgtggtggagctgggcatcgccgccaacggcatcaacaagctgctggacgccaagagcctgggcctgaaggtgttcgaggactacgccagaacctggtactggatcctgatcggcctgaccatcgccatggtgctgagctggatcttcctgatcctgctgagattcatcgccggctgcctgttctgggtgttcatgatcggcgtgatcggcatcatcggctacggcatctggcactgctaccagcagtacaccaacctgcaggagagacccagcagcgtgctgaccatctacgacatcggcatccagaccaacatcagcatgtacttcgagctgcagcagacctggttcaccttcatgatcatcctgtgcatcatcgaggtgatcgtgatcctgatgctgatcttcctgagaaacagaatcagagtggccatcatcctgctgaaggagggcagcaaggccatcggctacgtgcccagcaccctggtgtaccccgccctgaccttcatcctgctgagcatctgcatctgctactgggtggtgaccgccgtgttcctggccaccagcggcgtgcccgtgtacaaggtgatcgcccccggcggccactgcatccacgagaaccagacctgcgaccccgagatcttcaacaccaccgagatcgccaaggcctgccccggcgccctgtgcaacttcgccttctacggcggcaagagcctgtaccaccagtacatccccaccttccacgtgtacaacctgttcgtgttcctgtggctgatcaacttcgtgatcgccctgggccagtgcgccctggccggcgccttcgccacctactactgggccatgaagaagcccgacgacatccccagataccccctgttcaccgccttcggcagagccatcagataccacaccggcagcctggccttcggcagcctgatcatcgccctgatccagatgttcaagatcgtgctggagtacctggaccacagactgaagagaacccagaacaccctgagcaagttcctgcagtgctgcctgagatgctgcttctggtgcctggagaacgccatcaagttcctgaacagaaacgcctacatcatgatcgccatctacggcagaaacttctgcagaagcgccaaggacgccttcaacctgctgatgagaaacgtgctgaaggtggccgtgaccgacgaggtgacctacttcgtgctgttcctgggcaagctgctggtggccggcagcatcggcgtgctggccttcctgttcttcacccagagactgcccgtgatcgcccagggccccgccagcctgaactactactgggtgcccctgctgaccgtgatcttcggcagctacctgatcgcccacggcttcttcagcgtgtacgccatgtgcgtggagaccatcttcatctgcttctgcgaggacctggagagaaacgacggcagcaccgagaagccctacttcgtgacccccaacctgcacggcatcctgatcaagaagcagctggtgccccagaagcagaaggagtag

SEQ ID NO: 22386 - DNA, 2271 bp, Artificial Sequence
  Description of Artificial Sequence: Synthetic coding sequence
atgagcagagtgccccagttcaagatgcagaagagccccgccttctgcgtggacctggccggcagccacagacccgagctgttcctgttcggccacctggccagccacctgttcctgtgcttcttcctggagaagcccgccgacacccccagcgaggaggaggacttcggcgaccccagaacctacgaccccgacttcaagggccccgtggccaacagaagctgcaccgacgtgctgtgctgcatgatcttcctgctgtgcatcatcggctacatcgtgctgggcctggtggcctgggtgcacggcgaccccagaagagccgcctaccccaccgacagccagggccacttctgcggccagaagggcacccccaacgagaacaagaccatcctgttctacttcaacctgctgagatgcaccagccccagcgtgctgctgaacctgcagtgccccaccacccagatctgcgtgagcaagtgccccgagaagttcctgacctacgtggagatgcagctgctgtacaccaaggacaagagctactgggaggactacagacagttctgcaagaccaccgccaagcccgtgaagagcctgacccagctgctgctggacgacgactgccccaccgccatcttccccagcaagcccttcctgcagagatgcttccccgacttcagcaccaagaacggcaccctgaccatcggcagcaagatgatgttccaggacggcaacggcggcaccagaagcgtggtggagctgggcatcgccgccaacggcatcaacaagctgctggacgccaagagcctgggcctgaaggtgttcgaggactacgccagaacctggtactggatcctgatcggcctgaccatcgccatggtgctgagctggatcttcctgatcctgctgagattcatcgccggctgcctgttctgggtgttcatgatcggcgtgatcggcatcatcggctacggcatctggcactgctaccagcagtacaccaacctgcaggagagacccagcagcgtgctgaccatctacgacatcggcatccagaccaacatcagcatgtacttcgagctgcagcagacctggttcaccttcatgatcatcctgtgcatcatcgaggtgatcgtgatcctgatgctgatcttcctgagaaacagaatcagagtggccatcatcctgctgaaggagggcagcaaggccatcggctacgtgcccagcaccctggtgtaccccgccctgaccttcatcctgctgagcatctgcatctgctactgggtggtgaccgccgtgttcctggccaccagcggcgtgcccgtgtacaaggtgatcgcccccggcggccactgcatccacgagaaccagacctgcgaccccgagatcttcaacaccaccgagatcgccaaggcctgccccggcgccctgtgcaacttcgccttctacggcggcaagagcctgtaccaccagtacatccccaccttccacgtgtacaacctgttcgtgttcctgtggctgatcaacttcgtgatcgccctgggccagtgcgccctggccggcgccttcgccacctactactgggccatgaagaagcccgacgacatccccagataccccctgttcaccgccttcggcagagccatcagataccacaccggcagcctggccttcggcagcctgatcatcgccctgatccagatgttcaagatcgtgctggagtacctggaccacagactgaagagaacccagaacaccctgagcaagttcctgcagtgctgcctgagatgctgcttctggtgcctggagaacgccatcaagttcctgaacagaaacgcctacatcatgatcgccatctacggcagaaacttctgcagaagcgccaaggacgccttcaacctgctgatgagaaacgtgctgaaggtggccgtgaccgacgaggtgacctacttcgtgctgttcctgggcaagctgctggtggccggcagcatcggcgtgctggccttcctgttcttcacccagagactgcccgtgatcgcccagggccccgccagcctgaactactactgggtgcccctgctgaccgtgatcttcggcagctacctgatcgcccacggcttcttcagcgtgtacgccatgtgcgtggagaccatcttcatctgcttcctggaggacctggagagaaacgacggcagcaccgccagaccctactacgtgagccagcccctgctgaagatcttccaggaggagaacccccagaccagaaagcagtag

SEQ ID NO: 22387 - DNA, 1386 bp, Artificial Sequence
  Description of Artificial Sequence: Synthetic coding sequence
atgaagatcctgttcgtggagcccgccatcttcctgagcgccttcgccatgaccctgaccggccccctgaccacccagtacgtgtacagaagaatctgggaggagaccggcaactacaccttcagcagcgacagcaacatcagcgagtgcgagaagaacaagagcagccccatcttcgccttccaggaggaggtgcagaagaaggtgagcagattcaacctgcagatggacatcagcggcctgatccccggcctggtgagcaccttcatcctgctgagcatcagcgaccactacggcagaaagttccccatgatcctgagcagcgtgggcgccctggccaccagcgtgtggctgtgcctgctgtgctacttcgccttccccttccagctgctgatcgccagcaccttcatcggcgccttctgcggcaactacaccaccttctggggcgcctgcttcgcctacatcgtggaccagtgcaaggagcacaagcagaagaccatcagaatcgccatcatcgacttcctgctgggcctggtgaccggcctgaccggcctgagcagcggctacttcatcagagagctgggcttcgagtggagcttcctgatcatcgccgtgagcctggccgtgaacctgatctacatcctgttcttcctgggcgaccccgtgaaggagtgcagcagccagaacgtgaccatgagctgcagcgagggcttcaagaacctgttctacagaacctacatgctgttcaagaacgccagcggcaagagaagattcctgctgtgcctgctgctgttcaccgtgatcacctacttcttcgtggtgatcggcatcgcccccatcttcatcctgtacgagctggacagccccctgtgctggaacgaggtgttcatcggctacggcagcgccctgggcagcgccagcttcctgaccagcttcctgggcatctggctgttcagctactgcatggaggacatccacatggccttcatcggcatcttcaccaccatgaccggcatggccatgaccgccttcgccagcaccaccctgatgatgttcctggccagagtgcccttcctgttcaccatcgtgcccttcagcgtgctgagaagcatgctgagcaaggtggtgagaagcaccgagcagggcaccctgttcgcctgcatcgccttcctggagaccctgggcggcgtgaccgccgtgagcaccttcaacggcatctacagcgccaccgtggcctggtaccccggcttcaccttcctgctgagcgccggcctgctgctgctgcccgccatcagcctgtgcgtggtgaagtgcaccagctggaacgagggcagctacgagctgctgatccaggaggagagcagcgaggacgccagcgacagatag

SEQ ID NO: 22388 - DNA, 1392 bp, Artificial Sequence
  Description of Artificial Sequence: Synthetic coding sequence
atgaagatcctgttcgtggagcccgccatcttcctgagcgccttcgccatgaccctgaccggccccctgaccacccagtacgtgtacagaagaatctgggaggagaccggcaactacaccttcagcagcgacagcaacatcagcgagtgcgagaagaacaagagcagccccatcttcgccttccaggaggaggtgcagaagaaggtgagcagattcaacctgcagatggacatcagcggcctgatccccggcctggtgagcaccttcatcctgctgagcatcagcgaccactacggcagaaagttccccatgatcctgagcagcgtgggcgccctggccaccagcgtgtggctgtgcctgctgtgctacttcgccttccccttccagctgctgatcgccagcaccttcatcggcgccttctgcggcaactacaccaccttctggggcgcctgcttcgcctacatcgtggaccagtgcaaggagcacaagcagaagaccatcagaatcgccatcatcgacttcctgctgggcctggtgaccggcctgaccggcctgagcagcggctacttcatcagagagctgggcttcgagtggagcttcctgatcatcgccgtgagcctggccgtgaacctgatctacatcctgttcttcctgggcgaccccgtgaaggagtgcagcagccagaacgtgaccatgagctgcagcgagggcttcaagaacctgttctacagaacctacatgctgttcaagaacgccagcggcaagagaagattcctgctgtgcctgctgctgttcaccgtgatcacctacttcttcgtggtgatcggcatcgcccccatcttcatcctgtacgagctggacagccccctgtgctggaacgaggtgttcatcggctacggcagcgccctgggcagcgccagcttcctgaccagcttcctgggcatctggctgttcagctactgcatggaggacatccacatggccttcatcggcatcttcaccaccatgaccggcatggccatgaccgccttcgccagcaccaccctgatgatgttcctggccagagtgcccttcctgttcaccatcgtgcccttcagcgtgctgagaagcatgctgagcaaggtggtgagaagcaccgagcagggcaccctgttcgcctgcatcgccttcctggagaccctgggcggcgtgaccgccgtgagcaccttcaacggcatctacagcgccaccgtggcctggtaccccggcttcaccttcctgctgagcgccggcctgctgctgctgcccgccatcagcctgtgcgtggtgaagtgcaccagctggaacgagggcagctacgagctgctgatccaggaggagagcagcgaggacgccagcgacagagcctgctag

SEQ ID NO: 22389 - DNA, 453 bp, Artificial Sequence
  Description of Artificial Sequence: Synthetic coding sequence
atggcccccagcagactgcagctgggcctgagagccgcctacagcggcatcagcagcgtggccggcttcagcatcttcctggtgtggaccgtggtgtacagacagcccggcaccgccgccatgggcggcctggccggcgtgctggccctgtgggtgctggtgacccacgtgatgtacatgcaggactactggagaacctggctgaagggcctgagaggcttcttcttcgtgggcgtgctgttcagcgccgtgagcatcgccgccttctgcaccttcctggtgctggccatcaccagacaccagagcctgaccgaccccaccagctactacctgagcagcgtgtggagcttcatcagcttcaagtgggccttcctgctgagcctgcccaagtgctgggactacagatgcgagcccccctgccccgcctggatctgcttcctgagcacccagtag

SEQ ID NO: 22390 - DNA, 441 bp, Artificial Sequence
  Description of Artificial Sequence: Synthetic coding sequence
atggcccccagcagactgcagctgggcctgagagccgcctacagcggcatcagcagcgtggccggcttcagcatcttcctggtgtggaccgtggtgtacagacagcccggcaccgccgccatgggcggcctggccggcgtgctggccctgtgggtgctggtgacccacgtgatgtacatgcaggactactggagaacctggctgaagggcctgagaggcttcttcttcgtgggcgtgctgttcagcgccgtgagcatcgccgccttctgcaccttcctggtgctggccatcaccagacaccagagcctgaccgaccccaccagctactacctgagcagcgtgtggagcttcatcagcttcaagtgggccttcctgctgagcctgtacgcccacagatacagagccgacttcgccgacatcagcatcctgagcgacttctag

SEQ ID NO: 22391 - DNA, 270 bp, Artificial Sequence
  Description of Artificial Sequence: Synthetic coding sequence
atgtacatgcaggactactggagaacctggctgaagggcctgagaggcttcttcttcgtgggcgtgctgttcagcgccgtgagcatcgccgccttctgcaccttcctggtgctggccatcaccagacaccagagcctgaccgaccccaccagctactacctgagcagcgtgtggagcttcatcagcttcaagtgggccttcctgctgagcctgtacgcccacagatacagagccgacttcgccgacatcagcatcctgagcgacttctag

SEQ ID NO: 22392 - DNA, 270 bp, Artificial Sequence; identical to SEQ ID NO: 22391
  Description of Artificial Sequence: Synthetic coding sequence

SEQ ID NO: 22393 - DNA, 111 bp, Artificial Sequence
  Description of Artificial Sequence: Synthetic coding sequence
atgtacatgcaggactactggagaacctggctgaagggcctgagaggcttcttcttcgtgggcgtgctgttcagcgccgtgagcatcgccgccttctgcaccttcctgtag

SEQ ID NO: 22394 - DNA, 51 bp, Artificial Sequence
  Description of Artificial Sequence: Synthetic coding sequence
atgtacatgcaggactactggagaacctggctgaagggcctgagaggctag

SEQ ID NO: 22395 - DNA, 1743 bp, Artificial Sequence
  Description of Artificial Sequence: Synthetic coding sequence
atggccttccacgtggagggcctgatcgccatcatcgtgttctacctgctgatcctgctggtgggcatctgggccgcctggagaaccaagaacagcggcagcgccgaggagagaagcgaggccatcatcgtgggcggcagagacatcggcctgctggtgggcggcttcaccatgaccgccacctgggtgggcggcggctacatcaacggcaccgccgaggccgtgtacgtgcccggctacggcctggcctgggcccaggcccccatcggctacagcctgagcctgatcctgggcggcctgttcttcgccaagcccatgagaagcaagggctacgtgaccatgctggaccccttccagcagatctacggcaagagaatgggcggcctgctgttcatccccgccctgatgggcgagatgttctgggccgccgccatcttcagcgccctgggcgccaccatcagcgtgatcatcgacgtggacatgcacatcagcgtgatcatcagcgccctgatcgccaccctgtacaccctggtgggcggcctgtacagcgtggcctacaccgacgtggtgcagctgttctgcatcttcgtgggcctgtggatcagcgtgcccttcgccctgagccaccccgccgtggccgacatcggcttcaccgccgtgcacgccaagtaccagaagccctggctgggcaccgtggacagcagcgaggtgtacagctggctggacagcttcctgctgctgatgctgggcggcatcccctggcaggcctacttccagagagtgctgagcagcagcagcgccacctacgcccaggtgctgagcttcctggccgccttcggctgcctggtgatggccatccccgccatcctgatcggcgccatcggcgccagcaccgactggaaccagaccgcctacggcctgcccgaccccaagaccaccgaggaggccgacatgatcctgcccatcgtgctgcagtacctgtgccccgtgtacatcagcttcttcggcctgggcgccgtgagcgccgccgtgatgagcagcgccgacagcagcatcctgagcgccagcagcatgttcgccagaaacatctaccagctgagcttcagacagaacgccagcgacaaggagatcgtgtgggtgatgagaatcaccgtgttcgtgttcggcgccagcgccaccgccatggccctgctgaccaagaccgtgtacggcctgtggtacctgagcagcgacctggtgtacatcgtgatcttcccccagctgctgtgcgtgctgttcgtgaagggcaccaacacctacggcgccgtggccggctacgtgagcggcctgttcctgagaatcaccggcggcgagccctacctgtacctgcagcccctgatcttctaccccggctactaccccgacgacaacggcatctacaaccagaagttccccttcaagaccctggccatggtgaccagcttcctgaccaacatctgcatcagctacctggccaagtacctgttcgagagcggcaccctgccccccaagctggacgtgttcgacgccgtggtggccagacacagcgaggagaacatggacaagaccatcctggtgaagaacgagaacatcaagctggacgagctggccctggtgaagcccagacagagcatgaccctgagcagcaccttcaccaacaaggaggccttcctggacgtggacagcagccccgagggcagcggcaccgaggacaacctgcagtag

SEQ ID NO: 22396 - DNA, 1743 bp, Artificial Sequence; identical to SEQ ID NO: 22395
  Description of Artificial Sequence: Synthetic coding sequence

SEQ ID NO: 22397 - DNA, 1428 bp, Artificial Sequence
  Description of Artificial Sequence: Synthetic coding sequence
atgagaagcaagggctacgtgaccatgctggaccccttccagcagatctacggcaagagaatgggcggcctgctgttcatccccgccctgatgggcgagatgttctgggccgccgccatcttcagcgccctgggcgccaccatcagcgtgatcatcgacgtggacatgcacatcagcgtgatcatcagcgccctgatcgccaccctgtacaccctggtgggcggcctgtacagcgtggcctacaccgacgtggtgcagctgttctgcatcttcgtgggcctgtggatcagcgtgcccttcgccctgagccaccccgccgtggccgacatcggcttcaccgccgtgcacgccaagtaccagaagccctggctgggcaccgtggacagcagcgaggtgtacagctggctggacagcttcctgctgctgatgctgggcggcatcccctggcaggcctacttccagagagtgctgagcagcagcagcgccacctacgcccaggtgctgagcttcctggccgccttcggctgcctggtgatggccatccccgccatcctgatcggcgccatcggcgccagcaccgactggaaccagaccgcctacggcctgcccgaccccaagaccaccgaggaggccgacatgatcctgcccatcgtgctgcagtacctgtgccccgtgtacatcagcttcttcggcctgggcgccgtgagcgccgccgtgatgagcagcgccgacagcagcatcctgagcgccagcagcatgttcgccagaaacatctaccagctgagcttcagacagaacgccagcgacaaggagatcgtgtgggtgatgagaatcaccgtgttcgtgttcggcgccagcgccaccgccatggccctgctgaccaagaccgtgtacggcctgtggtacctgagcagcgacctggtgtacatcgtgatcttcccccagctgctgtgcgtgctgttcgtgaagggcaccaacacctacggcgccgtggccggctacgtgagcggcctgttcctgagaatcaccggcggcgagccctacctgtacctgcagcccctgatcttctaccccggctactaccccgacgacaacggcatctacaaccagaagttccccttcaagaccctggccatggtgaccagcttcctgaccaacatctgcatcagctacctggccaagtacctgttcgagagcggcaccctgccccccaagctggacgtgttcgacgccgtggtggccagacacagcgaggagaacatggacaagaccatcctggtgaagaacgagaacatcaagctggacgagctggccctggtgaagcccagacagagcatgaccctgagcagcaccttcaccaacaaggaggccttcctggacgtggacagcagccccgagggcagcggcaccgaggacaacctgcagtag

SEQ ID NO: 22398 - DNA, 1980 bp, Artificial Sequence
  Description of Artificial Sequence: Synthetic coding sequence
atggccagcaccgtgagccccagcaccatcgccgagacccccgagcccccccccctgagcgaccacatcagaaacgccgccgacatcagcgtgatcgtgatctacttcctggtggtgatggccgtgggcctgtgggccatgctgaagaccaacagaggcaccatcggcggcttcttcctggccggcagagacatggcctggtggcccatgggcgccagcctgttcgccagcaacatcggcagcaaccactacgtgggcctggccggcaccggcgccgccagcggcgtggccaccgtgaccttcgagtggaccagcagcgtgatgctgctgatcctgggctggatcttcgtgcccatctacatcaagagcggcgtgatgaccatgcccgagtacctgaagaagagattcggcggcgagagactgcaggtgtacctgagcatcctgagcctgttcatctgcgtggtgctgctgatcagcgccgacatcttcgccggcgccatcttcatcaagctggccctgggcctggacctgtacctggccatcttcatcctgctggccatgaccgccgtgtacaccaccaccggcggcctggccagcgtgatctacaccgacaccctgcagaccatcatcatgctgatcggcagcttcatcctgatgggcttcgccttcaacgaggtgggcggctacgagagcttcaccgagaagtacgtgaacgccacccccagcgtggtggagggcgacaacctgaccatcagcgccagctgctacacccccagagccgacagcttccacatcttcagagacgccgtgaccggcgacatcccctggcccggcatcatcttcggcatgcccatcaccgccctgtggtactggtgcaccaaccaggtgatcgtgcagagatgcctgtgcggcaaggacatgagccacgtgaaggccgcctgcatcatgtgcgcctacctgaagctgctgcccatgttcctgatggtgatgcccggcatgatcagcagaatcctgtacaccgacatggtggcctgcgtggtgcccagcgagtgcgtgaagcactgcggcgtggacgtgggctgcaccaactacgcctaccccaccatggtgctggagctgatgccccagggcctgagaggcctgatgctgagcgtgatgctggccagcctgatgagcagcctgaccagcatcttcaacagcgccagcaccctgttcaccatcgacctgtacaccaagatgagaaagcaggccagcgagaaggagctgctgatcgccggcagaatcttcgtgctgctgctgaccgtggtgagcatcgtgtgggtgcccctggtgcaggtgagccagaacggccagctgatccactacaccgagagcatcagcagctacctgggcccccccatcgccgccgtgttcgtgctggccatcttctgcaagagagtgaacgagcagggcgccttctggggcctgatggtgggcctggccatgggcctgatcagaatgatcaccgagttcgcctacggcaccggcagctgcctggcccccagcaactgccccaagatcatctgcggcgtgcactacctgtacttcagcatcgtgctgttcttcggcagcatgctggtgaccctgggcatcagcctgctgaccaagcccatccccgacgtgcacctgtacagactgtgctgggtgctgagaaacagcaccgaggagagaatcgacatcgacgccgaggagaagagccaggaggagaccgacgacggcgtggaggaggactaccccgagaagagcagaggctgcctgaagaaggcctacgacctgttctgcggcctgcagaagggccccaagctgaccaaggaggaggaggaggccctgagcaagaagctgaccgacaccagcgagagacccagctggagaaccatcgtgaacatcaacgccatcctgctgctggccgtggtggtgttcatccacggctactacgcctag

SEQ ID NO: 22399 - DNA, 1836 bp, Artificial Sequence
  Description of Artificial Sequence: Synthetic coding sequence
atggtgtggtggcccgtgggcgccagcctgttcgccagcaacgtgggcagcggccacttcatcggcctggccggcagcggcgccgccaccggcatcagcgtgagcgcctacgagctgaacggcctgttcagcgtgctgatgctggcctggatcttcctgcccatctacatcgccggccaggtgaccaccatgcccgagtacctgagaaagagattcggcggcatcagaatccccatcatcctggccgtgctgtacctgttcatctacatcttcaccaagatcagcgtggacatgtacgccggcgccatcttcatccagcagagcctgcacctggacctgtacctggccatcgtgggcctgctggccatcaccgccgtgtacaccgtggccggcggcctggccgccgtgatctacaccgacgccctgcagaccctgatcatgctgatcggcgccctgaccctgatgggctacagcttcgccgccgtgggcggcatggagggcctgaaggagaagtacttcctggccctggccagcaacagaagcgagaacagcagctgcggcctgcccagagaggacgccttccacatcttcagagaccccctgaccagcgacctgccctggcccggcgtgctgttcggcatgagcatccccagcctgtggtactggtgcaccgaccaggtgatcgtgcagagaaccctggccgccaagaacctgagccacgccaagggcggcgccctgatggccgcctacctgaaggtgctgcccctgttcatcatggtgttccccggcatggtgagcagaatcctgttccccgaccaggtggcctgcgccgaccccgagatctgccagaagatctgcagcaaccccagcggctgcagcgacatcgcctaccccaagctggtgctggagctgctgcccaccggcctgagaggcctgatgatggccgtgatggtggccgccctgatgagcagcctgaccagcatcttcaacagcgccagcaccatcttcaccatggacctgtggaaccacctgagacccagagccagcgagaaggagctgatgatcgtgggcagagtgttcgtgctgctgctggtgctggtgagcatcctgtggatccccgtggtgcaggccagccagggcggccagctgttcatctacatccagagcatcagcagctacctgcagccccccgtggccgtggtgttcatcatgggctgcttctggaagagaaccaacgagaagggcgccttctggggcctgatcagcggcctgctgctgggcctggtgagactggtgctggacttcatctacgtgcagcccagatgcgaccagcccgacgagagacccgtgctggtgaagagcatccactacctgtacttcagcatgatcctgagcaccgtgaccctgatcaccgtgagcaccgtgagctggttcaccgagccccccagcaaggagatggtgagccacctgacctggttcaccagacacgaccccgtggtgcagaaggagcaggccccccccgccgcccccctgagcctgaccctgagccagaacggcatgcccgaggccagcagcagcagcagcgtgcagttcgagatggtgcaggagaacaccagcaagacccacagctgcgacatgacccccaagcagagcaaggtggtgaaggccatcctgtggctgtgcggcatccaggagaagggcaaggaggagctgcccgccagagccgaggccatcatcgtgagcctggaggagaaccccctggtgaagaccctgctggacgtgaacctgatcttctgcgtgagctgcgccatcttcatctggggctacttcgcctag

SEQ ID NO: 22400 - DNA, 1701 bp, Artificial Sequence
  Description of Artificial Sequence: Synthetic coding sequence
atgacctggtggcccatcggcgccagcctgttcgccagcagcgagggcagcggcctgttcatcggcctggccggcagcggcgccgccggcggcctggccgtggccggcttcgagtggaacgccacctacgtgctgctggccctggcctgggtgttcgtgcccatctacatcagcagcgagatcgtgaccctgcccgagtacatccagaagagatacggcggccagagaatcagaatgtacctgagcgtgctgagcctgctgctgagcgtgttcaccaagatcagcctggacctgtacgccggcgccctgttcgtgcacatctgcctgggctggaacttctacctgagcaccatcctgaccctgggcatcaccgccctgtacaccatcgccgccttcgaccagatcggcggctacggccagctggaggccgcctacgcccaggccatccccagcagaaccatcgccaacaccacctgccacctgcccagaaccgacgccatgcacatgttcagagacccccacaccggcgacctgccctggaccggcatgaccttcggcctgaccatcatggccacctggtactggtgcaccgaccaggtgatcgtgcagagaagcctgagcgccagagacctgaaccacgccaaggccggcagcatcctggccagctacctgaagatgctgcccatgggcctgatcatcatgcccggcatgatcagcagagccctgttccccggcgcccacgtgtacgaggagagacaccaggtgagcgtgagcagaaccgacgacgtgggctgcgtggtgcccagcgagtgcctgagagcctgcggcgccgaggtgggctgcagcaacatcgcctaccccaagctggtgatggagctgatgcccatcggcctgagaggcctgatgatcgccgtgatgctggccgccctgatgagcagcctgaccagcatcttcaacagcagcagcaccctgttcaccatggacatctggagaagactgagacccagaagcggcgagagagagctgctgctggtgggcagaaccggcatccccagcaccccccccgccccccagagcagactgagcttcctgctgcccgagaccccccccctggagagatacctgctgggcctggtggtgatggacctgtggctggtgatcgtggccctgatcggcgtgagcgtggcctggatccccgtgctgcaggacagcaacagcggccagctgttcatctacatgcagagcgtgaccagcagcctggccccccccgtgaccgccgtgttcgtgctgggcgtgttctggagaagagccaacgagcagggcgccttctggggcctgatcgccggcctggtggtgggcgccaccagactggtgctggagttcctgaaccccgcccccccctgcggcgagcccgacaccagacccgccgtgctgggcagcatccactacctgcacttcgccgtggccctgttcgccctgagcggcgccgtggtggtggccggcagcctgctgaccccccccccccagagcgtgcagatcgagaacctgacctggtggaccctggcccaggacgtgcccctgggcaccaaggccggcgacggccagaccccccagaagcacgccttctgggccagagtgtgcggcttcaacgccatcctgctgatgtgcgtgaacatcttcttctacgcctacttcgcctag

SEQ ID NO: 22401 - DNA, 1701 bp, Artificial Sequence; identical to SEQ ID NO: 22400
  Description of Artificial Sequence: Synthetic coding sequence

SEQ ID NO: 22402 - DNA, 1710 bp, Artificial Sequence
  Description of Artificial Sequence: Synthetic coding sequence
atggccgccaacagcaccagcgacctgcacacccccggcacccagctgagcgtggccgacatcatcgtgatcaccgtgtacttcgccctgaacgtggccgtgggcatctggagcagctgcagagccagcagaaacaccgtgaacggctacttcctggccggcagagacatgacctggtggcccatcggcgccagcctgttcgccagcagcgagggcagcggcctgttcatcggcctggccggcagcggcgccgccggcggcctggccgtggccggcttcgagtggaacgccacctacgtgctgctggccctggcctgggtgttcgtgcccatctacatcagcagcgagatcgtgaccctgcccgagtacatccagaagagatacggcggccagagaatcagaatgtacctgagcgtgctgagcctgctgctgagcgtgttcaccaagatcagcctggacctgtacgccggcgccctgttcgtgcacatctgcctgggctggaacttctacctgagcaccatcctgaccctgggcatcaccgccctgtacaccatcgccgccttcgaccagatcggcggctacggccagctggaggccgcctacgcccaggccatccccagcagaaccatcgccaacaccacctgccacctgcccagaaccgacgccatgcacatgttcagagacccccacaccggcgacctgccctggaccggcatgaccttcggcctgaccatcatggccacctggtactggtgcaccgaccaggtgatcgtgcagagaagcctgagcgccagagacctgaaccacgccaaggccggcagcatcctggccagctacctgaagatgctgcccatgggcctgatcatcatgcccggcatgatcagcagagccctgttccccgacgacgtgggctgcgtggtgcccagcgagtgcctgagagcctgcggcgccgaggtgggctgcagcaacatcgcctaccccaagctggtgatggagctgatgcccatcggcctgagaggcctgatgatcgccgtgatgctggccgccctgatgagcagcctgaccagcatcttcaacagcagcagcaccctgttcaccatggacatctggagaagactgagacccagaagcggcgagagagagctgctgctggtgggcagactggtgatcgtggccctgatcggcgtgagcgtggcctggatccccgtgctgcaggacagcaacagcggccagctgttcatctacatgcagagcgtgaccagcagcctggccccccccgtgaccgccgtgttcgtgctgggcgtgttctggagaagagccaacgagcagggcgccttctggggcctgatcgccggcctggtggtgggcgccaccagactggtgctggagttcctgaaccccgcccccccctgcggcgagcccgacaccagacccgccgtgctgggcagcatccactacctgcacttcgccgtggccctgttcgccctgagcggcgccgtggtggtggccggcagcctgctgaccccccccccccagagcgtgcagatcgagaacctgacctggtggaccctggcccaggacgtgcccctgggcaccaaggccggcgacggccagaccccccagaagcacgccttctgggccagagtgtgcggcttcaacgccatcctgctgatgtgcgtgaacatcttcttctacgcctacttcgcctag

SEQ ID NO: 22403 - DNA, 1791 bp, Artificial Sequence
  Description of Artificial Sequence: Synthetic coding sequence
atggccgccaacagcaccagcgacctgcacacccccggcacccagctgagcgtggccgacatcatcgtgatcaccgtgtacttcgccctgaacgtggccgtgggcatctggagcagctgcagagccagcagaaacaccgtgaacggctacttcctggccggcagagacatgacctggtggcccatcggcgccagcctgttcgccagcagcgagggcagcggcctgttcatcggcctggccggcagcggcgccgccggcggcctggccgtggccggcttcgagtggaacgccacctacgtgctgctggccctggcctgggtgttcgtgcccatctacatcagcagcgagatcgtgaccctgcccgagtacatccagaagagatacggcggccagagaatcagaatgtacctgagcgtgctgagcctgctgctgagcgtgttcaccaagatcagcctggacctgtacgccggcgccctgttcgtgcacatctgcctgggctggaacttctacctgagcaccatcctgaccctgggcatcaccgccctgtacaccatcgccggcggcctggccgccgtgatctacaccgacgccctgcagaccctgatcatggtggtgggcgccgtgatcctgaccatcaaggccttcgaccagatcggcggctacggccagctggaggccgcctacgcccaggccatccccagcagaaccatcgccaacaccacctgccacctgcccagaaccgacgccatgcacatgttcagagacccccacaccggcgacctgccctggaccggcatgaccttcggcctgaccatcatggccacctggtactggtgcaccgaccaggtgatcgtgcagagaagcctgagcgccagagacctgaaccacgccaaggccggcagcatcctggccagctacctgaagatgctgcccatgggcctgatcatcatgcccggcatgatcagcagagccctgttccccgacgacgtgggctgcgtggtgcccagcgagtgcctgagagcctgcggcgccgaggtgggctgcagcaacatcgcctaccccaagctggtgatggagctgatgcccatcggcctgagaggcctgatgatcgccgtgatgctggccgccctgatgagcagcctgaccagcatcttcaacagcagcagcaccctgttcaccatggacatctggagaagactgagacccagaagcggcgagagagagctgctgctggtgggcagactggtgatcgtggccctgatcggcgtgagcgtggcctggatccccgtgctgcaggacagcaacagcggccagctgttcatctacatgcagagcgtgaccagcagcctggccccccccgtgaccgccgtgttcgtgctgggcgtgttctggagaagagccaacgagcagggcgccttctggggcctgatcgccggcctggtggtgggcgccaccagactggtgctggagttcctgaaccccgcccccccctgcggcgagcccgacaccagacccgccgtgctgggcagcatccactacctgcacttcgccgtggccctgttcgccctgagcggcgccgtggtggtggccggcagcctgctgaccccccccccccagagcgtgcagatcgagaacctgacctggtggaccctggcccaggacgtgcccctgggcaccaaggccggcgacggccagaccccccagaagcacgccttctgggccagagtgtgcggcttcaacgccatcctgctgatgtgcgtgaacatcttcttctacgcctacttcgcctag

SEQ ID NO: 22404 - DNA, 1839 bp, Artificial Sequence
  Description of Artificial Sequence: Synthetic coding sequence
atggccgccaacagcaccagcgacctgcacacccccggcacccagctgagcgtggccgacatcatcgtgatcaccgtgtacttcgccctgaacgtggccgtgggcatctggagcagctgcagagccagcagaaacaccgtgaacggctacttcctggccggcagagacatgacctggtggcccatcggcgccagcctgttcgccagcagcgagggcagcggcctgttcatcggcctggccggcagcggcgccgccggcggcctggccgtggccggcttcgagtggaacgccacctacgtgctgctggccctggcctgggtgttcgtgcccatctacatcagcagcgagatcgtgaccctgcccgagtacatccagaagagatacggcggccagagaatcagaatgtacctgagcgtgctgagcctgctgctgagcgtgttcaccaagatcagcctggacctgtacgccggcgccctgttcgtgcacatctgcctgggctggaacttctacctgagcaccatcctgaccctgggcatcaccgccctgtacaccatcgccggcggcctggccgccgtgatctacaccgacgccctgcagaccctgatcatggtggtgggcgccgtgatcctgaccatcaaggccttcgaccagatcggcggctacggccagctggaggccgcctacgcccaggccatccccagcagaaccatcgccaacaccacctgccacctgcccagaaccgacgccatgcacatgttcagagacccccacaccggcgacctgccctggaccggcatgaccttcggcctgaccatcatggccacctggtactggtgcaccgaccaggtgatcgtgcagagaagcctgagcgccagagacctgaaccacgccaaggccggcagcatcctggccagctacctgaagatgctgcccatgggcctgatcatcatgcccggcatgatcagcagagccctgttccccggcgcccacgtgtacgaggagagacaccaggtgagcgtgagcagaaccgacgacgtgggctgcgtggtgcccagcgagtgcctgagagcctgcggcgccgaggtgggctgcagcaacatcgcctaccccaagctggtgatggagctgatgcccatcggcctgagaggcctgatgatcgccgtgatgctggccgccctgatgagcagcctgaccagcatcttcaacagcagcagcaccctgttcaccatggacatctggagaagactgagacccagaagcggcgagagagagctgctgctggtgggcagactggtgatcgtggccctgatcggcgtgagcgtggcctggatccccgtgctgcaggacagcaacagcggccagctgttcatctacatgcagagcgtgaccagcagcctggccccccccgtgaccgccgtgttcgtgctgggcgtgttctggagaagagccaacgagcagggcgccttctggggcctgatcgccggcctggtggtgggcgccaccagactggtgctggagttcctgaaccccgcccccccctgcggcgagcccgacaccagacccgccgtgctgggcagcatccactacctgcacttcgccgtggccctgttcgccctgagcggcgccgtggtggtggccggcagcctgctgaccccccccccccagagcgtgcagatcgagaacctgacctggtggaccctggcccaggacgtgcccctgggcaccaaggccggcgacggccagaccccccagaagcacgccttctgggccagagtgtgcggcttcaacgccatcctgctgatgtgcgtgaacatcttcttctacgcctacttcgcctag

SEQ ID NO: 22405 - DNA, 1683 bp, Artificial Sequence
  Description of Artificial Sequence: Synthetic coding sequence
atggccgccaacagcaccagcgacctgcacacccccggcacccagctgagcgtggccgacatcatcgtgatcaccgtgtacttcgccctgaacgtggccgtgggcatctggagcagctgcagagccagcagaaacaccgtgaacggctacttcctggccggcagagacatgacctggtggcccatcggcgccagcctgttcgccagcagcgagggcagcggcctgttcatcggcctggccggcagcggcgccgccggcggcctggccgtggccggcttcgagtggaacgccacctacgtgctgctggccctggcctgggtgttcgtgcccatctacatcagcagcgagatcgtgaccctgcccgagtacatccagaagagatacggcggccagagaatcagaatgtacctgagcgtgctgagcctgctgctgagcgtgttcaccaagatcagcctggacctgtacgccggcgccctgttcgtgcacatctgcctgggctggaacttctacctgagcaccatcctgaccctgggcatcaccgccctgtacaccatcgccggcggcctggccgccgtgatctacaccgacgccctgcagaccctgatcatggtggtgggcgccgtgatcctgaccatcaaggccttcgaccagatcggcggctacggccagctggaggccgcctacgcccaggccatccccagcagaaccatcgccaacaccacctgccacctgcccagaaccgacgccatgcacatgttcagagacccccacaccggcgacctgccctggaccggcatgaccttcggcctgaccatcatggccacctggtactggtgcaccgaccaggtgatcgtgcagagaagcctgagcgccagagacctgaaccacgccaaggccggcagcatcctggccagctacctgaagatgctgcccatgggcctgatcatcatgcccggcatgatcagcagagccctgttccccggcctgagaggcctgatgatcgccgtgatgctggccgccctgatgagcagcctgaccagcatcttcaacagcagcagcaccctgttcaccatggacatctggagaagactgagacccagaagcggcgagagagagctgctgctggtgggcagactggtgatcgtggccctgatcggcgtgagcgtggcctggatccccgtgctgcaggacagcaacagcggccagctgttcatctacatgcagagcgtgaccagcagcctggccccccccgtgaccgccgtgttcgtgctgggcgtgttctggagaagagccaacgagcagggcgccttctggggcctgatcgccggcctggtggtgggcgccaccagactggtgctggagttcctgaaccccgcccccccctgcggcgagcccgacaccagacccgccgtgctgggcagcatccactacctgcacttcgccgtggccctgttcgccctgagcggcgccgtggtggtggccggcagcctgctgaccccccccccccagagcgtgcagatcgagaacctgacctggtggaccctggcccaggacgtgcccctgggcaccaaggccggcgacggccagaccccccagaagcacgccttctgggccagagtgtgcggcttcaacgccatcctgctgatgtgcgtgaacatcttcttctacgcctacttcgcctag

SEQ ID NO: 22406 - DNA, 2028 bp, Artificial Sequence
  Description of Artificial Sequence: Synthetic coding sequence
atggagagcggcaccagcagcccccagcccccccagctggaccccctggacgccttcccccagaagggcctggagcccggcgacatcgccgtgctggtgctgtacttcctgttcgtgctggccgtgggcctgtggagcaccgtgaagaccaagagagacaccgtgaagggctacttcctggccggcggcgacatggtgtggtggcccgtgggcgccagcctgttcgccagcaacgtgggcagcggccacttcatcggcctggccggcagcggcgccgccaccggcatcagcgtgagcgcctacgagctgaacggcctgttcagcgtgctgatgctggcctggatcttcctgcccatctacatcgccggccaggtgaccaccatgcccgagtacctgagaaagagattcggcggcatcagaatccccatcatcctggccgtgctgtacctgttcatctacatcttcaccaagatcagcgtggacatgtacgccggcgccatcttcatccagcagagcctgcacctggacctgtacctggccatcgtgggcctgctggccatcaccgccgtgtacaccgtggccggcggcctggccgccgtgatctacaccgacgccctgcagaccctgatcatgctgatcggcgccctgaccctgatgggctacagcttcgccgccgtgggcggcatggagggcctgaaggagaagtacttcctggccctggccagcaacagaagcgagaacagcagctgcggcctgcccagagaggacgccttccacatcttcagagaccccctgaccagcgacctgccctggcccggcgtgctgttcggcatgagcatccccagcctgtggtactggtgcaccgaccaggtgatcgtgcagagaaccctggccgccaagaacctgagccacgccaagggcggcgccctgatggccgcctacctgaaggtgctgcccctgttcatcatggtgttccccggcatggtgagcagaatcctgttccccgaccaggtggcctgcgccgaccccgagatctgccagaagatctgcagcaaccccagcggctgcagcgacatcgcctaccccaagctggtgctggagctgctgcccaccggcctgagaggcctgatgatggccgtgatggtggccgccctgatgagcagcctgaccagcatcttcaacagcgccagcaccatcttcaccatggacctgtggaaccacctgagacccagagccagcgagaaggagctgatgatcgtgggcagagtgttcgtgctgctgctggtgctggtgagcatcctgtggatccccgtggtgcaggccagccagggcggccagctgttcatctacatccagagcatcagcagctacctgcagccccccgtggccgtggtgttcatcatgggctgcttctggaagagaaccaacgagaagggcgccttctggggcctgatcagcggcctgctgctgggcctggtgagactggtgctggacttcatctacgtgcagcccagatgcgaccagcccgacgagagacccgtgctggtgaagagcatccactacctgtacttcagcatgatcctgagcaccgtgaccctgatcaccgtgagcaccgtgagctggttcaccgagccccccagcaaggagatggtgagccacctgacctggttcaccagacacgaccccgtggtgcagaaggagcaggccccccccgccgcccccctgagcctgaccctgagccagaacggcatgcccgaggccagcagcagcagcagcgtgcagttcgagatggtgcaggagaacaccagcaagacccacagctgcgacatgacccccaagcagagcaaggtggtgaaggccatcctgtggctgtgcggcatccaggagaagggcaaggaggagctgcccgccagagccgaggccatcatcgtgagcctggaggagaaccccctggtgaagaccctgctggacgtgaacctgatcttctgcgtgagctgcgccatcttcatctggggctacttcgcctag

SEQ ID NO: 22407 - DNA, 1923 bp, Artificial Sequence
  Description of Artificial Sequence: Synthetic coding sequence
atggagagcggcaccagcagcccccagcccccccagctggaccccctggacgccttcccccagaagggcctggagcccggcgacatcgccgtgctggtgctgtacttcctgttcgtgctggccgtgggcctgtggagcaccgtgaagaccaagagagacaccgtgaagggctacttcctggccggcggcgacatggtgtggtggcccgtgggcgccagcctgttcgccagcaacgtgggcagcggccacttcatcggcctggccggcagcggcgccgccaccggcatcagcgtgagcgcctacgagctgaacggcctgttcagcgtgctgatgctggcctggatcttcctgcccatctacatcgccggccaggtggacatgtacgccggcgccatcttcatccagcagagcctgcacctggacctgtacctggccatcgtgggcctgctggccatcaccgccgtgtacaccgtggccggcggcctggccgccgtgatctacaccgacgccctgcagaccctgatcatgctgatcggcgccctgaccctgatgggctacagcttcgccgccgtgggcggcatggagggcctgaaggagaagtacttcctggccctggccagcaacagaagcgagaacagcagctgcggcctgcccagagaggacgccttccacatcttcagagaccccctgaccagcgacctgccctggcccggcgtgctgttcggcatgagcatccccagcctgtggtactggtgcaccgaccaggtgatcgtgcagagaaccctggccgccaagaacctgagccacgccaagggcggcgccctgatggccgcctacctgaaggtgctgcccctgttcatcatggtgttccccggcatggtgagcagaatcctgttccccgaccaggtggcctgcgccgaccccgagatctgccagaagatctgcagcaaccccagcggctgcagcgacatcgcctaccccaagctggtgctggagctgctgcccaccggcctgagaggcctgatgatggccgtgatggtggccgccctgatgagcagcctgaccagcatcttcaacagcgccagcaccatcttcaccatggacctgtggaaccacctgagacccagagccagcgagaaggagctgatgatcgtgggcagagtgttcgtgctgctgctggtgctggtgagcatcctgtggatccccgtggtgcaggccagccagggcggccagctgttcatctacatccagagcatcagcagctacctgcagccccccgtggccgtggtgttcatcatgggctgcttctggaagagaaccaacgagaagggcgccttctggggcctgatcagcggcctgctgctgggcctggtgagactggtgctggacttcatctacgtgcagcccagatgcgaccagcccgacgagagacccgtgctggtgaagagcatccactacctgtacttcagcatgatcctgagcaccgtgaccctgatcaccgtgagcaccgtgagctggttcaccgagccccccagcaaggagatggtgagccacctgacctggttcaccagacacgaccccgtggtgcagaaggagcaggccccccccgccgcccccctgagcctgaccctgagccagaacggcatgcccgaggccagcagcagcagcagcgtgcagttcgagatggtgcaggagaacaccagcaagacccacagctgcgacatgacccccaagcagagcaaggtggtgaaggccatcctgtggctgtgcggcatccaggagaagggcaaggaggagctgcccgccagagccgaggccatcatcgtgagcctggaggagaaccccctggtgaagaccctgctggacgtgaacctgatcttctgcgtgagctgcgccatcttcatctggggctacttcgcctag

SEQ ID NO: 22408 - DNA, 1560 bp, Artificial Sequence
  Description of Artificial Sequence: Synthetic coding sequence
atggtgtggtggcccgtgggcgccagcctgttcgccagcaacgtgggcagcggccacttcatcggcctggccggcagcggcgccgccaccggcatcagcgtgagcgcctacgagctgaacggcctgttcagcgtgctgatgctggcctggatcttcctgcccatctacatcgccggccaggtgaccaccatgcccgagtacctgagaaagagattcggcggcatcagaatccccatcatcctggccgtgctgtacctgttcatctacatcttcaccaagatcagcgtggacatgtacgccggcgccatcttcatccagcagagcctgcacctggacctgtacctggccatcgtgggcctgctggccatcaccgccgtgtacaccgtggccggcggcctggccgccgtgatctacaccgacgccctgcagaccctgatcatgctgatcggcgccctgaccctgatgggctacagcgactgccccgccgacagcggctgccaggagcccgtgccctgccagagaagatgcagcgacggctgcatccccgagggcgccgcccccctgcacaacggcgtgccctgggacggccagccccaccccctgcccagaagcagcggcctgtgcagaagcagagacctgcccgaggacctgcagcagcccctgagactgttcggccacagagtgagccagaccagagccggcacccccgcccacagcgccagcaccatcttcaccatggacctgtggaaccacctgagacccagagccagcgagaaggagctgatgatcgtgggcagagtgttcgtgctgctgctggtgctggtgagcatcctgtggatccccgtggtgcaggccagccagggcggccagctgttcatctacatccagagcatcagcagctacctgcagccccccgtggccgtggtgttcatcatgggctgcttctggaagagaaccaacgagaagggcgccttctggggcctgatcagcggcctgctgctgggcctggtgagactggtgctggacttcatctacgtgcagcccagatgcgaccagcccgacgagagacccgtgctggtgaagagcatccactacctgtacttcagcatgatcctgagcaccgtgaccctgatcaccgtgagcaccgtgagctggttcaccgagccccccagcaaggagatggtgagccacctgacctggttcaccagacacgaccccgtggtgcagaaggagcaggccccccccgccgcccccctgagcctgaccctgagccagaacggcatgcccgaggccagcagcagcagcagcgtgcagttcgagatggtgcaggagaacaccagcaagacccacagctgcgacatgacccccaagcagagcaaggtggtgaaggccatcctgtggctgtgcggcatccaggagaagggcaaggaggagctgcccgccagagccgaggccatcatcgtgagcctggaggagaaccccctggtgaagaccctgctggacgtgaacctgatcttctgcgtgagctgcgccatcttcatctggggctacttcgcctag

SEQ ID NO: 22409 - DNA, 1836 bp, Artificial Sequence; identical to SEQ ID NO: 22399
  Description of Artificial Sequence: Synthetic coding sequence

SEQ ID NO: 22410 - DNA, 1818 bp, Artificial Sequence
  Description of Artificial Sequence: Synthetic coding sequence
atggagagcggcaccagcagcccccagcccccccagctggaccccctggacgccttcccccagaagggcctggagcccggcgacatcgccgtgctggtgctgtacttcctgttcgtgctggccgtgggcctgtggagcaccgtgaagaccaagagagacaccgtgaagggctacttcctggccggcggcgacatggtgtggtggcccggcctgttcagcgtgctgatgctggcctggatcttcctgcccatctacatcgccggccaggtggacatgtacgccggcgccatcttcatccagcagagcctgcacctggacctgtacctggccatcgtgggcctgctggccatcaccgccgtgtacaccgtggccggcggcctggccgccgtgatctacaccgacgccctgcagaccctgatcatgctgatcggcgccctgaccctgatgggctacagcttcgccgccgtgggcggcatggagggcctgaaggagaagtacttcctggccctggccagcaacagaagcgagaacagcagctgcggcctgcccagagaggacgccttccacatcttcagagaccccctgaccagcgacctgccctggcccggcgtgctgttcggcatgagcatccccagcctgtggtactggtgcaccgaccaggtgatcgtgcagagaaccctggccgccaagaacctgagccacgccaagggcggcgccctgatggccgcctacctgaaggtgctgcccctgttcatcatggtgttccccggcatggtgagcagaatcctgttccccgaccaggtggcctgcgccgaccccgagatctgccagaagatctgcagcaaccccagcggctgcagcgacatcgcctaccccaagctggtgctggagctgctgcccaccggcctgagaggcctgatgatggccgtgatggtggccgccctgatgagcagcctgaccagcatcttcaacagcgccagcaccatcttcaccatggacctgtggaaccacctgagacccagagccagcgagaaggagctgatgatcgtgggcagagtgttcgtgctgctgctggtgctggtgagcatcctgtggatccccgtggtgcaggccagccagggcggccagctgttcatctacatccagagcatcagcagctacctgcagccccccgtggccgtggtgttcatcatgggctgcttctggaagagaaccaacgagaagggcgccttctggggcctgatcagcggcctgctgctgggcctggtgagactggtgctggacttcatctacgtgcagcccagatgcgaccagcccgacgagagacccgtgctggtgaagagcatccactacctgtacttcagcatgatcctgagcaccgtgaccctgatcaccgtgagcaccgtgagctggttcaccgagccccccagcaaggagatggtgagccacctgacctggttcaccagacacgaccccgtggtgcagaaggagcaggccccccccgccgcccccctgagcctgaccctgagccagaacggcatgcccgaggccagcagcagcagcagcgtgcagttcgagatggtgcaggagaacaccagcaagacccacagctgcgacatgacccccaagcagagcaaggtggtgaaggccatcctgtggctgtgcggcatccaggagaagggcaaggaggagctgcccgccagagccgaggccatcatcgtgagcctggaggagaaccccctggtgaagaccctgctggacgtgaacctgatcttctgcgtgagctgcgccatcttcatctggggctacttcgcctag

SEQ ID NO: 22411 - DNA, 2121 bp, Artificial Sequence
  Description of Artificial Sequence: Synthetic coding sequence
atgagcaaggagctggccgccatgggccccggcgccagcggcgacggcgtgagaaccgagaccgccccccacatcgccctggacagcagagtgggcctgcacgcctacgacatcagcgtggtggtgatctacttcgtgttcgtgatcgccgtgggcatctggagcagcatcagagccagcagaggcaccatcggcggctacttcctggccggcagaagcatgagctggtggcccatcggcgccagcctgatgagcagcaacgtgggcagcggcctgttcatcggcctggccggcaccggcgccgccggcggcctggccgtgggcggcttcgagtggaacatgagaaagagcagaagcggcggcgacagaggcatccaccccagaagccacggcagaaccggcgtgagaagccaggccacctggctgctgctggccctgggctgggtgttcgtgcccgtgtacatcgccgccggcgtggtgaccatgccccagtacctgaagaagagattcggcggccagagaatccaggtgtacatgagcgtgctgagcctgatcctgtacatcttcaccaagatcagcaccgacatcttcagcggcgccctgttcatccagatggccctgggctggaacctgtacctgagcaccggcatcctgctggtggtgaccgccgtgtacaccatcgccggcggcctgatggccgtgatctacaccgacgccctgcagaccgtgatcatggtgggcggcgccctggtgctgatgttcctgggcttccaggacgtgggctggtaccccggcctggagcagagatacagacaggccatccccaacgtgaccgtgcccaacaccacctgccacctgcccagacccgacgccttccacatcctgagagaccccgtgagcggcgacatcccctggcccggcctgatcttcggcctgaccgtgctggccacctggtgctggtgcaccgaccaggtgatcgtgcagagaagcctgagcgccaagagcctgagccacgccaagggcggcagcgtgctgggcggctacctgaagatcctgcccatgttcttcatcgtgatgcccggcatgatcagcagagccctgttccccgacgaggtgggctgcgtggaccccgacgtgtgccagagaatctgcggcgccagagtgggctgcagcaacatcgcctaccccaagctggtgatggccctgatgcccgtgggcctgagaggcctgatgatcgccgtgatcatggccgccctgatgagcagcctgaccagcatcttcaacagcagcagcaccctgttcaccatcgacgtgtggcagagattcagaagaaagagcaccgagcaggagctgatggtggtgggcagagtgttcgtggtgttcctggtggtgatcagcatcctgtggatccccatcatccagagcagcaacagcggccagctgttcgactacatccaggccgtgaccagctacctggccccccccatcaccgccctgttcctgctggccatcttctgcaagagagtgaccgagcccggcgccttctggggcctggtgttcggcctgggcgtgggcctgctgagaatgatcctggagttcagctaccccgcccccgcctgcggcgaggtggacagaagacccgccgtgctgaaggacttccactacctgtacttcgccatcctgctgtgcggcctgaccgccatcgtgatcgtgatcgtgagcctgtgcaccacccccatccccgaggagcagctgaccagactgacctggtggaccagaaactgccccctgagcgagctggagaaggaggcccacgagagcacccccgagatcagcgagagacccgccggcgagtgccccgccggcggcggcgccgccgagaacagcagcctgggccaggagcagcccgaggcccccagcagaagctggggcaagctgctgtggagctggttctgcggcctgagcggcacccccgagcaggccctgagccccgccgagaaggccgccctggagcagaagctgaccagcatcgaggaggagcccctgtggagacacgtgtgcaacatcaacgccgtgctgctgctggccatcaacatcttcctgtggggctacttcgcctag

SEQ ID NO: 22412 - DNA, 501 bp, Artificial Sequence
  Description of Artificial Sequence: Synthetic coding sequence
atgggccccggcgccagcggcgacggcgtgagaaccgagaccgccccccacatcgccctggacagcagagtgggcctgcacgcctacgacatcagcgtggtggtgatctacttcgtgttcgtgatcgccgtgggcatctggagcagcatcagagccagcagaggcaccatcggcggctacttcctggccggcagaagcatgagctggtggcccatcggcgccagcctgatgagcagcaacgtgggcagcggcctgttcatcggcctggccggcaccggcgccgccggcggcctggccgtgggcggcttcgagtggaacgccacctggctgctgctggccctgggctgggtgttcgtgcccgtgtacatcgccgccggcgtggtgaccatgccccagtacctgaagaagagattcggcggccagagaatccaggtgtacatgagcgtgctgagcctgatcctgtacatcttcaccaagatcagcggcagctgctggtggtag

SEQ ID NO: 22413 - DNA, 2046 bp, Artificial Sequence
  Description of Artificial Sequence: Synthetic coding sequence
atgagcaaggagctggccgccatgggccccggcgccagcggcgacggcgtgagaaccgagaccgccccccacatcgccctggacagcagagtgggcctgcacgcctacgacatcagcgtggtggtgatctacttcgtgttcgtgatcgccgtgggcatctggagcagcatcagagccagcagaggcaccatcggcggctacttcctggccggcagaagcatgagctggtggcccatcggcgccagcctgatgagcagcaacgtgggcagcggcctgttcatcggcctggccggcaccggcgccgccggcggcctggccgtgggcggcttcgagtggaacgccacctggctgctgctggccctgggctgggtgttcgtgcccgtgtacatcgccgccggcgtggtgaccatgccccagtacctgaagaagagattcggcggccagagaatccaggtgtacatgagcgtgctgagcctgatcctgtacatcttcaccaagatcagcaccgacatcttcagcggcgccctgttcatccagatggccctgggctggaacctgtacctgagcaccggcatcctgctggtggtgaccgccgtgtacaccatcgccggcggcctgatggccgtgatctacaccgacgccctgcagaccgtgatcatggtgggcggcgccctggtgctgatgttcctgggcttccaggacgtgggctggtaccccggcctggagcagagatacagacaggccatccccaacgtgaccgtgcccaacaccacctgccacctgcccagacccgacgccttccacatcctgagagaccccgtgagcggcgacatcccctggcccggcctgatcttcggcctgaccgtgctggccacctggtgctggtgcaccgaccaggtgatcgtgcagagaagcctgagcgccaagagcctgagccacgccaagggcggcagcgtgctgggcggctacctgaagatcctgcccatgttcttcatcgtgatgcccggcatgatcagcagagccctgttccccgacgaggtgggctgcgtggaccccgacgtgtgccagagaatctgcggcgccagagtgggctgcagcaacatcgcctaccccaagctggtgatggccctgatgcccgtgggcctgagaggcctgatgatcgccgtgatcatggccgccctgatgagcagcctgaccagcatcttcaacagcagcagcaccctgttcaccatcgacgtgtggcagagattcagaagaaagagcaccgagcaggagctgatggtggtgggcagagtgttcgtggtgttcctggtggtgatcagcatcctgtggatccccatcatccagagcagcaacagcggccagctgttcgactacatccaggccgtgaccagctacctggccccccccatcaccgccctgttcctgctggccatcttctgcaagagagtgaccgagcccggcgccttctggggcctggtgttcggcctgggcgtgggcctgctgagaatgatcctggagttcagctaccccgcccccgcctgcggcgaggtggacagaagacccgccgtgctgaaggacttccactacctgtacttcgccatcctgctgtgcggcctgaccgccatcgtgatcgtgatcgtgagcctgtgcaccacccccatccccgaggagcagctgaccagactgacctggtggaccagaaactgccccctgagcgagctggagaaggaggcccacgagagcacccccgagatcagcgagagacccgccggcgagtgccccgccggcggcggcgccgccgagaacagcagcctgggccaggagcagcccgaggcccccagcagaagctggggcaagctgctgtggagctggttctgcggcctgagcggcacccccgagcaggccctgagccccgccgagaaggccgccctggagcagaagctgaccagcatcgaggaggagcccctgtggagacacgtgtgcaacatcaacgccgtgctgctgctggccatcaacatcttcctgtggggctacttcgcctag

SEQ ID NO: 22414 - DNA, 522 bp, Artificial Sequence
  Description of Artificial Sequence: Synthetic coding sequence
tgaagcaaggagctggccgccatgggccccggcgccagcggcgacggcgtgagaaccgagaccgccccccacatcgccctggacagcagagtgggcctgcacgcctacgacatcagcgtggtggtgatctacttcgtgttcgtgatcgccgtgggcatctggagcagcatcagagccagcagaggcaccatcggcggctacttcctggccggcagaagcatgagctggtggcccatcggcgccagcctgatgagcagcaacgtgggcagcggcctgttcatcggcctggccggcaccggcgccgccggcggcctggccgtgggcggcttcgagtggaacgccacctggctgctgctggccctgggctgggtgttcgtgcccgtgtacatcgccgccggcgtggtgaccatgccccagtacctgaagaagagattcggcggccagagaatccaggtgtacatgagcgtgctgagcctgatcctgtacatcttcaccaagatcagcggcagctgctggtggtag

SEQ ID NO: 22415 - DNA, 1908 bp, Artificial Sequence
  Description of Artificial Sequence: Synthetic coding sequence
atgagcgtgggcgtgagcaccagcgcccccctgagccccaccagcggcaccagcgtgggcatgagcaccttcagcatcatggactacgtggtgttcgtgctgctgctggtgctgagcctggccatcggcctgtaccacgcctgcagaggctggggcagacacaccgtgggcgagctgctgatggccgacagaaagatgggctgcctgcccgtggccctgagcctgctggccaccttccagagcgccgtggccatcctgggcgtgcccagcgagatctacagattcggcacccagtactggttcctgggctgctgctacttcctgggcctgctgatccccgcccacatcttcatccccgtgttctacagactgcacctgaccagcgcctacgagtacctggagctgagattcaacaagaccgtgagagtgtgcggcaccgtgaccttcatcttccagatggtgatctacatgggcgtggtgctgtacgcccccagcctggccctgaacgccgtgaccggcttcgacctgtggctgagcgtgctggccctgggcatcgtgtgcaccgtgtacaccgccctgggcggcctgaaggccgtgatctggaccgacgtgttccagaccctggtgatgttcctgggccagctggccgtgatcatcgtgggcagcgccaaggtgggcggcctgggcagagtgtgggccgtggccagccagcacggcagaatcagcggcttcgagctggaccccgaccccttcgtgagacacaccttctggaccctggccttcggcggcgtgttcatgatgctgagcctgtacggcgtgaaccaggcccaggtgcagagatacctgagcagcagaaccgagaaggccgccgtgctgagctgctacgccgtgttccccttccagcaggtgagcctgtgcgtgggctgcctgatcggcctggtgatgttcgcctactaccaggagtaccccatgagcatccagcaggcccaggccgcccccgaccagttcgtgctgtacttcgtgatggacctgctgaagggcctgcccggcctgcccggcctgttcatcgcctgcctgttcagcggcagcctgagcaccatcagcagcgccttcaacagcctggccaccgtgaccatggaggacctgatcagaccctggttccccgagttcagcgaggccagagccatcatgctgagcagaggcctggccttcggctacggcctgctgtgcctgggcatggcctacatcagcagccagatgggccccgtgctgcaggccgccatcagcatcttcggcatggtgggcggccccctgctgggcctgttctgcctgggcatgttcttcccctgcgccaacccccccggcgccgtggtgggcctgctggccggcctggtgatggccttctggatcggcatcggcagcatcgtgaccagcatgggcagcagcatgccccccagccccagcaacggcagcagcttcagcctgcccaccaacctgaccgtggccaccgtgaccaccctgatgcccctgaccaccttcagcaagcccaccggcctgcagagattctacagcctgagctacctgtggtacagcgcccacaacagcaccaccgtgatcgtggtgggcctgatcgtgagcctgctgaccggcagaatgagaggcagaagcctgaaccccgccaccatctaccccgtgctgcccaagctgctgagcctgctgcccctgagctgccagaagagactgcactgcagaagctacggccaggaccacctggacaccggcctgttccccgagaagcccagaaacggcgtgctgggcgacagcagagacaaggaggccatggccctggacggcaccgcctaccagggcagcagcagcacctgcatcctgcaggagaccagcctgtag

SEQ ID NO: 22416 - DNA, 444 bp, Artificial Sequence
  Description of Artificial Sequence: Synthetic coding sequence
atgagcgtgggcgtgagcaccagcgcccccctgagccccaccagcggcaccagcgtgggcatgagcaccttcagcatcatggactacgtggtgttcgtgctgctgctggtgctgagcctggccatcggcctgtaccacgcctgcagaggctggggcagacacaccgtgggcgagctgctgatggccgacagaaagatgggctgcctgcccgtggccctgagcctgctggccaccttccagagcgccgtggccatcctgggcgtgcccagcgagatctacagattcggcacccagtactggttcctgggctgctgctacttcctgggcctgctgatccccgcccacatcttcatccccgtgttctacagactgcacctgaccagcgcctacgagtacctggagctgagattcaacaagaccgtgagagtgtgcggcaccgtgtag

SEQ ID NO: 22417 - DNA, 1908 bp, Artificial Sequence; identical to SEQ ID NO: 22415
  Description of Artificial Sequence: Synthetic coding sequence

SEQ ID NO: 22418 - DNA, 582 bp, Artificial Sequence
  Description of Artificial Sequence: Synthetic coding sequence
atgagcgtgggcgtgagcaccagcgcccccctgagccccaccagcggcaccagcgtgggcatgagcaccttcagcatcatggactacgtggtgttcgtgctgctgctggtgctgagcctggccatcggcctgtaccacgcctgcagaggctggggcagacacaccgtgggcgagctgctgatggccgacagaaagatgggctgcctgcccgtggccctgagcctgctggccaccttccagagcgccgtggccatcctgggcgtgcccagcgagatctacagattcggcacccagtactggttcctgggctgctgctacttcctgggcctgctgatccccgcccacatcttcatccccgtgttctacagactgcacctgaccagcgcctacgagtacctggagctgagattcaacaagaccgtgagagtgtgcggcaccgtgaccttcatcttccagatggtgatctacatgggcgtggtgctgtacgcccccagcctggccctgaacgccgtgaccggcttcgacctgtggctgagcgtgctggccctgggcatcgtgtgcaccgtgtacaccgccctgtag

SEQ ID NO: 22419 - DNA, 237 bp, Artificial Sequence
  Description of Artificial Sequence: Synthetic coding sequence
atgagcgtgggcgtgagcaccagcgcccccctgagccccaccagcggcaccagcgtgggcatgagcaccttcagcatcatggactacgtggtgttcgtgctgctgctggtgctgagcctggccatcggcctgtaccacgcctgcagaggctggggcagacacaccgtgggcgagctgctgatggccgacagaaagatgggctgcctgcccgtggccctgagcctgctggccacctag

SEQ ID NO: 22420 - DNA, 348 bp, Artificial Sequence
  Description of Artificial Sequence: Synthetic coding sequence
atgagcgtgggcgtgagcaccagcgcccccctgagccccaccagcggcaccagcgtgggcatgagcaccttcagcatcatggactacgtggtgttcgtgctgctgctggtgctgagcctggccatcggcctgtaccacgcctgcagaggctggggcagacacaccgtgggcgagctgctgatggccgacagaaagatgggctgcctgcccgtggccctgagcctgctggccaccttccagagcgccgtggccatcctgggcgtgcccagcgagatctacagattcggcacccagtactggttcctgggctgctgctacttcctgggcctgctgatccccgcccactag

SEQ ID NO: 22421 - DNA, 180 bp, Artificial Sequence
  Description of Artificial Sequence: Synthetic coding sequence
atgagcgtgggcgtgagcaccagcgcccccctgagccccaccagcggcaccagcgtgggcatgagcaccttcagcatcatggactacgtggtgttcgtgctgctgctggtgctgagcctggccatcggcctgtaccacgcctgcagaggctggggcagacacaccgtgggcgagctgtag

SEQ ID NO: 22422 - DNA, 120 bp, Artificial Sequence
  Description of Artificial Sequence: Synthetic coding sequence
atgagcgtgggcgtgagcaccagcgcccccctgagccccaccagcggcaccagcgtgggcatgagcaccttcagcatcatggactacgtggtgttcgtgctgctgctggtgctgagctag

SEQ ID NO: 22423 - DNA, 402 bp, Artificial Sequence
  Description of Artificial Sequence: Synthetic coding sequence
atgagcgtgggcgtgagcaccagcgcccccctgagccccaccagcggcaccagcgtgggcatgagcaccttcagcatcatggactacgtggtgttcgtgctgctgctggtgctgagcctggccatcggcctgtaccacgcctgcagaggctggggcagacacaccgtgggcgagctgctgatggccgacagaaagatgggctgcctgcccgtggccctgagcctgctggccaccttccagagcgccgtggccatcctgggcgtgcccagcgagatctacagattcggcacccagtactggttcctgggctgctgctacttcctgggcctgctgatccccgcccacatcttcatccccgtgttctacagactgcacctgaccagcgcctacgagtacctgtag

SEQ ID NO: 22424 - DNA, 84 bp, Artificial Sequence
  Description of Artificial Sequence: Synthetic coding sequence
atgagcgtgggcgtgagcaccagcgcccccctgagccccaccagcggcaccagcgtgggcatgagcaccttcagcatcatgtag

SEQ ID NO: 22425 - DNA, 462 bp, Artificial Sequence
  Description of Artificial Sequence: Synthetic coding sequence
atgagcgtgggcgtgagcaccagcgcccccctgagccccaccagcggcaccagcgtgggcatgagcaccttcagcatcatggactacgtggtgttcgtgctgctgctggtgctgagcctggccatcggcctgtaccacgcctgcagaggctggggcagacacaccgtgggcgagctgctgatggccgacagaaagatgggctgcctgcccgtggccctgagcctgctggccaccttccagagcgccgtggccatcctgggcgtgcccagcgagatctacagattcggcacccagtactggttcctgggctgctgctacttcctgggcctgctgatccccgcccacatcttcatccccgtgttctacagactgcacctgaccagcgcctacgagtacctggagctgagattcaacaagaccgtgagagtgtgcggcaccgtgaccttcatcttccagatgtag

SEQ ID NO: 22426 - DNA, 1746 bp, Artificial Sequence
  Description of Artificial Sequence: Synthetic coding sequence
atggagagacagaaccagtgcatccagagctggaagagaagaagaaagatggccccctggagcggcggcaccggcaccaccagatggagcctgtgcaacgtgtggagattcccctacctgtgctacaagaacggcggcggcgccttcttcatcccctacctggtgttcctgttcacctgcggcatccccgtgttcctgctggagaccgccctgggccagtacaccagccagggcggcgtgaccgcctggagaaagatctgccccatcttcgagggcatcggctacgccagccagatgatcgtgatcctgctgaacgtgtactacatcatcgtgctggcctgggccctgttctacctgttcagcagcttcaccatcgacctgccctggggcggctgctaccacgagtggaacaccgagcactgcatggagttccagaagaccaacggcagcctgaacggcaccagcgagaacgccaccagccccgtgatcgagttctgggagagaagagtgctgaagatcagcgacggcatccagcacctgggcgccctgagatgggagctggccctgtgcctgctgctggcctgggtgatctgctacttctgcatctggaagggcgtgaagagcaccggcaaggtggtgtacttcaccgccaccttcccctacctgatgctggtggtgctgctgatcagaggcgtgaccctgcccggcgccgcccagggcatccagttctacctgtaccccaacctgaccagactgtgggacccccaggtgtggatggacgccggcacccagatcttcttcagcttcgccatctgcctgggctgcctgaccgccctgggcagctacaacaagtaccacaacaactgctacagagactgcatcgccctgtgcttcctgaacagcggcaccagcttcgtggccggcttcgccatcttcagcatcctgggcttcatgagccaggagcagggcgtgcccatcagcgaggtggccgagagcggccccggcctggccttcatcgcctaccccagagccgtggtgatgctgcccttcagccccctgtgggcctgctgcttcttcttcatggtggtgctgctgggcctggacagccagttcgtgtgcgtggagagcctggtgaccgccctggtggacatgtacccccacgtgttcagaaagaagaacagaagagaggtgctgatcctgggcgtgagcgtggtgagcttcctggtgggcctgatcatgctgaccgagggcggcatgtacgtgttccagctgttcgactactacgccgccagcggcatgtgcctgctgttcgtggccatcttcgagagcctgtgcgtggcctgggtgtacggcgccaagagattctacgacaacatcgaggacatgatcggctacagaccctggcccctgatcaagtactgctggctgttcctgacccccgccgtgtgcaccgccaccttcctgttcagcctgatcaagtacacccccctgacctacaacaagaagtacacctacccctggtggggcgacgccctgggctggctgctggccctgagcagcatggtgtgcatccccgcctggagcctgtacagactgggcaccctgaagggccccttcagagagagaatcagacagctgatgtgccccgccgaggacctgccccagagaaaccccgccggccccagcgcccccgccacccccagaaccagcctgctgagactgaccgagctggagagccactgctag

SEQ ID NO: 22427 - DNA, 1809 bp, Artificial Sequence
  Description of Artificial Sequence: Synthetic coding sequence
atggacagcagagtgagcggcaccaccagcaacggcgagaccaagcccgtgtaccccgtgatggagaagaaggaggaggacggcaccctggagagaggccactggaacaacaagatggagttcgtgctgagcgtggccggcgagatcatcggcctgggcaacgtgtggagattcccctacctgtgctacaagaacggcggcggcgccttcttcatcccctacctggtgttcctgttcacctgcggcatccccgtgttcctgctggagaccgccctgggccagtacaccagccagggcggcgtgaccgcctggagaaagatctgccccatcttcgagggcatcggctacgccagccagatgatcgtgatcctgctgaacgtgtactacatcatcgtgctggcctgggccctgttctacctgttcagcagcttcaccatcgacctgccctggggcggctgctaccacgagtggaacaccgagcactgcatggagttccagaagaccaacggcagcctgaacggcaccagcgagaacgccaccagccccgtgatcgagttctgggagagaagagtgctgaagatcagcgacggcatccagcacctgggcgccctgagatgggagctggccctgtgcctgctgctggcctgggtgatctgctacttctgcatctggaagggcgtgaagagcaccggcaaggtggtgtacttcaccgccaccttcccctacctgatgctggtggtgctgctgatcagaggcgtgaccctgcccggcgccgcccagggcatccagttctacctgtaccccaacctgaccagactgtgggacccccaggtgtggatggacgccggcacccagatcttcttcagcttcgccatctgcctgggctgcctgaccgccctgggcagctacaacaagtaccacaacaactgctacagagactgcatcgccctgtgcttcctgaacagcggcaccagcttcgtggccggcttcgccatcttcagcatcctgggcttcatgagccaggagcagggcgtgcccatcagcgaggtggccgagagcggccccggcctggccttcatcgcctaccccagagccgtggtgatgctgcccttcagccccctgtgggcctgctgcttcttcttcatggtggtgctgctgggcctggacagccagttcgtgtgcgtggagagcctggtgaccgccctggtggacatgtacccccacgtgttcagaaagaagaacagaagagaggtgctgatcctgggcgtgagcgtggtgagcttcctggtgggcctgatcatgctgaccgagggcggcatgtacgtgttccagctgttcgactactacgccgccagcggcatgtgcctgctgttcgtggccatcttcgagagcctgtgcgtggcctgggtgtacggcgccaagagattctacgacaacatcgaggacatgatcggctacagaccctggcccctgatcaagtactgctggctgttcctgacccccgccgtgtgcaccgccaccttcctgttcagcctgatcaagtacacccccctgacctacaacaagaagtacacctacccctggtggggcgacgccctgggctggctgctggccctgagcagcatggtgtgcatccccgcctggagcctgtacagactgggcaccctgaagggccccttcagagagagaatcagacagctgatgtgccccgccgaggacctgccccagagaaaccccgccggccccagcgcccccgccacccccagaaccagcctgctgagactgaccgagctggagagccactgctag

SEQ ID NO: 22428 - DNA, 294 bp, Artificial Sequence
  Description of Artificial Sequence: Synthetic coding sequence
atggacagcagagtgagcggcaccaccagcaacggcgagaccaagcccgtgtaccccgtgatggagaagaaggaggaggacggcaccctggagagaggccactggaacaacaagatggagttcgtgctgagcgtggccggcgagatcatcggcctgggcaacgtgtggagattcccctacctgtgctacaagaacggcggcggcgagatgagagccctggtgcccccccaccccctgctggagggcggctacttccacctgctgcacctgagacccctgtggggcgtgccctag

SEQ ID NO: 22429 - DNA, 1533 bp, Artificial Sequence
  Description of Artificial Sequence: Synthetic coding sequence
atggacagcagagtgagcggcaccaccagcaacggcgagaccaagcccgtgtaccccgtgatggagaagaaggaggaggacggcaccctggagagaggccactggaacaacaagatggagttcgtgctgagcgtggccggcgagatcatcggcctgggcaacgtgtggagattcccctacctgtgctacaagaacggcggcgagcactgcatggagttccagaagaccaacggcagcctgaacggcaccagcgagaacgccaccagccccgtgatcgagttctgggagagaagagtgctgaagatcagcgacggcatccagcacctgggcgccctgagatgggagctggccctgtgcctgctgctggcctgggtgatctgctacttctgcatctggaagggcgtgaagagcaccggcaaggtggtgtacttcaccgccaccttcccctacctgatgctggtggtgctgctgatcagaggcgtgaccctgcccggcgccgcccagggcatccagttctacctgtaccccaacctgaccagactgtgggacccccaggtgtggatggacgccggcacccagatcttcttcagcttcgccatctgcctgggctgcctgaccgccctgggcagctacaacaagtaccacaacaactgctacagagactgcatcgccctgtgcttcctgaacagcggcaccagcttcgtggccggcttcgccatcttcagcatcctgggcttcatgagccaggagcagggcgtgcccatcagcgaggtggccgagagcggccccggcctggccttcatcgcctaccccagagccgtggtgatgctgcccttcagccccctgtgggcctgctgcttcttcttcatggtggtgctgctgggcctggacagccagttcgtgtgcgtggagagcctggtgaccgccctggtggacatgtacccccacgtgttcagaaagaagaacagaagagaggtgctgatcctgggcgtgagcgtggtgagcttcctggtgggcctgatcatgctgaccgagggcggcatgtacgtgttccagctgttcgactactacgccgccagcggcatgtgcctgctgttcgtggccatcttcgagagcctgtgcgtggcctgggtgtacggcgccaagagattctacgacaacatcgaggacatgatcggctacagaccctggcccctgatcaagtactgctggctgttcctgacccccgccgtgtgcaccgccaccttcctgttcagcctgatcaagtacacccccctgacctacaacaagaagtacacctacccctggtggggcgacgccctgggctggctgctggccctgagcagcatggtgtgcatccccgcctggagcctgtacagactgggcaccctgaagggccccttcagagagagaatcagacagctgatgtgccccgccgaggacctgccccagagaaaccccgccggccccagcgcccccgccacccccagaaccagcctgctgagactgaccgagctggagagccactgctag

SEQ ID NO: 22430 - DNA, 2193 bp, Artificial Sequence
  Description of Artificial Sequence: Synthetic coding sequence
atgcccaagaacagcaaggtggtgaagagagagctggacgacgacgtgaccgagagcgtgaaggacctgctgagcaacgaggacgccgccgacgacgccttcaagaccagcgagctgatcgtggacggccaggaggagaaggacaccgacgtggaggagggcagcgaggtggaggacgagagacccgcctggaacagcaagctgcagtacatcctggcccaggtgggcttcagcgtgggcctgggcaacgtgtggagattcccctacctgtgccagaagaacggcggcggcgcctacctgctgccctacctgatcctgctgatggtgatcggcatccccctgttcttcctggagctgagcgtgggccagagaatcagaagaggcagcatcggcgtgtggaactacatcagccccaagctgggcggcatcggcttcgccagctgcgtggtgtgctacttcgtggccctgtactacaacgtgatcatcggctggagcctgttctacttcagccagagcttccagcagcccctgccctgggaccagtgccccctggtgaagaacgccagccacaccttcgtggagcccgagtgcgagcagagcagcgccaccacctactactggtacagagaggccctgaacatcagcagcagcatcagcgagagcggcggcctgaactggaagatgaccatctgcctgctggccgcctgggtgatggtgtgcctggccatgatcaagggcatccagagcagcggcaagatcatctacttcagcagcctgttcccctacgtggtgctgatctgcttcctgatcagagccttcctgctgaacggcagcatcgacggcatcagacacatgttcacccccaagctggagatcatgctggagcccaaggtgtggagagaggccgccacccaggtgttcttcgccctgggcctgggcttcggcggcgtgatcgccttcagcagctacaacaagagagacaacaactgccacttcgacgccgtgctggtgagcttcatcaacttcttcaccagcgtgctggccaccctggtggtgttcgccgtgctgggcttcaaggccaacgtgatcaacgagaagtgcatcacccagaacagcgagaccatcatgaagttcctgaagatgggcaacatcagccaggacatcatcccccaccacatcaacctgagcaccgtgaccgccgaggactaccacctggtgtacgacatcatccagaaggtgaaggaggaggagttccccgccctgcacctgaacagctgcaagatcgaggaggagctgaacaaggccgtgcagggcaccggcctggccttcatcgccttcaccgaggccatgacccacttccccgccagccccttctggagcgtgatgttcttcctgatgctggtgaacctgggcctgggcagcatgttcggcaccatcgagggcatcgtgacccccatcgtggacaccttcaaggtgagaaaggagatcctgaccgtgatctgctgcctgctggccttctgcatcggcctgatcttcgtgcagagaagcggcaactacttcgtgaccatgttcgacgactacagcgccaccctgcccctgctgatcgtggtgatcctggagaacatcgccgtgtgcttcgtgtacggcatcgacaagttcatggaggacctgaaggacatgctgggcttcgcccccagcagatactactactacatgtggaagtacatcagccccctgatgctgctgagcctgctgatcgccagcgtggtgaacatgggcctgagcccccccggctacaacgcctggatcgaggacaaggccagcgaggagttcctgagctaccccacctggggcctggtggtgtgcgtgagcctggtggtgttcgccatcctgcccgtgcccgtggtgttcatcgtgagaagattcaacctgatcgacgacagcagcggcaacctggccagcgtgacctacaagagaggcagagtgctgaaggagcccgtgaacctggagggcgacgacaccagcctgatccacggcaagatccccagcgagatgcccagccccaacttcggcaagaacatctacagaaagcagagcggcagccccaccctggacaccgcccccaacggcagatacggcatcggctacctgatggccgacatcatgcccgacatgcccgagagcgacctgtag

SEQ ID NO: 22431 - DNA, 750 bp, Artificial Sequence
  Description of Artificial Sequence: Synthetic coding sequence
atgttcacccccaagctggagatcatgctggagcccaaggtgtggagagaggccgccacccaggtgttcttcgccctgggcctgggcttcggcggcgtgatcgccttcagcagctacaacaagagagacaacaactgccacttcgacgccgtgctggtgagcttcatcaacttcttcaccagcgtgctggccaccctggtggtgttcgccgtgctgggcttcaaggccaacgtgatcaacgagaagtgcatcacccagaacagcgagaccatcatgaagttcctgaagatgggcaacatcagccaggacatcatcccccaccacatcaacctgagcaccgtgaccgccgaggactaccacctggtgtacgacatcatccagaaggtgaaggaggaggagttccccgccctgcacctgaacagctgcaagatcgaggaggagctgaacaaggccgtgcagggcaccggcctggccttcatcgccttcaccgaggccatgacccacttccccgccagccccttctggagcgtgatgttcttcctgatgctggtgaacctgggcctgggcagcatgttcggcaccatcgagggcatcgtgacccccatcgtggacaccttcaaggtgagaaaggagatcctgaccgtgatctgctgcctgctggccttctgcatcggcctgatcctgtgcaacgccctggagatcaccctgctgcagtgcctgatgatcatcctgctgcactgcctgtgctag

SEQ ID NO: 22432 - DNA, 870 bp, Artificial Sequence
  Description of Artificial Sequence: Synthetic coding sequence
atgcccaagaacagcaaggtggtgaagagagagctggacgacgacgtgaccgagagcgtgaaggacctgctgagcaacgaggacgccgccgacgacgccttcaagaccagcgagctgatcgtggacggccaggaggagaaggacaccgacgtggaggagggcagcgaggtggaggacgagagacccgcctggaacagcaagctgcagtacatcctggcccaggtgggcttcagcgtgggcctgggcaacgtgtggagattcccctacctgtgccagaagaacggcggcggcgcctacctgctgccctacctgatcctgctgatggtgatcggcatccccctgttcttcctggagctgagcgtgggccagagaatcagaagaggcagcatcggcgtgtggaactacatcagccccaagctgggcggcatcggcttcgccagctgcgtggtgtgctacttcgtggccctgtactacaacgtgatcatcggctggagcctgttctacttcagccagagcttccagcagcccctgccctgggaccagtgccccctggtgaagaacgccagccacaccttcgtggagcccgagtgcgagcagagcagcgccaccacctactactggtacagagaggccctgaacatcagcagcagcatcagcgagagcggcggcctgaactggaagatgaccatctgcctgctggccgcctgggtgatggtgtgcctggccatgatcaagggcatccagagcagcggcaaggtgagcatgctggagcccttcctgatcctgctgatcaccatcagcggcttcatccccctgagcaacagcgtgaccgacttctgcggccagatcacccacaacaccagcttctag

SEQ ID NO: 22433 - DNA, 291 bp, Artificial Sequence
  Description of Artificial Sequence: Synthetic coding sequence
atgcccaagaacagcaaggtggtgaagagagagctggacgacgacgtgaccgagagcgtgaaggacctgctgagcaacgaggacgccgccgacgacgccttcaagaccagcgagctgatcgtggacggccaggaggagaaggacaccgacgtggaggagggcagcgaggtggaggacgagagacccgcctggaacagcaagctgcagtacatcctggcccaggtgggcttcagcgtgggcctgggcaacgtgtggagattcccctacctgtgccagaagaacggcggctag

SEQ ID NO: 22434 - DNA, 1872 bp, Artificial Sequence
  Description of Artificial Sequence: Synthetic coding sequence
atggtgatcggcatccccctgttcttcctggagctgagcgtgggccagagaatcagaagaggcagcatcggcgtgtggaactacatcagccccaagctgggcggcatcggcttcgccagctgcgtggtgtgctacttcgtggccctgtactacaacgtgatcatcggctggagcctgttctacttcagccagagcttccagcagcccctgccctgggaccagtgccccctggtgaagaacgccagccacaccttcgtggagcccgagtgcgagcagagcagcgccaccacctactactggtacagagaggccctgaacatcagcagcagcatcagcgagagcggcggcctgaactggaagatgaccatctgcctgctggccgcctgggtgatggtgtgcctggccatgatcaagggcatccagagcagcggcaagatcatctacttcagcagcctgttcccctacgtggtgctgatctgcttcctgatcagagccttcctgctgaacggcagcatcgacggcatcagacacatgttcacccccaagctggagatcatgctggagcccaaggtgtggagagaggccgccacccaggtgttcttcgccctgggcctgggcttcggcggcgtgatcgccttcagcagctacaacaagagagacaacaactgccacttcgacgccgtgctggtgagcttcatcaacttcttcaccagcgtgctggccaccctggtggtgttcgccgtgctgggcttcaaggccaacgtgatcaacgagaagtgcatcacccagaacagcgagaccatcatgaagttcctgaagatgggcaacatcagccaggacatcatcccccaccacatcaacctgagcaccgtgaccgccgaggactaccacctggtgtacgacatcatccagaaggtgaaggaggaggagttccccgccctgcacctgaacagctgcaagatcgaggaggagctgaacaaggccgtgcagggcaccggcctggccttcatcgccttcaccgaggccatgacccacttccccgccagccccttctggagcgtgatgttcttcctgatgctggtgaacctgggcctgggcagcatgttcggcaccatcgagggcatcgtgacccccatcgtggacaccttcaaggtgagaaaggagatcctgaccgtgatctgctgcctgctggccttctgcatcggcctgatcttcgtgcagagaagcggcaactacttcgtgaccatgttcgacgactacagcgccaccctgcccctgctgatcgtggtgatcctggagaacatcgccgtgtgcttcgtgtacggcatcgacaagttcatggaggacctgaaggacatgctgggcttcgcccccagcagatactactactacatgtggaagtacatcagccccctgatgctgctgagcctgctgatcgccagcgtggtgaacatgggcctgagcccccccggctacaacgcctggatcgaggacaaggccagcgaggagttcctgagctaccccacctggggcctggtggtgtgcgtgagcctggtggtgttcgccatcctgcccgtgcccgtggtgttcatcgtgagaagattcaacctgatcgacgacagcagcggcaacctggccagcgtgacctacaagagaggcagagtgctgaaggagcccgtgaacctggagggcgacgacaccagcctgatccacggcaagatccccagcgagatgcccagccccaacttcggcaagaacatctacagaaagcagagcggcagccccaccctggacaccgcccccaacggcagatacggcatcggctacctgatggccgacatcatgcccgacatgcccgagagcgacctgtag

SEQ ID NO: 22435 - DNA, 2211 bp, Artificial Sequence
  Description of Artificial Sequence: Synthetic coding sequence
atgaagaccgaggcccagcccagcaccagcctgctggccaacaccagctggaccggcaccgtgatcagcgacagcgtgcccggcagccagacctgggaggacaagggcagcctgaccagaagcgccaccagctggaccagcgaggcccaggtgagcgccgccagagtggccgaggcccaggccagaaccagccagcccaagcagatcagcgtgctggaggccctgaccgccagcgccctgaaccagaagcccacccacgagaaggtgcagatgaccgagaagaaggagagcgaggtgctgctggccagacccttctggagcagcaagaccgagtacatcctggcccaggtgggcttcagcatgaagcccagctgcctgtggagattcgcctacctgtggctgaacagcggcggctgcagcttcgccgccatctacatcttcatgctgttcctggtgggcgtgcccctgctgttcctggagatggccgccggccagagcatgagacagggcggcatgggcgtgtggaagatcatcgccccctggatcggcggcgtgggctacagcagcttcatggtgtgcttcatcctgggcctgtacttcaacgtggtgaacagctggatcatcttctacatgagccagagcttccagttccccgtgccctgggagaagtgccccctgaccatgaacagcagcggcttcgaccccgagtgcgagagaaccacccccagcatctacttctggtaccagcaggccctgaaggccagcgacagaatcgaggacggcggcagccccgtgtacagcctggtgctgcccttcttcctgtgctggtgcctggtgggcgccttcatgatcaacggcctgaagagcaccggcaaggtgatctacgtgctggtgctgctgccctgcttcatcatcgtgggcttcttcatcagaaccctgctgctggagggcgccaagttcggcctgcagcagctggtggtggccaagatcagcgacgtgtacaacatgagcgtgtggagcctggccggcggccaggtgctgagcaacaccggcatcggcctgggcagcgtggccagcctggccagctacatgccccagagcaacaactgcctgagcgacgccttcctggtgagcgtgatcaacctgctgaccctgctggtgttcaccagcttcaacttctgcgtgctgggcttctgggccaccgtgatcacccacagatgctgcgagagaaacgccgagatcctgctgaagctgatcaacctgggcaagctgccccccgacgccaagccccccgtgaacctgctgtacaaccccaccagcatctacaacgcctggctgagcggcctgccccagcacatcaagagcatggtgctgagagaggtgaccgagtgcaacatcgagacccagttcctgaaggccagcgagggccccaagttcgccttcctgagcttcgtggaggccatgagcttcctgccccccagcgtgttctggagcttcatcttcttcctgatgctgctggccatgggcctgagcagcgccatcggcatcatgcagggcatcatcacccccctgcaggacaccttcagcttcttcagaaagcacaccaagctgctgatcgtgggcgtgttcctgctgatgttcgtgtgcggcctgttcttcaccagacccagcggcagctacttcatcagactgctgagcgactactggatcgtgttccccatcatcgtggtggtggtgttcgagaccatggccgtgagctgggcctacggcgccagaagattcctggccgacctgaccatcctgctgggccaccccatcagccccatcttcggctggctgtggccccacctgtgccccgtggtgctgctgatcatcttcgtgaccatgatggtgcacctgtgcatgaagcccatcacctacatgagctgggacagcagcaccagcaaggaggtgctgagaccctaccccccctgggccctgctgctgatgatcaccctgttcgccatcgtgatcctgcccatccccgcctacttcgtgtactgcagaatccacagaatccccttcagacccaagagcggcgacggccccatgaccgccagcaccagcctgcccctgagccaccagctgacccccagcaaggaggtgcagaaggaggagatcctgcaggtggacgagaccaagtaccccagcacctgcaacgtgaccagctag

SEQ ID NO: 22436 - DNA, 1980 bp, Artificial Sequence
  Description of Artificial Sequence: Synthetic coding sequence
atgaagaccgaggcccagcccagcaccagcctgctggccaacaccagctggaccggcaccgtgatcagcgacagcgtgcccggcagccagacctgggaggacaagggcagcctgaccagaagcgccaccagctggaccagcgaggcccaggtgagcgccgccagagtggccgaggcccaggccagaaccagccagcccaagcagatcagcgtgctggaggccctgaccgccagcgccctgaaccagaagcccacccacgagaaggtgcagatgaccgagaagaaggagagcgaggtgctgctggccagacccttctggagcagcaagaccgagtacatcctggcccaggtgggcttcagcatgaagcccagctgcctgtggagattcgcctacctgtggctgaacagcggcggctgcagcttcgccgccatctacatcttcatgctgttcctggtgggcgtgcccctgctgttcctggagatggccgccggccagagcatgagacagggcggcatgggcgtgtggaagatcatcgccccctggatcggcggcgtgggctacagcagcttcatggtgtgcttcatcctgggcctgtacttcaacgtggtgaacagctggatcatcttctacatgagccagagcttccagttccccgtgccctgggagaagtgccccctgaccatgaacagcagcggcttcgaccccgagtgcgagagaaccacccccagcatctacttctggtaccagcaggccctgaaggccagcgacagaatcgaggacggcggcagccccgtgtacagcctggtgctgcccttcttcctgtgctggtgcctggtgggcgccttcatgatcaacggcctgaagagcaccggcaaggtgatctacgtgctggtgctgctgccctgcttcatcatcgtgggcttcttcatcagaaccctgctgctggagggcgccaagttcggcctgcagcagctggtggtggccaagatcagcgacgtgtacaacatgagcgtgtggagcctggccggcggccaggtgctgagcaacaccggcatcggcctgggcagcgtggccagcctggccagctacatgccccagagcaacaactgcctgagcgacgccttcctggtgagcgtgatcaacctgctgaccctgctggtgttcaccagcttcaacttctgcgtgctgggcttctgggccaccgtgatcacccacagatgctgcgagagaaacgccgagatcctgctgaagctgatcaacctgggcaagctgccccccgacgccaagccccccgtgaacctgctgtacaaccccaccagcatctacaacgcctggctgagcggcctgccccagcacatcaagagcatggtgctgagagaggtgaccgagtgcaacatcgagacccagttcctgaaggccagcgagggccccaagttcgccttcctgagcttcgtggaggccatgagcttcctgccccccagcgtgttctggagcttcatcttcttcctgatgctgctggccatgggcctgagcagcgccatcggcatcatgcagggcatcatcacccccctgcaggacaccttcagcttcttcagaaagcacaccaagctgctgatcgtgggcgtgttcctgctgatgttcgtgtgcggcctgttcttcaccagacccagcggcagctacttcatcagactgctgagcgactactggatcgtgttccccatcatcgtggtggtggtgttcgagaccatggccgtgagctgggcctacggcgccagaagattcctggccgacctgaccatcctgctgggccaccccatcagccccatcttcggctggctgtggccccacctgtgccccgtggtgctgctgatcatcttcgtgaccatgatggtgcacctgtgcatgaagcccatcacctacatgagctgggacagcagcaccgtgagcctgccccaggaccccgagcccctgtgggagtag

SEQ ID NO: 22437 - DNA, 2184 bp, Artificial Sequence
  Description of Artificial Sequence: Synthetic coding sequence
atgcccaagaacagcaaggtgacccagagagagcacagcagcgagcacgtgaccgagagcgtggccgacctgctggccctggaggagcccgtggactacaagcagagcgtgctgaacgtggccggcgaggccggcggcaagcagaaggccgtggaggaggagctggacgccgaggacagacccgcctggaacagcaagctgcagtacatcctggcccagatcggcttcagcgtgggcctgggcaacatctggagattcccctacctgtgccagaagaacggcggcggcgcctacctggtgccctacctggtgctgctgatcatcatcggcatccccctgttcttcctggagctggccgtgggccagagaatcagaagaggcagcatcggcgtgtggcactacatctgccccagactgggcggcatcggcttcagcagctgcatcgtgtgcctgttcgtgggcctgtactacaacgtgatcatcggctggagcatcttctacttcttcaagagcttccagtaccccctgccctggagcgagtgccccgtggtgagaaacggcagcgtggccgtggtggaggccgagtgcgagaagagcagcgccaccacctacttctggtacagagaggccctggacatcagcgacagcatcagcgagagcggcggcctgaactggaagatgaccctgtgcctgctggtggcctggagcatcgtgggcatggccgtggtgaagggcatccagagcagcggcaaggtgatgtacttcagcagcctgttcccctacgtggtgctggcctgcttcctggtgagaggcctgctgctgagaggcgccgtggacggcatcctgcacatgttcacccccaagctggacaagatgctggacccccaggtgtggagagaggccgccacccaggtgttcttcgccctgggcctgggcttcggcggcgtgatcgccttcagcagctacaacaagcaggacaacaactgccacttcgacgccgccctggtgagcttcatcaacttcttcaccagcgtgctggccaccctggtggtgttcgccgtgctgggcttcaaggccaacatcatgaacgagaagtgcgtggtggagaacgccgagaagatcctgggctacctgaacaccaacgtgctgagcagagacctgatccccccccacgtgaacttcagccacctgaccaccaaggactacatggagatgtacaacgtgatcatgaccgtgaaggaggaccagttcagcgccctgggcctggacccctgcctgctggaggacgagctggacaagagcgtgcagggcaccggcctggccttcatcgccttcaccgaggccatgacccacttccccgccagccccttctggagcgtgatgttcttcctgatgctgatcaacctgggcctgggcagcatgatcggcaccatggccggcatcaccacccccatcatcgacaccttcaaggtgcccaaggagatgttcaccgtgggctgctgcgtgttcgccttcctggtgggcctgctgttcgtgcagagaagcggcaactacttcgtgaccatgttcgacgactacagcgccaccctgcccctgaccctgatcgtgatcctggagaacatcgccgtggcctggatctacggcaccaagaagttcatgcaggagctgaccgagatgctgggcttcagaccctacagattctacttctacatgtggaagttcgtgagccccctgtgcatggccgtgctgaccaccgccagcatcatccagctgggcgtgaccccccccggctacagcgcctggatcaaggaggaggccgccgagagatacctgtacttccccaactgggccatggccctgctgatcaccctgatcgtggtggccaccctgcccatccccgtggtgttcgtgctgagacacttccacctgctgagcgacggcagcaacaccctgagcgtgagctacaagaagggcagaatgatgaaggacatcagcaacctggaggagaacgacgagaccagattcatcctgagcaaggtgcccagcgaggcccccagccccatgcccacccacagaagctacctgggccccggcagcaccagccccctggagaccagcggcaaccccaacggcagatacggcagcggctacctgctggccagcacccccgagagcgagctgtag

SEQ ID NO: 22438 - DNA, 2184 bp, Artificial Sequence; identical to SEQ ID NO: 22437
  Description of Artificial Sequence: Synthetic coding sequence

SEQ ID NO: 22439 - DNA, 1506 bp, Artificial Sequence
  Description of Artificial Sequence: Synthetic coding sequence
atggtgagaaagcccgtggtgagcaccatcagcaagggcggctacctgcagggcaacgtgaacggcagactgcccagcctgggcaacaaggagccccccggccaggagaaggtgcagctgaagagaaaggtgaccctgctgagaggcgtgagcatcatcatcggcaccatcatcggcgccggcatcttcatcagccccaagggcgtgctgcagaacaccggcagcgtgggcatgagcctgaccatctggaccgtgtgcggcgtgctgagcctgttcggcgccctgagctacgccgagctgggcaccaccatcaagaagagcggcggccactacacctacatcctggaggtgttcggccccctgcccgccttcgtgagagtgtgggtggagctgctgatcatcagacccgccgccaccgccgtgatcagcctggccttcggcagatacatcctggagcccttcttcatccagtgcgagatccccgagctggccatcaagctgatcaccgccgtgggcatcaccgtggtgatggtgctgaacagcatgagcgtgagctggagcgccagaatccagatcttcctgaccttctgcaagctgaccgccatcctgatcatcatcgtgcccggcgtgatgcagctgatcaagggccagacccagaacttcaaggacgccttcagcggcagagacagcagcatcaccagactgcccctggccttctactacggcatgtacgcctacgccggctggttctacctgaacttcgtgaccgaggaggtggagaaccccgagaagaccatccccctggccatctgcatcagcatggccatcgtgaccatcggctacgtgctgaccaacgtggcctacttcaccaccatcaacgccgaggagctgctgctgagcaacgccgtggccgtgaccttcagcgagagactgctgggcaacttcagcctggccgtgcccatcttcgtggccctgagctgcttcggcagcatgaacggcggcgtgttcgccgtgagcagactgttctacgtggccagcagagagggccacctgcccgagatcctgagcatgatccacgtgagaaagcacacccccctgcccgccgtgatcgtgctgcaccccctgaccatgatcatgctgttcagcggcgacctggacagcctgctgaacttcctgagcttcgccagatggctgttcatcggcctggccgtggccggcctgatctacctgagatacaagtgccccgacatgcacagacccttcaaggtgcccctgttcatccccgccctgttcagcttcacctgcctgttcatggtggccctgagcctgtacagcgaccccttcagcaccggcatcggcttcgtgatcaccctgaccggcgtgcccgcctactacctgttcatcatctgggacaagaagcccagatggttcagaatcatgagcgagaagatcaccagaaccctgcagatcatcctggaggtggtgcccgaggaggacaagctgtag

SEQ ID NO: 22440 - DNA, 1413 bp, Artificial Sequence
  Description of Artificial Sequence: Synthetic coding sequence
atggacagaggcgagaagatccagctgaagagagtgttcggctactggtggggcaccagcttcctgctgatcaacatcatcggcgccggcatcttcgtgagccccaagggcgtgctggcctacagctgcatgaacgtgggcgtgagcctgtgcgtgtgggccggctgcgccatcctggccatgaccagcaccctgtgcagcgccgagatcagcatcagcttcccctgcagcggcgcccagtactacttcctgaagagatacttcggcagcaccgtggccttcctgaacctgtggaccagcctgttcctgggcagcggcgtggtggccggccaggccctgctgctggccgagtacagcatccagcccttcttccccagctgcagcgtgcccaagctgcccaagaagtgcctggccctggccatgctgtggatcgtgggcatcctgaccagcagaggcgtgaaggaggtgacctggctgcagatcgccagcagcgtgctgaaggtgagcatcctgagcttcatcagcctgaccggcgtggtgttcctgatcagaggcaagaaggagaacgtggagagattccagaacgccttcgacgccgagctgcccgacatcagccacctgatccaggccatcttccagggctacttcgcctacagcggcggcgcctgcttcaccctgatcgccggcgagctgaagaagcccagaaccaccatccccaagtgcatcttcaccgccctgcccctggtgaccgtggtgtacctgctggtgaacatcagctacctgaccgtgctgacccccagagagatcctgagcagcgacgccgtggccatcacctgggccgacagagccttccccagcctggcctggatcatgcccttcgccatcagcaccagcctgttcagcaacctgctgatcagcatcttcaagagcagcagacccatctacctggccagccaggagggccagctgcccctgctgttcaacaccctgaacagccacagcagccccttcaccgccgtgctgctgctggtgaccctgggcagcctggccatcatcctgaccagcctgatcgacctgatcaactacatcttcttcaccggcagcctgtggagcatcctgctgatgatcggcatcctgagaagaagataccaggagcccaacctgagcatcccctacaaggtgttcctgagcttccccctggccaccatcgtgatcgacgtgggcctggtggtgatccccctggtgaagagccccaacgtgcactacgtgtacgtgctgctgctggtgctgagcggcctgctgttctacatccccctgatccacttcaagatcagactggcctggttcgagaagatgacctgctacctgcagctgctgttcaacatctgcctgcccgacgtgagcgaggagtag

SEQ ID NO: 22441 - DNA, 1302 bp, Artificial Sequence
  Description of Artificial Sequence: Synthetic coding sequence
atggacagaggcgagaagatccagctgaagagagtgttcggctactggtggggcaccagcttcctgctgatcaacatcatcggcgccggcatcttcgtgagccccaagggcgtgctggcctacagctgcatgaacgtgggcgtgagcctgtgcgtgtgggccggctgcgccatcctggccatgaccagcaccctgtgcagcgccgagatcagcatcagcttcccctgcagcggcgcccagtactacttcctgaagagatacttcggcagcaccgtggccttcctgaacctgtggaccagcctgttcctgggcagcggcgtggtggccggccaggccctgctgctggccgagtacagcatccagcccttcttccccagctgcagcgtgcccaagctgcccaagaagtgcctggccctggccatgctgtggatcgtgggcatcctgaccagcagaggcgtgaaggaggtgacctggctgcagatcgccagcagcgtgctgaaggtgagcatcctgagcttcatcagcctgaccggcgtggtgttcctgatcagaggcaagaaggagaacgtggagagattccagaacgccttcgacgccgagctgcccgacatcagccacctgatccaggccatcttccagggctacttcgcctacagcggcgagctgaagaagcccagaaccaccatccccaagtgcatcttcaccgccctgcccctggtgaccgtggtgtacctgctggtgaacatcagctacctgaccgtgctgacccccagagagatcctgagcagcgacgccgtggccatcacctgggccgacagagccttccccagcctggcctggatcatgcccttcgccatcagcaccagcctgttcagcaacctgctgatcagcatcttcaagagcagcagacccatctacctggccagccaggagggccagctgcccctgctgttcaacaccctgaacagccacagcagccccttcaccgccgtgctgctgctggtgaccctgggcagcctggccatcatcctgaccagcctgatcgacctgatcaactacatcttcttcaccggcagcctgtggagcatcctgctgatgatcggcatcctgagaagaagataccaggagcccaacctgagcatcccctacaagagcctgatcctggtggtgcaggccggcgaggccggcgtgcagtggcacgacctgggcctgctgcagcccctgctgcccggcttcaagagattcagctgcctgagcctgcccagcagctgggactacagatgcttctgccacttccactag

SEQ ID NO: 22442 - DNA, 1860 bp, Artificial Sequence
  Description of Artificial Sequence: Synthetic coding sequence
atgccctggcaggccttcagaagattcggccagaagctggtgagaagaagaaccctggagagcggcatggccgagaccagactggccagatgcctgagcaccctggacctggtggccctgggcgtgggcagcaccctgggcgccggcgtgtacgtgctggccggcgaggtggccaaggacaaggccggccccagcatcgtgatctgcttcctggtggccgccctgagcagcgtgctggccggcctgtgctacgccgagttcggcgccagagtgcccagaagcggcagcgcctacctgtacagctacgtgaccgtgggcgagctgtgggccttcaccaccggctggaacctgatcctgagctacgtgatcggcaccgccagcgtggccagagcctggagcagcgccttcgacaacctgatcggcaaccacatcagcaagaccctgcagggcagcatcgccctgcacgtgccccacgtgctggccgagtaccccgacttcttcgccctgggcctggtgctgctgctgaccggcctgctggccctgggcgccagcgagagcgccctggtgaccaaggtgttcaccggcgtgaacctgctggtgctgggcttcgtgatgatcagcggcttcgtgaagggcgacgtgcacaactggaagctgaccgaggaggactacgagctggccatggccgagctgaacgacacctacagcctgggccccctgggcagcggcggcttcgtgcccttcggcttcgagggcatcctgagaggcgccgccacctgcttctacgccttcgtgggcttcgactgcatcgccaccaccggcgaggaggcccagaacccccagagaagcatccccatgggcatcgtgatcagcctgagcgtgtgcttcctggcctacttcgccgtgagcagcgccctgaccctgatgatgccctactaccagctgcagcccgagagccccctgcccgaggccttcctgtacatcggctgggcccccgccagatacgtggtggccgtgggcagcctgtgcgccctgagcaccagcctgctgggcagcatgttccccatgcccagagtgatctacgccatggccgaggacggcctgctgttcagagtgctggccagaatccacaccggcaccagaacccccatcatcgccaccgtggtgagcggcatcatcgccgccttcatggccttcctgttcaagctgaccgacctggtggacctgatgagcatcggcaccctgctggcctacagcctggtgagcatctgcgtgctgatcctgagataccagcccgaccaggagaccaagaccggcgaggaggtggagctgcaggaggaggccatcaccaccgagagcgagaagctgaccctgtggggcctgttcttccccctgaacagcatccccacccccctgagcggccagatcgtgtacgtgtgcagcagcctgctggccgtgctgctgaccgccctgtgcctggtgctggcccagtggagcgtgcccctgctgagcggcgacctgctgtggaccgccgtggtggtgctgctgctgctgctgatcatcggcatcatcgtggtgatctggagacagccccagagcagcacccccctgcacttcaaggtgcccgccctgcccctgctgcccctgatgagcatcttcgtgaacatctacctgatgatgcagatgaccgccggcacctgggccagattcggcgtgtggatgctgatcggcttcgccatctacttcggctacggcatccagcacagcctggaggagatcaagagcaaccagcccagcagaaagagcagagccaagaccgtggacctggaccccggcaccctgtacgtgcacagcgtgtag

SEQ ID NO: 22443 - DNA, 1860 bp, Artificial Sequence; identical to SEQ ID NO: 22442
  Description of Artificial Sequence: Synthetic coding sequence

SEQ ID NO: 22444 - DNA, 1572 bp, Artificial Sequence
  Description of Artificial Sequence: Synthetic coding sequence
atggccggccacacccagcagcccagcggcagaggcaaccccagacccgcccccagccccagccccgtgcccggcaccgtgcccggcgccagcgagagagtggccctgaagaaggagatcggcctgctgagcgcctgcaccatcatcatcggcaacatcatcggcagcggcatcttcatcagccccaagggcgtgctggagcacagcggcagcgtgggcctggccctgttcgtgtgggtgctgggcggcggcgtgaccgccctgggcagcctgtgctacgccgagctgggcgtggccatccccaagagcggcggcgactacgcctacgtgaccgagatcttcggcggcctggccggcttcctgctgctgtggagcgccgtgctgatcatgtaccccaccagcctggccgtgatcagcatgaccttcagcaactacgtgctgcagcccgtgttccccaactgcatcccccccaccaccgccagcagagtgctgagcatggcctgcctgatgctgctgacctgggtgaacagcagcagcgtgagatgggccaccagaatccaggacatgttcaccggcggcaagctgctggccctgagcctgatcatcggcgtgggcctgctgcagatcttccagggccacttcgaggagctgagacccagcaacgccttcgccttctggatgacccccagcgtgggccacctggccctggccttcctgcagggcagcttcgccttcagcggctggaacttcctgaactacgtgaccgaggagatggtggacgccagaaagaacctgcccagagccatcttcatcagcatccccctggtgaccttcgtgtacaccttcaccaacatcgcctacttcaccgccatgagcccccaggagctgctgagcagcaacgccgtggccgtgaccttcggcgagaagctgctgggctacttcagctgggtgatgcccgtgagcgtggccctgagcaccttcggcggcatcaacggctacctgttcacctacagcagactgtgcttcagcggcgccagagagggccacctgcccagcctgctggccatgatccacgtgagacactgcacccccatccccgccctgctggtgtgctgcggcgccaccgccgtgatcatgctggtgggcgacacctacaccctgatcaactacgtgagcttcatcaactacctgtgctacggcgtgaccatcctgggcctgctgctgctgagatggagaagacccgccctgcacagacccatcaaggtgaacctgctgatccccgtggcctacctggtgttctgggccttcctgctggtgttcagcttcatcagcgagcccatggtgtgcggcgtgggcgtgatcatcatcctgaccggcgtgcccatcttcttcctgggcgtgttctggagaagcaagcccaagtgcgtgcacagactgaccgagagcatgacccactggggccaggagctgtgcttcgtggtgtacccccaggacgcccccgaggaggaggagaacggcccctgcccccccagcctgctgcccgccaccgacaagcccagcaagccccagtag

SEQ ID NO: 22445 - DNA, 1080 bp, Artificial Sequence
  Description of Artificial Sequence: Synthetic coding sequence
atggcccccaacggcaccgccagcagcttctgcctggacagcaccgcctgcaagatcaccatcaccgtggtgctggccgtgctgatcctgatcaccgtggccggcaacgtggtggtgtgcctggccgtgggcctgaacagaagactgagaaacctgaccaactgcttcatcgtgagcctggccatcaccgacctgctgctgggcctgctggtgctgcccttcagcgccatctaccagctgagctgcaagtggagcttcggcaaggtgttctgcaacatctacaccagcctggacgtgatgctgtgcaccgccagcatcctgaacctgttcatgatcagcctggacagatactgcgccgtgatggaccccctgagataccccgtgctggtgacccccgtgagagtggccatcagcctggtgctgatctgggtgatcagcatcaccctgagcttcctgagcatccacctgggctggaacagcagaaacgagaccagcaagggcaaccacaccaccagcaagtgcaaggtgcaggtgaacgaggtgtacggcctggtggacggcctggtgaccttctacctgcccctgctgatcatgtgcatcacctactacagaatcttcaaggtggccagagaccaggccaagagaatcaaccacatcagcagctggaaggccgccaccatcagagagcacaaggccaccgtgaccctggccgccgtgatgggcgccttcatcatctgctggttcccctacttcaccgccttcgtgtacagaggcctgagaggcgacgacgccatcaacgaggtgctggaggccatcgtgctgtggctgggctacgccaacagcgccctgaaccccatcctgtacgccgccctgaacagagacttcagaaccggctaccagcagctgttctgctgcagactggccaacagaaacagccacaagaccagcctgagaagcaacgccagccagctgagcagaacccagagcagagagcccagacagcaggaggagaagcccctgaagctgcaggtgtggagcggcaccgaggtgaccgccccccagggcgccaccgacagatag

SEQ ID NO: 22446 - DNA, 1296 bp, Artificial Sequence
  Description of Artificial Sequence: Synthetic coding sequence
atgagcgtgaacgtgaacagaagcgtgagcgaccagttctacagatacaagatgcccagactgatcgccaaggtggagggcaagggcaacggcatcaagaccgtgatcgtgaacatggtggacgtggccaaggccctgaacagaccccccacctaccccaccaagtacttcggctgcgagctgggcgcccagacccagttcgacgtgaagaacgacagatacatcgtgaacggcagccacgaggccaacaagctgcaggacatgctggacggcttcatcaagaagttcgtgctgtgccccgagtgcgagaaccccgagaccgacctgcacgtgaaccccaagaagcagaccatcggcaacagctgcaaggcctgcggctacagaggcatgctggacacccaccacaagctgtgcaccttcatcctgaagaacccccccgagaacagcgacagcggcaccggcaagaaggagaaggagaagaagaacagaaagggcaaggacaaggagaacggcagcgtgagcagcagcgagacccccccccccccccccccccccaacgagatcaacccccccccccacaccatggaggaggaggaggacgacgactggggcgaggacaccaccgaggaggcccagagaagaagaatggacgagatcagcgaccacgccaaggtgctgaccctgagcgacgacctggagagaaccatcgaggagagagtgaacatcctgttcgacttcgtgaagaagaagaaggaggagggcgtgatcgacagcagcgacaaggagatcgtggccgaggccgagagactggacgtgaaggccatgggccccctggtgctgaccgaggtgctgttcaacgagaagatcagagagcagatcaagaagtacagaagacacttcctgagattctgccacaacaacaagaaggcccagagatacctgctgcacggcctggagtgcgtggtggccatgcaccaggcccagctgatcagcaagatcccccacatcctgaaggagatgtacgacgccgacctgctggaggaggaggtgatcatcagctggagcgagaaggccagcaagaagtacgtgagcaaggagctggccaaggagatcagagtgaaggccgagcccttcatcaagtggctgaaggaggccgaggaggagagcagcggcggcgaggaggaggacgaggacgagaacatcgaggtggtgtacagcaaggccgccagcgtgcccaaggtggagaccgtgaagagcgacaacaaggacgacgacatcgacatcgacgccatctag

SEQ ID NO: 22447 - DNA, 2766 bp, Artificial Sequence
  Description of Artificial Sequence: Synthetic coding sequence
atggcctggctgagactgcagcccctgaccagcgccttcctgcacttcggcctggtgaccttcgtgctgttcctgaacggcctgagagccgaggccggcggcagcggcgacgtgcccagcaccggccagaacaacgagagctgcagcggcagcagcgactgcaaggagggcgtgatcctgcccatctggtaccccgagaaccccagcctgggcgacaagatcgccagagtgatcgtgtacttcgtggccctgatctacatgttcctgggcgtgagcatcatcgccgacagattcatggccagcatcgaggtgatcaccagccaggagagagaggtgaccatcaagaagcccaacggcgagaccagcaccaccaccatcagagtgtggaacgagaccgtgagcaacctgaccctgatggccctgggcagcagcgcccccgagatcctgctgagcctgatcgaggtgtgcggccacggcttcatcgccggcgacctgggccccagcaccatcgtgggcagcgccgccttcaacatgttcatcatcatcggcatctgcgtgtacgtgatccccgacggcgagaccagaaagatcaagcacctgagagtgttcttcatcaccgccgcctggagcatcttcgcctacatctggctgtacatgatcctggccgtgttcagccccggcgtggtgcaggtgtgggagggcctgctgaccctgttcttcttccccgtgtgcgtgctgctggcctgggtggccgacaagagactgctgttctacaagtacatgcacaagaagtacagaaccgacaagcacagaggcatcatcatcgagaccgagggcgaccaccccaagggcatcgagatggacggcaagatgatgaacagccacttcctggacggcaacctggtgcccctggagggcaaggaggtggacgagagcagaagagagatgatcagaatcctgaaggacctgaagcagaagcaccccgagaaggacctggaccagctggtggagatggccaactactacgccctgagccaccagcagaagagcagagccttctacagaatccaggccaccagaatgatgaccggcgccggcaacatcctgaagaagcacgccgccgagcaggccaagaaggccagcagcatgagcgaggtgcacaccgacgagcccgaggacttcatcagcaaggtgttcttcgacccctgcagctaccagtgcctggagaactgcggcgccgtgctgctgaccgtggtgagaaagggcggcgacatgagcaagaccatgtacgtggactacaagaccgaggacggcagcgccaacgccggcgccgactacgagttcaccgagggcaccgtggtgctgaagcccggcgagacccagaaggagttcagcgtgggcatcatcgacgacgacatcttcgaggaggacgagcacttcttcgtgagactgagcaacgtgagaatcgaggaggagcagcccgaggagggcatgccccccgccatcttcaacagcctgcccctgcccagagccgtgctggccagcccctgcgtggccaccgtgaccatcctggacgacgaccacgccggcatcttcaccttcgagtgcgacaccatccacgtgagcgagagcatcggcgtgatggaggtgaaggtgctgagaaccagcggcgccagaggcaccgtgatcgtgcccttcagaaccgtggagggcaccgccaagggcggcggcgaggacttcgaggacacctacggcgagctggagttcaagaacgacgagaccgtgaagaccatcagagtgaagatcgtggacgaggaggagtacgagagacaggagaacttcttcatcgccctgggcgagcccaagtggatggagagaggcatcagcgacgtgaccgacagaaagctgaccatggaggaggaggaggccaagagaatcgccgagatgggcaagcccgtgctgggcgagcaccccaagctggaggtgatcatcgaggagagctacgagttcaagaccaccgtggacaagctgatcaagaagaccaacctggccctggtggtgggcacccacagctggagagaccagttcatggaggccatcaccgtgagcgccgccggcgacgaggacgaggacgagagcggcgaggagagactgcccagctgcttcgactacgtgatgcacttcctgaccgtgttctggaaggtgctgttcgcctgcgtgccccccaccgagtactgccacggctgggcctgcttcgccgtgagcatcctgatcatcggcatgctgaccgccatcatcggcgacctggccagccacttcggctgcaccatcggcctgaaggacagcgtgaccgccgtggtgttcgtggccttcggcaccagcgtgcccgacaccttcgccagcaaggccgccgccctgcaggacgtgtacgccgacgccagcatcggcaacgtgaccggcagcaacgccgtgaacgtgttcctgggcatcggcctggcctggagcgtggccgccatctactgggccctgcagggccaggagttccacgtgagcgccggcaccctggccttcagcgtgaccctgttcaccatcttcgccttcgtgtgcatcagcgtgctgctgtacagaagaagaccccacctgggcggcgagctgggcggccccagaggctgcaagctggccaccacctggctgttcgtgagcctgtggctgctgtacatcctgttcgccaccctggaggcctactgctacatcaagggcttctag

SEQ ID NO: 22448 - DNA, 2778 bp, Artificial Sequence
  Description of Artificial Sequence: Synthetic coding sequence
atggcctggctgagactgcagcccctgaccagcgccttcctgcacttcggcctggtgaccttcgtgctgttcctgaacggcctgagagccgaggccggcggcagcggcgacgtgcccagcaccggccagaacaacgagagctgcagcggcagcagcgactgcaaggagggcgtgatcctgcccatctggtaccccgagaaccccagcctgggcgacaagatcgccagagtgatcgtgtacttcgtggccctgatctacatgttcctgggcgtgagcatcatcgccgacagattcatggccagcatcgaggtgatcaccagccaggagagagaggtgaccatcaagaagcccaacggcgagaccagcaccaccaccatcagagtgtggaacgagaccgtgagcaacctgaccctgatggccctgggcagcagcgcccccgagatcctgctgagcctgatcgaggtgtgcggccacggcttcatcgccggcgacctgggccccagcaccatcgtgggcagcgccgccttcaacatgttcatcatcatcggcatctgcgtgtacgtgatccccgacggcgagaccagaaagatcaagcacctgagagtgttcttcatcaccgccgcctggagcatcttcgcctacatctggctgtacatgatcctggccgtgttcagccccggcgtggtgcaggtgtgggagggcctgctgaccctgttcttcttccccgtgtgcgtgctgctggcctgggtggccgacaagagactgctgttctacaagtacatgcacaagaagtacagaaccgacaagcacagaggcatcatcatcgagaccgagggcgaccaccccaagggcatcgagatggacggcaagatgatgaacagccacttcctggacggcaacctggtgcccctggagggcaaggaggtggacgagagcagaagagagatgatcagaatcctgaaggacctgaagcagaagcaccccgagaaggacctggaccagctggtggagatggccaactactacgccctgagccaccagcagaagagcagagccttctacagaatccaggccaccagaatgatgaccggcgccggcaacatcctgaagaagcacgccgccgagcaggccaagaaggccagcagcatgagcgaggtgcacaccgacgagcccgaggacttcatcagcaaggtgttcttcgacccctgcagctaccagtgcctggagaactgcggcgccgtgctgctgaccgtggtgagaaagggcggcgacatgagcaagaccatgtacgtggactacaagaccgaggacggcagcgccaacgccggcgccgactacgagttcaccgagggcaccgtggtgctgaagcccggcgagacccagaaggagttcagcgtgggcatcatcgacgacgacatcttcgaggaggacgagcacttcttcgtgagactgagcaacgtgagaatcgaggaggagcagcccgaggagggcatgccccccgccatcttcaacagcctgcccctgcccagagccgtgctggccagcccctgcgtggccaccgtgaccatcctggacgacgaccacgccggcatcttcaccttcgagtgcgacaccatccacgtgagcgagagcatcggcgtgatggaggtgaaggtgctgagaaccagcggcgccagaggcaccgtgatcgtgcccttcagaaccgtggagggcaccgccaagggcggcggcgaggacttcgaggacacctacggcgagctggagttcaagaacgacgagaccgtgaagaccatccacatcaaggtgatcgacgacgaggcctacgagaagaacaagaactacttcatcgagatgatgggccccagaatggtggacatgagcttccagaaggccctgctgctgagccccgacagaaagctgaccatggaggaggaggaggccaagagaatcgccgagatgggcaagcccgtgctgggcgagcaccccaagctggaggtgatcatcgaggagagctacgagttcaagaccaccgtggacaagctgatcaagaagaccaacctggccctggtggtgggcacccacagctggagagaccagttcatggaggccatcaccgtgagcgccgccggcgacgaggacgaggacgagagcggcgaggagagactgcccagctgcttcgactacgtgatgcacttcctgaccgtgttctggaaggtgctgttcgcctgcgtgccccccaccgagtactgccacggctgggcctgcttcgccgtgagcatcctgatcatcggcatgctgaccgccatcatcggcgacctggccagccacttcggctgcaccatcggcctgaaggacagcgtgaccgccgtggtgttcgtggccttcggcaccagcgtgcccgacaccttcgccagcaaggccgccgccctgcaggacgtgtacgccgacgccagcatcggcaacgtgaccggcagcaacgccgtgaacgtgttcctgggcatcggcctggcctggagcgtggccgccatctactgggccctgcagggccaggagttccacgtgagcgccggcaccctggccttcagcgtgaccctgttcaccatcttcgccttcgtgtgcatcagcgtgctgctgtacagaagaagaccccacctgggcggcgagctgggcggccccagaggctgcaagctggccaccacctggctgttcgtgagcctgtggctgctgtacatcctgttcgccaccctggaggcctactgctacatcaagggcttctag

SEQ ID NO: 22449 - DNA, 2784 bp, Artificial Sequence
  Description of Artificial Sequence: Synthetic coding sequence
atggcctggctgagactgcagcccctgaccagcgccttcctgcacttcggcctggtgaccttcgtgctgttcctgaacggcctgagagccgaggccggcggcagcggcgacgtgcccagcaccggccagaacaacgagagctgcagcggcagcagcgactgcaaggagggcgtgatcctgcccatctggtaccccgagaaccccagcctgggcgacaagatcgccagagtgatcgtgtacttcgtggccctgatctacatgttcctgggcgtgagcatcatcgccgacagattcatggccagcatcgaggtgatcaccagccaggagagagaggtgaccatcaagaagcccaacggcgagaccagcaccaccaccatcagagtgtggaacgagaccgtgagcaacctgaccctgatggccctgggcagcagcgcccccgagatcctgctgagcctgatcgaggtgtgcggccacggcttcatcgccggcgacctgggccccagcaccatcgtgggcagcgccgccttcaacatgttcatcatcatcggcatctgcgtgtacgtgatccccgacggcgagaccagaaagatcaagcacctgagagtgttcttcatcaccgccgcctggagcatcttcgcctacatctggctgtacatgatcctggccgtgttcagccccggcgtggtgcaggtgtgggagggcctgctgaccctgttcttcttccccgtgtgcgtgctgctggcctgggtggccgacaagagactgctgttctacaagtacatgcacaagaagtacagaaccgacaagcacagaggcatcatcatcgagaccgagggcgaccaccccaagggcatcgagatggacggcaagatgatgaacagccacttcctggacggcaacctggtgcccctggagggcaaggaggtggacgagagcagaagagagatgatcagaatcctgaaggacctgaagcagaagcaccccgagaaggacctggaccagctggtggagatggccaactactacgccctgagccaccagcagaagagcagagccttctacagaatccaggccaccagaatgatgaccggcgccggcaacatcctgaagaagcacgccgccgagcaggccaagaaggccagcagcatgagcgaggtgcacaccgacgagcccgaggacttcatcagcaaggtgttcttcgacccctgcagctaccagtgcctggagaactgcggcgccgtgctgctgaccgtggtgagaaagggcggcgacatgagcaagaccatgtacgtggactacaagaccgaggacggcagcgccaacgccggcgccgactacgagttcaccgagggcaccgtggtgctgaagcccggcgagacccagaaggagttcagcgtgggcatcatcgacgacgacatcttcgaggaggacgagcacttcttcgtgagactgagcaacgtgagaatcgaggaggagcagcccgaggagggcatgccccccgccatcttcaacagcctgcccctgcccagagccgtgctggccagcccctgcgtggccaccgtgaccatcctggacgacgaccacgccggcatcttcaccttcgagtgcgacaccatccacgtgagcgagagcatcggcgtgatggaggtgaaggtgctgagaaccagcggcgccagaggcaccgtgatcgtgcccttcagaaccgtggagggcaccgccaagggcggcggcgaggacttcgaggacacctacggcgagctggagttcaagaacgacgagaccgtgaagaccatcagagtgaagatcgtggacgaggaggagtacgagagacaggagaacttcttcatcgccctgggcgagcccaagtggatggagagaggcatcagcgccctgctgctgagccccgacgtgaccgacagaaagctgaccatggaggaggaggaggccaagagaatcgccgagatgggcaagcccgtgctgggcgagcaccccaagctggaggtgatcatcgaggagagctacgagttcaagaccaccgtggacaagctgatcaagaagaccaacctggccctggtggtgggcacccacagctggagagaccagttcatggaggccatcaccgtgagcgccgccggcgacgaggacgaggacgagagcggcgaggagagactgcccagctgcttcgactacgtgatgcacttcctgaccgtgttctggaaggtgctgttcgcctgcgtgccccccaccgagtactgccacggctgggcctgcttcgccgtgagcatcctgatcatcggcatgctgaccgccatcatcggcgacctggccagccacttcggctgcaccatcggcctgaaggacagcgtgaccgccgtggtgttcgtggccttcggcaccagcgtgcccgacaccttcgccagcaaggccgccgccctgcaggacgtgtacgccgacgccagcatcggcaacgtgaccggcagcaacgccgtgaacgtgttcctgggcatcggcctggcctggagcgtggccgccatctactgggccctgcagggccaggagttccacgtgagcgccggcaccctggccttcagcgtgaccctgttcaccatcttcgccttcgtgtgcatcagcgtgctgctgtacagaagaagaccccacctgggcggcgagctgggcggccccagaggctgcaagctggccaccacctggctgttcgtgagcctgtggctgctgtacatcctgttcgccaccctggaggcctactgctacatcaagggcttctag

SEQ ID NO: 22450 - DNA, 855 bp, Artificial Sequence
  Description of Artificial Sequence: Synthetic coding sequence
atggaggaggaggaggccaagagaatcgccgagatgggcaagcccgtgctgggcgagcaccccaagctggaggtgatcatcgaggagagctacgagttcaagaccaccgtggacaagctgatcaagaagaccaacctggccctggtggtgggcacccacagctggagagaccagttcatggaggccatcaccgtgagcgccgccggcgacgaggacgaggacgagagcggcgaggagagactgcccagctgcttcgactacgtgatgcacttcctgaccgtgttctggaaggtgctgttcgcctgcgtgccccccaccgagtactgccacggctgggcctgcttcgccgtgagcatcctgatcatcggcatgctgaccgccatcatcggcgacctggccagccacttcggctgcaccatcggcctgaaggacagcgtgaccgccgtggtgttcgtggccttcggcaccagcgtgcccgacaccttcgccagcaaggccgccgccctgcaggacgtgtacgccgacgccagcatcggcaacgtgaccggcagcaacgccgtgaacgtgttcctgggcatcggcctggcctggagcgtggccgccatctactgggccctgcagggccaggagttccacgtgagcgccggcaccctggccttcagcgtgaccctgttcaccatcttcgccttcgtgtgcatcagcgtgctgctgtacagaagaagaccccacctgggcggcgagctgggcggccccagaggctgcaagctggccaccacctggctgttcgtgagcctgtggctgctgtacatcctgttcgccaccctggaggcctactgctacatcaagggcttctag

SEQ ID NO: 22451 - DNA, 1863 bp, Artificial Sequence
  Description of Artificial Sequence: Synthetic coding sequence
atggcctggctgagactgcagcccctgaccagcgccttcctgcacttcggcctggtgaccttcgtgctgttcctgaacggcctgagagccgaggccggcggcagcggcgacgtgcccagcaccggccagaacaacgagagctgcagcggcagcagcgactgcaaggagggcgtgatcctgcccatctggtaccccgagaaccccagcctgggcgacaagatcgccagagtgatcgtgtacttcgtggccctgatctacatgttcctgggcgtgagcatcatcgccgacagattcatggccagcatcgaggtgatcaccagccaggagagagaggtgaccatcaagaagcccaacggcgagaccagcaccaccaccatcagagtgtggaacgagaccgtgagcaacctgaccctgatggccctgggcagcagcgcccccgagatcctgctgagcctgatcgaggtgtgcggccacggcttcatcgccggcgacctgggccccagcaccatcgtgggcagcgccgccttcaacatgttcatcatcatcggcatctgcgtgtacgtgatccccgacggcgagaccagaaagatcaagcacctgagagtgttcttcatcaccgccgcctggagcatcttcgcctacatctggctgtacatgatcctggccgtgttcagccccggcgtggtgcaggtgtgggagggcctgctgaccctgttcttcttccccgtgtgcgtgctgctggcctgggtggccgacaagagactgctgttctacaagtacatgcacaagaagtacagaaccgacaagcacagaggcatcatcatcgagaccgagggcgaccaccccaagggcatcgagatggacggcaagatgatgaacagccacttcctggacggcaacctggtgcccctggagggcaaggaggtggacgagagcagaagagagatgatcagaatcctgaaggacctgaagcagaagcaccccgagaaggacctggaccagctggtggagatggccaactactacgccctgagccaccagcagaagagcagagccttctacagaatccaggccaccagaatgatgaccggcgccggcaacatcctgaagaagcacgccgccgagcaggccaagaaggccagcagcatgagcgaggtgcacaccgacgagcccgaggacttcatcagcaaggtgttcttcgacccctgcagctaccagtgcctggagaactgcggcgccgtgctgctgaccgtggtgagaaagggcggcgacatgagcaagaccatgtacgtggactacaagaccgaggacggcagcgccaacgccggcgccgactacgagttcaccgagggcaccgtggtgctgaagcccggcgagacccagaaggagttcagcgtgggcatcatcgacgacgacatcttcgaggaggacgagcacttcttcgtgagactgagcaacgtgagaatcgaggaggagcagcccgaggagggcatgccccccgccatcttcaacagcctgcccctgcccagagccgtgctggccagcccctgcgtggccaccgtgaccatcctggacgacgaccacgccggcatcttcaccttcgagtgcgacaccatccacgtgagcgagagcatcggcgtgatggaggtgaaggtgctgagaaccagcggcgccagaggcaccgtgatcgtgcccttcagaaccgtggagggcaccgccaagggcggcggcgaggacttcgaggacacctacggcgagctggagttcaagaacgacgagaccgtgtgcgacagacaggaggccgactacggcagaagaggcggccaggaggacagcagagacggcaaggccagcatcggctag

SEQ ID NO: 22452 - DNA, 2778 bp, Artificial Sequence; identical to SEQ ID NO: 22448
  Description of Artificial Sequence: Synthetic coding sequence

SEQ ID NO: 22453 - DNA, 2775 bp, Artificial Sequence
  Description of Artificial Sequence: Synthetic coding sequence
atggcctggctgagactgcagcccctgaccagcgccttcctgcacttcggcctggtgaccttcgtgctgttcctgaacggcctgagagccgaggccggcggcagcggcgacgtgcccagcaccggccagaacaacgagagctgcagcggcagcagcgactgcaaggagggcgtgatcctgcccatctggtaccccgagaaccccagcctgggcgacaagatcgccagagtgatcgtgtacttcgtggccctgatctacatgttcctgggcgtgagcatcatcgccgacagattcatggccagcatcgaggtgatcaccagccaggagagagaggtgaccatcaagaagcccaacggcgagaccagcaccaccaccatcagagtgtggaacgagaccgtgagcaacctgaccctgatggccctgggcagcagcgcccccgagatcctgctgagcctgatcgaggtgtgcggccacggcttcatcgccggcgacctgggccccagcaccatcgtgggcagcgccgccttcaacatgttcatcatcatcggcatctgcgtgtacgtgatccccgacggcgagaccagaaagatcaagcacctgagagtgttcttcatcaccgccgcctggagcatcttcgcctacatctggctgtacatgatcctggccgtgttcagccccggcgtggtgcaggtgtgggagggcctgctgaccctgttcttcttccccgtgtgcgtgctgctggcctgggtggccgacaagagactgctgttctacaagtacatgcacaagaagtacagaaccgacaagcacagaggcatcatcatcgagaccgagggcgaccaccccaagggcatcgagatggacggcaagatgatgaacagccacttcctggacggcaacctggtgcccctggagggcaaggaggtggacgagagcagaagagagatgatcagaatcctgaaggacctgaagcagaagcaccccgagaaggacctggaccagctggtggagatggccaactactacgccctgagccaccagcagaagagcagagccttctacagaatccaggccaccagaatgatgaccggcgccggcaacatcctgaagaagcacgccgccgagcaggccaagaaggccagcagcatgagcgaggtgcacaccgacgagcccgaggacttcatcagcaaggtgttcttcgacccctgcagctaccagtgcctggagaactgcggcgccgtgctgctgaccgtggtgagaaagggcggcgacatgagcaagaccatgtacgtggactacaagaccgaggacggcagcgccaacgccggcgccgactacgagttcaccgagggcaccgtggtgctgaagcccggcgagacccagaaggagttcagcgtgggcatcatcgacgacgacatcttcgaggaggacgagcacttcttcgtgagactgagcaacgtgagaatcgaggaggagcagcccgaggagggcatgccccccgccatcttcaacagcctgcccctgcccagagccgtgctggccagcccctgcgtggccaccgtgaccatcctggacgacgaccacgccggcatcttcaccttcgagtgcgacaccatccacgtgagcgagagcatcggcgtgatggaggtgaaggtgctgagaaccagcggcgccagaggcaccgtgatcgtgcccttcagaaccgtggagggcaccgccaagggcggcggcgaggacttcgaggacacctacggcgagctggagttcaagaacgacgagaccgtgaagaccatcagagtgaagatcgtggacgaggaggagtacgagagacaggagaacttcttcatcgccctgggcgagcccaagtggatggagagaggcatcagcgccctgctgctgagccccgacagaaagctgaccatggaggaggaggaggccaagagaatcgccgagatgggcaagcccgtgctgggcgagcaccccaagctggaggtgatcatcgaggagagctacgagttcaagaccaccgtggacaagctgatcaagaagaccaacctggccctggtggtgggcacccacagctggagagaccagttcatggaggccatcaccgtgagcgccgccggcgacgaggacgaggacgagagcggcgaggagagactgcccagctgcttcgactacgtgatgcacttcctgaccgtgttctggaaggtgctgttcgcctgcgtgccccccaccgagtactgccacggctgggcctgcttcgccgtgagcatcctgatcatcggcatgctgaccgccatcatcggcgacctggccagccacttcggctgcaccatcggcctgaaggacagcgtgaccgccgtggtgttcgtggccttcggcaccagcgtgcccgacaccttcgccagcaaggccgccgccctgcaggacgtgtacgccgacgccagcatcggcaacgtgaccggcagcaacgccgtgaacgtgttcctgggcatcggcctggcctggagcgtggccgccatctactgggccctgcagggccaggagttccacgtgagcgccggcaccctggccttcagcgtgaccctgttcaccatcttcgccttcgtgtgcatcagcgtgctgctgtacagaagaagaccccacctgggcggcgagctgggcggccccagaggctgcaagctggccaccacctggctgttcgtgagcctgtggctgctgtacatcctgttcgccaccctggaggcctactgctacatcaagggcttctag

SEQ ID NO: 22454 - DNA, 3375 bp, Artificial Sequence
  Description of Artificial Sequence: Synthetic coding sequence
atgagcagctacttctgggcccagaacgagagcaacagacccgacctgctgtgcggccagcccgccgactacctggtggaggagaagcacttcaccaccctggtgtgcttcatcgtggtgctgggcggcctgctgaagatgtgcctgaagaactgcgaggtgatcgtgctgaccatcctgagcctgagcggcttcgtgatcggccacatggcctacaacagcgtggaggtgcaccagatcgtgtaccccctgctgagaaccagcagcttcagcctgtacagctacttcagccccctgatcatcttcatggtggccctggacgtggagttctacaccctgaagaagatgttctggcaggtgctgctgaccggcctgatcagcttcagcaccgccagcatcatcatcggctacgtggtgatcaagttcaacaaggacagctgggacctgcagagctgcctgctgttcagcatcaccctgggcatcatcgaccccctgagaagcgtgaacagcctgaagaccatcggcatcagcaagatctacatcgacctgatcagaggcgagagcctgatcatctgcagcatcgccagcatcttcttcggcaacttcagaggcaacagaatccacttcagcatcttcagagacctgcacgtgggcatcgagctgagctacgacatcctgggcagcatcatcttcggctactggtgcgccaagatcatccagtgcatcctggccgacgtgttcagcaacatgctgaccaacatcatcctgtgcttcagcatggtgtacatgaccttctacatcgtggagttcctgggcatgagcggcaccctggccctggccgccgtgggcctgaacctggacagcctgaccttcaagcccaagatcgagctggtgatcaccaagttcctgagaatcttcagcagcgtgtacgagcacctgatctacgccttcttcggcatcgtgatcggctgcggcgagctgagccactacgagttccacaccatccccttcatcttcatcctgttcaccaccgtgaacctggtgagactgctgaccatcctgctggtgagccccatcctgatgcacagcaactacgagtacaactggagatggggcgtggtgatcacctggagcggcatcaagggcgtgttcaacctgctgtgggcccccgacgtgtacaacctggccgagagaaaggtggaggtgccccagatgttcatcctgtacgtgcaggtgatcagcctgctgaccatgggcatcaacagctacgtgatgacccagagcgccagaaagctggacctgtgcgtgctgagcctgcccagacagatgatcctgcagaacgccacccagcacatccaggagatcgtgcagaacaccatcaccctgttcaagaccgagaagatcctgaccaacgtgaactggaccctggtggaggacaagaccagaatcgagtacatccccttcagccacgtgagccacaacgacatgaagaccgagagcaccaccgacgaggccctgatggaggaggccagactgcacgtggccgccatccagatgagcagcttcgagaagcagagaaacaacggcatcctggagatcgaggccgccagaatcctgatcggcgccgccaagtgctactacagcatccagggcaagttcatgagcatctacgacgtgagcacctacatgagaaccagaagctggctgatcaagttcaagaacgtgctgaccttcctggagtactgcatcgagaagatccacttcatcccccccgagagcaacaccttcctgaccttcatcttccacatcgtgttcagcgaggagttcgagtacaccggccagatcatcaacctgatctacatctaccccatgatcatccacctgtggcccatggccagaggcctgaacgtgagcgccctgatcagcatcaactactacttcatgttcctgtacgtgctggagagcaccctgaagatcatcatcctgaagagaaagtacttccagcagtgctggaacaccctggagttcttcatcctggtgatcggcatcatcgacatcttctgcgtgtacttcgtgaagctgagacccgacaacctggccctgatccagctgaccgtgatcatgggctacctgagaatcatcagattcctgcccctgttcaagatcatcgtgcccatcctgatcagaatcgccgacgtgcagatcaagaagagactgagcctgatgtacagcatcaccaagggctacatcaagagccaggaggacgccaagctgctgatcaagcagatcgccgtgtgcgagagcatctaccagaagctgtgcgagatcctggagaccaacaagcaggacgccgtgaaggagctggtgctgatggagcacgagggcagagacgtggtgatcgccctgaagaccaagcaggccatcagaaacgtgatcgccaaggccctgaagaacctgaccttcctgtgcagcagaggcatcatcgacaagcacgaggtgatcgagatcaacaaggtgctgctgaagaagctgaaggccctgaacaacttccccaaggccatccccccccccacccccgacatctacctgcacaacatcatctggctggagggcaaggacgtgctgatcgacttcttcaaggagagagccaagctggcctgcttcgacagcggcgacaccatctgcaagggcggcgagatgccccagggcatctacctgatcatcagcggcatggccatcctgcacagcctgagccccaccttcggcatcgagagcaaccagagatgcgacagaggcagcagagacatgttcaccgagttctgcaccaccggcgacatcatcggcgagctgagctgcctgctgaagagagagatcgagtacaccgtgatctgcgagaccagcctgcaggcctgcttcatcagcctggaggacctgtacgagggcttcgacgccttctggcccagcctggagtacaagatctggctgaagctggccctgagcaccgcctaccagtacttcgagagcagcctgatcgacgaggacctgagattccagaactgcgtgatgttcaaccaggcctacgtggagaccctgagcagctacagcgacatgatcatcgacaacatgaccatgaagttcgtgatcatcgtgtacggcagcgtgatcgacaccaagaccgaggagccctacttcgccccctgcatcatccccaccacctgcgagcaggtgcagggcaccagcgacctgagcaagctgctgatcatccaggccagcgagctgacccagagaaacagcaacaccaacgtgatggccagcgtgaacaccgtgttcgagcagcccggcaagaacatcaacggcagacagaagatgagctag

SEQ ID NO: 22455 - DNA, 1353 bp, Artificial Sequence
  Description of Artificial Sequence: Synthetic coding sequence
atggtggccctggacgtggagttctacaccctgaagaagatgttctggcaggtgctgctgaccggcctgatcagcttcagcaccgccagcatcatcatcggctacgtggtgatcaagttcaacaaggacagctgggacctgcagagctgcctgctgttcagcatcaccctgggcatcatcgaccccctgagaagcgtgaacagcctgaagaccatcggcatcagcaagatctacatcgacctgatcagaggcgagagcctgatcatctgcagcatcgccagcatcttcttcggcaacttcagaggcaacagaatccacttcagcatcttcagagacctgcacgtgggcatcgagctgagctacgacatcctgggcagcatcatcttcggctactggtgcgccaagatcatccagtgcatcctggccgacgtgttcagcaacatgctgaccaacatcatcctgtgcttcagcatggtgtacatgaccttctacatcgtggagttcctgggcatgagcggcaccctggccctggccgccgtgggcctgaacctggacagcctgaccttcaagcccaagatcgagctggtgatcaccaagttcctgagaatcttcagcagcgtgtacgagcacctgatctacgccttcttcggcatcgtgatcggctgcggcgagctgagccactacgagttccacaccatccccttcatcttcatcctgttcaccaccgtgaacctggtgagactgctgaccatcctgctggtgagccccatcctgatgcacagcaactacgagtacaactggagatggggcgtggtgatcacctggagcggcatcaagggcgtgttcaacctgctgtgggcccccgacgtgtacaacctggccgagagaaaggtggaggtgccccagatgttcatcctgtacgtgcaggtgatcagcctgctgaccatgggcatcaacagctacgtgatgacccagagcgccagaaagctggacctgtgcgtgctgagcctgcccagacagatgatcctgcagaacgccacccagcacatccaggagatcgtgcagaacaccatcaccctgttcaagaccgagaagatcctgaccaacgtgaactggaccctggtggaggacaagaccagaatcgagtacatccccttcagccacgtgagccacaacgacatgaagaccgagagcaccaccgacgaggccctgatggaggaggccagactgcacgtggccgccatccagatgagcagcttcgagaagcagagaaacaacggcatcctggagatcgaggccgccagaatcctgatcggcgccgccaagtgctactacagcatccagggcaagtag

SEQ ID NO: 22456 - DNA, 1548 bp, Artificial Sequence
  Description of Artificial Sequence: Synthetic coding sequence
atgcacaccaccgagagcaagaacgagcacctggaggacgagaacttccagaccagcaccaccccccagagcctgatcgaccccaacaacaccgcccaggaggagaccaagaccgtgctgagcgacaccgaggagatcaagccccagaccaagaaggagacctacatcagctgccccctgagaggcgtgctgaacgtgatcatcaccaacggcgtgatcctgttcgtgatctggtgcatgacctggagcatcctgggcagcgaggccctgcccggcggcaacctgttcggcctgttcatcatcttctacagcgccatcatcggcggcaagatcctgcagctgatcagaatccccctggtgccccccctgccccccctgctgggcatgctgctggccggcttcaccatcagaaacgtgcccttcatcaacgagcacgtgcacgtgcccaacacctggagcagcatcctgagaagcatcgccctgaccatcatcctgatcagagccggcctgggcctggacccccaggccctgagacacctgaaggtggtgtgcttcagactggccgtgggcccctgcctgatggaggccagcgccgccgccgtgttcagccacttcatcatgaagttcccctggcagtgggccttcctgctgggcttcgtgctgggcgccgtgagccccgccgtggtggtgccctacatgatggtgctgcaggagaacggctacggcgtggaggagggcatccccaccctgctgatggccgccagcagcatggacgacatcctggccatcaccggcttcaacacctgcctgagcatcgtgttcagcagcggcggcatcctgaacaacgccatcgccagcatcagaaacgtgtgcatcagcctgctggccggcatcgtgctgggcttcttcgtgagatacttccccagcgaggaccagaagaagctgaccctgaagagaggcttcctggtgctgaccatgtgcgtgagcgccgtgctgggcagccagagaatcggcctgcacggcagcggcggcctgtgcaccctggtgctgagcttcatcgccggcaccaagtggagccaggagaagatgaaggtgcagaagatcatcaccaccgtgtgggacatcttccagcccctgctgttcggcctggtgggcgccgaggtgagcgtgagcagcctggagagcaacatcgtgggcatcagcgtggccaccctgagcctggccctgtgcgtgagaatcctgaccacctacctgctgatgtgcttcgccggcttcagcttcaaggagaagatcttcatcgccctggcctggatgcccaaggccaccgtgcaggccgtgctgggccccctggccctggagaccgccagagtgagcgccccccacctggagccctacgccaaggacgtgatgaccgtggccttcctggccatcctgatcaccgcccccaacggcgccctgctgatgggcatcctgggccccaagatgctgaccagacactacgaccccagcaagatcaagctgcagctgagcaccctggagcaccactag

SEQ ID NO: 22457 - DNA, 1428 bp, Artificial Sequence
  Description of Artificial Sequence: Synthetic coding sequence
atgcacaccaccgagagcaagaacgagcacctggaggacgagaacttccagaccagcaccaccccccagagcctgatcgaccccaacaacaccgcccaggaggagaccaagaccgtgctgagcgacaccgaggagatcaagccccagaccaagaaggagacctacatcagctgccccctgagaggcgtgctgaacgtgatcatcaccaacggcgtgatcctgttcgtgatctggtgcatgacctggagcatcctgggcagcgaggccctgcccggcggcaacctgttcggcctgttcatcatcttctacagcgccatcatcggcggcaagatcctgcagctgatcagaatccccctggtgccccccctgccccccctgctgggcatgctgctggccggcttcaccatcagaaacgtgcccttcatcaacgagcacgtgcacgtgcccaacacctggagcagcatcctgagaagcatcgccctgaccatcatcctgatcagagccggcctgggcctggacccccaggccctgagacacctgaaggtggtgtgcttcagactggccgtgggcccctgcctgatggaggccagcgccgccgccgtgttcagccacttcatcatgaagttcccctggcagtgggccttcctgctgggcttcgtgctgggcgccgtgagccccgccgtggtggtgccctacatgatggtgctgcaggagaacggctacggcgtggaggagggcatccccaccctgctgatggccgccagcagcatggacgacatcctggccatcaccggcttcaacacctgcctgagcatcgtgttcagcagcggcggcatcctgaacaacgccatcgccagcatcagaaacgtgtgcatcagcctgctggccggcatcgtgctgggcttcttcgtgagatacttccccagcgaggaccagaagaagctgaccctgaagagaggcttcctggtgctgaccatgtgcgtgagcgccgtgctgggcagccagagaatcggcctgcacggcagcggcggcctgtgcaccctggtgctgagcttcatcgccggcaccaagtggagccaggagaagatgaaggtgcagaagatcatcaccaccgtgtgggacatcttccagcccctgctgttcggcctggtgggcgccgaggtgagcgtgagcagcctggagagcaacatcgtgggcatcagcgtggccaccctgagcctggccctgtgcgtgagaatcctgaccacctacctgctgatgtgcttcgccggcttcagcttcaaggagaagatcttcatcgccctggcctggatgcccaaggccaccgtgcagatcaaccaggccatcctgctgctgttcctgctgagagaggagtggaccaactgcaaggtggccaagaagtgcgagtacaccaaggagagacagtag

SEQ ID NO: 22458 - DNA, 663 bp, Artificial Sequence
  Description of Artificial Sequence: Synthetic coding sequence
atgcacaccaccgagagcaagaacgagcacctggaggacgagaacttccagaccagcaccaccccccagagcctgatcgaccccaacaacaccgcccaggaggagaccaagaccgtgctgagcgacaccgaggagatcaagccccagaccaagaaggagacctacatcagctgccccctgagaggcgtgctgaacgtgatcatcaccaacggcgtgatcctgttcgtgatctggtgcatgacctggagcatcctgggcagcgaggccctgcccggcggcaacctgttcggcctgttcatcatcttctacagcgccatcatcggcggcaagatcctgcagctgatcagaatccccctggtgccccccctgccccccctgctgggcatgctgctggccggcttcaccatcagaaacgtgcccttcatcaacgagcacgtgcacgtgcccaacacctggagcagcatcctgagaagcatcgccctgaccatcatcctgatcagagccggcctgggcctggacccccaggccctgagacacctgaaggtggtgtgcttcagactggccgtgggcccctgcctgatggaggccagcgccgccgccgtgttcagccacttcatcatgaagttcccctggcagtgggccttcctgctgggcctgttctag

SEQ ID NO: 22459 - DNA, 153 bp, Artificial Sequence
  Description of Artificial Sequence: Synthetic coding sequence
atgcacaccaccgagagcaagaacgagcacctggaggacgagaacttccagaccagcaccaccccccagagcctgatcgaccccaacaacaccgcccaggaggagaccaagaccgtgctgagcgacaccgaggagatcaagccccagacctag

SEQ ID NO: 22460 - DNA, 1365 bp, Artificial Sequence
  Description of Artificial Sequence: Synthetic coding sequence
atgggcgacgaggacaagagaatcacctacgaggacagcgagcccagcaccggcatgaactacacccccagcatgcaccaggaggcccaggaggagaccgtgatgaagctgaagggcatcgacgccaacgagcccaccgagggcagcatcctgctgaagagcagcgagaagaagctgcaggagacccccaccgaggccaaccacgtgcagagactgagacagatgctggcctgccccccccacggcctgctggacagagtgatcaccaacgtgaccatcatcgtgctgctgtgggccgtggtgtggagcatcaccggcagcgagtgcctgcccggcggcaacctgttcggcatcatcatcctgttctactgcgccatcatcggcggcaagctgctgggcctgatcaagctgcccaccctgccccccctgcccagcctgctgggcatgctgctggccggcttcctgatcagaaacatccccgtgatcaacgacaacgtgcagatcaagcacaagtggagcagcagcctgagaagcatcgccctgagcatcatcctggtgagagccggcctgggcctggacagcaaggccctgaagaagctgaagggcgtgtgcgtgagactgagcatgggcccctgcatcgtggaggcctgcaccagcgccctgctggcccactacctgctgggcctgccctggcagtggggcttcatcctgggcttcgtgctgggcgccgtgagccccgccgtggtggtgcccagcatgctgctgctgcagggcggcggctacggcgtggagaagggcgtgcccaccctgctgatggccgccggcagcttcgacgacatcctggccatcaccggcttcaacacctgcctgggcatcgccttcagcaccggcagcaccgtgttcaacgtgctgagaggcgtgctggaggtggtgatcggcgtggccaccggcagcgtgctgggcttcttcatccagtacttccccagcagagaccaggacaagctggtgtgcaagagaaccttcctggtgctgggcctgagcgtgctggccgtgttcagcagcgtgcacttcggcttccccggcagcggcggcctgtgcaccctggtgatggccttcctggccggcatgggctggaccagcgagaaggccgaggtggagaagatcatcgccgtggcctgggacatcttccagcccctgctgttcggcctgatcggcgccgaggtgagcatcgccagcctgagacccgagaccgtgggcagcgccgacagcatcaccggcaacttcggcaccgagagacccaagctgctgggcccccccagcacccagctgagattccacttcttccacatccagctgagcacctag

SEQ ID NO: 22461 - DNA, 1614 bp, Artificial Sequence
  Description of Artificial Sequence: Synthetic coding sequence
atgggcgacgaggacaagagaatcacctacgaggacagcgagcccagcaccggcatgaactacacccccagcatgcaccaggaggcccaggaggagaccgtgatgaagctgaagggcatcgacgccaacgagcccaccgagggcagcatcctgctgaagagcagcgagaagaagctgcaggagacccccaccgaggccaaccacgtgcagagactgagacagatgctggcctgccccccccacggcctgctggacagagtgatcaccaacgtgaccatcatcgtgctgctgtgggccgtggtgtggagcatcaccggcagcgagtgcctgcccggcggcaacctgttcggcatcatcatcctgttctactgcgccatcatcggcggcaagctgctgggcctgatcaagctgcccaccctgccccccctgcccagcctgctgggcatgctgctggccggcttcctgatcagaaacatccccgtgatcaacgacaacgtgcagatcaagcacaagtggagcagcagcctgagaagcatcgccctgagcatcatcctggtgagagccggcctgggcctggacagcaaggccctgaagaagctgaagggcgtgtgcgtgagactgagcatgggcccctgcatcgtggaggcctgcaccagcgccctgctggcccactacctgctgggcctgccctggcagtggggcttcatcctgggcttcgtgctgggcgccgtgagccccgccgtggtggtgcccagcatgctgctgctgcagggcggcggctacggcgtggagaagggcgtgcccaccctgctgatggccgccggcagcttcgacgacatcctggccatcaccggcttcaacacctgcctgggcatcgccttcagcaccggcagcaccgtgttcaacgtgctgagaggcgtgctggaggtggtgatcggcgtggccaccggcagcgtgctgggcttcttcatccagtacttccccagcagagaccaggacaagctggtgtgcaagagaaccttcctggtgctgggcctgagcgtgctggccgtgttcagcagcgtgcacttcggcttccccggcagcggcggcctgtgcaccctggtgatggccttcctggccggcatgggctggaccagcgagaaggccgaggtggagaagatcatcgccgtggcctgggacatcttccagcccctgctgttcggcctgatcggcgccgaggtgagcatcgccagcctgagacccgagaccgtgggcctgtgcgtggccaccgtgggcatcgccgtgctgatcagaatcctgaccaccttcctgatggtgtgcttcgccggcttcaacctgaaggagaagatcttcatcagcttcgcctggctgcccaaggccaccgtgcaggccgccatcggcagcgtggccctggacaccgccagaagccacggcgagaagcagctggaggactacggcatggacgtgctgaccgtggccttcctgagcatcctgatcaccgcccccatcggcagcctgctgatcggcctgctgggccccagactgctgcagaaggtggagcaccagaacaaggacgaggaggtgcagggcgagaccagcgtgcaggtgtag

SEQ ID NO: 22462 - DNA, 1614 bp, Artificial Sequence; identical to SEQ ID NO: 22461
  Description of Artificial Sequence: Synthetic coding sequence

SEQ ID NO: 22463 - DNA, 1254 bp, Artificial Sequence
  Description of Artificial Sequence: Synthetic coding sequence
atgggcgacgaggacaagagaatcacctacgaggacagcgagcccagcaccggcatgaactacacccccagcatgcaccaggaggcccaggaggagaccgtgatgaagctgaagggcatcgacgccaacgagcccaccgagggcagcatcctgctgaagagcagcgagaagaagctgcaggagacccccaccgaggccaaccacgtgcagagactgagacagatgctggcctgccccccccacggcctgctggacagagtgatcaccaacggcatgctgctggccggcttcctgatcagaaacatccccgtgatcaacgacaacgtgcagatcaagcacaagtggagcagcagcctgagaagcatcgccctgagcatcatcctggtgagagccggcctgggcctggacagcaaggccctgaagaagctgaagggcgtgtgcgtgagactgagcatgggcccctgcatcgtggaggcctgcaccagcgccctgctggcccactacctgctgggcctgccctggcagtggggcttcatcctgggcttcgtgctgggcgccgtgagccccgccgtggtggtgcccagcatgctgctgctgcagggcggcggctacggcgtggagaagggcgtgcccaccctgctgatggccgccggcagcttcgacgacatcctggccatcaccggcttcaacacctgcctgggcatcgccttcagcaccggcagcaccgtgttcaacgtgctgagaggcgtgctggaggtggtgatcggcgtggccaccggcagcgtgctgggcttcttcatccagtacttccccagcagagaccaggacaagctggtgtgcaagagaaccttcctggtgctgggcctgagcgtgctggccgtgttcagcagcgtgcacttcggcttccccggcagcggcggcctgtgcaccctggtgatggccttcctggccggcatgggctggaccagcgagaaggccgaggtggagaagatcatcgccgtggcctgggacatcttccagcccctgctgttcggcctgatcggcgccgaggtgagcatcgccagcctgagacccgagaccgtgggctgcaacagaatctgcggcttcggccacagcaaggtgacctggagagagaccatcagaagactgtggaacggctgcgtggacagcggcatcttcgtgcacccccaccacagccccaactggaagagcgcctactggttcaccggcccccaggccagcgccgagagctag

SEQ ID NO: 22464 - DNA, 1443 bp, Artificial Sequence
  Description of Artificial Sequence: Synthetic coding sequence
atgggcgacgaggacaagagaatcacctacgaggacagcgagcccagcaccggcatgaactacacccccagcatgcaccaggaggcccaggaggagaccgtgatgaagctgaagggcatcgacgccaacgagcccaccgagggcagcatcctgctgaagagcagcgagaagaagctgcaggagacccccaccgaggccaaccacgtgcagagactgagacagatgctggcctgccccccccacggcctgctggacagagtgatcaccaacggcatgctgctggccggcttcctgatcagaaacatccccgtgatcaacgacaacgtgcagatcaagcacaagtggagcagcagcctgagaagcatcgccctgagcatcatcctggtgagagccggcctgggcctggacagcaaggccctgaagaagctgaagggcgtgtgcgtgagactgagcatgggcccctgcatcgtggaggcctgcaccagcgccctgctggcccactacctgctgggcctgccctggcagtggggcttcatcctgggcttcgtgctgggcgccgtgagccccgccgtggtggtgcccagcatgctgctgctgcagggcggcggctacggcgtggagaagggcgtgcccaccctgctgatggccgccggcagcttcgacgacatcctggccatcaccggcttcaacacctgcctgggcatcgccttcagcaccggcagcaccgtgttcaacgtgctgagaggcgtgctggaggtggtgatcggcgtggccaccggcagcgtgctgggcttcttcatccagtacttccccagcagagaccaggacaagctggtgtgcaagagaaccttcctggtgctgggcctgagcgtgctggccgtgttcagcagcgtgcacttcggcttccccggcagcggcggcctgtgcaccctggtgatggccttcctggccggcatgggctggaccagcgagaaggccgaggtggagaagatcatcgccgtggcctgggacatcttccagcccctgctgttcggcctgatcggcgccgaggtgagcatcgccagcctgagacccgagaccgtgggcctgtgcgtggccaccgtgggcatcgccgtgctgatcagaatcctgaccaccttcctgatggtgtgcttcgccggcttcaacctgaaggagaagatcttcatcagcttcgcctggctgcccaaggccaccgtgcaggccgccatcggcagcgtggccctggacaccgccagaagccacggcgagaagcagctggaggactacggcatggacgtgctgaccgtggccttcctgagcatcctgatcaccgcccccatcggcagcctgctgatcggcctgctgggccccagactgctgcagaaggtggagcaccagaacaaggacgaggaggtgcagggcgagaccagcgtgcaggtgtag

SEQ ID NO: 22465 - DNA, 432 bp, Artificial Sequence
  Description of Artificial Sequence: Synthetic coding sequence
atgggcgacgaggacaagagaatcacctacgaggacagcgagcccagcaccggcatgaactacacccccagcatgcaccaggaggcccaggaggagaccgtgatgaagctgaagggcatcgacgccaacgagcccaccgagggcagcatcctgctgaagagcagcgagaagaagctgcaggagacccccaccgaggccaaccacgtgcagagactgagacagatgctggcctgccccccccacggcctgctggacagagtgatcaccaacgtgaccatcatcgtgctgctgtgggccgtggtgtggagcatcaccggcagcgagtgcctgcccggcggcaacctgttcggcatcatcatcctgttctactgcgccatcatcggcggcaagctgctgggcctgatcaagctgcccaccctgccccccctgtag

SEQ ID NO: 22466 - DNA, 2064 bp, Artificial Sequence
  Description of Artificial Sequence: Synthetic coding sequence
atggacgagggcaccggcctgcagcccggcgccggcgagcagctggaggcccccgccaccgccgaggccgtgcaggagagatgcgagcccgagaccctgagaagcaagagcctgcccgtgctgagcagcgccagctgcagacccagcctgagccccaccagcggcgacgccaaccccgccttcggctgcgtggacagcagcggccaccaggagctgaagcagggccccaaccccctggcccccagccccagcgcccccagcaccagcgccggcctgggcgactgcaaccacagagtggacctgagcaagaccttcagcgtgagcagcgccctggccatgctgcaggagagaagatgcctgtacgtggtgctgaccgacagcagatgcttcctggtgtgcatgtgcttcctgaccttcatccaggccctgatggtgagcggctacctgagcagcgtgatcaccaccatcgagagaagatacagcctgaagagcagcgagagcggcctgctggtgagctgcttcgacatcggcaacctggtggtggtggtgttcgtgagctacttcggcggcagaggcagaagacccctgtggctggccgtgggcggcctgctgatcgccttcggcgccgccctgttcgccctgccccacttcatcagccccccctaccagatccaggagctgaacgccagcgcccccaacgacggcctgtgccagggcggcaacagcaccgccaccctggagccccccgcctgccccaaggacagcggcggcaacaaccactgggtgtacgtggccctgttcatctgcgcccagatcctgatcggcatgggcagcacccccatctacaccctgggccccacctacctggacgacaacgtgaagaaggagaacagcagcctgtacctggccatcatgtacgtgatgggcgccctgggccccgccgtgggctacctgctgggcggcctgctgatcggcttctacgtggaccccagaaaccccgtgcacctggaccagaacgaccccagattcatcggcaactggtggagcggcttcctgctgtgcgccatcgccatgttcctggtgatcttccccatgttcaccttccccaagaagctgccccccagacacaagaagaagaagaagaagaagttcagcgtggacgccgtgagcgacgacgacgtgctgaaggagaagagcaacaacagcgagcaggccgacaagaaggtgagcagcatgggcttcggcaaggacgtgagagacctgcccagagccgccgtgagaatcctgagcaacatgaccttcctgttcgtgagcctgagctacaccgccgagagcgccatcgtgaccgccttcatcaccttcatccccaagttcatcgagagccagttcggcatccccgccagcaacgccagcatctacaccggcgtgatcatcgtgcccagcgccggcgtgggcatcgtgctgggcggctacatcatcaagaagctgaagctgggcgccagagagagcgccaagctggccatgatctgcagcggcgtgagcctgctgtgcttcagcaccctgttcatcgtgggctgcgagagcatcaacctgggcggcatcaacatcccctacaccaccggccccagcctgaccatgccccacagaaacctgaccggcagctgcaacgtgaactgcggctgcaagatccacgagtacgagcccgtgtgcggcagcgacggcatcacctacttcaacccctgcctggccggctgcgtgaacagcggcaacctgagcaccggcatcagaaactacaccgagtgcacctgcgtgcagagcagacaggtgatcaccccccccaccgtgggccagagaagccagctgagagtggtgatcgtgaagacctacctgaacgagaacggctacgccgtgagcggcaagtgcaagagaacctgcaacaccctgatccccttcctggtgttcctgttcatcgtgaccttcatcaccgcctgcgcccagcccagcgccatcatcgtgaccctgagcatccacagctacagcaacctgctgtggagcagccactag

SEQ ID NO: 22467 - DNA, 2013 bp, Artificial Sequence
  Description of Artificial Sequence: Synthetic coding sequence
atgggcgagaccgagaagagaatcgagacccacagaatcagatgcctgagcaagctgaagatgttcctgctggccatcacctgcgccttcgtgagcaagaccctgagcggcagctacatgaacagcatgctgacccagatcgagagacagttcaacatccccaccagcctggtgggcttcatcaacggcagcttcgagatcggcaacctgctgctgatcatcttcgtgagctacttcggcaccaagctgcacagacccatcatgatcggcatcggctgcgtggtgatgggcctgggctgcttcctgaagagcctgccccacttcctgatgaaccagtacgagtacgagagcaccgtgagcgtgagcggcaacctgagcagcaacagcttcctgtgcatggagaacggcacccagatcctgagacccacccaggaccccagcgagtgcaccaaggaggtgaagagcctgatgtgggtgtacgtgctggtgggcaacatcgtgagaggcatgggcgagacccccatcctgcccctgggcatcagctacatcgaggacttcgccaagttcgagaacagccccctgtacatcggcctggtggagaccggcgccatcatcggccccctgatcggcctgctgctggccagcttctgcgccaacgtgtacgtggacaccggcttcgtgaacaccgacgacctgatcatcacccccaccgacaccagatgggtgggcgcctggtggttcggcttcctgatctgcgccggcgtgaacgtgctgaccgccatccccttcttcttcctgcccaacaccctgcccaaggagggcctggagaccaacgccgacatcatcaagaacgagaacgaggacaagcagaaggaggaggtgaagaaggagaagtacggcatcaccaaggacttcctgcccttcatgaagagcctgagctgcaaccccatctacatgctgttcatcctggtgagcgtgatccagttcaacgccttcgtgaacatgatcagcttcatgcccaagtacctggagcagcagtacggcatcagcagcagcgacgccatcttcctgatgggcatctacaacctgccccccatctgcatcggctacatcatcggcggcctgatcatgaagaagttcaagatcaccgtgaagcaggccgcccacatcggctgctggctgagcctgctggagtacctgctgtacttcctgagcttcctgatgacctgcgagaacagcagcgtggtgggcatcaacaccagctacgagggcatcccccaggacctgtacgtggagaacgacatcttcgccgactgcaacgtggactgcaactgccccagcaagatctgggaccccgtgtgcggcaacaacggcctgagctacctgagcgcctgcctggccggctgcgagaccagcatcggcaccggcatcaacatggtgttccagaactgcagctgcatccagaccagcggcaacagcagcgccgtgctgggcctgtgcgacaagggccccgactgcagcctgatgctgcagtacttcctgatcctgagcgccatgagcagcttcatctacagcctggccgccatccccggctacatggtgctgctgagatgcatgaagagcgaggagaagagcctgggcgtgggcctgcacaccttctgcaccagagtgttcgccggcatccccgcccccatctacttcggcgccctgatggacagcacctgcctgcactggggcaccctgaagtgcggcgagagcggcgcctgcagaatctacgacagcaccaccttcagatacatctacctgggcctgcccgccgccctgagaggcagcagcttcgtgcccgccctgatcatcctgatcctgctgagaaagtgccacctgcccggcgagaacgccagcagcggcaccgagctgatcgagaccaaggtgaagggcaaggagaacgagtgcaaggacatctaccagaagagcaccgtgctgaaggacgacgagctgaagaccaagctgtag

SEQ ID NO: 22468 - DNA, 1740 bp, Artificial Sequence
  Description of Artificial Sequence: Synthetic coding sequence
atgttcctgaccaagaactgcaagcaggagcaggagagagtggagagcgccaagatgttcctgctggccatcacctgcgccttcgtgagcaagaccctgagcggcagctacatgaacagcatgctgacccagatcgagagacagttcaacatccccaccagcctggtgggcttcatcaacggcagcttcgagatcggcaacctgctgctgatcatcttcgtgagctacttcggcaccaagctgcacagacccatcatgatcggcatcggctgcgtggtgatgggcctgggctgcttcctgaagagcctgccccacttcctgatgaaccagtacgagtacgagagcaccgtgagcgtgagcggcaacctgagcagcaacagcttcctgtgcatggagaacggcacccagatcctgagacccacccaggaccccagcgagtgcaccaaggaggtgaagagcctgatgtgggtgtacgtgctggtgggcaacatcgtgagaggcatgggcgagacccccatcctgcccctgggcatcagctacatcgaggacttcgccaagttcgagaacagccccctgtacatcggcctggtggagaccggcgccatcatcggccccctgatcggcctgctgctggccagcttctgcgccaacgtgtacgtggacaccggcttcgtgaacaccgacgacctgatcatcacccccaccgacaccagatgggtgggcgcctggtggttcggcttcctgatctgcgccggcgtgaacgtgctgaccgccatccccttcttcttcctgcccaacaccctgcccaaggagggcctggagaccaacgccgacatcatcaagaacgagaacgaggacaagcagaaggaggaggtgaagaaggagaagtacggcatcaccaaggacttcctgcccttcatgaagagcctgagctgcaaccccatctacatgctgttcatcctggtgagcgtgatccagttcaacgccttcgtgaacatgatcagcttcatgcccaagtacctggagcagcagtacggcatcagcagcagcgacgccatcttcctgatgggcatctacaacctgccccccatctgcatcggctacatcatcggcggcctgatcatgaagaagttcaagatcaccgtgaagcaggccgcccacatcggctgctggctgagcctgctggagtacctgctgtacttcctgagcttcctgatgacctgcgagaacagcagcgtggtgggcatcaacaccagctacgagggcatcccccaggacctgtacgtggagaacgacatcttcgccgactgcaacgtggactgcaactgccccagcaagatctgggaccccgtgtgcggcaacaacggcctgagctacctgagcgcctgcctggccggctgcgagaccagcatcggcaccggcatcaacatggtgttccagaactgcagctgcatccagaccagcggcaacagcagcgccgtgctgggcctgtgcgacaagggccccgactgcagcctgatgctgcagtacttcctgatcctgagcgccatgagcagcttcatctacagcctggccgccatccccggctacatggtgctgctgagatgcatgaagagcgaggagaagagcctgggcgtgggcctgcacaccttctgcaccagagtgttcggcaagaacagctacttcttcccccaccccatcagaaccatcctgctgctgctgttcttcatcaccctgtag

SEQ ID NO: 22469 - DNA, 42 bp, Artificial Sequence
  Description of Artificial Sequence: Synthetic coding sequence
atgggcgagaccgagaagagaatcgagacccacagaatctag

SEQ ID NO: 22470 - DNA, 156 bp, Artificial Sequence
  Description of Artificial Sequence: Synthetic coding sequence
atgggcgagaccgagaagagaatcgagacccacagaatcagatgcctgagcaagctgaagatgttcctgctggccatcacctgcgccttcgtgagcaagaccctgagcggcagctacatgaacagcatgctgacccagatcgagagacagttctag

SEQ ID NO: 22471 - DNA, 300 bp, Artificial Sequence
  Description of Artificial Sequence: Synthetic coding sequence
atgggcgagaccgagaagagaatcgagacccacagaatcagatgcctgagcaagctgaagatgttcctgctggccatcacctgcgccttcgtgagcaagaccctgagcggcagctacatgaacagcatgctgacccagatcgagagacagttcaacatccccaccagcctggtgggcttcatcaacggcagcttcgagatcggcaacctgctgctgatcatcttcgtgagctacttcggcaccaagctgcacagacccatcatgatcggcatcggctgcgtggtgatgggcctgggctag

SEQ ID NO: 22472 - DNA, 444 bp, Artificial Sequence
  Description of Artificial Sequence: Synthetic coding sequence
atgggcgagaccgagaagagaatcgagacccacagaatcagatgcctgagcaagctgaagatgttcctgctggccatcacctgcgccttcgtgagcaagaccctgagcggcagctacatgaacagcatgctgacccagatcgagagacagttcaacatccccaccagcctggtgggcttcatcaacggcagcttcgagatcggcaacctgctgctgatcatcttcgtgagctacttcggcaccaagctgcacagacccatcatgatcggcatcggctgcgtggtgatgggcctgggctgcttcctgaagagcctgccccacttcctgatgaaccagtacgagtacgagagcaccgtgagcgtgagcggcaacctgagcagcaacagcttcctgtgcatggagaacggcacccagatcctgagacccacccaggaccccagctag

SEQ ID NO: 22473 - DNA, 9 bp, Artificial Sequence
  Description of Artificial Sequence: Synthetic coding sequence
atgggctag

SEQ ID NO: 22474 - DNA, 267 bp, Artificial Sequence
  Description of Artificial Sequence: Synthetic coding sequence
atgggcgagaccgagaagagaatcgagacccacagaatcagatgcctgagcaagctgaagatgttcctgctggccatcacctgcgccttcgtgagcaagaccctgagcggcagctacatgaacagcatgctgacccagatcgagagacagttcaacatccccaccagcctggtgggcttcatcaacggcagcttcgagatcggcaacctgctgctgatcatcttcgtgagctacttcggcaccaagctgcacagacccatcatgtag

SEQ ID NO: 22475 - DNA, 276 bp, Artificial Sequence
  Description of Artificial Sequence: Synthetic coding sequence
atgggcgagaccgagaagagaatcgagacccacagaatcagatgcctgagcaagctgaagatgttcctgctggccatcacctgcgccttcgtgagcaagaccctgagcggcagctacatgaacagcatgctgacccagatcgagagacagttcaacatccccaccagcctggtgggcttcatcaacggcagcttcgagatcggcaacctgctgctgatcatcttcgtgagctacttcggcaccaagctgcacagacccatcatgatcggcatctag

SEQ ID NO: 22476 - DNA, 2013 bp, Artificial Sequence; identical to SEQ ID NO: 22467
  Description of Artificial Sequence: Synthetic coding sequence

SEQ ID NO: 22477 - DNA, 414 bp, Artificial Sequence
  Description of Artificial Sequence: Synthetic coding sequence
atgggcgagaccgagaagagaatcgagacccacagaatcagatgcctgagcaagctgaagatgttcctgctggccatcacctgcgccttcgtgagcaagaccctgagcggcagctacatgaacagcatgctgacccagatcgagagacagttcaacatccccaccagcctggtgggcttcatcaacggcagcttcgagatcggcaacctgctgctgatcatcttcgtgagctacttcggcaccaagctgcacagacccatcatgatcggcatcggctgcgtggtgatgggcctgggctgcttcctgaagagcctgccccacttcctgatgaaccagtacgagtacgagagcaccgtgagcgtgagcggcaacctgagcagcaacagcttcctgtgcatggagaacggcacctag

SEQ ID NO: 22478 - DNA, 1617 bp, Artificial Sequence
  Description of Artificial Sequence: Synthetic coding sequence
atggagaacggcacccagatcctgagacccacccaggaccccagcgagtgcaccaaggaggtgaagagcctgatgtgggtgtacgtgctggtgggcaacatcgtgagaggcatgggcgagacccccatcctgcccctgggcatcagctacatcgaggacttcgccaagttcgagaacagccccctgtacatcggcctggtggagaccggcgccatcatcggccccctgatcggcctgctgctggccagcttctgcgccaacgtgtacgtggacaccggcttcgtgaacaccgacgacctgatcatcacccccaccgacaccagatgggtgggcgcctggtggttcggcttcctgatctgcgccggcgtgaacgtgctgaccgccatccccttcttcttcctgcccaacaccctgcccaaggagggcctggagaccaacgccgacatcatcaagaacgagaacgaggacaagcagaaggaggaggtgaagaaggagaagtacggcatcaccaaggacttcctgcccttcatgaagagcctgagctgcaaccccatctacatgctgttcatcctggtgagcgtgatccagttcaacgccttcgtgaacatgatcagcttcatgcccaagtacctggagcagcagtacggcatcagcagcagcgacgccatcttcctgatgggcatctacaacctgccccccatctgcatcggctacatcatcggcggcctgatcatgaagaagttcaagatcaccgtgaagcaggccgcccacatcggctgctggctgagcctgctggagtacctgctgtacttcctgagcttcctgatgacctgcgagaacagcagcgtggtgggcatcaacaccagctacgagggcatcccccaggacctgtacgtggagaacgacatcttcgccgactgcaacgtggactgcaactgccccagcaagatctgggaccccgtgtgcggcaacaacggcctgagctacctgagcgcctgcctggccggctgcgagaccagcatcggcaccggcatcaacatggtgttccagaactgcagctgcatccagaccagcggcaacagcagcgccgtgctgggcctgtgcgacaagggccccgactgcagcctgatgctgcagtacttcctgatcctgagcgccatgagcagcttcatctacagcctggccgccatccccggctacatggtgctgctgagatgcatgaagagcgaggagaagagcctgggcgtgggcctgcacaccttctgcaccagagtgttcgccggcatccccgcccccatctacttcggcgccctgatggacagcacctgcctgcactggggcaccctgaagtgcggcgagagcggcgcctgcagaatctacgacagcaccaccttcagatacatctacctgggcctgcccgccgccctgagaggcagcagcttcgtgcccgccctgatcatcctgatcctgctgagaaagtgccacctgcccggcgagaacgccagcagcggcaccgagctgatcgagaccaaggtgaagggcaaggagaacgagtgcaaggacatctaccagaagagcaccgtgctgaaggacgacgagctgaagaccaagctgtag

SEQ ID NO: 22479 - DNA, 1617 bp, Artificial Sequence; identical to SEQ ID NO: 22478
  Description of Artificial Sequence: Synthetic coding sequence

SEQ ID NO: 22480 - DNA, 1704 bp, Artificial Sequence
  Description of Artificial Sequence: Synthetic coding sequence
atgggcctgctgcccaagctgggcgccagccagggcagcgacaccagcaccagcagagccggcagatgcgccagaagcgtgttcggcaacatcaaggtgttcgtgctgtgccagggcctgctgcagctgtgccagctgctgtacagcgcctacttcaagagcagcctgaccaccatcgagaagagattcggcctgagcagcagcagcagcggcctgatcagcagcctgaacgagatcagcaacgccatcctgatcatcttcgtgagctacttcggcagcagagtgcacagacccagactgatcggcatcggcggcctgttcctggccgccggcgccttcatcctgaccctgccccacttcctgagcgagccctaccagtacaccctggccagcaccgccatcctgttcgccatcagcgtgttcggccccgccttcggctacctgctgggcagcgtgatgctgcagatcttcgtggactacggcagagtgaacaccgccgccgtgaacctggtgcccggcgaccccagatggatcggcgcctggtggctgggcctgctgatcagcagcgccctgctggtgctgaccagcttccccttcttcttcttccccagagccatgcccatcggcgccaagagagcccccgccaccgccgacgaggccagaaagctggaggaggccaagagcagaggcagcctggtggacttcatcaagagattcccctgcatcttcctgagactgctgatgaacagcctgttcgtgctggtggtgctggcccagtgcaccttcagcagcgtgatcgccggcctgagcaccttcctgaacaagttcctggagaagcagtacggcaccagcgccgcctacgccaacttcctgatcggcgccgtgaacctgcccgccgccgccctgggcatgctgttcggcggcatcctgatgaagagattcgtgttcagcctgcaggccatccccagaatcgccaccaccatcatcaccatcagcatgatcctgtgcgtgcccctgttcttcatgggctgcagcacccccaccgtggccgaggtgtacccccccagcaccagcagcagcatccacccccagagccccgcctgcagaagagactgcagctgccccgacagcatcttccaccccgtgtgcggcgacaacggcatcgagtacctgagcccctgccacgccggctgcagcaacatcaacatgagcagcgccaccagcaagcagctgatctacctgaactgcagctgcgtgaccggcggcagcgccagcgccaagaccggcagctgccccgtgccctgcgcccacttcctgctgcccgccatcttcctgatcagcttcgtgagcctgatcgcctgcatcagccacaaccccctgtacatgatggtgctgagagtggtgaaccaggaggagaagagcttcgccatcggcgtgcagttcctgctgatgagactgctggcctggctgcccagccccgccctgtacggcctgaccatcgaccacagctgcatcagatggaacagcctgtgcctgggcagaagaggcgcctgcgcctactacgacaacgacgccctgagagacagatacctgggcctgcagatgggctacaaggccctgggcatgctgctgctgtgcttcatcagctggagagtgaagaagaacaaggagtacaacgtgcagaaggccgccggcctgatctag

SEQ ID NO: 22481 - DNA, 2130 bp, Artificial Sequence
  Description of Artificial Sequence: Synthetic coding sequence
atgggccccagaatcggccccgccggcgaggtgccccaggtgcccgacaaggagaccaaggccaccatgggcaccgagaacacccccggcggcaaggccagccccgacccccaggacgtgagacccagcgtgttccacaacatcaagctgttcgtgctgtgccacagcctgctgcagctggcccagctgatgatcagcggctacctgaagagcagcatcagcaccgtggagaagagattcggcctgagcagccagaccagcggcctgctggccagcttcaacgaggtgggcaacaccgccctgatcgtgttcgtgagctacttcggcagcagagtgcacagacccagaatgatcggctacggcgccatcctggtggccctggccggcctgctgatgaccctgccccacttcatcagcgagccctacagatacgacaacaccagccccgaggacatgccccaggacttcaaggccagcctgtgcctgcccaccaccagcgcccccgccagcgcccccagcaacggcaactgcagcagctacaccgagacccagcacctgagcgtggtgggcatcatgttcgtggcccagaccctgctgggcgtgggcggcgtgcccatccagcccttcggcatcagctacatcgacgacttcgcccacaacagcaacagccccctgtacctgggcatcctgttcgccgtgaccatgatgggccccggcctggccttcggcctgggcagcctgatgctgagactgtacgtggacatcaaccagatgcccgagggcggcatcagcctgaccatcaaggaccccagatgggtgggcgcctggtggctgggcttcctgatcgccgccggcgccgtggccctggccgccatcccctacttcttcttccccaaggagatgcccaaggagaagagagagctgcagttcagaagaaaggtgctggccgtgaccgacagccccgccagaaagggcaaggacagccccagcaagcagagccccggcgagagcaccaagaagcaggacggcctggtgcagatcgcccccaacctgaccgtgatccagttcatcaaggtgttccccagagtgctgctgcagaccctgagacaccccatcttcctgctggtggtgctgagccaggtgtgcctgagcagcatggccgccggcatggccatcttcctgcccaagttcctggagagacagttcagcatcaccgccagctacgccaacctgctgatcggctgcctgagcttccccagcgtgatcgtgggcatcgtggtgggcggcgtgctggtgaagagactgcacctgggccccgtgggctgcggcgccctgtgcctgctgggcatgctgctgtgcctgttcttcagcctgcccctgttcttcatcggctgcagcagccaccagatcgccggcatcacccaccagaccagcgcccaccccggcctggagctgagccccagctgcatggaggcctgcagctgccccctggacggcttcaaccccgtgtgcgaccccagcaccagagtggagtacatcaccccctgccacgccggctgcagcagctgggtggtgcaggacgccctggacaacagccaggtgttctacaccaactgcagctgcgtggtggagggcaaccccgtgctggccggcagctgcgacagcacctgcagccacctggtggtgcccttcctgctgctggtgagcctgggcagcgccctggcctgcctgacccacacccccagcttcatgctgatcctgagaggcgtgaagaaggaggacaagaccctggccgtgggcatccagttcatgttcctgagaatcctggcctggatgcccagccccgtgatccacggcagcgccatcgacaccacctgcgtgcactgggccctgagctgcggcagaagagccgtgtgcagatactacaacaacgacctgctgagaaacagattcatcggcctgcagttcttcttcaagaccggcagcgtgatctgcttcgccctggtgctggccgtgctgagacagcaggacaaggaggccagaaccaaggagagcagaagcagccccgccgtggagcagcagctgctggtgagcggccccggcaagaagcccgaggacagcagagtgtag

SEQ ID NO: 22482 - DNA, 1449 bp, Artificial Sequence
  Description of Artificial Sequence: Synthetic coding sequence
atgatcggctacggcgccatcctggtggccctggccggcctgctgatgaccctgccccacttcatcagcgagccctacagatacgacaacaccagccccggcggcatcagcctgaccatcaaggaccccagatgggtgggcgcctggtggctgggcttcctgatcgccgccggcgccgtggccctggccgccatcccctacttcttcttccccaaggagatgcccaaggagaagagagagctgcagttcagaagaaaggtgctggccgtgaccgacagccccgccagaaagggcaaggacagccccagcaagcagagccccggcgagagcaccaagaagcaggacggcctggtgcagatcgcccccaacctgaccgtgatccagttcatcaaggtgttccccagagtgctgctgcagaccctgagacaccccatcttcctgctggtggtgctgagccaggtgtgcctgagcagcatggccgccggcatggccatcttcctgcccaagttcctggagagacagttcagcatcaccgccagctacgccaacctgctgatcggctgcctgagcttccccagcgtgatcgtgggcatcgtggtgggcggcgtgctggtgaagagactgcacctgggccccgtgggctgcggcgccctgtgcctgctgggcatgctgctgtgcctgttcttcagcctgcccctgttcttcatcggctgcagcagccaccagatcgccggcatcacccaccagaccagcgcccaccccggcctggagctgagccccagctgcatggaggcctgcagctgccccctggacggcttcaaccccgtgtgcgaccccagcaccagagtggagtacatcaccccctgccacgccggctgcagcagctgggtggtgcaggacgccctggacaacagccaggtgttctacaccaactgcagctgcgtggtggagggcaaccccgtgctggccggcagctgcgacagcacctgcagccacctggtggtgcccttcctgctgctggtgagcctgggcagcgccctggcctgcctgacccacacccccagcttcatgctgatcctgagaggcgtgaagaaggaggacaagaccctggccgtgggcatccagttcatgttcctgagaatcctggcctggatgcccagccccgtgatccacggcagcgccatcgacaccacctgcgtgcactgggccctgagctgcggcagaagagccgtgtgcagatactacaacaacgacctgctgagaaacagattcatcggcctgcagttcttcttcaagaccggcagcgtgatctgcttcgccctggtgctggccgtgctgagacagcaggacaaggaggccagaaccaaggagagcagaagcagccccgccgtggagcagcagctgctggtgagcggccccggcaagaagcccgaggacagcagagtgtag

SEQ ID NO: 22483 - DNA, 2064 bp, Artificial Sequence
  Description of Artificial Sequence: Synthetic coding sequence
atgggcaccgagaacacccccggcggcaaggccagccccgacccccaggacgtgagacccagcgtgttccacaacatcaagctgttcgtgctgtgccacagcctgctgcagctggcccagctgatgatcagcggctacctgaagagcagcatcagcaccgtggagaagagattcggcctgagcagccagaccagcggcctgctggccagcttcaacgaggtgggcaacaccgccctgatcgtgttcgtgagctacttcggcagcagagtgcacagacccagaatgatcggctacggcgccatcctggtggccctggccggcctgctgatgaccctgccccacttcatcagcgagccctacagatacgacaacaccagccccgaggacatgccccaggacttcaaggccagcctgtgcctgcccaccaccagcgcccccgccagcgcccccagcaacggcaactgcagcagctacaccgagacccagcacctgagcgtggtgggcatcatgttcgtggcccagaccctgctgggcgtgggcggcgtgcccatccagcccttcggcatcagctacatcgacgacttcgcccacaacagcaacagccccctgtacctgggcatcctgttcgccgtgaccatgatgggccccggcctggccttcggcctgggcagcctgatgctgagactgtacgtggacatcaaccagatgcccgagggcggcatcagcctgaccatcaaggaccccagatgggtgggcgcctggtggctgggcttcctgatcgccgccggcgccgtggccctggccgccatcccctacttcttcttccccaaggagatgcccaaggagaagagagagctgcagttcagaagaaaggtgctggccgtgaccgacagccccgccagaaagggcaaggacagccccagcaagcagagccccggcgagagcaccaagaagcaggacggcctggtgcagatcgcccccaacctgaccgtgatccagttcatcaaggtgttccccagagtgctgctgcagaccctgagacaccccatcttcctgctggtggtgctgagccaggtgtgcctgagcagcatggccgccggcatggccatcttcctgcccaagttcctggagagacagttcagcatcaccgccagctacgccaacctgctgatcggctgcctgagcttccccagcgtgatcgtgggcatcgtggtgggcggcgtgctggtgaagagactgcacctgggccccgtgggctgcggcgccctgtgcctgctgggcatgctgctgtgcctgttcttcagcctgcccctgttcttcatcggctgcagcagccaccagatcgccggcatcacccaccagaccagcgcccaccccggcctggagctgagccccagctgcatggaggcctgcagctgccccctggacggcttcaaccccgtgtgcgaccccagcaccagagtggagtacatcaccccctgccacgccggctgcagcagctgggtggtgcaggacgccctggacaacagccaggtgttctacaccaactgcagctgcgtggtggagggcaaccccgtgctggccggcagctgcgacagcacctgcagccacctggtggtgcccttcctgctgctggtgagcctgggcagcgccctggcctgcctgacccacacccccagcttcatgctgatcctgagaggcgtgaagaaggaggacaagaccctggccgtgggcatccagttcatgttcctgagaatcctggcctggatgcccagccccgtgatccacggcagcgccatcgacaccacctgcgtgcactgggccctgagctgcggcagaagagccgtgtgcagatactacaacaacgacctgctgagaaacagattcatcggcctgcagttcttcttcaagaccggcagcgtgatctgcttcgccctggtgctggccgtgctgagacagcaggacaaggaggccagaaccaaggagagcagaagcagccccgccgtggagcagcagctgctggtgagcggccccggcaagaagcccgaggacagcagagtgtag

SEQ ID NO: 22484 - DNA, 1449 bp, Artificial Sequence; identical to SEQ ID NO: 22482
  Description of Artificial Sequence: Synthetic coding sequence

SEQ ID NO: 22485 - DNA, 1698 bp, Artificial Sequence
  Description of Artificial Sequence: Synthetic coding sequence
atgggccccagaatcgaggacatgccccaggacttcaaggccagcctgtgcctgcccaccaccagcgcccccgccagcgcccccagcaacggcaactgcagcagctacaccgagacccagcacctgagcgtggtgggcatcatgttcgtggcccagaccctgctgggcgtgggcggcgtgcccatccagcccttcggcatcagctacatcgacgacttcgcccacaacagcaacagccccctgtacctgggcatcctgttcgccgtgaccatgatgggccccggcctggccttcggcctgggcagcctgatgctgagactgtacgtggacatcaaccagatgcccgagggcggcatcagcctgaccatcaaggaccccagatgggtgggcgcctggtggctgggcttcctgatcgccgccggcgccgtggccctggccgccatcccctacttcttcttccccaaggagatgcccaaggagaagagagagctgcagttcagaagaaaggtgctggccgtgaccgacagccccgccagaaagggcaaggacagccccagcaagcagagccccggcgagagcaccaagaagcaggacggcctggtgcagatcgcccccaacctgaccgtgatccagttcatcaaggtgttccccagagtgctgctgcagaccctgagacaccccatcttcctgctggtggtgctgagccaggtgtgcctgagcagcatggccgccggcatggccatcttcctgcccaagttcctggagagacagttcagcatcaccgccagctacgccaacctgctgatcggctgcctgagcttccccagcgtgatcgtgggcatcgtggtgggcggcgtgctggtgaagagactgcacctgggccccgtgggctgcggcgccctgtgcctgctgggcatgctgctgtgcctgttcttcagcctgcccctgttcttcatcggctgcagcagccaccagatcgccggcatcacccaccagaccagcgcccaccccggcctggagctgagccccagctgcatggaggcctgcagctgccccctggacggcttcaaccccgtgtgcgaccccagcaccagagtggagtacatcaccccctgccacgccggctgcagcagctgggtggtgcaggacgccctggacaacagccaggtgttctacaccaactgcagctgcgtggtggagggcaaccccgtgctggccggcagctgcgacagcacctgcagccacctggtggtgcccttcctgctgctggtgagcctgggcagcgccctggcctgcctgacccacacccccagcttcatgctgatcctgagaggcgtgaagaaggaggacaagaccctggccgtgggcatccagttcatgttcctgagaatcctggcctggatgcccagccccgtgatccacggcagcgccatcgacaccacctgcgtgcactgggccctgagctgcggcagaagagccgtgtgcagatactacaacaacgacctgctgagaaacagattcatcggcctgcagttcttcttcaagaccggcagcgtgatctgcttcgccctggtgctggccgtgctgagacagcaggacaaggaggccagaaccaaggagagcagaagcagccccgccgtggagcagcagctgctggtgagcggccccggcaagaagcccgaggacagcagagtgtag

SEQ ID NO: 22486 - DNA, 135 bp, Artificial Sequence
  Description of Artificial Sequence: Synthetic coding sequence
atgggcaccgagaacacccccggcggcaaggccagccccgacccccaggacgtgagacccagcgtgttccacaacatcaagctgttcgtgctgtgccacagcctgctgcagctggcccagctgatgatcagctag

SEQ ID NO: 22487 - DNA, 453 bp, Artificial Sequence
  Description of Artificial Sequence: Synthetic coding sequence
atgggcaccgagaacacccccggcggcaaggccagccccgacccccaggacgtgagacccagcgtgttccacaacatcaagctgttcgtgctgtgccacagcctgctgcagctggcccagctgatgatcagcggctacctgaagagcagcatcagcaccgtggagaagagattcggcctgagcagccagaccagcggcctgctggccagcttcaacgaggtgggcaacaccgccctgatcgtgttcgtgagctacttcggcagcagagtgcacagacccagaatgatcggctacggcgccatcctggtggccctggccggcctgctgatgaccctgccccacttcatcagcgagccctacagatacgacaacaccagccccgaggacatgccccaggacttcaaggccagcctgtgcctgcccaccaccagcgcccccgccagcgccccctag

SEQ ID NO: 22488 - DNA, 135 bp, Artificial Sequence; identical to SEQ ID NO: 22486
  Description of Artificial Sequence: Synthetic coding sequence

SEQ ID NO: 22489 - DNA, 264 bp, Artificial Sequence
  Description of Artificial Sequence: Synthetic coding sequence
atgggcaccgagaacacccccggcggcaaggccagccccgacccccaggacgtgagacccagcgtgttccacaacatcaagctgttcgtgctgtgccacagcctgctgcagctggcccagctgatgatcagcggctacctgaagagcagcatcagcaccgtggagaagagattcggcctgagcagccagaccagcggcctgctggccagcttcaacgaggtgggcaacaccgccctgatcgtgttcgtgagctacttcggctag

SEQ ID NO: 22490 - DNA, 1782 bp, Artificial Sequence
  Description of Artificial Sequence: Synthetic coding sequence
atgatcggctacggcgccatcctggtggccctggccggcctgctgatgaccctgccccacttcatcagcgagccctacagatacgacaacaccagccccgaggacatgccccaggacttcaaggccagcctgtgcctgcccaccaccagcgcccccgccagcgcccccagcaacggcaactgcagcagctacaccgagacccagcacctgagcgtggtgggcatcatgttcgtggcccagaccctgctgggcgtgggcggcgtgcccatccagcccttcggcatcagctacatcgacgacttcgcccacaacagcaacagccccctgtacctgggcatcctgttcgccgtgaccatgatgggccccggcctggccttcggcctgggcagcctgatgctgagactgtacgtggacatcaaccagatgcccgagggcggcatcagcctgaccatcaaggaccccagatgggtgggcgcctggtggctgggcttcctgatcgccgccggcgccgtggccctggccgccatcccctacttcttcttccccaaggagatgcccaaggagaagagagagctgcagttcagaagaaaggtgctggccgtgaccgacagccccgccagaaagggcaaggacagccccagcaagcagagccccggcgagagcaccaagaagcaggacggcctggtgcagatcgcccccaacctgaccgtgatccagttcatcaaggtgttccccagagtgctgctgcagaccctgagacaccccatcttcctgctggtggtgctgagccaggtgtgcctgagcagcatggccgccggcatggccatcttcctgcccaagttcctggagagacagttcagcatcaccgccagctacgccaacctgctgatcggctgcctgagcttccccagcgtgatcgtgggcatcgtggtgggcggcgtgctggtgaagagactgcacctgggccccgtgggctgcggcgccctgtgcctgctgggcatgctgctgtgcctgttcttcagcctgcccctgttcttcatcggctgcagcagccaccagatcgccggcatcacccaccagaccagcgcccaccccggcctggagctgagccccagctgcatggaggcctgcagctgccccctggacggcttcaaccccgtgtgcgaccccagcaccagagtggagtacatcaccccctgccacgccggctgcagcagctgggtggtgcaggacgccctggacaacagccaggtgttctacaccaactgcagctgcgtggtggagggcaaccccgtgctggccggcagctgcgacagcacctgcagccacctggtggtgcccttcctgctgctggtgagcctgggcagcgccctggcctgcctgacccacacccccagcttcatgctgatcctgagaggcgtgaagaaggaggacaagaccctggccgtgggcatccagttcatgttcctgagaatcctggcctggatgcccagccccgtgatccacggcagcgccatcgacaccacctgcgtgcactgggccctgagctgcggcagaagagccgtgtgcagatactacaacaacgacctgctgagaaacagattcatcggcctgcagttcttcttcaagaccggcagcgtgatctgcttcgccctggtgctggccgtgctgagacagcaggacaaggaggccagaaccaaggagagcagaagcagccccgccgtggagcagcagctgctggtgagcggccccggcaagaagcccgaggacagcagagtgtag

SEQ ID NO: 22491 - DNA, 135 bp, Artificial Sequence; identical to SEQ ID NO: 22486
  Description of Artificial Sequence: Synthetic coding sequence

SEQ ID NO: 22492 - DNA, 384 bp, Artificial Sequence
  Description of Artificial Sequence: Synthetic coding sequence
atgggcaccgagaacacccccggcggcaaggccagccccgacccccaggacgtgagacccagcgtgttccacaacatcaagctgttcgtgctgtgccacagcctgctgcagctggcccagctgatgatcagcggctacctgaagagcagcatcagcaccgtggagaagagattcggcctgagcagccagaccagcggcctgctggccagcttcaacgaggtgggcaacaccgccctgatcgtgttcgtgagctacttcggcagcagagtgcacagacccagaatgatcggctacggcgccatcctggtggccctggccggcctgctgatgaccctgccccacttcatcagcgagccctacagatacgacaacaccagcccctag

SEQ ID NO: 22493 - DNA, 2175 bp, Artificial Sequence
  Description of Artificial Sequence: Synthetic coding sequence
atgaagagcgccaagggcatcgagaacctggccttcgtgcccagcagccccgacatcctgagaagactgagcgccagccccagccagatcgaggtgagcgccctgagcagcgacccccagagagagaacagccagccccaggagctgcagaagccccaggagccccagaagagccccgagcccagcctgcccagcgccccccccaacgtgagcgaggagaagctgagaagcctgagcctgagcgagttcgaggagggcagctacggctggagaaacttccacccccagtgcctgcagagatgcaacacccccggcggcttcctgctgcactactgcctgctggccgtgacccagggcatcgtggtgaacggcctggtgaacatcagcatcagcaccgtggagaagagatacgagatgaagagcagcctgaccggcctgatcagcagcagctacgacatcagcttctgcctgctgagcctgttcgtgagcttcttcggcgagagaggccacaagcccagatggctggccttcgccgccttcatgatcggcctgggcgccctggtgttcagcctgccccagttcttcagcggcgagtacaagctgggcagcctgttcgaggacacctgcgtgaccaccagaaacagcaccagctgcaccagcagcaccagcagcctgagcaactacctgtacgtgttcatcctgggccagctgctgctgggcgccggcggcacccccctgtacaccctgggcaccgccttcctggacgacagcgtgcccacccacaagagcagcctgtacatcggcaccggctacgccatgagcatcctgggccccgccatcggctacgtgctgggcggccagctgctgaccatctacatcgacgtggccatgggcgagagcaccgacgtgaccgaggacgaccccagatggctgggcgcctggtggatcggcttcctgctgagctggatcttcgcctggagcctgatcatccccttcagctgcttccccaagcacctgcccggcaccgccgagatccaggccggcaagaccagccaggcccaccagagcaacagcaacgccgacgtgaagttcggcaagagcatcaaggacttccccgccgccctgaagaacctgatgaagaacgccgtgttcatgtgcctggtgctgagcaccagcagcgaggccctgatcaccaccggcttcgccaccttcctgcccaagttcatcgagaaccagttcggcctgaccagcagcttcgccgccaccctgggcggcgccgtgctgatccccggcgccgccctgggccagatcctgggcggcttcctggtgagcaagttcagaatgacctgcaagaacaccatgaagttcgccctgttcaccagcggcgtggccctgaccctgagcttcgtgttcatgtacgccaagtgcgagaacgagcccttcgccggcgtgagcgagagctacaacggcaccggcgagctgggcaacctgatcgccccctgcaacgccaactgcaactgcagcagaagctactactaccccgtgtgcggcgacggcgtgcagtacttcagcccctgcttcgccggctgcagcaaccccgtggcccacagaaagcccaaggtgtactacaactgcagctgcatcgagagaaagaccgagatcaccagcaccgccgagaccttcggcttcgaggccaaggccggcaagtgcgagacccactgcgccaagctgcccatcttcctgtgcatcttcttcatcgtgatcatcttcaccttcatggccggcacccccatcaccgtgagcatcctgagatgcgtgaaccacagacagagaagcctggccctgggcatccagttcatggtgctgagactgctgggcaccatccccggccccatcatcttcggcttcaccatcgacagcacctgcatcctgtgggacatcaacgactgcggcatcaagggcgcctgctggatctacgacaacatcaagatggcccacatgctggtggccatcagcgtgacctgcaaggtgatcaccatgttcttcaacggcttcgccatcttcctgtacaagcccccccccagcgccaccgacgtgagcttccacaaggagaacgccgtggtgaccaacgtgctggccgagcaggacctgaacaagatcgtgaaggagggctag

SEQ ID NO: 22494 - DNA, 2547 bp, Artificial Sequence
  Description of Artificial Sequence: Synthetic coding sequence
atggacgagggcaccggcctgcagcccggcgccggcgagcagctggaggcccccgccaccgccgaggccgtgcaggagagatgcgagcccgagaccctgagaagcaagagcctgcccgtgctgagcagcgccagctgcagacccagcctgagccccaccagcggcgacgccaaccccgccttcggctgcgtggacagcagcggccaccaggagctgaagcagggccccaaccccctggcccccagccccagcgcccccagcaccagcgccggcctgggcgactgcaaccacagagtggacctgagcaagaccttcagcgtgagcagcgccctggccatgctgcaggagagaagatgcctgtacgtggtgctgaccgacagcagatgcttcctggtgtgcatgtgcttcctgaccttcatccaggccctgatggtgagcggctacctgagcagcgtgatcaccaccatcgagagaagatacagcctgaagagcagcgagagcggcctgctggtgagctgcttcgacatcggcaacctggtggtggtggtgttcgtgagctacttcggcggcagaggcagaagacccctgtggctggccgtgggcggcctgctgatcgccttcggcgccgccctgttcgccctgccccacttcatcagccccccctaccagatccaggagctgaacgccagcgcccccaacgacggcctgtgccagggcggcaacagcaccgccaccctggagccccccgcctgccccaaggacagcggcggcaacaaccactgggtgtacgtggccctgttcatctgcgcccagatcctgatcggcatgggcagcacccccatctacaccctgggccccacctacctggacgacaacgtgaagaaggagaacagcagcctgtacctggccatcatgtacgtgatgggcgccctgggccccgccgtgggctacctgctgggcggcctgctgatcggcttctacgtggaccccagaaaccccgtgcacctggaccagaacgaccccagattcatcggcaactggtggagcggcttcctgctgtgcgccatcgccatgttcctggtgatcttccccatgttcaccttccccaagaagctgccccccagacacaagaagaagaagaagaagaagttcagcgtggacgccgtgagcgacgacgacgtgctgaaggagaagagcaacaacagcgagcaggccgacaagaaggtgagcagcatgggcttcggcaaggacgtgagagacctgcccagagccgccgtgagaatcctgagcaacatgaccttcctgttcgtgagcctgagctacaccgccgagagcgccatcgtgaccgccttcatcaccttcatccccaagttcatcgagagccagttcggcatccccgccagcaacgccagcatctacaccggcgtgatcatcgtgcccagcgccggcgtgggcatcgtgctgggcggctacatcatcaagaagctgaagctgggcgccagagagagcgccaagctggccatgatctgcagcggcgtgagcctgctgtgcttcagcaccctgttcatcgtgggctgcgagagcatcaacctgggcggcatcaacatcccctacaccaccggccccagcctgaccatgccccacagaaacctgaccggcagctgcaacgtgaactgcggctgcaagatccacgagtacgagcccgtgtgcggcagcgacggcatcacctacttcaacccctgcctggccggctgcgtgaacagcggcaacctgagcaccggcatcagaaactacaccgagtgcacctgcgtgcagagcagacaggtgatcaccccccccaccgtgggccagagaagccagctgagagtggtgatcgtgaagacctacctgaacgagaacggctacgccgtgagcggcaagtgcaagagaacctgcaacaccctgatccccttcctggtgttcctgttcatcgtgaccttcatcaccgcctgcgcccagcccagcgccatcatcgtgaccctgagaagcgtggaggacgaggagagacccttcgccctgggcatgcagttcgtgctgctgagaaccctggcctacatccccacccccatctacttcggcgccgtgatcgacaccacctgcatgctgtggcagcaggagtgcggcgtgcagggcagctgctgggagtacaacgtgaccagcttcagattcgtgtacttcggcctggccgccggcctgaagttcgtgggcttcatcttcatcttcctggcctggtacagcatcaagtacaaggaggacggcctgcagagaagaagacagagagagttccccctgagcaccgtgagcgagagagtgggccaccccgacaacgccagaaccagaagctgccccgccttcagcacccagggcgagttccacgaggagaccggcctgcagaagggcatccagtgcgccgcccagacctaccccggccccttccccgaggccatcagcagcagcgccgaccccggcctggaggagagccccgccgccctggagccccccagctag

SEQ ID NO: 22495 - DNA, 2382 bp, Artificial Sequence
  Description of Artificial Sequence: Synthetic coding sequence
atggacgagggcaccggcctgcagcccggcgccggcgagcagctggaggcccccgccaccgccgaggccgtgcaggagagatgcgagcccgagaccctgagaagcaagagcctgcccgtgctgagcagcgccagctgcagacccagcctgagccccaccagcggcgacgccaaccccgccttcggctgcgtggacagcagcggccaccaggagctgaagcagggccccaaccccctggcccccagccccagcgcccccagcaccagcgccggcctgggcgactgcaaccacagagtggacctgagcaagaccttcagcgtgagcagcgccctggccatgctgcaggagagaagatgcctgtacgtggtgctgaccgacagcagatgcttcctggtgtgcatgtgcttcctgaccttcatccaggccctgatggtgagcggctacctgagcagcgtgatcaccaccatcgagagaagatacagcctgaagagcagcgagagcggcctgctggtgagctgcttcgacatcggcaacctggtggtggtggtgttcgtgagctacttcggcggcagaggcagaagacccctgtggctggccgtgggcggcctgctgatcgccttcggcgccgccctgttcgccctgccccacttcatcagccccccctaccagatccaggagctgaacgccagcgcccccaacgacggcctgtgccagggcggcaacagcaccgccaccctggagccccccgcctgccccaaggacagcggcggcaacaaccactgggtgtacgtggccctgttcatctgcgcccagatcctgatcggcatgggcagcacccccatctacaccctgggccccacctacctggacgacaacgtgaagaaggagaacagcagcctgtacctggccatcatgtacgtgatgggcgccctgggccccgccgtgggctacctgctgggcggcctgctgatcggcttctacgtggaccccagaaaccccgtgcacctggaccagaacgaccccagattcatcggcaactggtggagcggcttcctgctgtgcgccatcgccatgttcctggtgatcttccccatgttcaccttccccaagaagctgccccccagacacaagaagaagaagaagaagaagttcagcgtggacgccgtgagcgacgacgacgtgctgaaggagaagagcaacaacagcgagcaggccgacaagaaggtgagcagcatgggcttcggcaaggacgtgagaggcgtgatcatcgtgcccagcgccggcgtgggcatcgtgctgggcggctacatcatcaagaagctgaagctgggcgccagagagagcgccaagctggccatgatctgcagcggcgtgagcctgctgtgcttcagcaccctgttcatcgtgggctgcgagagcatcaacctgggcggcatcaacatcccctacaccaccggccccagcctgaccatgccccacagaaacctgaccggcagctgcaacgtgaactgcggctgcaagatccacgagtacgagcccgtgtgcggcagcgacggcatcacctacttcaacccctgcctggccggctgcgtgaacagcggcaacctgagcaccggcatcagaaactacaccgagtgcacctgcgtgcagagcagacaggtgatcaccccccccaccgtgggccagagaagccagctgagagtggtgatcgtgaagacctacctgaacgagaacggctacgccgtgagcggcaagtgcaagagaacctgcaacaccctgatccccttcctggtgttcctgttcatcgtgaccttcatcaccgcctgcgcccagcccagcgccatcatcgtgaccctgagaagcgtggaggacgaggagagacccttcgccctgggcatgcagttcgtgctgctgagaaccctggcctacatccccacccccatctacttcggcgccgtgatcgacaccacctgcatgctgtggcagcaggagtgcggcgtgcagggcagctgctgggagtacaacgtgaccagcttcagattcgtgtacttcggcctggccgccggcctgaagttcgtgggcttcatcttcatcttcctggcctggtacagcatcaagtacaaggaggacggcctgcagagaagaagacagagagagttccccctgagcaccgtgagcgagagagtgggccaccccgacaacgccagaaccagaagctgccccgccttcagcacccagggcgagttccacgaggagaccggcctgcagaagggcatccagtgcgccgcccagacctaccccggccccttccccgaggccatcagcagcagcgccgaccccggcctggaggagagccccgccgccctggagccccccagctag

SEQ ID NO: 22496 - DNA, 606 bp, Artificial Sequence
  Description of Artificial Sequence: Synthetic coding sequence
atgttccccgagcagcagaaggaggagttcgtgagcgtgtgggtgagagaccccagaatccagaaggaggacttctggcacagctacatcgactacgagatctgcatccacaccaacagcatgtgcttcaccatgaagaccagctgcgtgagaagaagatacagagagttcgtgtggctgagacagagactgcagagcaacgccctgctggtgcagctgcccgagctgcccagcaagaacctgttcttcaacatgaacaacagacagcacgtggaccagagaagacagggcctggaggacttcctgagaaaggtgctgcagaacgccctgctgctgagcgacagcagcctgcacctgttcctgcagagccacctgaacagcgaggacatcgaggcctgcgtgagcggccagaccaagtacagcgtggaggaggccatccacaagttcgccctgatgaacagaagattccccgaggaggacgaggagggcaagaaggagaacgacatcgactacgacagcgagagcagcagcagcggcctgggccacagcagcgacgacagcagcagccacggctgcaaggtgaacaccgccccccaggagagctag

SEQ ID NO: 22497 - DNA, 606 bp, Artificial Sequence; identical to SEQ ID NO: 22496
  Description of Artificial Sequence: Synthetic coding sequence

SEQ ID NO: 22498 - DNA, 684 bp, Artificial Sequence
  Description of Artificial Sequence: Synthetic coding sequence
atgatcctgatggagggcatcggctgcatgagacacagcagcctgaccagacagcccaagctgccctacagaagcctggccagcgccagaggcggcctgcaggagttcgtgagcgtgtgggtgagagaccccagaatccagaaggaggacttctggcacagctacatcgactacgagatctgcatccacaccaacagcatgtgcttcaccatgaagaccagctgcgtgagaagaagatacagagagttcgtgtggctgagacagagactgcagagcaacgccctgctggtgcagctgcccgagctgcccagcaagaacctgttcttcaacatgaacaacagacagcacgtggaccagagaagacagggcctggaggacttcctgagaaaggtgctgcagaacgccctgctgctgagcgacagcagcctgcacctgttcctgcagagccacctgaacagcgaggacatcgaggcctgcgtgagcggccagaccaagtacagcgtggaggaggccatccacaagttcgccctgatgaacagaagattccccgaggaggacgaggagggcaagaaggagaacgacatcgactacgacagcgagagcagcagcagcggcctgggccacagcagcgacgacagcagcagccacggctgcaaggtgaacaccgccccccaggagagctag

SEQ ID NO: 22499 - DNA, 354 bp, Artificial Sequence
  Description of Artificial Sequence: Synthetic coding sequence
atgaacaacagacagcacgtggaccagagaagacagggcctggaggacttcctgagaaaggtgctgcagaacgccctgctgctgagcgacagcagcctgcacctgttcctgcagagccacctgaacagcgaggacatcgaggcctgcgtgagcggccagaccaagtacagcgtggaggaggccatccacaagttcgccctgatgaacagaagattccccgaggaggacgaggagggcaagaaggagaacgacatcgactacgacagcgagagcagcagcagcggcctgggccacagcagcgacgacagcagcagccacggctgcaaggtgaacaccgccccccaggagagctag

SEQ ID NO: 22500 - DNA, 2841 bp, Artificial Sequence
  Description of Artificial Sequence: Synthetic coding sequence
atggtgccctgggtgagaaccatgggccagaagctgaagcagagactgagactggacgtgggcagagagatctgcagacagtaccccctgttctgcttcctgctgctgtgcctgagcgccgccagcctgctgctgaacagatacatccacatcctgatgatcttctggagcttcgtggccggcgtggtgaccttctactgcagcctgggccccgacagcctgctgcccaacatcttcttcaccatcaagtacaagcccaagcagctgggcctgcaggagctgttcccccagggccacagctgcgccgtgtgcggcaaggtgaagtgcaagagacacagacccagcctgctgctggagaactaccagccctggctggacctgaagatcagcagcaaggtggacgccagcctgagcgaggtgctggagctggtgctggagaacttcgtgtacccctggtacagagacgtgaccgacgacgagagcttcgtggacgagctgagaatcaccctgagattcttcgccagcgtgctgatcagaagaatccacaaggtggacatccccagcatcatcaccaagaagctgctgaaggccgccatgaagcacatcgaggtgatcgtgaaggccagacagaaggtgaagaacaccgagttcctgcagcaggccgccctggaggagtacggccccgagctgcacgtggccctgagaagcagaagagacgagctgcactacctgagaaagctgaccgagctgctgttcccctacatcctgccccccaaggccaccgactgcagaagcctgaccctgctgatcagagagatcctgagcggcagcgtgttcctgcccagcctggacttcctggccgaccccgacaccgtgaaccacctgctgatcatcttcatcgacgacagcccccccgagaaggccaccgagcccgccagccccctggtgcccttcctgcagaagttcgccgagcccagaaacaagaagcccagcgtgctgaagctggagctgaagcagatcagagagcagcaggacctgctgttcagattcatgaacttcctgaagcaggagggcgccgtgcacgtgctgcagttctgcctgaccgtggaggagttcaacgacagaatcctgagacccgagctgagcaacgacgagatgctgagcctgcacgaggagctgcagaagatctacaagacctactgcctggacgagagcatcgacaagatcagattcgaccccttcatcgtggaggagatccagagaatcgccgagggcccctacatcgacgtggtgaagctgcagaccatgagatgcctgttcgaggcctacgagcacgtgctgagcctgctggagaacgtgttcacccccatgttctgccacagcgacgagtacttcagacagctgctgagaggcgccgagagccccaccagaaacagcaagctgaacagaggcagcctgagcctggacgacttcagaaacacccagaagagaggcgagagcttcggcatcagcagaatcggcagcaagatcaagggcgtgttcaagagcaccaccatggagggcgccatgctgcccaactacggcgtggccgagggcgaggacgacttcatcgaggagggcatcgtggtgatggaggacgacagccccgtggaggccgtgagcacccccaacacccccagaaacctggccgcctggaagatcagcatcccctacgtggacttcttcgaggaccccagcagcgagagaaaggagaagaaggagagaatccccgtgttctgcatcgacgtggagagaaacgacagaagagccgtgggccacgagcccgagcactggagcgtgtacagaagatacctggagttctacgtgctggagagcaagctgaccgagttccacggcgccttccccgacgcccagctgcccagcaagagaatcatcggccccaagaactacgagttcctgaagagcaagagagaggagttccaggagtacctgcagaagctgctgcagcaccccgagctgagcaacagccagctgctggccgacttcctgagccccaacggcggcgagacccagttcctggacaagatcctgcccgacgtgaacctgggcaagatcatcaagagcgtgcccggcaagctgatgaaggagaagggccagcacctggagcccttcatcatgaacttcatcaacagctgcgagagccccaagcccaagcccagcagacccgagctgaccatcctgagccccaccagcgagaacaacaagaagctgttcaacgacctgttcaagaacaacgccaacagagccgagaacaccgagagaaagcagaaccagaactacttcatggaggtgatgaccgtggagggcgtgtacgactacctgatgtacgtgggcagagtggtgttccaggtgcccgactggctgcaccacctgctgatgggcaccagaatcctgttcaagaacaccctggagatgtacaccgactactacctgcagtgcaagctggagcagctgttccaggagcacagactggtgagcctgatcaccctgctgagagacgccatcttctgcgagaacaccgagcccagaagcctgcaggacaagcagaagggcgccaagcagaccttcgaggagatgatgaactacatccccgacctgctggtgaagtgcatcggcgaggagaccaagtacgagagcatcagactgctgttcgacggcctgcagcagcccgtgctgaacaagcagctgacctacgtgctgctggacatcgtgatccaggagctgttccccgagctgaacaaggtgcagaaggaggtgaccagcgtgaccagctggatgtag

SEQ ID NO: 22501 - DNA, 2682 bp, Artificial Sequence
  Description of Artificial Sequence: Synthetic coding sequence
atggtgccctgggtgagaaccatgggccagaagctgaagcagagactgagactggacgtgggcagagagatctgcagacagtaccccctgttctgcttcctgctgctgtgcctgagcgccgccagcctgctgctgaacagatacatccacatcctgatgatcttctggagcttcgtggccggcgtggtgaccttctactgcagcctgggccccgacagcctgctgcccaacatcttcttcaccatcaagtacaagcccaagcagctgggcctgcaggagctgttcccccagggccacagctgcgccgtgtgcggcaaggtgaagtgcaagagacacagacccagcctgctgctggagaactaccagccctggctggacctgaagatcagcagcaaggtggacgccagcctgagcgaggtggacatccccagcatcatcaccaagaagctgctgaaggccgccatgaagcacatcgaggtgatcgtgaaggccagacagaaggtgaagaacaccgagttcctgcagcaggccgccctggaggagtacggccccgagctgcacgtggccctgagaagcagaagagacgagctgcactacctgagaaagctgaccgagctgctgttcccctacatcctgccccccaaggccaccgactgcagaagcctgaccctgctgatcagagagatcctgagcggcagcgtgttcctgcccagcctggacttcctggccgaccccgacaccgtgaaccacctgctgatcatcttcatcgacgacagcccccccgagaaggccaccgagcccgccagccccctggtgcccttcctgcagaagttcgccgagcccagaaacaagaagcccagcgtgctgaagctggagctgaagcagatcagagagcagcaggacctgctgttcagattcatgaacttcctgaagcaggagggcgccgtgcacgtgctgcagttctgcctgaccgtggaggagttcaacgacagaatcctgagacccgagctgagcaacgacgagatgctgagcctgcacgaggagctgcagaagatctacaagacctactgcctggacgagagcatcgacaagatcagattcgaccccttcatcgtggaggagatccagagaatcgccgagggcccctacatcgacgtggtgaagctgcagaccatgagatgcctgttcgaggcctacgagcacgtgctgagcctgctggagaacgtgttcacccccatgttctgccacagcgacgagtacttcagacagctgctgagaggcgccgagagccccaccagaaacagcaagctgaacagaaacacccagaagagaggcgagagcttcggcatcagcagaatcggcagcaagatcaagggcgtgttcaagagcaccaccatggagggcgccatgctgcccaactacggcgtggccgagggcgaggacgacttcatcgaggagggcatcgtggtgatggaggacgacagccccgtggaggccgtgagcacccccaacacccccagaaacctggccgcctggaagatcagcatcccctacgtggacttcttcgaggaccccagcagcgagagaaaggagaagaaggagagaatccccgtgttctgcatcgacgtggagagaaacgacagaagagccgtgggccacgagcccgagcactggagcgtgtacagaagatacctggagttctacgtgctggagagcaagctgaccgagttccacggcgccttccccgacgcccagctgcccagcaagagaatcatcggccccaagaactacgagttcctgaagagcaagagagaggagttccaggagtacctgcagaagctgctgcagcaccccgagctgagcaacagccagctgctggccgacttcctgagccccaacggcggcgagacccagttcctggacaagatcctgcccgacgtgaacctgggcaagatcatcaagagcgtgcccggcaagctgatgaaggagaagggccagcacctggagcccttcatcatgaacttcatcaacagctgcgagagccccaagcccaagcccagcagacccgagctgaccatcctgagccccaccagcgagaacaacaagaagctgttcaacgacctgttcaagaacaacgccaacagagccgagaacaccgagagaaagcagaaccagaactacttcatggaggtgatgaccgtggagggcgtgtacgactacctgatgtacgtgggcagagtggtgttccaggtgcccgactggctgcaccacctgctgatgggcaccagaatcctgttcaagaacaccctggagatgtacaccgactactacctgcagtgcaagctggagcagctgttccaggagcacagactggtgagcctgatcaccctgctgagagacgccatcttctgcgagaacaccgagcccagaagcctgcaggacaagcagaagggcgccaagcagaccttcgaggagatgatgaactacatccccgacctgctggtgaagtgcatcggcgaggagaccaagtacgagagcatcagactgctgttcgacggcctgcagcagcccgtgctgaacaagcagctgacctacgtgctgctggacatcgtgatccaggagctgttccccgagctgaacaaggtgcagaaggaggtgaccagcgtgaccagctggatgtag

SEQ ID NO: 22502 - DNA, 2814 bp, Artificial Sequence
  Description of Artificial Sequence: Synthetic coding sequence
atggtgccctgggtgagaaccatgggccagaagctgaagcagagactgagactggacgtgggcagagagatctgcagacagtaccccctgttctgcttcctgctgctgtgcctgagcgccgccagcctgctgctgaacagatacatccacatcctgatgatcttctggagcttcgtggccggcgtggtgaccttctactgcagcctgggccccgacagcctgctgcccaacatcttcttcaccatcaagtacaagcccaagcagctgggcctgcaggagctgttcccccagggccacagctgcgccgtgtgcggcaaggtgaagtgcaagagacacagacccagcctgctgctggagaactaccagccctggctggacctgaagatcagcagcaaggtggacgccagcctgagcgaggtgctggagctggtgctggagaacttcgtgtacccctggtacagagacgtgaccgacgacgagagcttcgtggacgagctgagaatcaccctgagattcttcgccagcgtgctgatcagaagaatccacaaggtggacatccccagcatcatcaccaagaagctgctgaaggccgccatgaagcacatcgaggtgatcgtgaaggccagacagaaggtgaagaacaccgagttcctgcagcaggccgccctggaggagtacggccccgagctgcacgtggccctgagaagcagaagagacgagctgcactacctgagaaagctgaccgagctgctgttcccctacatcctgccccccaaggccaccgactgcagaagcctgaccctgctgatcagagagatcctgagcggcagcgtgttcctgcccagcctggacttcctggccgaccccgacaccgtgaaccacctgctgatcatcttcatcgacgacagcccccccgagaaggccaccgagcccgccagccccctggtgcccttcctgcagaagttcgccgagcccagaaacaagaagcccagcgtgctgaagctggagctgaagcagatcagagagcagcaggacctgctgttcagattcatgaacttcctgaagcaggagggcgccgtgcacgtgctgcagttctgcctgaccgtggaggagttcaacgacagaatcctgagacccgagctgagcaacgacgagatgctgagcctgcacgaggagctgcagaagatctacaagacctactgcctggacgagagcatcgacaagatcagattcgaccccttcatcgtggaggagatccagagaatcgccgagggcccctacatcgacgtggtgaagctgcagaccatgagatgcctgttcgaggcctacgagcacgtgctgagcctgctggagaacgtgttcacccccatgttctgccacagcgacgagtacttcagacagctgctgagaggcgccgagagccccaccagaaacagcaagctgaacagaaacacccagaagagaggcgagagcttcggcatcagcagaatcggcagcaagatcaagggcgtgttcaagagcaccaccatggagggcgccatgctgcccaactacggcgtggccgagggcgaggacgacttcatcgaggagggcatcgtggtgatggaggacgacagccccgtggaggccgtgagcacccccaacacccccagaaacctggccgcctggaagatcagcatcccctacgtggacttcttcgaggaccccagcagcgagagaaaggagaagaaggagagaatccccgtgttctgcatcgacgtggagagaaacgacagaagagccgtgggccacgagcccgagcactggagcgtgtacagaagatacctggagttctacgtgctggagagcaagctgaccgagttccacggcgccttccccgacgcccagctgcccagcaagagaatcatcggccccaagaactacgagttcctgaagagcaagagagaggagttccaggagtacctgcagaagctgctgcagcaccccgagctgagcaacagccagctgctggccgacttcctgagccccaacggcggcgagacccagttcctggacaagatcctgcccgacgtgaacctgggcaagatcatcaagagcgtgcccggcaagctgatgaaggagaagggccagcacctggagcccttcatcatgaacttcatcaacagctgcgagagccccaagcccaagcccagcagacccgagctgaccatcctgagccccaccagcgagaacaacaagaagctgttcaacgacctgttcaagaacaacgccaacagagccgagaacaccgagagaaagcagaaccagaactacttcatggaggtgatgaccgtggagggcgtgtacgactacctgatgtacgtgggcagagtggtgttccaggtgcccgactggctgcaccacctgctgatgggcaccagaatcctgttcaagaacaccctggagatgtacaccgactactacctgcagtgcaagctggagcagctgttccaggagcacagactggtgagcctgatcaccctgctgagagacgccatcttctgcgagaacaccgagcccagaagcctgcaggacaagcagaagggcgccaagcagaccttcgaggagatgatgaactacatccccgacctgctggtgaagtgcatcggcgaggagaccaagtacgagagcatcagactgctgttcgacggcctgcagcagcccgtgctgaacaagcagctgacctacgtgctgctggacatcgtgatccaggagctgttccccgagctgaacaaggtgcagaaggaggtgaccagcgtgaccagctggatgtag

SEQ ID NO: 22503 - DNA, 1047 bp, Artificial Sequence
  Description of Artificial Sequence: Synthetic coding sequence
atggaggacgacagccccgtggaggccgtgagcacccccaacacccccagaaacctggccgcctggaagatcagcatcccctacgtggacttcttcgaggaccccagcagcgagagaaaggagaagaaggagagaatccccgtgttctgcatcgacgtggagagaaacgacagaagagccgtgggccacgagcccgagcactggagcgtgtacagaagatacctggagttctacgtgctggagagcaagctgaccgagttccacggcgccttccccgacgcccagctgcccagcaagagaatcatcggccccaagaactacgagttcctgaagagcaagagagaggagttccaggagtacctgcagaagctgctgcagcaccccgagctgagcaacagccagctgctggccgacttcctgagccccaacggcggcgagacccagttcctggacaagatcctgcccgacgtgaacctgggcaagatcatcaagagcgtgcccggcaagctgatgaaggagaagggccagcacctggagcccttcatcatgaacttcatcaacagctgcgagagccccaagcccaagcccagcagacccgagctgaccatcctgagccccaccagcgagaacaacaagaagctgttcaacgacctgttcaagaacaacgccaacagagccgagaacaccgagagaaagcagaaccagaactacttcatggaggtgatgaccgtggagggcgtgtacgactacctgatgtacgtggacgccatcttctgcgagaacaccgagcccagaagcctgcaggacaagcagaagggcgccaagcagaccttcgaggagatgatgaactacatccccgacctgctggtgaagtgcatcggcgaggagaccaagtacgagagcatcagactgctgttcgacggcctgcagcagcccgtgctgaacaagcagctgacctacgtgctgctggacatcgtgatccaggagctgttccccgagctgaacaaggtgcagaaggaggtgaccagcgtgaccagctggatgtag

SEQ ID NO: 22504 - DNA, 2685 bp, Artificial Sequence
  Description of Artificial Sequence: Synthetic coding sequence
atgatcttctggagcttcgtggccggcgtggtgaccttctactgcagcctgggccccgacagcctgctgcccaacatcttcttcaccatcaagtacaagcccaagcagctgggcctgcaggagctgttcccccagggccacagctgcgccgtgtgcggcaaggtgaagtgcaagagacacagacccagcctgctgctggagaactaccagccctggctggacctgaagatcagcagcaaggtggacgccagcctgagcgaggtgctggagctggtgctggagaacttcgtgtacccctggtacagagacgtgaccgacgacgagagcttcgtggacgagctgagaatcaccctgagattcttcgccagcgtgctgatcagaagaatccacaaggtggacatccccagcatcatcaccaagaagctgctgaaggccgccatgaagcacatcgaggtgatcgtgaaggccagacagaaggtgaagaacaccgagttcctgcagcaggccgccctggaggagtacggccccgagctgcacgtggccctgagaagcagaagagacgagctgcactacctgagaaagctgaccgagctgctgttcccctacatcctgccccccaaggccaccgactgcagaagcctgaccctgctgatcagagagatcctgagcggcagcgtgttcctgcccagcctggacttcctggccgaccccgacaccgtgaaccacctgctgatcatcttcatcgacgacagcccccccgagaaggccaccgagcccgccagccccctggtgcccttcctgcagaagttcgccgagcccagaaacaagaagcccagcgtgctgaagctggagctgaagcagatcagagagcagcaggacctgctgttcagattcatgaacttcctgaagcaggagggcgccgtgcacgtgctgcagttctgcctgaccgtggaggagttcaacgacagaatcctgagacccgagctgagcaacgacgagatgctgagcctgcacgaggagctgcagaagatctacaagacctactgcctggacgagagcatcgacaagatcagattcgaccccttcatcgtggaggagatccagagaatcgccgagggcccctacatcgacgtggtgaagctgcagaccatgagatgcctgttcgaggcctacgagcacgtgctgagcctgctggagaacgtgttcacccccatgttctgccacagcgacgagtacttcagacagctgctgagaggcgccgagagccccaccagaaacagcaagctgaacagaggcagcctgagcctggacgacttcagaaacacccagaagagaggcgagagcttcggcatcagcagaatcggcagcaagatcaagggcgtgttcaagagcaccaccatggagggcgccatgctgcccaactacggcgtggccgagggcgaggacgacttcatcgaggagggcatcgtggtgatggaggacgacagccccgtggaggccgtgagcacccccaacacccccagaaacctggccgcctggaagatcagcatcccctacgtggacttcttcgaggaccccagcagcgagagaaaggagaagaaggagagaatccccgtgttctgcatcgacgtggagagaaacgacagaagagccgtgggccacgagcccgagcactggagcgtgtacagaagatacctggagttctacgtgctggagagcaagctgaccgagttccacggcgccttccccgacgcccagctgcccagcaagagaatcatcggccccaagaactacgagttcctgaagagcaagagagaggagttccaggagtacctgcagaagctgctgcagcaccccgagctgagcaacagccagctgctggccgacttcctgagccccaacggcggcgagacccagttcctggacaagatcctgcccgacgtgaacctgggcaagatcatcaagagcgtgcccggcaagctgatgaaggagaagggccagcacctggagcccttcatcatgaacttcatcaacagctgcgagagccccaagcccaagcccagcagacccgagctgaccatcctgagccccaccagcgagaacaacaagaagctgttcaacgacctgttcaagaacaacgccaacagagccgagaacaccgagagaaagcagaaccagaactacttcatggaggtgatgaccgtggagggcgtgtacgactacctgatgtacgtgggcagagtggtgttccaggtgcccgactggctgcaccacctgctgatgggcaccagaatcctgttcaagaacaccctggagatgtacaccgactactacctgcagtgcaagctggagcagctgttccaggagcacagactggtgagcctgatcaccctgctgagagacgccatcttctgcgagaacaccgagcccagaagcctgcaggacaagcagaagggcgccaagcagaccttcgaggagatgatgaactacatccccgacctgctggtgaagtgcatcggcgaggagaccaagtacgagagcatcagactgctgttcgacggcctgcagcagcccgtgctgaacaagcagctgacctacgtgctgctggacatcgtgatccaggagctgttccccgagctgaacaaggtgcagaaggaggtgaccagcgtgaccagctggatgtag

SEQ ID NO: 22505 - DNA, 1035 bp, Artificial Sequence
  Description of Artificial Sequence: Synthetic coding sequence
atggccaccccctacgtgcccgtgcccatgcccatcggcaacagcgccagcagcttcaccaccaacagaaaccagagaagcagcagcttcggcagcgtgagcaccagcagcaacagcagcaagggccagctggaggacagcaacatgggcaacttcaagcagaccagcgtgcccgaccagatggacaacaccagcagcgtgtgcagcagccccctgatcagaaccaagttcaccggcaccgccagcagcatcgagtacagcaccagacccagagacaccgaggagcagaaccccgagaccgtgaactgggaggacagacccagcacccccaccatcctgggctacgaggtgatggaggagagagccaagttcaccgtgtacaagatcctggtgaagaagacccccgaggagagctgggtggtgttcagaagatacaccgacttcagcagactgaacgacaagctgaaggagatgttccccggcttcagactggccctgccccccaagagatggttcaaggacaactacaacgccgacttcctggaggacagacagctgggcctgcaggccttcctgcagaacctggtggcccacaaggacatcgccaactgcctggccgtgagagagttcctgtgcctggacgacccccccggccccttcgacagcctggaggagagcagagccttctgcgagaccctggaggagaccaactacagactgcagaaggagctgctggagaagcagaaggagatggagagcctgaagaagctgctgagcgagaagcagctgcacatcgacaccctggagaacagaatcagaaccctgagcctggagcccgaggagagcctggacgtgagcgagaccgagggcgagcagatcctgaaggtggagagcagcgccctggaggtggaccaggacgtgctggacgaggagagcagagccgacaacaagccctgcctgagcttcagcgagcccgagaacgccgtgagcgagatcgaggtggccgaggtggcctacgacgccgaggaggactag

SEQ ID NO: 22506 - DNA, 948 bp, Artificial Sequence
  Description of Artificial Sequence: Synthetic coding sequence
atggccaccccctacgtgcccgtgcccatgcccatcggcaacagcgccagcagcttcaccaccaacagaaaccagagaagcagcagcttcggcagcgtgagcaccagcagcaacagcagcaagggccagctggaggacagcaacatgggcaacttcaagcagaccagcgtgcccgaccagatggacaacaccagcagcgtgtgcagcagccccctgatcagaaccaagttcaccggcaccgccagcagcatcgagtacagcaccagacccagagacaccgaggagcagaaccccgagaccgtgaactgggaggacagacccagcacccccaccatcctgggctacgaggtgatggaggagagagccaagttcaccctgaaggagatgttccccggcttcagactggccctgccccccaagagatggttcaaggacaactacaacgccgacttcctggaggacagacagctgggcctgcaggccttcctgcagaacctggtggcccacaaggacatcgccaactgcctggccgtgagagagttcctgtgcctggacgacccccccggccccttcgacagcctggaggagagcagagccttctgcgagaccctggaggagaccaactacagactgcagaaggagctgctggagaagcagaaggagatggagagcctgaagaagctgctgagcgagaagcagctgcacatcgacaccctggagaacagaatcagaaccctgagcctggagcccgaggagagcctggacgtgagcgagaccgagggcgagcagatcctgaaggtggagagcagcgccctggaggtggaccaggacgtgctggacgaggagagcagagccgacaacaagccctgcctgagcttcagcgagcccgagaacgccgtgagcgagatcgaggtggccgaggtggcctacgacgccgaggaggactag

SEQ ID NO: 22507 - DNA, 1035 bp, Artificial Sequence; identical to SEQ ID NO: 22505
  Description of Artificial Sequence: Synthetic coding sequence

SEQ ID NO: 22508 - DNA, 255 bp, Artificial Sequence
  Description of Artificial Sequence: Synthetic coding sequence
atggccaccccctacgtgcccgtgcccatgcccatcggcaacagcgccagcagcttcaccaccaacagaaaccagagaagcagcagcttcggcagcgtgagcaccagcagcaacagcagcaagggccagctggaggacagcaacatgggcaacttcaagcagaccagcgtgcccgaccagatggacaacaccagcagcgtgtgcagcagccccctgatcagaaccaagttcaccggcaccgccagcagcatctag

SEQ ID NO: 22509 - DNA, 279 bp, Artificial Sequence
  Description of Artificial Sequence: Synthetic coding sequence
atggccaccccctacgtgcccgtgcccatgcccatcggcaacagcgccagcagcttcaccaccaacagaaaccagagaagcagcagcttcggcagcgtgagcaccagcagcaacagcagcaagggccagctggaggacagcaacatgggcaacttcaagcagaccagcgtgcccgaccagatggacaacaccagcagcgtgtgcagcagccccctgatcagaaccaagttcaccggcaccgccagcagcatcgagtacagcaccagacccagagactag

SEQ ID NO: 22510 - DNA, 111 bp, Artificial Sequence
  Description of Artificial Sequence: Synthetic coding sequence
atggccaccccctacgtgcccgtgcccatgcccatcggcaacagcgccagcagcttcaccaccaacagaaaccagagaagcagcagcttcggcagcgtgagcaccagctag

SEQ ID NO: 22511 - DNA, 612 bp, Artificial Sequence
  Description of Artificial Sequence: Synthetic coding sequence
atggccaccccctacgtgcccgtgcccatgcccatcggcaacagcgccagcagcttcaccaccaacagaaaccagagaagcagcagcttcggcagcgtgagcaccagcagcaacagcagcaagggccagctggaggacagcaacatgggcaacttcaagcagaccagcgtgcccgaccagatggacaacaccagcagcgtgtgcagcagccccctgatcagaaccaagttcaccggcaccgccagcagcatcgagtacagcaccagacccagagacaccgaggagcagaaccccgagaccgtgaactgggaggacagacccagcacccccaccatcctgggctacgaggtgatggaggagagagccaagttcaccgtgtacaagatcctggtgaagaagacccccgaggagagctgggtggtgttcagaagatacaccgacttcagcagactgaacgacaagctgaaggagatgttccccggcttcagactggccctgccccccaagagatggttcaaggacaactacaacgccgacttcctggaggacagacagctgggcctgcaggccttcctgcagaacctggtggcccacaaggacatcgccaactag

SEQ ID NO: 22512 - DNA, 1887 bp, Artificial Sequence
  Description of Artificial Sequence: Synthetic coding sequence
atggccctgagagccagagccctgtacgacttcagaagcgagaaccccggcgagatcagcctgagagagcacgaggtgctgagcctgtgcagcgagcaggacatcgagggctggctggagggcgtgaacagcagaggcgacagaggcctgttccccgccagctacgtgcaggtgatcagagcccccgagcccggccccgccggcgacggcggccccggcgcccccgccagatacgccaacgtgccccccggcggcttcgagcccctgcccgtggccccccccgccagcttcaagcccccccccgacgccttccaggccctgctgcagccccagcaggcccccccccccagcaccttccagccccccggcgccggcttcccctacggcggcggcgccctgcagcccagcccccagcagctgtacggcggctaccaggccagccagggcagcgacgacgactgggacgacgagtgggacgacagcagcaccgtggccgacgagcccggcgccctgggcagcggcgcctaccccgacctggacggcagcagcagcgccggcgtgggcgccgccggcagatacagactgagcaccagaagcgacctgagcctgggcagcagaggcggcagcgtgcccccccagcaccaccccagcggccccaagagcagcgccaccgtgagcagaaacctgaacagattcagcaccttcgtgaagagcggcggcgaggccttcgtgctgggcgaggccagcggcttcgtgaaggacggcgacaagctgtgcgtggtgctgggcccctacggccccgagtggcaggagaacccctaccccttccagtgcaccatcgacgaccccaccaagcagaccaagttcaagggcatgaagagctacatcagctacaagctggtgcccacccacacccaggtgcccgtgcacagaagatacaagcacttcgactggctgtacgccagactggccgagaagttccccgtgatcagcgtgccccacctgcccgagaagcaggccaccggcagattcgaggaggacttcatcagcaagagaagaaagggcctgatctggtggatgaaccacatggccagccaccccgtgctggcccagtgcgacgtgttccagcacttcctgacctgccccagcagcaccgacgagaaggcctggaagcagggcaagagaaaggccgagaaggacgagatggtgggcgccaacttcttcctgaccctgagcaccccccccgccgccgccctggacctgcaggaggtggagagcaagatcgacggcttcaagtgcttcaccaagaagatggacgacagcgccctgcagctgaaccacaccgccaacgagttcgccagaaagcaggtgaccggcttcaagaaggagtaccagaaggtgggccagagcttcagaggcctgagccaggccttcgagctggaccagcaggccttcagcgtgggcctgaaccaggccatcgccttcaccggcgacgcctacgacgccatcggcgagctgttcgccgagcagcccagacaggacctggaccccgtgatggacctgctggccctgtaccagggccacctggccaacttccccgacatcatccacgtgcagaagggcaaggcctggcccctggagcaggtgatctggagcgtgctgtgcagactgaagggcgccaccctgaccgccgtgcccctgtgggtgagcgagagctacagcaccggcgaggaggccagcagagacgtggacgcctgggtgttcagcctggagtgcaagctggactgcagcaccggcagcttcctgctggagtacctggccctgggcaacgagtacagcttcagcaaggtgcagagagtgcccctgatgaccgtgctgagcttctag

SEQ ID NO: 22513 - DNA, 1776 bp, Artificial Sequence
  Description of Artificial Sequence: Synthetic coding sequence
atggccctgagagccagagccctgtacgacttcagaagcgagaaccccggcgagatcagcctgagagagcacgaggtgctgagcctgtgcagcgagcaggacatcgagggctggctggagggcgtgaacagcagaggcgacagaggcctgttccccgccagctacgtgcaggtgatcagagcccccgagcccggccccgccggcgacggcggccccggcgcccccgccagatacgccaacgtgccccccggcggcttcgagcccctgcccgtggccccccccgccagcttcaagcccccccccgacgccttccaggccctgctgcagccccagcaggcccccccccccagcaccttccagccccccggcgccggcttcccctacggcggcggcgccctgcagcccagcccccagcagctgtacggcggctaccaggccagccagggcagcgacgacgactgggacgacgagtgggacgacagcagcaccgtggccgacgagcccggcgccctgggcagcggcgcctaccccgacctggacggcagcagcagcgccggcgtgggcgccgccggcagatacagactgagcaccagaagcgacctgagcctgggcagcagaggcggcagcgtgcccccccagcaccaccccagcggccccaagagcagcgccaccgtgagcagaaacctgaacagattcagcaccttcgtgaagagcggcggcgaggccttcgtgctgggcgaggccagcggcttcgtgaaggacggcgacaagctgtgcgtggtgctgggcccctacggccccgagtggcaggagaacccctaccccttccagtgcaccatcgacgaccccaccaagcagaccaagttcaagggcatgaagagctacatcagctacaagctggtgcccacccacacccaggtgcccgtgcacagaagatacaagcacttcgactggctgtacgccagactggccgagaagttccccgtgatcagcgtgccccacctgcccgagaagcaggccaccggcagattcgaggaggacttcatcagcaagagaagaaagggcctgatctggtggatgaaccacatggccagccaccccgtgctggcccagtgcgacgtgttccagcacttcctgacctgccccagcagcaccgacgagaaggcctggaagcagggcaagagaaaggccgagaaggacgagatggtgggcgccaacttcttcctgaccctgagcaccccccccgccgccgccctggacctgcaggaggtggagagcaagatcgacggcttcaagtgcttcaccaagaagatggacgacagcgccctgcagctgaaccacaccgccaacgagttcgccagaaagcaggtgaccggcttcaagaaggagtaccagaaggtgggccagagcttcagaggcctgagccaggccttcgagctggaccagcaggccttcagcgtgggcctgaaccaggccatcgccttcaccggcgacgcctacgacgccatcggcgagctgttcgccgagcagcccagacaggacctggaccccgtgatggacctgctggccctgtaccagggccacctggccaacttccccgacatcatccacgtgcagaagggcaaggcctggcccctggagcaggtgatctggagcgtgctgtgcagactgaagggcgccaccctgaccgccgtgcccctgtgggtgagcgagagctacagcaccggcgaggaggccagcagagacgtggacgcctgggtgttcagcctggagtag

SEQ ID NO: 22514 - DNA, 1875 bp, Artificial Sequence
  Description of Artificial Sequence: Synthetic coding sequence
atggccctgagagccagagccctgtacgacttcagaagcgagaaccccggcgagatcagcctgagagagcacgaggtgctgagcctgtgcagcgagcaggacatcgagggctggctggagggcgtgaacagcagaggcgacagaggcctgttccccgccagctacgtgcaggtgatcagagcccccgagcccggccccgccggcgacggcggccccggcgcccccgccagatacgccaacgtgccccccggcggcttcgagcccctgcccgtggccccccccgccagcttcaagcccccccccgacgccttccaggccctgctgcagccccagcaggcccccccccccagcaccttccagccccccggcgccggcttcccctacggcggcggcgccctgcagcccagcccccagcagctgtacggcggctaccaggccagccagggcagcgacgacgactgggacgacgagtgggacgacagcagcaccgtggccgacgagcccggcgccctgggcagcggcgcctaccccgacctggacggcagcagcagcgccggcgtgggcgccgccggcagatacagactgagcaccagaagcgacctgagcctgggcagcagaggcggcagcgtgcccccccagcaccaccccagcggccccaagagcagcgccaccgtgagcagaaacctgaacagattcagcaccttcgtgaagagcggcggcgaggccttcgtgctgggcgaggccagcggcttcgtgaaggacggcgacaagctgtgcgtggtgctgggcccctacggccccgagtggcaggagaacccctaccccttccagtgcaccatcgacgaccccaccaagcagaccaagttcaagggcatgaagagctacatcagctacaagctggtgcccacccacacccaggtgcccgtgcacagaagatacaagcacttcgactggctgtacgccagactggccgagaagttccccgtgatcagcgtgccccacctgcccgagaagcaggccaccggcagattcgaggaggacttcatcagcaagagaagaaagggcctgatctggtggatgaaccacatggccagccaccccgtgctggcccagtgcgacgtgttccagcacttcctgacctgccccagcagcaccgacgagaaggcctggaagcagggcaagagaaaggccgagaaggacgagatggtgggcgccaacttcttcctgaccctgagcaccccccccgccgccgccctggacctgcaggaggtggagagcaagatcgacggcttcaagtgcttcaccaagaagatggacgacagcgccctgcagctgaaccacaccgccaacgagttcgccagaaagcaggtgaccggcttcaagaaggagtaccagaaggtgggccagagcttcagaggcctgagccaggccttcgagctggaccagcaggccttcagcgtgggcctgaaccaggccatcgccttcaccggcgacgcctacgacgccatcggcgagctgttcgccgagcagcccagacaggacctggaccccgtgatggacctgctggccctgtaccagggccacctggccaacttccccgacatcatccacgtgcagaagggcgccctgaccaaggtgaaggagagcagaagacacgtggaggagggcaagatggaggtgcagaaggccgacggcatccaggacagatgcaacaccatcagcttcgccaccctggccgagatccaccacttccaccagatcagagtgagagacttcaagagccagatgcagcacttcctgcagcagcagatcatcttcttccagaaggtgacccagaagctggaggaggccctgcacaagtacgacagcgtgtag

SEQ ID NO: 22515 - DNA, 2979 bp, Artificial Sequence
  Description of Artificial Sequence: Synthetic coding sequence
atgaagaccgagaccgtgccccccttccaggagacccccgccggcagcagctgccacctgaacaacctgctgagcagcagaaagctgatggccgtgggcgtgctgctgggctggctgctggtgatccacctgctggtgaacgtgtggctgctgtgcctgctgagcgccctgctggtggtgctgggcggctggctgggcagcagcctggccggcgtggccagcggcagactgcacctggagagattcatccccctggccacctgccccccctgccccgaggccgagagacagctggagagagagatcaacagaaccatccagatgatcatcagagacttcgtgctgagctggtacagaagcgtgagccaggagcccgccttcgaggaggagatggaggccgccatgaagggcctggtgcaggagctgagaagaagaatgagcgtgatggacagccacgccgtggcccagagcgtgctgaccctgtgcggctgccacctgcagagctacatccaggccaaggaggccaccgccggcaagaacggccccgtggagcccagccacctgtgggaggcctactgcagagccaccgccccccaccccgccgtgcacagccccagcgccgaggtgacctacaccagaggcgtggtgaacctgctgctgcagggcctggtgcccaagccccacctggagaccagaaccggcagacacgtggtggtggagctgatcacctgcaacgtgatcctgcccctgatcagcagactgagcgaccccgactggatccacctggtgctggtgggcatcttcagcaaggccagagaccccgccccctgccccgccagcgcccccgagcagcccagcgtgcccaccagcctgcccctgatcgccgaggtggagcagctgcccgagggcagagccagccccgtggccgcccccgtgttcctgagctacagcgagcccgagggcagcgccggccccagccccgaggtggaggagggccacgaggccgtggagggcgacctgggcggcatgtgcgaggagagaaaggtgggcaacaacagcagccacttcctgcagcccaacgtgagaggccccctgttcctgtgcgaggacagcgagctggagagccccctgagcgagctgggcaaggagaccatcatgctgatgacccccggcagcttcctgagcgacagaatccaggacgccctgtgcgccctggagagcagccaggccctggagcccaaggacggcgaggccagcgagggcgccgaggccgaggagggccccggcaccgagaccgagaccggcctgcccgtgagcaccctgaacagctgccccgagatccacatcgacaccgccgacaaggagatcgagcagggcgacgtgaccgccagcgtgaccgccctgctggagggccccgagaagacctgccccagcagacccagctgcctggagaaggacctgaccaacgacgtgagcagcctggaccccaccctgccccccgtgctgctgagcagcagcccccccggccccctgagcagcgccaccttcagcttcgagcccctgagcagccccgacggccccgtgatcatccagaacctgagaatcaccggcaccatcaccgccagagagcacagcggcaccggcttccacccctacaccctgtacaccgtgaagtacgagaccgccctggacggcgagaacagcagcggcctgcagcagctggcctaccacaccgtgaacagaagatacagagagttcctgaacctgcagaccagactggaggagaagcccgacctgagaaagttcatcaagaacgtgaagggccccaagaagctgttccccgacctgcccctgggcaacatggacagcgacagagtggaggccagaaagagcctgctggagagcttcctgaagcagctgtgcgccatccccgagatcgccaacagcgaggaggtgcaggagttcctggccctgaacaccgacgccagaatcgccttcgtgaagaagcccttcatggtgagcagaatcgacaagatggtggtgagcgccatcgtggacaccctgaagaccgccttccccagaagcgagccccagagccccaccgaggagctgagcgaggccgagaccgagagcaagccccagaccgagggcaagaaggccagcaagagcagactgagattcagcagcagcaagatcagccccgccctgagcgtgaccgaggcccaggacaagatcctgtactgcctgcaggagggcaacgtggagagcgagaccctgagcatgagcgccatggagagcttcatcgagaagcagaccaagctgctggagatgcagcccaccaaggcccccgagaaggaccccgagcagccccccaagggcagagtggacagctgcgtgagcgacgccgccgtgcccgcccaggaccccagcaacagcgaccccggcaccgagaccgagctggccgacaccgccctggacctgctgctgctgctgctgaccgagcagtggaagtggctgtgcaccgagaacatgcagaagttcctgagactgatcttcggcaccctggtgcagagatggctggaggtgcaggtggccaacctgaccagcccccagagatgggtgcagtacctgctgctgctgcaggagagcatctggcccggcggcgtgctgcccaagttccccagacccgtgagaacccaggagcagaagctggccgccgagaagcaggccctgcagagcctgatgggcgtgctgcccgacctggtggtggagatcctgggcgtgaacaagtgcagactgagctggggcctggtgctggagagcctgcagcagcccctgatcaacagacacctgatctactgcctgggcgacatcatcctggagttcctggacctgagcgccagcgtggaggagagcgccgccaccaccagcgccagcgacacccccggcaacagcaagagaatgggcgtgagcagctag

SEQ ID NO: 22516 - DNA, 1308 bp, Artificial Sequence
  Description of Artificial Sequence: Synthetic coding sequence
atgtacgagaccgccctggacggcgagaacagcagcggcctgcagcagctggcctaccacaccgtgaacagaagatacagagagttcctgaacctgcagaccagactggaggagaagcccgacctgagaaagttcatcaagaacgtgaagggccccaagaagctgttccccgacctgcccctgggcaacatggacagcgacagagtggaggccagaaagagcctgctggagagcttcctgaagcagctgtgcgccatccccgagatcgccaacagcgaggaggtgcaggagttcctggccctgaacaccgacgccagaatcgccttcgtgaagaagcccttcatggtgagcagaatcgacaagatggtggtgagcgccatcgtggacaccctgaagaccgccttccccagaagcgagccccagagccccaccgaggagctgagcgaggccgagaccgagagcaagccccagaccgagggcaagaaggccagcaagagcagactgagattcagcagcagcaagatcagccccgccctgagcgtgaccgaggcccaggacaagatcctgtactgcctgcaggagggcaacgtggagagcgagaccctgagcatgagcgccatggagagcttcatcgagaagcagaccaagctgctggagatgcagcccaccaaggcccccgagaaggaccccgagcagccccccaagggcagagtggacagctgcgtgagcgacgccgccgtgcccgcccaggaccccagcaacagcgaccccggcaccgagaccgagctggccgacaccgccctggacctgctgctgctgctgctgaccgagcagtggaagtggctgtgcaccgagaacatgcagaagttcctgagactgatcttcggcaccctggtgcagagatggctggaggtgcaggtggccaacctgaccagcccccagagatgggtgcagtacctgctgctgctgcaggagagcatctggcccggcggcgtgctgcccaagttccccagacccgtgagaacccaggagcagaagctggccgccgagaagcaggccctgcagagcctgatgggcgtgctgcccgacctggtggtggagatcctgggcgtgaacaagtgcagactgagctggggcctggtgctggagagcctgcagcagcccctgatcaacagacacctgatctactgcctgggcgacatcatcctggagttcctggacctgagcgccagcgtggaggagagcgccgccaccaccagcgccagcgacacccccggcaacagcaagagaatgggcgtgagcagctag

SEQ ID NO: 22517 - DNA, 699 bp, Artificial Sequence
  Description of Artificial Sequence: Synthetic coding sequence
atgagcgccatggagagcttcatcgagaagcagaccaagctgctggagatgcagcccaccaaggcccccgagaaggaccccgagcagccccccaagggcagagtggacagctgcgtgagcgacgccgccgtgcccgcccaggaccccagcaacagcgaccccggcaccgagaccgagctggccgacaccgccctggacctgctgctgctgctgctgaccgagcagtggaagtggctgtgcaccgagaacatgcagaagttcctgagactgatcttcggcaccctggtgcagagatggctggaggtgcaggtggccaacctgaccagcccccagagatgggtgcagtacctgctgctgctgcaggagagcatctggcccggcggcgtgctgcccaagttccccagacccgtgagaacccaggagcagaagctggccgccgagaagcaggccctgcagagcctgatgggcgtgctgcccgacctggtggtggagatcctgggcgtgaacaagtgcagactgagctggggcctggtgctggagagcctgcagcagcccctgatcaacagacacctgatctactgcctgggcgacatcatcctggagttcctggacctgagcgccagcgtggaggagagcgccgccaccaccagcgccagcgacacccccggcaacagcaagagaatgggcgtgagcagctag

SEQ ID NO: 22518 - DNA, 582 bp, Artificial Sequence
  Description of Artificial Sequence: Synthetic coding sequence
atgctggaggtgcacatccccagcgtgggccccgaggccgagggccccagacagagccccgagaagagccacatggtgttcagagtggaggtgctgtgcagcggcagaagacacaccgtgcccagaagatacagcgagttccacgccctgcacaagagaatcaagaagctgtacaaggtgcccgacttccccagcaagagactgcccaactggagaaccagaggcctggagcagagaagacagggcctggaggcctacatccagggcatcctgtacctgaaccaggaggtgcccaaggagctgctggagttcctgagactgagacacttccccaccgaccccaaggccagcaactggggcaccctgagagagttcctgcccggcgacagcagcagccagcagcaccagagacccgtgctgagcttccacgtggacccctacgtgtgcaaccccagccccgagagcctgcccaacgtggtggtgaacggcgtgctgcagggcctgtacagcttcagcatcagccccgacaaggcccagcccaaggccgcctgccaccccgcccccctgccccccatgccctag

SEQ ID NO: 22519 - DNA, 525 bp, Artificial Sequence
  Description of Artificial Sequence: Synthetic coding sequence
atgctggaggtgcacatccccagcgtgggccccgaggccgagggccccagacagagccccgagaagagccacatgatcaagaagctgtacaaggtgcccgacttccccagcaagagactgcccaactggagaaccagaggcctggagcagagaagacagggcctggaggcctacatccagggcatcctgtacctgaaccaggaggtgcccaaggagctgctggagttcctgagactgagacacttccccaccgaccccaaggccagcaactggggcaccctgagagagttcctgcccggcgacagcagcagccagcagcaccagagacccgtgctgagcttccacgtggacccctacgtgtgcaaccccagccccggcgaggaggtgcccagatacggcgccaccggcctgggctgcggcctgtgcatcagcagactgctgggccccagcgacagcatcagcttcctgctgcccaccagcggcgccaccaccagctgcagctgccccctggagcccgccctgtag

SEQ ID NO: 22520 - DNA, 510 bp, Artificial Sequence
  Description of Artificial Sequence: Synthetic coding sequence
atggaggtgtacatccccagcttcagatacgaggagagcgacctggagagaggctacaccgtgttcaagatcgaggtgctgatgaacggcagaaagcacttcgtggagaagagatacagcgagttccacgccctgcacaagaagctgaagaagtgcatcaagacccccgagatccccagcaagcacgtgagaaactgggtgcccaaggtgctggagcagagaagacagggcctggagacctacctgcaggccgtgatcctggagaacgaggagctgcccaagctgttcctggacttcctgaacgtgagacacctgcccagcctgcccaaggccgagagctgcggcagcttcgacgagaccgagagcgaggagagcagcaagctgagccaccagcccgtgctgctgttcctgagagacccctacgtgctgcccgccgccagcgacttccccaacgtggtgatcgagggcgtgctgcacggcatcttctacccccacctgcagcccagatag

SEQ ID NO: 22521 - DNA, 480 bp, Artificial Sequence
  Description of Artificial Sequence: Synthetic coding sequence
atggaggtgtacatccccagcttcagatacgaggagagcgacctggagagaggctacaccgtgttcaagatcgaggtgctgatgaacggcagaaagcacttcgtggagaagagatacagcgagttccacgccctgcacaagaagctgaagaagtgcatcaagacccccgagatccccagcaagcacgtgagaaactgggtgcccaaggtgctggagcagagaagacagggcctggagacctacctgcaggccgtgatcctggagaacgaggagctgcccaagctgttcctggacttcctgaacgtgagacacctgcccagcctgcccaaggccgagagctgcggcagcttcgacgagaccgagagcgaggagagcagcaagctgagccaccagcccgtgctgctgttcctgagagacccctacgtgctgcccgccgccagcggcaaccagacctgccacctgctgaccgccctgtactag

SEQ ID NO: 22522 - DNA, 480 bp, Artificial Sequence; identical to SEQ ID NO: 22521
  Description of Artificial Sequence: Synthetic coding sequence

SEQ ID NO: 22523 - DNA, 1086 bp, Artificial Sequence
  Description of Artificial Sequence: Synthetic coding sequence
atgagaaacctgaacatcaaggacgtgagcaagctgaaggacgagatcatcctgatcgagaaggagagaaccgacctgcagctgcacatggccagaaccgactggtggtgcgagaacctgggcatgtggaaggccagcatcaccagcggcgaggtgaccgaggagaacggcgagcagctgccctgctacttcgtgatggtgagcctgcaggaggtgggcggcgtggagaccaagaactggaccgtgcccagaagactgagcgagttccagaacctgcacagaaagctgagcgagtgcgtgcccagcctgaagaaggtgcagctgcccagcctgagcaagctgcccttcaagagcatcgaccagaagttcatggagaagagcaagaaccagctgaacaagttcctgcagaacctgctgagcgacgagagactgtgccagagcgaggccctgtacgccttcctgagccccagccccgactacctgaaggtgatcgacgtgcagggcaagaagaacagcttcagcctgagcagcttcctggagagactgcccagagacttcttcagccaccaggaggaggagaccgaggaggacagcgacctgagcgactacggcgacgacgtggacggcagaaaggacgccctggccgagccctgcttcatgctgatcggcgagatcttcgagctgagaggcatgttcaagtgggtgagaagaaccctgatcgccctggtgcaggtgaccttcggcagaaccatcaacaagcagatcagagacaccgtgagctggatcttcagcgagcagatgctggtgtactacatcaacatcttcagagacgccttctggcccaacggcaagctggccccccccaccaccatcagaagcaaggagcagagccaggagaccaagcagagagcccagcagaagctgctggagaacatccccgacatgctgcagagcctggtgggccagcagaacgccagacacggcatcatcaagatcttcaacgccctgcaggagaccagagccaacaagcacctgctgtacggcaccagcaccaacaccctgctgagccccagagaccacgactag

SEQ ID NO: 22524 - DNA, 2523 bp, Artificial Sequence
  Description of Artificial Sequence: Synthetic coding sequence
atggacaaggccctgaaggaggtgttcgactacagctacagagactacatcctgagctggtacggcaacctgagcagagacgagggccagctgtaccacctgctgctggaggacttctgggagatcgccagacagctgcaccacagactgagccacgtggacgtggtgaaggtggtgtgcaacgacgtggtgagaaccctgctgacccacttctgcgacctgaaggccgccaacgccagacacgaggagcagcccagacccttcgtgctgcacgcctgcctgagaaacagcgacgacgaggtgagattcctgcagacctgcagcagagtgctggtgttctgcctgctgcccagcaaggacgtgcagagcctgagcctgagaatcatgctggccgagatcctgaccaccaaggtgctgaagcccgtggtggagctgctgagcaaccccgactacatcaaccagatgctgctggcccagctggcctacagagagcagatgaacgagcaccacaagagagcctacacctacgcccccagctacgaggacttcatcaagctgatcaacagcaacagcgacgtggagttcctgaagcagctgagataccagatcgtggtggagatcatccaggccaccaccatcagcagcttcccccagctgaagagacacaagggcaaggagaccgccgccatgaaggccgacctgctgagagccagaaacatgaagagatacatcaaccagctgaccgtggccaagaagcagtgcgagaagagaatcagaatcctgggcggccccgcctacgaccagcaggaggacggcgccctggacgagggcgagggcccccagagccagaagatcctgcagttcgaggacatcctggccaacaccttctacagagagcacttcggcatgtacatggagagaatggacaagagagccctgatcagcttctgggagagcgtggagcacctgaagaacgccaacaagaacgagatcccccagctggtgggcgagatctaccagaacttcttcgtggagagcaaggagatcagcgtggagaagagcctgtacaaggagatccagcagtgcctggtgggcaacaagggcatcgaggtgttctacaagatccaggaggacgtgtacgagaccctgaaggacagatactaccccagcttcatcgtgagcgacctgtacgagaagctgctgatcaaggaggaggagaagcacgccagccagatgatcagcaacaaggacgagatgggccccagagacgaggccggcgaggaggccgtggacgacggcaccaaccagatcaacgagcaggccagcttcgccgtgaacaagctgagagagctgaacgagaagctggagtacaagagacaggccctgaacagcatccagaacgcccccaagcccgacaagaagatcgtgagcaagctgaaggacgagatcatcctgatcgagaaggagagaaccgacctgcagctgcacatggccagaaccgactggtggtgcgagaacctgggcatgtggaaggccagcatcaccagcggcgaggtgaccgaggagaacggcgagcagctgccctgctacttcgtgatggtgagcctgcaggaggtgggcggcgtggagaccaagaactggaccgtgcccagaagactgagcgagttccagaacctgcacagaaagctgagcgagtgcgtgcccagcctgaagaaggtgcagctgcccagcctgagcaagctgcccttcaagagcatcgaccagaagttcatggagaagagcaagaaccagctgaacaagttcctgcagaacctgctgagcgacgagagactgtgccagagcgaggccctgtacgccttcctgagccccagccccgactacctgaaggtgatcgacgtgcagggcaagaagaacagcttcagcctgagcagcttcctggagagactgcccagagacttcttcagccaccaggaggaggagaccgaggaggacagcgacctgagcgactacggcgacgacgtggacggcagaaaggacgccctggccgagccctgcttcatgctgatcggcgagatcttcgagctgagaggcatgttcaagtgggtgagaagaaccctgatcgccctggtgcaggtgaccttcggcagaaccatcaacaagcagatcagagacaccgtgagctggatcttcagcgagcagatgctggtgtactacatcaacatcttcagagacgccttctggcccaacggcaagctggccccccccaccaccatcagaagcaaggagcagagccaggagaccaagcagagagcccagcagaagctgctggagaacatccccgacatgctgcagagcctggtgggccagcagaacgccagacacggcatcatcaagatcttcaacgccctgcaggagaccagagccaacaagcacctgctgtacgccctgatggagctgctgctgatcgagctgtgccccgagctgagagtgcacctggaccagctgaaggccggccaggtgtag

SEQ ID NO: 22525 - DNA, 2523 bp, Artificial Sequence; identical to SEQ ID NO: 22524
  Description of Artificial Sequence: Synthetic coding sequence

SEQ ID NO: 22526 - DNA, 1356 bp, Artificial Sequence
  Description of Artificial Sequence: Synthetic coding sequence
atggagggcgagagaagagccagccaggcccccagcagcggcctgcccgccggcggcgccaacggcgagagccccggcggcggcgcccccttccccggcagcagcggcagcagcgccctgctgcaggccgaggtgctggacctggacgaggacgaggacgacctggaggtgttcagcaaggacgccagcctgatggacatgaacagcttcagccccatgatgcccaccagccccctgagcatgatcaaccagatcaagttcgaggacgagcccgacctgaaggacctgttcatcaccgtggacgagcccgagagccacgtgaccaccatcgagaccttcatcacctacagaatcatcaccaagaccagcagaggcgagttcgacagcagcgagttcgaggtgagaagaagataccaggacttcctgtggctgaagggcaagctggaggaggcccaccccaccctgatcatcccccccctgcccgagaagttcatcgtgaagggcatggtggagagattcaacgacgacttcatcgagaccagaagaaaggccctgcacaagttcctgaacagaatcgccgaccaccccaccctgaccttcaacgaggacttcaagatcttcctgaccgcccaggcctgggagctgagcagccacaagaagcagggccccggcctgctgagcagaatgggccagaccgtgagagccgtggccagcagcatgagaggcgtgaagaacagacccgaggagttcatggagatgaacaacttcatcgagctgttcagccagaagatcaacctgatcgacaagatcagccagagaatctacaaggaggagagagagtacttcgacgagatgaaggagtacggccccatccacatcctgtggagcgccagcgaggaggacctggtggacaccctgaaggacgtggccagctgcatcgacagatgctgcaaggccaccgagaagagaatgagcggcctgagcgaggccctgctgcccgtggtgcacgagtacgtgctgtacagcgagatgctgatgggcgtgatgaagagaagagaccagatccaggccgagctggacagcaaggtggaggtgctgacctacaagaaggccgacaccgacctgctgcccgaggagatcggcaagctggaggacaaggtggagtgcgccaacaacgccctgaaggccgactgggagagatggaagcagaacatgcagaacgacatcaagctggccttcaccgacatggccgaggagaacatccactactacgagcagtgcctggccacctgggagagcttcctgaccagccagaccaacctgcacctggaggaggccagcgaggacaagccctag

SEQ ID NO: 22527 - DNA, 1011 bp, Artificial Sequence
  Description of Artificial Sequence: Synthetic coding sequence
atggacatgaacagcttcagccccatgatgcccaccagccccctgagcatgatcaaccagatcaagttcgaggacgagcccgacctgaaggacctgttcatcaccgtggacgagcccgagagccacgtgaccaccatcgagaccttcatcacctacagaatcatcaccaagaccagcagaggcgagttcgacagcagcgagttcgaggtgagaagaagataccaggacttcctgtggctgaagggcaagctggaggaggcccaccccaccctgatcatcccccccctgcccgagaagttcatcgtgaagggcatggtggagagattcaacgacgacttcatcgagaccagaagaaaggccctgcacaagttcctgaacagaatcgccgaccaccccaccctgaccttcaacgaggacttcaagatcttcctgaccgcccaggcctgggagctgagcagccacaagaagcagggccccggcctgctgagcagaatgggccagaccgtgagagccgtggccagcagcatgagaggcgtgaagaacagacccgaggagttcatggagatgaacaacttcatcgagctgttcagccagaagatcaacctgatcgacaagatcagccagagaatctacaaggaggagagagagtacttcgacgagatgaaggagtacggccccatccacatcctgtggagcgccagcgaggaggacctggtggacaccctgaaggacgtggccagctgcatcgacagatgctgcaaggccaccgagaagagaatgagcggcctgagcgaggccctgctgcccgtggtgcacgagtacgtgctgtacagcgagatgctgatgggcgtgatgaagagaagagaccagatccaggccgagctggacagcaaggtggaggtgctgacctacaagaaggccgacaccgacctgtgcctggccacctgggagagcttcctgaccagccagaccaacctgcacctggaggaggccagcgaggacaagccctag

SEQ ID NO: 22528 - DNA, 1191 bp, Artificial Sequence
  Description of Artificial Sequence: Synthetic coding sequence
atggagggcgagagaagagccagccaggcccccagcagcggcctgcccgccggcggcgccaacggcgagagccccggcggcggcgcccccttccccggcagcagcggcagcagcgccctgctgcaggccgaggtgctggacctggacgaggacgaggacgacctggaggtgttcagcaaggacgccagcctgatggacatgaacagcttcagccccatgatgcccaccagccccctgagcatgatcaaccagatcaagttcgaggacgagcccgacctgaaggacctgttcatcaccgtggacgagcccgagagccacgtgaccaccatcgagaccttcatcacctacagaatcatcaccaagaccagcagaggcgagttcgacagcagcgagttcgaggtgagaagaagataccaggacttcctgtggctgaagggcaagctggaggaggcccaccccaccctgatcatccccgagctgagcagccacaagaagcagggccccggcctgctgagcagaatgggccagaccgtgagagccgtggccagcagcatgagaggcgtgaagaacagacccgaggagttcatggagatgaacaacttcatcgagctgttcagccagaagatcaacctgatcgacaagatcagccagagaatctacaaggaggagagagagtacttcgacgagatgaaggagtacggccccatccacatcctgtggagcgccagcgaggaggacctggtggacaccctgaaggacgtggccagctgcatcgacagatgctgcaaggccaccgagaagagaatgagcggcctgagcgaggccctgctgcccgtggtgcacgagtacgtgctgtacagcgagatgctgatgggcgtgatgaagagaagagaccagatccaggccgagctggacagcaaggtggaggtgctgacctacaagaaggccgacaccgacctgctgcccgaggagatcggcaagctggaggacaaggtggagtgcgccaacaacgccctgaaggccgactgggagagatggaagcagaacatgcagaacgacatcaagctggccttcaccgacatggccgaggagaacatccactactacgagcagtgcctggccacctgggagagcttcctgaccagccagaccaacctgcacctggaggaggccagcgaggacaagccctag

SEQ ID NO: 22529 - DNA, 1509 bp, Artificial Sequence
  Description of Artificial Sequence: Synthetic coding sequence
atggacctgatccccaacctggccgtggagacctggctgctgctggccgtgagcctggtgctgctgtacctgtacggcaccagaacccacggcctgttcaagagactgggcatccccggccccacccccctgcccctgctgggcaacgtgctgagctacagacagggcctgtggaagttcgacaccgagtgctacaagaagtacggcaagatgtggggcacctacgagggccagctgcccgtgctggccatcaccgaccccgacgtgatcagaaccgtgctggtgaaggagtgctacagcgtgttcaccaacagaagaagcctgggccccgtgggcttcatgaagagcgccatcagcctggccgaggacgaggagtggaagagaatcagaagcctgctgagccccaccttcaccagcggcaagctgaaggagatgttccccatcatcgcccagtacggcgacgtgctggtgagaaacctgagaagagaggccgagaagggcaagcccgtgaccctgaaggacatcttcggcgcctacagcatggacgtgatcaccggcaccagcttcggcgtgaacatcgacagcctgaacaacccccaggaccccttcgtggagagcaccaagaagttcctgaagttcggcttcctggaccccctgttcctgagcatcatcctgttccccttcctgacccccgtgttcgaggccctgaacgtgagcctgttccccaaggacaccatcaacttcctgagcaagagcgtgaacagaatgaagaagagcagactgaacgacaagcagaagcacagactggacttcctgcagctgatgatcgacagccagaacagcaaggagaccgagagccacaaggccctgagcgacctggagctggccgcccagagcatcatcttcatcttcgccggctacgagaccaccagcagcgtgctgagcttcaccctgtacgagctggccacccaccccgacgtgcagcagaagctgcagaaggagatcgacgccgtgctgcccaacaaggccccccccacctacgacgccgtggtgcagatggagtacctggacatggtggtgaacgagaccctgagactgttccccgtggccatcagactggagagaacctgcaagaaggacgtggagatcaacggcgtgttcatccccaagggcagcatggtggtgatccccacctacgccctgcaccacgaccccaagtactggaccgagcccgaggagttcagacccgagagattcagcaagaagaaggacagcatcgacccctacatctacacccccttcggcaccggccccagaaactgcatcggcatgagattcgccctgatgaacatgaagctggccctgatcagagtgctgcagaacttcagcttcaagccctgcaaggagacccagatccccctgaagctggacacccagggcctgctgcagcccgagaagcccatcgtgctgaaggtggacagcagagacggcaccctgagcggcgagtag

SEQ ID NO: 22530 - DNA, 129 bp, Artificial Sequence
  Description of Artificial Sequence: Synthetic coding sequence
atgcagatgccccagggcaaccccctgctgctgagccacaccctgcaggagctgctggccagagacaccgtgcaggtggagctgatccccgagaagaagggcctgttcctgaagcacgtggagtactag

SEQ ID NO: 22531 - DNA, 531 bp, Artificial Sequence
  Description of Artificial Sequence: Synthetic coding sequence
atgcagatgccccagggcaaccccctgctgctgagccacaccctgcaggagctgctggccagagacaccgtgcaggtggagctgatccccgagaagaagggcctgttcctgaagcacgtggagtacgaggtgagcagccagagattcaagagcagcgtgtacagaagatacaacgacttcgtggtgttccaggagatgctgctgcacaagttcccctacagaatggtgcccgccctgccccccaagagaatgctgggcgccgacagagagttcatcgaggccagaagaagagccctgaagagattcgtgaacctggtggccagacaccccctgttcagcgaggacgtggtgctgaagctgttcctgagcttcagcggcagcgacgtgcagaacaagctgaaggagagcgcccagtgcgtgggcgacgagttcctgaactgcaagctggccaccagagccaaggacttcctgcccgccgacatccaggcccagttcgccatcagcagagagctgatcagaaacatctactag

SEQ ID NO: 22532 - DNA, 600 bp, Artificial Sequence
  Description of Artificial Sequence: Synthetic coding sequence
atgcacagaggcacccaggagggcgccatggccagcagactgctgcacagactgagacacgccctggccggcgacggccccggcgaggccgccgccagccccgaggccgagcagttccccgagagcagcgagctggaggacgacgacgccgagggcctgagcagcagactgagcggcaccctgagcttcaccagcgccgaggacgacgaggacgacgaggacgaggacgacgaggaggccggccccgaccagctgcccctgggcgacggcaccagcggcgaggacgccgagagaagccccccccccgacggccagtggggcagccagctgctggccagacagctgcaggacttctggaagaagagcagaaacaccctggccccccagagactgctgttcgaggtgaccagcgccaacgtggtgaaggacccccccagcaagtacgtgctgtacaccctggccgtgatcggccccggcccccccgactgccagcccgcccagatcagcagaagatacagcgacttcgagagactgcacagaaacctgcagagacagttcagaggccccatggccgccatcagcttcccccagagccactag

SEQ ID NO: 22533 - DNA, 453 bp, Artificial Sequence
  Description of Artificial Sequence: Synthetic coding sequence
atggccagcagactgctgcacagactgagacacgccctggccggcgacggccccggcgaggccgccgccagccccgaggccgagcagttccccgagagcagcgagctggaggacgacgacgccgagggcctgagcagcagactgagcggcaccctgagcttcaccagcgccgaggacgacgaggacgacgaggacgaggacgacgaggaggccggccccgaccagctgcccctgggcgacggcaccagcggcgaggacgccgagagaagccccccccccgacggccagtggggcagccagctgctggccagacagctgcaggacttctggaagaagagcagaaacaccctggccccccagagactgctgttcgaggtgaccagcgccaacgtggtgaaggacccccccagcaagtacgtgacccccaccctgagcagcacccccagcccctag

SEQ ID NO: 22534 - DNA, 477 bp, Artificial Sequence
  Description of Artificial Sequence: Synthetic coding sequence
atgcacagaggcacccaggagggcgccatggccagcagactgctgcacagactgagacacgccctggccggcgacggccccggcgaggccgccgccagccccgaggccgagcagttccccgagagcagcgagctggaggacgacgacgccgagggcctgagcagcagactgagcggcaccctgagcttcaccagcgccgaggacgacgaggacgacgaggacgaggacgacgaggaggccggccccgaccagctgcccctgggcgacggcaccagcggcgaggacgccgagagaagccccccccccgacggccagtggggcagccagctgctggccagacagctgcaggacttctggaagaagagcagaaacaccctggccccccagagactgctgttcgaggtgaccagcgccaacgtggtgaaggacccccccagcaagtacgtgaccaacctgagcagcacccccagcccctag

SEQ ID NO: 22535 - DNA, 1122 bp, Artificial Sequence
  Description of Artificial Sequence: Synthetic coding sequence
atgcacagaggcacccaggagggcgccatggccagcagactgctgcacagactgagacacgccctggccggcgacggccccggcgaggccgccgccagccccgaggccgagcagttccccgagagcagcgagctggaggacgacgacgccgagggcctgagcagcagactgagcggcaccctgagcttcaccagcgccgaggacgacgaggacgacgaggacgaggacgacgaggaggccggccccgaccagctgcccctgggcgacggcaccagcggcgaggacgccgagagaagccccccccccgacggccagtggggcagccagctgctggccagacagctgcaggacttctggaagaagagcagaaacaccctggccccccagagactgctgttcgaggtgaccagcgccaacgtggtgaaggacccccccagcaagtacgtgctgtacaccctggccgtgatcggccccggcccccccgactgccagcccgcccagatcagcagaagatacagcgacttcgagagactgcacagaaacctgcagagacagttcagaggccccatggccgccatcagcttccccagaaagagactgagaagaaacttcaccgccgagaccatcgccagaagaagcagagccttcgagcagttcctgggccacctgcaggccgtgcccgagctgagacacgcccccgacctgcaggacttcttcgtgctgcccgagctgagaagagcccagagcctgacctgcaccggcctgtacagagaggccctggccctgtgggccaacgcctggcagctgcaggcccagctgggcacccccagcggccccgacagacccctgctgaccctggccggcctggccgtgtgccaccaggagctggaggaccccggcgaggccagagcctgctgcgagaaggccctgcagctgctgggcgacaagagcctgcaccccctgctggcccccttcctggaggcccacgtgagactgagctggagactgggcctggacaagagacagagcgaggccagactgcaggccctgcaggaggccggcctgacccccacccccccccccagcctgaaggagctgctgatcaaggaggtgctggactag

SEQ ID NO: 22536 - DNA, 294 bp, Artificial Sequence
  Description of Artificial Sequence: Synthetic coding sequence
atggacaagcagagcagcgccggcggcgtgaagagaagcgtgccctgcgacagcaacgaggccaacgagatgatgcccgagaccagcagcggctacagcgacccccagcccgcccccaagaagctgaagaccagcgagagcagcaccatcctggtggtgagatacagaagaaacttcaagagaaccagccccgaggagctggtgaacgaccacgccagaaagaacagaatcaaccccctgcagatggaggaggaggagttcatggagatcatggtggagatccccgccaagtag

SEQ ID NO: 22537 - DNA, 3771 bp, Artificial Sequence
  Description of Artificial Sequence: Synthetic coding sequence
atggacagacccctgagcagcagcgccgaggccgaggaggagctggagtggcaggtggccagcagaagaagaaaggcctgggccaagtgcagaagcagctggcaggccagcgagaccgaggacctgagcaccgaggccaccacccaggacgaggaggaggacgaggaggaggacctgcccggcgcccagctgcccgccgccggcggcagaggcaacgtgcccaacgagaagatcgccatctggctgaaggactgcagaacccccctgggcgccagcctggacgagcagagcagcagcaccctgaagggcgtgctggtgagaaacggcggcagcttcgaggacgacctgagcctgggcgccgaggccaaccacctgcacgagagcgacgcccagatcgagaactgcaacaacatcctggccaaggagagaagactgcagttccaccagaagggcagaagcatgaacagcaccggcagcggcaagagcagcggcaccgtgagcagcgtgagcgagctgctggagctgtacgaggaggaccccgaggagatcctgtacaacctgggcttcggcagagacgagcccgacatcgccagcaagatccccagcagattcttcaacagcagcagcttcgccaagggcatcgacatcaaggtgttcctgagcgcccagatgcagagaatggaggtggagaaccccaactacgccctgaccagcagattcagacagatcgaggtgctgaccaccgtggccaacgccttcagcagcctgtacagccaggtgagcggcacccccctgcagagaatcggcagcatgagcagcgtgaccagcaacaaggagaccgacccccccccccccctgaccagaagcaacaccgccaacagactgatgaagaccctgagcaagctgaacctgtgcgtggacaagaccgagaagggcgagagcagcagccccagccccagcgccgagaagggcaagatcctgaacgtgagcgtgatcgaggagagcggcaacaagaacgaccagaagagccagaagatcatgaagaagaaggagagcagcagcatgctggccaccgtgaaggaggaggtgagcggcagcagcgccgccgtgaccgagaacgccgacagcgacagaatcagcgacgaggccaacagcaacttcaaccagggcaccgagaacgagcagagcaaggagacccagagccacgagagcaagctgggcgaggagagcggcatcgtggagagcaagctggacagcgacttcaacatcagcagccacagcgagctggagaacagcagcgagctgaagagcgtgcacatcagcacccccgagaaggagccctgcgcccccctgaccatccccagcatcagaaacatcatgacccagcagaaggacagcttcgagatggaggaggtgcagagcaccgagggcgaggccccccacgtgcccgccacctaccagctgggcctgaccaagagcaagagagaccacctgctgagaaccgccagccagcacagcgacagcagcggcttcgccgaggacagcaccgactgcctgagcctgaaccacctgcaggtgcaggagagcctgcaggccatgggcagcagcgccgacagctgcgacagcgagaccaccgtgaccagcctgggcgaggacctggccacccccaccgcccaggaccagccctacttcaacgagagcgaggaggagagcctggtgcccctgcagaagggcctggagaaggccgccgccgtggccgacaagagaaagagcggcagccaggacttcccccagtgcaacaccatcgagaacaccggcaccaagcagagcacctgcagccccggcgaccacatcatcgagatcaccgaggtggaggaggacctgttccccgccgagaccgtggagctgctgagagaggccagcgccgagagcgacgtgggcaagagcagcgagagcgagttcacccagtacaccacccaccacatcctgaagagcctggccagcatcgaggccaagtgcagcgacatgagcagcgagaacaccaccggcccccccagcagcatggacagagtgaacaccgccctgcagagagcccagatgaaggtgtgcagcctgagcaaccagagaatgggcagaagcctgctgaagagcaaggacctgctgaagcagagatacctgttcgccaaggccggctaccccctgagaagaagccagagcctgcccaccaccctgctgagccccgtgagagtggtgagcagcgtgaacgtgagactgagccccggcaaggagaccagatgcagcccccccagcttcacctacaagtacacccccgaggaggagcaggagctggagaagagagtgatggagcacgacggccagagcctggtgaagagcaccatcttcatcagccccagcagcgtgaagaaggaggaggccccccagagcgaggcccccagagtggaggagtgccaccacggcagaacccccacctgcagcagactggcccccccccccatgagccagagcacctgcagcctgcacagcatccacagcgagtggcaggagagacccctgtgcgagcacaccagaaccctgagcacccacagcgtgcccaacatcagcggcgccacctgcagcgccttcgccagccccttcggctgcccctacagccacagacacgccacctacccctacagagtgtgcagcgtgaacccccccagcgccatcgagatgcagctgagaagagtgctgcacgacatcagaaacagcctgcagaacctgagccagtaccccatgatgagaggccccgaccccgccgccgccccctacagcacccagaagagcagcgtgctgcccctgtacgagaacaccttccaggagctgcaggtgatgagaagaagcctgaacctgttcagaacccagatgatggacctggagctggccatgctgagacagcagaccatggtgtaccaccacatgaccgaggaggagagattcgaggtggaccagctgcagggcctgagaaacagcgtgagaatggagctgcaggacctggagctgcagctggaggagagactgctgggcctggaggagcagctgagagccgtgagaatgcccagccccttcagaagcagcgccctgatgggcatgtgcggcagcagaagcgccgacaacctgagctgccccagccccctgaacgtgatggagcccgtgaccgagctgatgcaggagcagagctacctgaagagcgagctgggcctgggcctgggcgagatgggcttcgagatcccccccggcgagagcagcgagagcgtgttcagccaggccaccagcgagagcagcagcgtgtgcagcggccccagccacgccaacagaagaaccggcgtgcccagcaccgccagcgtgggcaagagcaagacccccctggtggccagaaagaaggtgttcagagccagcgtggccctgacccccaccgcccccagcagaaccggcagcgtgcagaccccccccgacctggagagcagcgaggaggtggacgccgccgagggcgcccccgaggtggtgggccccaagagcgaggtggaggagggccacggcaagctgcccagcatgcccgccgccgaggagatgcacaagaacgtggagcaggacgagctgcagcaggtgatcagagaggtgggcatggaccccatcagctgcgtgatcctggagctgagcatgatctgcaccggcggcggcgtgatctgcgccctggaggacacctgctgctag

SEQ ID NO: 22538 - DNA, 3255 bp, Artificial Sequence
  Description of Artificial Sequence: Synthetic coding sequence
atgaacagcaccggcagcggcaagagcagcggcaccgtgagcagcgtgagcgagctgctggagctgtacgaggaggaccccgaggagatcctgtacaacctgggcttcggcagagacgagcccgacatcgccagcaagatccccagcagattcttcaacagcagcagcttcgccaagggcatcgacatcaaggtgttcctgagcgcccagatgcagagaatggaggtggagaaccccaactacgccctgaccagcagattcagacagatcgaggtgctgaccaccgtggccaacgccttcagcagcctgtacagccaggtgagcggcacccccctgcagagaatcggcagcatgagcagcgtgaccagcaacaaggagaccgacccccccccccccctgaccagaagcaacaccgccaacagactgatgaagaccctgagcaagctgaacctgtgcgtggacaagaccgagaagggcgagagcagcagccccagccccagcgccgagaagggcaagatcctgaacgtgagcgtgatcgaggagagcggcaacaagaacgaccagaagagccagaagatcatgaagaagaaggagagcagcagcatgctggccaccgtgaaggaggaggtgagcggcagcagcgccgccgtgaccgagaacgccgacagcgacagaatcagcgacgaggccaacagcaacttcaaccagggcaccgagaacgagcagagcaaggagacccagagccacgagagcaagctgggcgaggagagcggcatcgtggagagcaagctggacagcgacttcaacatcagcagccacagcgagctggagaacagcagcgagctgaagagcgtgcacatcagcacccccgagaaggagccctgcgcccccctgaccatccccagcatcagaaacatcatgacccagcagaaggacagcttcgagatggaggaggtgcagagcaccgagggcgaggccccccacgtgcccgccacctaccagctgggcctgaccaagagcaagagagaccacctgctgagaaccgccagccagcacagcgacagcagcggcttcgccgaggacagcaccgactgcctgagcctgaaccacctgcaggtgcaggagagcctgcaggccatgggcagcagcgccgacagctgcgacagcgagaccaccgtgaccagcctgggcgaggacctggccacccccaccgcccaggaccagccctacttcaacgagagcgaggaggagagcctggtgcccctgcagaagggcctggagaaggccgccgccgtggccgacaagagaaagagcggcagccaggacttcccccagtgcaacaccatcgagaacaccggcaccaagcagagcacctgcagccccggcgaccacatcatcgagatcaccgaggtggaggaggacctgttccccgccgagaccgtggagctgctgagagaggccagcgccgagagcgacgtgggcaagagcagcgagagcgagttcacccagtacaccacccaccacatcctgaagagcctggccagcatcgaggccaagtgcagcgacatgagcagcgagaacaccaccggcccccccagcagcatggacagagtgaacaccgccctgcagagagcccagatgaaggtgtgcagcctgagcaaccagagaatgggcagaagcctgctgaagagcaaggacctgctgaagcagagatacctgttcgccaaggccggctaccccctgagaagaagccagagcctgcccaccaccctgctgagccccgtgagagtggtgagcagcgtgaacgtgagactgagccccggcaaggagaccagatgcagcccccccagcttcacctacaagtacacccccgaggaggagcaggagctggagaagagagtgatggagcacgacggccagagcctggtgaagagcaccatcttcatcagccccagcagcgtgaagaaggaggaggccccccagagcgaggcccccagagtggaggagtgccaccacggcagaacccccacctgcagcagactggcccccccccccatgagccagagcacctgcagcctgcacagcatccacagcgagtggcaggagagacccctgtgcgagcacaccagaaccctgagcacccacagcgtgcccaacatcagcggcgccacctgcagcgccttcgccagccccttcggctgcccctacagccacagacacgccacctacccctacagagtgtgcagcgtgaacccccccagcgccatcgagatgcagctgagaagagtgctgcacgacatcagaaacagcctgcagaacctgagccagtaccccatgatgagaggccccgaccccgccgccgccccctacagcacccagaagagcagcgtgctgcccctgtacgagaacaccttccaggagctgcaggtgatgagaagaagcctgaacctgttcagaacccagatgatggacctggagctggccatgctgagacagcagaccatggtgtaccaccacatgaccgaggaggagagattcgaggtggaccagctgcagggcctgagaaacagcgtgagaatggagctgcaggacctggagctgcagctggaggagagactgctgggcctggaggagcagctgagagccgtgagaatgcccagccccttcagaagcagcgccctgatggtgaccgagctgatgcaggagcagagctacctgaagagcgagctgggcctgggcctgggcgagatgggcttcgagatcccccccggcgagagcagcgagagcgtgttcagccaggccaccagcgagagcagcagcgtgtgcagcggccccagccacgccaacagaagaaccggcgtgcccagcaccgccagcgtgggcaagagcaagacccccctggtggccagaaagaaggtgttcagagccagcgtggccctgacccccaccgcccccagcagaaccggcagcgtgcagaccccccccgacctggagagcagcgaggaggtggacgccgccgagggcgcccccgaggtggtgggccccaagagcgaggtggaggagggccacggcaagctgcccagcatgcccgccgccgaggagatgcacaagaacgtggagcaggacgagctgcagcaggtgatcagagagatcaaggagagcatcgtgggcgagatcagaagagagatcgtgagcggcctgctggccgccgtgagcagcagcaaggccagcaacagcaagcaggactaccactag

SEQ ID NO: 22539 - DNA, 3780 bp, Artificial Sequence
  Description of Artificial Sequence: Synthetic coding sequence
atggacagacccctgagcagcagcgccgaggccgaggaggagctggagtggcaggtggccagcagaagaagaaaggcctgggccaagtgcagaagcagctggcaggccagcgagaccgaggacctgagcaccgaggccaccacccaggacgaggaggaggacgaggaggaggacctgcccggcgcccagctgcccgccgccggcggcagaggcaacgtgcccaacgagaagatcgccatctggctgaaggactgcagaacccccctgggcgccagcctggacgagcagagcagcagcaccctgaagggcgtgctggtgagaaacggcggcagcttcgaggacgacctgagcctgggcgccgaggccaaccacctgcacgagagcgacgcccagatcgagaactgcaacaacatcctggccaaggagagaagactgcagttccaccagaagggcagaagcatgaacagcaccggcagcggcaagagcagcggcaccgtgagcagcgtgagcgagctgctggagctgtacgaggaggaccccgaggagatcctgtacaacctgggcttcggcagagacgagcccgacatcgccagcaagatccccagcagattcttcaacagcagcagcttcgccaagggcatcgacatcaaggtgttcctgagcgcccagatgcagagaatggaggtggagaaccccaactacgccctgaccagcagattcagacagatcgaggtgctgaccaccgtggccaacgccttcagcagcctgtacagccaggtgagcggcacccccctgcagagaatcggcagcatgagcagcgtgaccagcaacaaggagaccgacccccccccccccctgaccagaagcaacaccgccaacagactgatgaagaccctgagcaagctgaacctgtgcgtggacaagaccgagaagggcgagagcagcagccccagccccagcgccgagaagggcaagatcctgaacgtgagcgtgatcgaggagagcggcaacaagaacgaccagaagagccagaagatcatgaagaagaaggagagcagcagcatgctggccaccgtgaaggaggaggtgagcggcagcagcgccgccgtgaccgagaacgccgacagcgacagaatcagcgacgaggccaacagcaacttcaaccagggcaccgagaacgagcagagcaaggagacccagagccacgagagcaagctgggcgaggagagcggcatcgtggagagcaagctggacagcgacttcaacatcagcagccacagcgagctggagaacagcagcgagctgaagagcgtgcacatcagcacccccgagaaggagccctgcgcccccctgaccatccccagcatcagaaacatcatgacccagcagaaggacagcttcgagatggaggaggtgcagagcaccgagggcgaggccccccacgtgcccgccacctaccagctgggcctgaccaagagcaagagagaccacctgctgagaaccgccagccagcacagcgacagcagcggcttcgccgaggacagcaccgactgcctgagcctgaaccacctgcaggtgcaggagagcctgcaggccatgggcagcagcgccgacagctgcgacagcgagaccaccgtgaccagcctgggcgaggacctggccacccccaccgcccaggaccagccctacttcaacgagagcgaggaggagagcctggtgcccctgcagaagggcctggagaaggccgccgccgtggccgacaagagaaagagcggcagccaggacttcccccagtgcaacaccatcgagaacaccggcaccaagcagagcacctgcagccccggcgaccacatcatcgagatcaccgaggtggaggaggacctgttccccgccgagaccgtggagctgctgagagaggccagcgccgagagcgacgtgggcaagagcagcgagagcgagttcacccagtacaccacccaccacatcctgaagagcctggccagcatcgaggccaagtgcagcgacatgagcagcgagaacaccaccggcccccccagcagcatggacagagtgaacaccgccctgcagagagcccagatgaaggtgtgcagcctgagcaaccagagaatgggcagaagcctgctgaagagcaaggacctgctgaagcagagatacctgttcgccaaggccggctaccccctgagaagaagccagagcctgcccaccaccctgctgagccccgtgagagtggtgagcagcgtgaacgtgagactgagccccggcaaggagaccagatgcagcccccccagcttcacctacaagtacacccccgaggaggagcaggagctggagaagagagtgatggagcacgacggccagagcctggtgaagagcaccatcttcatcagccccagcagcgtgaagaaggaggaggccccccagagcgaggcccccagagtggaggagtgccaccacggcagaacccccacctgcagcagactggcccccccccccatgagccagagcacctgcagcctgcacagcatccacagcgagtggcaggagagacccctgtgcgagcacaccagaaccctgagcacccacagcgtgcccaacatcagcggcgccacctgcagcgccttcgccagccccttcggctgcccctacagccacagacacgccacctacccctacagagtgtgcagcgtgaacccccccagcgccatcgagatgcagctgagaagagtgctgcacgacatcagaaacagcctgcagaacctgagccagtaccccatgatgagaggccccgaccccgccgccgccccctacagcacccagaagagcagcgtgctgcccctgtacgagaacaccttccaggagctgcaggtgatgagaagaagcctgaacctgttcagaacccagatgatggacctggagctggccatgctgagacagcagaccatggtgtaccaccacatgaccgaggaggagagattcgaggtggaccagctgcagggcctgagaaacagcgtgagaatggagctgcaggacctggagctgcagctggaggagagactgctgggcctggaggagcagctgagagccgtgagaatgcccagccccttcagaagcagcgccctgatgggcatgtgcggcagcagaagcgccgacaacctgagctgccccagccccctgaacgtgatggagcccgtgaccgagctgatgcaggagcagagctacctgaagagcgagctgggcctgggcctgggcgagatgggcttcgagatcccccccggcgagagcagcgagagcgtgttcagccaggccaccagcgagagcagcagcgtgtgcagcggccccagccacgccaacagaagaaccggcgtgcccagcaccgccagcgtgggcaagagcaagacccccctggtggccagaaagaaggtgttcagagccagcgtggccctgacccccaccgcccccagcagaaccggcagcgtgcagaccccccccgacctggagagcagcgaggaggtggacgccgccgagggcgcccccgaggtggtgggccccaagagcgaggtggaggagggccacggcaagctgcccagcatgcccgccgccgaggagatgcacaagaacgtggagcaggacgagctgcagcaggtgatcagagagatcaaggagagcatcgtgggcgagatcagaagagagatcgtgagcggcctgctggccgccgtgagcagcagcaaggccagcaacagcaagcaggactaccactag

SEQ ID NO: 22540 - DNA, 519 bp, Artificial Sequence
  Description of Artificial Sequence: Synthetic coding sequence
atgcccgtgggcgccggcctgcccaccagcctgaccagcccccccagcaccgaggcccccaagagcagcctgctgagaaagcagacccagccccccaagaagcagagcagccccgccgtgcacctgagatgcaccatggaccccgtgatgatgaccgtgagccccccccccgcccacagacacagaagaagaggcagccccaccagatgcgcccactgccccgtggcctgggcccccgacaccgacgacgagaagccccaccagtaccccgccatctgcagctaccactgggacgtgcccgaggactgggagggcttccagcacacccagggcacctgggtgccctggagccaggacgcccccgagagccccccccagaccatcagattccagcccggcagacagagcgagacccccagcaagaagaagaagaagaagaagaagaagagaaacatcggcgcccccctgaagagatacctgaccgtgaccagccagctgagcgtgaccagcctgctgtag

SEQ ID NO: 22541 - DNA, 930 bp, Artificial Sequence
  Description of Artificial Sequence: Synthetic coding sequence
atggccatggtggagagacccagacccgagtgggccagctaccacaactgcaacagcaacagctgccaggacctgggcaacagcgtgctgctgctgctgggcctgatcatctgcatcaacatcagcatcaacatcgtgaccctgctgtggagcagattcagaggcgtgctgtaccaggtgttccacgacaccatctgcgagaaggaggcccccaagagcagcctgctgagaaagcagacccagccccccaagaagcagagcagccccgccgtgcacctgagatgcaccatggaccccgtgatgatgaccgtgagccccccccccgcccacagacacagaagaagaggcagccccaccagatgcgcccactgccccgtggcctgggcccccgacaccgacgacgagaagccccaccagtaccccgccatctgcagctaccactgggacgtgcccgaggactgggagggcttccagcacacccagggcacctgggtgccctggagccaggacgcccccgagagccccccccagaccatcagattccagcccaccgtggaggagagacccctgaagaccggcatctggagcgagctgggcctgagagcctacgtgtaccccgtgaacccccccccccccagccccgaggcccccagccacaagaacggcggcgagggcgccgtgcccgaggccgaggccgcccagtaccagcccgtgcccgcccccaccctgggccccgccgtgatccccgagttcagcagacacagaagcagcggcagaatcgtgtacgacgccagagacatgagaagaagactgagagagctgaccagagaggtggaggccctgagcggctgctaccccctggccagcggcagcagcaccgccgaggagaccagcaagaactgggtgtacagaagcctgaccggcagatag

SEQ ID NO: 22542 - DNA, 987 bp, Artificial Sequence
  Description of Artificial Sequence: Synthetic coding sequence
atggccagcagatgcagcgagccctaccccgaggtgagcagaatccccaccgtgagaggctgcaacggcagcctgagcggcgccctgagctgctgcgaggacagcgccagaggcagcggcccccccaaggcccccaccgtggccgagggccccagcagctgcctgagaagaaacgtgatcagcgagagagagagaagaaagagaatgagcctgagctgcgagagactgagagccctgctgccccagttcgacggcagaagagaggacatggccagcgtgctggagatgagcgtgcagttcctgagactggccagcgccctgggccccagccaggagcagcacgccatcctggccagcagcaaggagatgtggcacagcctgcaggaggacgtgctgcagctgaccctgagcagccagatccaggccggcgtgcccgaccccggcaccggcgccagcagcggcaccagaacccccgacgtgaaggccttcctggagagcccctggagcctggaccccgccagcgccagccccgagcccgtgccccacatcctggccagcagcagacagtgggaccccgccagctgcaccagcctgggcaccgacaagtgcgaggccctgctgggcctgtgccaggtgagaggcggcctgccccccttcagcgagcccagcagcctggtgccctggccccccggcagaagcctgcccaaggccgtgagaccccccctgagctggccccccttcagccagcagcagaccctgcccgtgatgagcggcgaggccctgggctggctgggccaggccggccccctggccatgggcgccgcccccctgggcgagcccgccaaggaggaccccatgctggcccaggaggccggcagcgccctgggcagcgacgtggacgacggcaccagcttcctgctgaccgccggccccagcagctggcccggcgagtggggccccggcttcagagccggcccccccgcctag

SEQ ID NO: 22543 - DNA, 1164 bp, Artificial Sequence
  Description of Artificial Sequence: Synthetic coding sequence
atggccagcagatgcagcgagccctaccccgaggtgagcagaatccccaccgtgagaggctgcaacggcagcctgagcggcgccctgagctgctgcgaggacagcgccagaggcagcggcccccccaaggcccccaccgtggccgagggccccagcagctgcctgagaagaaacgtgatcagcgagagagagagaagaaagagaatgagcctgagctgcgagagactgagagccctgctgccccagttcgacggcagaagagaggacatggccagcgtgctggagatgagcgtgcagttcctgagactggccagcgccctgggccccagccaggagcagcacgccatcctggccagcagcaaggagatgtggcacagcctgcaggaggacgtgctgcagctgaccctgagcagccagatccaggccggcgtgcccgaccccggcaccggcgccagcagcggcaccagaacccccgacgtgaaggccttcctggagagcccctggagcctggaccccgccagcgccagccccgagcccgtgccccacatcctggccagcagcagacagtgggaccccgccagctgcaccagcctgggcaccgacaagtgcgaggccctgctgggcctgtgccaggtgagaggcggcctgccccccttcagcgagcccagcagcctggtgccctggccccccggcagaagcctgcccaaggccgtgagaccccccctgagctggccccccttcagccagcagcagaccctgcccgtgatgagcggcgaggccctgggctggctgggccaggccggccccctggccatgggcgccgcccccctgggcgagcccgccaaggaggaccccatgctggcccaggaggccggcagcgccctgggcagcgacgtggacgacggcaccagcttcctgctgaccgccggccccagcagctggcccggcagcctggagggcagaggcggcagcggccccgcctgggcccccgccgagagcagccccctggacgtgggcgagcccggcttcctgggcgaccccgagctgggcagccaggagctgcaggacagccccctggagccctggggcctggacgtggactgcgccggcctggccctgaaggacgaggtggagagcatcttccccgacttcttcgcctgctag

SEQ ID NO: 22544 - DNA, 684 bp, Artificial Sequence
  Description of Artificial Sequence: Synthetic coding sequence
atgagctacttcagaaccccccagacccaccccggccccctgcccagcggccagggcggcgccgccagccccggcctgagcctgggcctgtgcagccccgtggagcccgtggtggtggccagcggcggcaccggccccctgagccagaaggccgagcaggtggcccccgccgcccaggcctggggccccgccctggccatgccccaggccagaggctgccccggcggcaccagctgggagaccctgagaaaggagtacagcagaaactgccacaagttcccccacgtgagacagctggagagcctgggctgggacaacggctacagcagaagcagagcccccgacctgggcggccccagcagacccagacccctgatgctgtgcggcctgagccccagagtgctgcccgtgcccagcgaggccgtgggcaaggaggccagcagccagcccgacatctgcatcctgaccctggccatgatgatcgccggcatccccaccgtgcccgtgcccggcgtgagagaggaggacctgatctgggccgcccaggccttcatgatggcccaccccgagcccgagggcgccgtggagggcgccagatgggagcaggcccacgcccacaccgccagcggcaagatgcccctggtgagaagcaagagaggccagccccccggcagctgcctgtag

SEQ ID NO: 22545 - DNA, 765 bp, Artificial Sequence
  Description of Artificial Sequence: Synthetic coding sequence
atgcccatcaagcccgtgggctggatctgcggccaggtgctgaagaacttcagcggcagaatcgagggcatccagaaggccatcatggacctggtggacgagttcaaggacgagttccccaccatcctgagactgagccagagcaaccagaagagagagcccgcccagaagaccagcaagatcagaatggccatcgccctggccaagatcaacagagccaccctgatcagaggcctgaacagcatcagcagaagcagcaagagcgtggccaagctgctgcacccccagctggcctgcagactgctggagctgagagacatcagcggcagactgctgagagaggtgaacgcccccagacagcccctgtacaacatccaggtgagaaagggcagcctgttcgagatcatcagcttccccgccaagaccgccctgaccagcatcatctacgccagctacgccgccctgatctacctggccgtgtgcgtgaacgccgtgctgaagaaggtgaagaacatcttccaggaggaggagagcatcagacagaacagagaggagagcgagaactgcagaaaggccttcagcgagcccgtgctgagcgagcccatgttcgccgagggcgagatcaaggccaagccctacagaagcctgcccgagaagcccgacatcagcgactaccccaagctgctggccaacaagcagagcaacaacatccaggtgctgcacagcgtgttcgaccagagcgccgagatgaacgagcagatctag

SEQ ID NO: 22546 - DNA, 765 bp, Artificial Sequence; identical to SEQ ID NO: 22545
  Description of Artificial Sequence: Synthetic coding sequence

SEQ ID NO: 22547 - DNA, 408 bp, Artificial Sequence
  Description of Artificial Sequence: Synthetic coding sequence
atgcccatcaagcccgtgggctggatctgcggccaggtgctgaagaacttcagcggcagaatcgagggcatccagaaggccatcatggacctggtggacgagttcaaggacgagttccccaccatcctgagactgagccagagcaaccagaagagagagcccgcccagaagaccagcaagatcagaatggccatcgccctggccaagatcaacagagccaccctgatcagaggcctgaacagcatcagcagaagcagcaagagcgtggccaagctgctgcacccccagctggcctgcagactgctggagctgagagacatcagcggcagactgctgagagaggtgaacgcccccagacagcccctgtacaacatccaggagaagaagatgggcctgcagctgagctag

SEQ ID NO: 22548 - DNA, 1272 bp, Artificial Sequence
  Description of Artificial Sequence: Synthetic coding sequence
atgaagcccaacttcagcctgagactgagaatcttcaacctgaactgctggggcatcccctacctgagcaagcacagagccgacagaatgagaagactgggcgacttcctgaaccaggagagcttcgacctggccctgctggaggaggtgtggagcgagcaggacttccagtacctgagacagaagctgagccccacctaccccgccgcccaccacttcagaagcggcatcatcggcagcggcctgtgcgtgttcagcaagcaccccatccaggagctgacccagcacatctacaccctgaacggctacccctacatgatccaccacggcgactggttcagcggcaaggccgtgggcctgctggtgctgcacctgagcggcatggtgctgaacgcctacgtgacccacctgcacgccgagtacaacagacagaaggacatctacctggcccacagagtggcccaggcctgggagctggcccagttcatccaccacaccagcaagaaggccgacgtggtgctgctgtgcggcgacctgaacatgcaccccgaggacctgggctgctgcctgctgaaggagtggaccggcctgcacgacgcctacctggagaccagagacttcaagggcagcgaggagggcaacaccatggtgcccaagaactgctacgtgagccagcaggagctgaagcccttccccttcggcgtgagaatcgactacgtgctgtacaaggccgtgagcggcttctacatcagctgcaagagcttcgagaccaccaccggcttcgacccccacagaggcacccccctgagcgaccacgaggccctgatggccaccctgttcgtgagacacagccccccccagcagaaccccagcagcacccacggccccgccgagagaagccccctgatgtgcgtgctgaaggaggcctggaccgagctgggcctgggcatggcccaggccagatggtgggccaccttcgccagctacgtgatcggcctgggcctgctgctgctggccctgctgtgcgtgctggccgccggcggcggcgccggcgaggccgccatcctgctgtggacccccagcgtgggcctggtgctgtgggccggcgccttctacctgttccacgtgcaggaggtgaacggcctgtacagagcccaggccgagctgcagcacgtgctgggcagagccagagaggcccaggacctgggccccgagccccagcccgccctgctgctgggccagcaggagggcgacagaaccaaggagcagtag

SEQ ID NO: 22549 - DNA, 846 bp, Artificial Sequence
  Description of Artificial Sequence: Synthetic coding sequence
atgcccgtgcagctgaccaccgccctgagagtggtgggcaccagcctgttcgccctggccgtgctgggcggcatcctggccgcctacgtgaccggctaccagttcatccacaccgagaagcactacctgagcttcggcctgtacggcgccatcctgggcctgcacctgctgatccagagcctgttcgccttcctggagcacagaagaatgagaagagccggccaggccctgaagctgcccagccccagaagaggcagcgtggccctgtgcatcgccgcctaccaggaggaccccgactacctgagaaagtgcctgagaagcgcccagagaatcagcttccccgacctgaaggtggtgatggtggtggacggcaacagacaggaggacgcctacatgctggacatcttccacgaggtgctgggcggcaccgagcaggccggcttcttcgtgtggagaagcaacttccacgaggccggcgagggcgagaccgaggccagcctgcaggagggcatggacagagtgagagacgtggtgagagccagcaccttcagctgcatcatgcagaagtggggcggcaagagagaggtgatgtacaccgccttcaaggccctgggcgacagcgtggactacatccaggtgtgcgacagcgacaccgtgctggaccccgcctgcaccatcgagatgctgagagtgctggaggaggacccccaggtgggcggcgtgggcggcgacgtgcagccccccggcaagggcatggccgtggaggacgaccaggtgcaggccgcccaggtgagagccaccgaggcctggagcgtgcaccagagacacgtgagcagagagcagtag

SEQ ID NO: 22550 - DNA, 2175 bp, Artificial Sequence
  Description of Artificial Sequence: Synthetic coding sequence
atggccggcagaaagcacttctggcagcccagatggtgccccagatggctggagccccccctgctgaccggcgccagagagagctgcggcgtgcagcacagagacggcatcagcagaccctggggccccgtgaaggccagcatccaggagtgcatcctgcccgacagccccctgtaccacaacaaggtgcagttcacccccaccggcggcctgggcctgaacctggccctgaaccccttcgagtactacatcttcttcttcgccctgagcctgatcacccagaagcccctgcccgtgagcctgcacgtgagaaccagcgactgcgcctacttcatcctggtggacagatacctgagctggttcctgcccaccgagggcagcgtgcccccccccctgagcagcagccccggcggcaccagccccagccccccccccagaacccccgccatccccttcgccagctacggcctgcaccacaccagcctgctgaagagacacatcagccaccagaccagcgtgaacgccgaccccgccagccacgagatctggagaagcgagaccctgctgcaggtgttcgtggagatgtggctgcaccactacagcctggagatgtaccagaagatgcagagcccccacgccaaggagagcttcacccccaccgaggagcacgtgctggtggtgagactgctgctgaagcacctgcacgccttcgccaacagcctgaagcccgagcaggccagccccagcgcccacagccacgccaccagccccctggaggagttcaagagagccgccgtgcccagattcgtgcagcagaagctgtacctgttcctgcagcactgcttcggccactggcccctggacgccagcttcagagccgtgctggagatgtggctgagctacctgcagccctggagatacgcccccgacaagcaggcccccggcagcgacagccagcccagatgcgtgagcgagaagtgggcccccttcgtgcaggagaacctgctgatgtacaccaagctgttcgtgggcttcctgaacagagccctgagaaccgacctggtgagccccaagcacgccctgatggtgttcagagtggccaaggtgttcgcccagcccaacctggccgagatgatccagaagggcgagcagctgttcctggagcccgagctggtgatcccccacagacagcacagactgttcaccgcccccaccttcaccggcagcttcctgagcccctggccccccgccgtgaccgacgccagcttcaaggtgaagagccacgtgtacagcctggagggccaggactgcaagtacacccccatgttcggccccgaggccagaaccctggtgctgagactggcccagctgatcacccaggccaagcacaccgccaagagcatcagcgaccagtgcgccgagagccccgccggccacagcttcctgagctggctgggcttcagcagcatggacaccaacggcagctacaccgccaacgacctggacgagatgggccaggacagcgtgagaaagaccgacgagtacctggagaaggccctggagtacctgagacagatcttcagactgagcgaggcccagctgagacagttcaccctggccctgggcaccacccaggacgagaacggcaagaagcagctgcccgactgcatcgtgggcgaggacggcctgatcctgacccccctgggcagataccagatcatcaacggcctgagaagattcgagatcgagtaccagggcgaccccgagctgcagcccatcagaagctacgagatcgccagcctggtgagaaccctgttcagactgagcagcgccatcaaccacagattcgccggccagatggccgccctgtgcagcagagacgacttcctgggcagcttctgcagataccacctgaccgagcccggcctggccagcagacacctgctgagccccgtgggcagaagacaggtggccggccacaccagaggccccagactgagcctgagattcctgggcagctacagaaccctggtgagcctgctgctggccttcttcgtggccagcctgttctgcgtgggccccctgccctgcaccctgctgctgaccctgggctacgtgctgtacgccagcgccatgaccctgctgaccgagagaggcaagctgcaccagccctag

SEQ ID NO: 22551 - DNA, 2514 bp, Artificial Sequence
  Description of Artificial Sequence: Synthetic coding sequence
atgaccaccttcggcgccgtggccgagtggagactgcccagcctgagaagagccaccctgtggatcccccagtggttcgccaagaaggccatcttcaacagccccctggaggccgccatggccttcccccacctgcagcagcccagcttcctgctggccagcctgaaggccgacagcatcaacaagcccttcgcccagcagtgccaggacctggtgaaggtgatcgaggacttccccgccaaggagctgcacaccatcttcccctggctggtggagagcatcttcggcagcctggacggcgtgctggtgggctggaacctgagatgcctgcagggcagagtgaaccccgtggagtacagcatcgtgatggagttcctggaccccggcggccccatgatgaagctggtgtacaagctgcaggccgaggactacaagttcgacttccccgtgagctacctgcccggccccgtgaaggccagcatccaggagtgcatcctgcccgacagccccctgtaccacaacaaggtgcagttcacccccaccggcggcctgggcctgaacctggccctgaaccccttcgagtactacatcttcttcttcgccctgagcctgatcacccagaagcccctgcccgtgagcctgcacgtgagaaccagcgactgcgcctacttcatcctggtggacagatacctgagctggttcctgcccaccgagggcagcgtgcccccccccctgagcagcagccccggcggcaccagccccagccccccccccagaacccccgccatccccttcgccagctacggcctgcaccacaccagcctgctgaagagacacatcagccaccagaccagcgtgaacgccgaccccgccagccacgagatctggagaagcgagaccctgctgcaggtgttcgtggagatgtggctgcaccactacagcctggagatgtaccagaagatgcagagcccccacgccaaggagagcttcacccccaccgaggagcacgtgctggtggtgagactgctgctgaagcacctgcacgccttcgccaacagcctgaagcccgagcaggccagccccagcgcccacagccacgccaccagccccctggaggagttcaagagagccgccgtgcccagattcgtgcagcagaagctgtacctgttcctgcagcactgcttcggccactggcccctggacgccagcttcagagccgtgctggagatgtggctgagctacctgcagccctggagatacgcccccgacaagcaggcccccggcagcgacagccagcccagatgcgtgagcgagaagtgggcccccttcgtgcaggagaacctgctgatgtacaccaagctgttcgtgggcttcctgaacagagccctgagaaccgacctggtgagccccaagcacgccctgatggtgttcagagtggccaaggtgttcgcccagcccaacctggccgagatgatccagaagggcgagcagctgttcctggagcccgagctggtgatcccccacagacagcacagactgttcaccgcccccaccttcaccggcagcttcctgagcccctggccccccgccgtgaccgacgccagcttcaaggtgaagagccacgtgtacagcctggagggccaggactgcaagtacacccccatgttcggccccgaggccagaaccctggtgctgagactggcccagctgatcacccaggccaagcacaccgccaagagcatcagcgaccagtgcgccgagagccccgccggccacagcttcctgagctggctgggcttcagcagcatggacaccaacggcagctacaccgccaacgacctggacgagatgggccaggacagcgtgagaaagaccgacgagtacctggagaaggccctggagtacctgagacagatcttcagactgagcgaggcccagctgagacagttcaccctggccctgggcaccacccaggacgagaacggcaagaagcagctgcccgactgcatcgtgggcgaggacggcctgatcctgacccccctgggcagataccagatcatcaacggcctgagaagattcgagatcgagtaccagggcgaccccgagctgcagcccatcagaagctacgagatcgccagcctggtgagaaccctgttcagactgagcagcgccatcaaccacagattcgccggccagatggccgccctgtgcagcagagacgacttcctgggcagcttctgcagataccacctgaccgagcccggcctggccagcagacacctgctgagccccgtgggcagaagacaggtggccggccacaccagaggccccagactgagcctgagattcctgggcagctacagaaccctggtgagcctgctgctggccttcttcgtggccagcctgttctgcgtgggccccctgccctgcaccctgctgctgaccctgggctacgtgctgtacgccagcgccatgaccctgctgaccgagagaggcaagctgcaccagccctag

SEQ ID NO: 22552 - DNA, 2601 bp, Artificial Sequence
  Description of Artificial Sequence: Synthetic coding sequence
atgaccaccttcggcgccgtggccgagtggagactgcccagcctgagaagagccaccctgtggatcccccagtggttcgccaagaaggccatcttcaacagccccctggaggccgccatggccttcccccacctgcagcagcccagcttcctgctggccagcctgaaggccgacagcatcaacaagcccttcgcccagcagtgccaggacctggtgaaggtgatcgaggacttccccgccaaggagctgcacaccatcttcccctggctggtggagagcatcttcggcagcctggacggcgtgctggtgggctggaacctgagatgcctgcagggcagagtgaaccccgtggagtacagcatcgtgatggagttcctggaccccggcggccccatgatgaagctggtgtacaagctgcaggccgaggactacaagttcgacttccccgtgagctacctgcccggccccgtgaaggccagcatccaggagtgcatcctgcccgacagccccctgtaccacaacaaggtgcagttcacccccaccggcggcctgggcctgaacctggccctgaaccccttcgagtactacatcttcttcttcgccctgagcctgatcacccagaagcccctgcccgtgagcctgcacgtgagaaccagcgactgcgcctacttcatcctggtggacagatacctgagctggttcctgcccaccgagggcagcgtgcccccccccctgagcagcagccccggcggcaccagccccagccccccccccagaacccccgccatccccttcgccagctacggcctgcaccacaccagcctgctgaagagacacatcagccaccagaccagcgtgaacgccgaccccgccagccacgagatctggagaagcgagaccctgctgcaggtgttcgtggagatgtggctgcaccactacagcctggagatgtaccagaagatgcagagcccccacgccaagctggaggtgctgcactacagactgagcgtgagcagcgccctgtacagccccgcccagcccagcctgcaggccctgcacgcctaccaggagagcttcacccccaccgaggagcacgtgctggtggtgagactgctgctgaagcacctgcacgccttcgccaacagcctgaagcccgagcaggccagccccagcgcccacagccacgccaccagccccctggaggagttcaagagagccgccgtgcccagattcgtgcagcagaagctgtacctgttcctgcagcactgcttcggccactggcccctggacgccagcttcagagccgtgctggagatgtggctgagctacctgcagccctggagatacgcccccgacaagcaggcccccggcagcgacagccagcccagatgcgtgagcgagaagtgggcccccttcgtgcaggagaacctgctgatgtacaccaagctgttcgtgggcttcctgaacagagccctgagaaccgacctggtgagccccaagcacgccctgatggtgttcagagtggccaaggtgttcgcccagcccaacctggccgagatgatccagaagggcgagcagctgttcctggagcccgagctggtgatcccccacagacagcacagactgttcaccgcccccaccttcaccggcagcttcctgagcccctggccccccgccgtgaccgacgccagcttcaaggtgaagagccacgtgtacagcctggagggccaggactgcaagtacacccccatgttcggccccgaggccagaaccctggtgctgagactggcccagctgatcacccaggccaagcacaccgccaagagcatcagcgaccagtgcgccgagagccccgccggccacagcttcctgagctggctgggcttcagcagcatggacaccaacggcagctacaccgccaacgacctggacgagatgggccaggacagcgtgagaaagaccgacgagtacctggagaaggccctggagtacctgagacagatcttcagactgagcgaggcccagctgagacagttcaccctggccctgggcaccacccaggacgagaacggcaagaagcagctgcccgactgcatcgtgggcgaggacggcctgatcctgacccccctgggcagataccagatcatcaacggcctgagaagattcgagatcgagtaccagggcgaccccgagctgcagcccatcagaagctacgagatcgccagcctggtgagaaccctgttcagactgagcagcgccatcaaccacagattcgccggccagatggccgccctgtgcagcagagacgacttcctgggcagcttctgcagataccacctgaccgagcccggcctggccagcagacacctgctgagccccgtgggcagaagacaggtggccggccacaccagaggccccagactgagcctgagattcctgggcagctacagaaccctggtgagcctgctgctggccttcttcgtggccagcctgttctgcgtgggccccctgccctgcaccctgctgctgaccctgggctacgtgctgtacgccagcgccatgaccctgctgaccgagagaggcaagctgcaccagccctag

SEQ ID NO: 22553 - DNA, 1509 bp, Artificial Sequence
  Description of Artificial Sequence: Synthetic coding sequence
atgcagacccccccccccaccagaagcggcggccagaagctgtgcagcagattcctgctgaagtgcggcttcatcaccatcccctggagatgcatcaagaagtgcagccccctgatgcccagagccgccgtgcccagattcgtgcagcagaagctgtacctgttcctgcagcactgcttcggccactggcccctggacgccagcttcagagccgtgctggagatgtggctgagctacctgcagccctggagatacgcccccgacaagcaggcccccggcagcgacagccagcccagatgcgtgagcgagaagtgggcccccttcgtgcaggagaacctgctgatgtacaccaagctgttcgtgggcttcctgaacagagccctgagaaccgacctggtgagccccaagcacgccctgatggtgttcagagtggccaaggtgttcgcccagcccaacctggccgagatgatccagaagggcgagcagctgttcctggagcccgagctggtgatcccccacagacagcacagactgttcaccgcccccaccttcaccggcagcttcctgagcccctggccccccgccgtgaccgacgccagcttcaaggtgaagagccacgtgtacagcctggagggccaggactgcaagtacacccccatgttcggccccgaggccagaaccctggtgctgagactggcccagctgatcacccaggccaagcacaccgccaagagcatcagcgaccagtgcgccgagagccccgccggccacagcttcctgagctggctgggcttcagcagcatggacaccaacggcagctacaccgccaacgacctggacgagatgggccaggacagcgtgagaaagaccgacgagtacctggagaaggccctggagtacctgagacagatcttcagactgagcgaggcccagctgagacagttcaccctggccctgggcaccacccaggacgagaacggcaagaagcagctgcccgactgcatcgtgggcgaggacggcctgatcctgacccccctgggcagataccagatcatcaacggcctgagaagattcgagatcgagtaccagggcgaccccgagctgcagcccatcagaagctacgagatcgccagcctggtgagaaccctgttcagactgagcagcgccatcaaccacagattcgccggccagatggccgccctgtgcagcagagacgacttcctgggcagcttctgcagataccacctgaccgagcccggcctggccagcagacacctgctgagccccgtgggcagaagacaggtggccggccacaccagaggccccagactgagcctgagattcctgggcagctacagaaccctggtgagcctgctgctggccttcttcgtggccagcctgttctgcgtgggccccctgccctgcaccctgctgctgaccctgggctacgtgctgtacgccagcgccatgaccctgctgaccgagagaggcaagctgcaccagccctag

SEQ ID NO: 22554 - DNA, 2295 bp, Artificial Sequence
  Description of Artificial Sequence: Synthetic coding sequence
atgaccaccttcggcgccgtggccgagtggagactgcccagcctgagaagagccaccctgtggatcccccagtggttcgccaagaaggccatcttcaacagccccctggaggccgccatggccttcccccacctgcagcagcccagcttcctgctggccagcctgaaggccgacagcatcaacaagcccttcgcccagcagtgccaggacctggtgaaggtgatcgaggacttccccgccaagggccccgtgaaggccagcatccaggagtgcatcctgcccgacagccccctgtaccacaacaaggtgcagttcacccccaccggcggcctgggcctgaacctggccctgaaccccttcgagtactacatcttcttcttcgccctgagcctgatcacccagaagcccctgcccgtgagcctgcacgtgagaaccagcgactgcgcctacttcatcctggtggacagatacctgagctggttcctgcccaccgagggcagcgtgcccccccccctgagcagcagccccggcggcaccagccccagccccccccccagaacccccgccatccccttcgccagctacggcctgcaccacaccagcctgctgaagagacacatcagccaccagaccagcgtgaacgccgaccccgccagccacgagatctggagaagcgagaccctgctgcaggtgttcgtggagatgtggctgcaccactacagcctggagatgtaccagaagatgcagagcccccacgccaaggagagcttcacccccaccgaggagcacgtgctggtggtgagactgctgctgaagcacctgcacgccttcgccaacagcctgaagcccgagcaggccagccccagcgcccacagccacgccaccagccccctggaggagttcaagagagccgccgtgcccagattcgtgcagcagaagctgtacctgttcctgcagcactgcttcggccactggcccctggacgccagcttcagagccgtgctggagatgtggctgagctacctgcagccctggagatacgcccccgacaagcaggcccccggcagcgacagccagcccagatgcgtgagcgagaagtgggcccccttcgtgcaggagaacctgctgatgtacaccaagctgttcgtgggcttcctgaacagagccctgagaaccgacctggtgagccccaagcacgccctgatggtgttcagagtggccaaggtgttcgcccagcccaacctggccgagatgatccagaagggcgagcagctgttcctggagcccgagctggtgatcccccacagacagcacagactgttcaccgcccccaccttcaccggcagcttcctgagcccctggccccccgccgtgaccgacgccagcttcaaggtgaagagccacgtgtacagcctggagggccaggactgcaagtacacccccatgttcggccccgaggccagaaccctggtgctgagactggcccagctgatcacccaggccaagcacaccgccaagagcatcagcgaccagtgcgccgagagccccgccggccacagcttcctgagctggctgggcttcagcagcatggacaccaacggcagctacaccgccaacgacctggacgagatgggccaggacagcgtgagaaagaccgacgagtacctggagaaggccctggagtacctgagacagatcttcagactgagcgaggcccagctgagacagttcaccctggccctgggcaccacccaggacgagaacggcaagaagcagctgcccgactgcatcgtgggcgaggacggcctgatcctgacccccctgggcagataccagatcatcaacggcctgagaagattcgagatcgagtaccagggcgaccccgagctgcagcccatcagaagctacgagatcgccagcctggtgagaaccctgttcagactgagcagcgccatcaaccacagattcgccggccagatggccgccctgtgcagcagagacgacttcctgggcagcttctgcagataccacctgaccgagcccggcctggccagcagacacctgctgagccccgtgggcagaagacaggtggccggccacaccagaggccccagactgagcctgagattcctgggcagctacagaaccctggtgagcctgctgctggccttcttcgtggccagcctgttctgcgtgggccccctgccctgcaccctgctgctgaccctgggctacgtgctgtacgccagcgccatgaccctgctgaccgagagaggcaagctgcaccagccctag

SEQ ID NO: 22555 - DNA, 1593 bp, Artificial Sequence
  Description of Artificial Sequence: Synthetic coding sequence
atgtggctgcaccactacagcctggagatgtaccagaagatgcagagcccccacgccaaggagagcttcacccccaccgaggagcacgtgctggtggtgagactgctgctgaagcacctgcacgccttcgccaacagcctgaagcccgagcaggccagccccagcgcccacagccacgccaccagccccctggaggagttcaagagagccgccgtgcccagattcgtgcagcagaagctgtacctgttcctgcagcactgcttcggccactggcccctggacgccagcttcagagccgtgctggagatgtggctgagctacctgcagccctggagatacgcccccgacaagcaggcccccggcagcgacagccagcccagatgcgtgagcgagaagtgggcccccttcgtgcaggagaacctgctgatgtacaccaagctgttcgtgggcttcctgaacagagccctgagaaccgacctggtgagccccaagcacgccctgatggtgttcagagtggccaaggtgttcgcccagcccaacctggccgagatgatccagaagggcgagcagctgttcctggagcccgagctggtgatcccccacagacagcacagactgttcaccgcccccaccttcaccggcagcttcctgagcccctggccccccgccgtgaccgacgccagcttcaaggtgaagagccacgtgtacagcctggagggccaggactgcaagtacacccccatgttcggccccgaggccagaaccctggtgctgagactggcccagctgatcacccaggccaagcacaccgccaagagcatcagcgaccagtgcgccgagagccccgccggccacagcttcctgagctggctgggcttcagcagcatggacaccaacggcagctacaccgccaacgacctggacgagatgggccaggacagcgtgagaaagaccgacgagtacctggagaaggccctggagtacctgagacagatcttcagactgagcgaggcccagctgagacagttcaccctggccctgggcaccacccaggacgagaacggcaagaagcagctgcccgactgcatcgtgggcgaggacggcctgatcctgacccccctgggcagataccagatcatcaacggcctgagaagattcgagatcgagtaccagggcgaccccgagctgcagcccatcagaagctacgagatcgccagcctggtgagaaccctgttcagactgagcagcgccatcaaccacagattcgccggccagatggccgccctgtgcagcagagacgacttcctgggcagcttctgcagataccacctgaccgagcccggcctggccagcagacacctgctgagccccgtgggcagaagacaggtggccggccacaccagaggccccagactgagcctgagattcctgggcagctacagaaccctggtgagcctgctgctggccttcttcgtggccagcctgttctgcgtgggccccctgccctgcaccctgctgctgaccctgggctacgtgctgtacgccagcgccatgaccctgctgaccgagagaggcaagctgcaccagccctag

SEQ ID NO: 22556 - DNA, 1824 bp, Artificial Sequence
  Description of Artificial Sequence: Synthetic coding sequence
atgcagacccccccccccaccagaagcggcggccagaagctgtgcagcagattcctgctgaagtgcggcttcatcaccatcccctggagatgcatcaagaagtgcagccccctgatgcccagctggagattctgcaccaccgacagcgtgagccccgcccccagcaccgccccccccaaccccgccagcagacccagcacccccaccaagagcctgggcaacagaggcagcgacgccagaggcttctactgggccgagttcagcagcggctgcgtgcaggacgaggagcaggagagcttcacccccaccgaggagcacgtgctggtggtgagactgctgctgaagcacctgcacgccttcgccaacagcctgaagcccgagcaggccagccccagcgcccacagccacgccaccagccccctggaggagttcaagagagccgccgtgcccagattcgtgcagcagaagctgtacctgttcctgcagcactgcttcggccactggcccctggacgccagcttcagagccgtgctggagatgtggctgagctacctgcagccctggagatacgcccccgacaagcaggcccccggcagcgacagccagcccagatgcgtgagcgagaagtgggcccccttcgtgcaggagaacctgctgatgtacaccaagctgttcgtgggcttcctgaacagagccctgagaaccgacctggtgagccccaagcacgccctgatggtgttcagagtggccaaggtgttcgcccagcccaacctggccgagatgatccagaagggcgagcagctgttcctggagcccgagctggtgatcccccacagacagcacagactgttcaccgcccccaccttcaccggcagcttcctgagcccctggccccccgccgtgaccgacgccagcttcaaggtgaagagccacgtgtacagcctggagggccaggactgcaagtacacccccatgttcggccccgaggccagaaccctggtgctgagactggcccagctgatcacccaggccaagcacaccgccaagagcatcagcgaccagtgcgccgagagccccgccggccacagcttcctgagctggctgggcttcagcagcatggacaccaacggcagctacaccgccaacgacctggacgagatgggccaggacagcgtgagaaagaccgacgagtacctggagaaggccctggagtacctgagacagatcttcagactgagcgaggcccagctgagacagttcaccctggccctgggcaccacccaggacgagaacggcaagaagcagctgcccgactgcatcgtgggcgaggacggcctgatcctgacccccctgggcagataccagatcatcaacggcctgagaagattcgagatcgagtaccagggcgaccccgagctgcagcccatcagaagctacgagatcgccagcctggtgagaaccctgttcagactgagcagcgccatcaaccacagattcgccggccagatggccgccctgtgcagcagagacgacttcctgggcagcttctgcagataccacctgaccgagcccggcctggccagcagacacctgctgagccccgtgggcagaagacaggtggccggccacaccagaggccccagactgagcctgagattcctgggcagctacagaaccctggtgagcctgctgctggccttcttcgtggccagcctgttctgcgtgggccccctgccctgcaccctgctgctgaccctgggctacgtgctgtacgccagcgccatgaccctgctgaccgagagaggcaagctgcaccagccctag

SEQ ID NO: 22557 - DNA, 1848 bp, Artificial Sequence
  Description of Artificial Sequence: Synthetic coding sequence
atgaccaccttcggcgccgtggccgagtggagactgcccagcctgagaagagccaccctgtggatcccccagtggttcgccaagaaggccatcttcaacagccccctggaggccgccatggccttcccccacctgcagcagcccagcttcctgctggccagcctgaaggccgacagcatcaacaagcccttcgcccagcagtgccaggacctggtgaaggtgatcgaggacttccccgccaaggtgttcgtggagatgtggctgcaccactacagcctggagatgtaccagaagatgcagagcccccacgccaaggagagcttcacccccaccgaggagcacgtgctggtggtgagactgctgctgaagcacctgcacgccttcgccaacagcctgaagcccgagcaggccagccccagcgcccacagccacgccaccagccccctggaggagttcaagagagccgccgtgcccagattcgtgcagcagaagctgtacctgttcctgcagcactgcttcggccactggcccctggacgccagcttcagagccgtgctggagatgtggctgagctacctgcagccctggagatacgcccccgacaagcaggcccccggcagcgacagccagcccagatgcgtgagcgagaagtgggcccccttcgtgcaggagaacctgctgatgtacaccaagctgttcgtgggcttcctgaacagagccctgagaaccgacctggtgagccccaagcacgccctgatggtgttcagagtggccaaggtgttcgcccagcccaacctggccgagatgatccagaagggcgagcagctgttcctggagcccgagctggtgatcccccacagacagcacagactgttcaccgcccccaccttcaccggcagcttcctgagcccctggccccccgccgtgaccgacgccagcttcaaggtgaagagccacgtgtacagcctggagggccaggactgcaagtacacccccatgttcggccccgaggccagaaccctggtgctgagactggcccagctgatcacccaggccaagcacaccgccaagagcatcagcgaccagtgcgccgagagccccgccggccacagcttcctgagctggctgggcttcagcagcatggacaccaacggcagctacaccgccaacgacctggacgagatgggccaggacagcgtgagaaagaccgacgagtacctggagaaggccctggagtacctgagacagatcttcagactgagcgaggcccagctgagacagttcaccctggccctgggcaccacccaggacgagaacggcaagaagcagctgcccgactgcatcgtgggcgaggacggcctgatcctgacccccctgggcagataccagatcatcaacggcctgagaagattcgagatcgagtaccagggcgaccccgagctgcagcccatcagaagctacgagatcgccagcctggtgagaaccctgttcagactgagcagcgccatcaaccacagattcgccggccagatggccgccctgtgcagcagagacgacttcctgggcagcttctgcagataccacctgaccgagcccggcctggccagcagacacctgctgagccccgtgggcagaagacaggtggccggccacaccagaggccccagactgagcctgagattcctgggcagctacagaaccctggtgagcctgctgctggccttcttcgtggccagcctgttctgcgtgggccccctgccctgcaccctgctgctgaccctgggctacgtgctgtacgccagcgccatgaccctgctgaccgagagaggcaagctgcaccagccctag

SEQ ID NO: 22558 - DNA, 609 bp, Artificial Sequence
  Description of Artificial Sequence: Synthetic coding sequence
atcctggaggtgtacagcaccaaggccaagaactacgtgaacggccactgcaccaagtacgagccctggcagctgatcgcctggagcgtggtgtggaccctgctgatcgtgtggggctacgagttcgtgttccagcccgagagcctgtggagcagattcaagaagaagtgcttcaagctgaccagaaagatgcccatcatcggcagaaagatccaggacaagctgaacaagaccaaggacgacatcagcaagaacatgagcttcctgaaggtggacaaggagtacgtgaaggccctgcccagccagggcctgagcagcagcgccgtgctggagaagctgaaggagtacagcagcatggacgccttctggcaggagggcagagccagcggcaccgtgtacagcggcgaggagaagctgaccgagctgctggtgaaggcctacggcgacttcgcctggagcaaccccctgcaccccgacatcttccccggcctgagaaagatcgaggccgagatcgtgagaatcgcctgcagcctgttcaacggcggccccgacagctgcggctgcgaggccctgttcctgttctgcttcagcaacatgctggccccctag

SEQ ID NO: 22559 - DNA, 1707 bp, Artificial Sequence
  Description of Artificial Sequence: Synthetic coding sequence
atgcccagcaccgacctgctgatgctgaaggccttcgagccctacctggagatcctggaggtgtacagcaccaaggccaagaactacgtgaacggccactgcaccaagtacgagccctggcagctgatcgcctggagcgtggtgtggaccctgctgatcgtgtggggctacgagttcgtgttccagcccgagagcctgtggagcagattcaagaagaagtgcttcaagctgaccagaaagatgcccatcatcggcagaaagatccaggacaagctgaacaagaccaaggacgacatcagcaagaacatgagcttcctgaaggtggacaaggagtacgtgaaggccctgcccagccagggcctgagcagcagcgccgtgctggagaagctgaaggagtacagcagcatggacgccttctggcaggagggcagagccagcggcaccgtgtacagcggcgaggagaagctgaccgagctgctggtgaaggcctacggcgacttcgcctggagcaaccccctgcaccccgacatcttccccggcctgagaaagatcgaggccgagatcgtgagaatcgcctgcagcctgttcaacggcggccccgacagctgcggctgcgtgaccagcggcggcaccgagagcatcctgatggcctgcaaggcctacagagacctggccttcgagaagggcatcaagacccccgagatcgtggccccccagagcgcccacgccgccttcaacaaggccgccagctacttcggcatgaagatcgtgagagtgcccctgaccaagatgatggaggtggacgtgagagccatgagaagagccatcagcagaaacaccgccatgctggtgtgcagcaccccccagttcccccacggcgtgatcgaccccgtgcccgaggtggccaagctggccgtgaagtacaagatccccctgcacgtggacgcctgcctgggcggcttcctgatcgtgttcatggagaaggccggctaccccctggagcaccccttcgacttcagagtgaagggcgtgaccagcatcagcgccgacacccacaagtacggctacgcccccaagggcagcagcctggtgctgtacagcgacaagaagtacagaaactaccagttcttcgtggacaccgactggcagggcggcatctacgccagccccaccatcgccggcagcagacccggcggcatcagcgccgcctgctgggccgccctgatgcacttcggcgagaacggctacgtggaggccaccaagcagatcatcaagaccgccagattcctgaagagcgagctggagaacatcaagggcatcttcgtgttcggcaacccccagctgagcgtgatcgccctgggcagcagagacttcgacatctacagactgagcaacctgatgaccgccaagggctggaacctgaaccagctgcagttcccccccagcatccacttctgcatcaccctgctgcacgccagaaagagagtggccatccagttcctgaaggacatcagagagagcgtgacccagatcatgaagaaccccaaggccaagaccaccggcatgggcgccatctacggcatggcccagaccaccgtggacagaaacatggtggccgagctgagcagcgtgttcctggacagcctgtacagcaccgacaccgtgacccagggcagccagatgaacggcagccccaagccccactag

SEQ ID NO: 22560 - DNA, 408 bp, Artificial Sequence
  Description of Artificial Sequence: Synthetic coding sequence
tgaatccaggacaagctgaacaagaccaaggacgacatcagcaagaacatgagcttcctgaaggtggacaaggagtacgtgaaggccctgcccagccagggcctgagcagcagcgccgtgctggagaagctgaaggagtacagcagcatggacgccttctggcaggagggcagagccagcggcaccgtgtacagcggcgaggagaagctgaccgagctgctggtgaaggcctacggcgacttcgcctggagcaaccccctgcaccccgacatcttccccggcctgagaaagatcgaggccgagatcgtgagaatcgcctgcagcctgttcaacggcggccccgacagctgcggctgcgtgagcatctgcaagggccaccccatcgccctgttcttcagactgaagtag

SEQ ID NO: 22561 - DNA, 1638 bp, Artificial Sequence
  Description of Artificial Sequence: Synthetic coding sequence
atggagaccgagctgtgcgccgcccacctgcccaccgagagcgacgcccccaaccactaccaggccgtgtgcagagccctgttcgccgagaccatggagctgcacaccttcctgaccaagatcaagagcgccaaggagaacctgaagaagatccaggagatggagaagagcgacgagagcagcaccgacctggaggagctgaagaacgccgactgggccagattctgggtgcaggtgatgagagacctgagaaacggcgtgaagctgaagaaggtgcaggagagacagtacaaccccctgcccatcgagtaccagctgaccccctacgagatgctgatggacgacatcagatgcaagagatacaccctgagaaaggtgatggtgaacggcgacatcccccccagactgaagaagagcgcccacgagatcatcctggacttcatcagaagcagaccccccctgaaccccgtgagcgccagaaagctgaagcccaccccccccagacccagaagcctgcacgagagaatcctggaggagatcaaggccgagagaaagctgagacccgtgagccccgaggagatcagaagaagcagactggacgtgaccacccccgagagcaccaagaacctggtggagagcagcatggtgaacggcggcctgaccagccagaccaaggagaacggcctgagcaccagccagcaggtgcccgcccagagaaagaagctgctgagagcccccaccctggccgagctggacagcagcgagagcgaggaggagaccctgcacaagagcaccagcagcagcagcgtgagccccagcttccccgaggagcccgtgctggaggccgtgagcaccagaaagaagccccccaagttcctgcccatcagcagcaccccccagcccgagagaagacagcccccccagagaagacacagcatcgagaaggagacccccaccaacgtgagacagttcctgccccccagcagacagagcagcagaagcctggaggagttctgctaccccgtggagtgcctggccctgaccgtggaggaggtgatgcacatcagacaggtgctggtgaaggccgagctggagaagtaccagcagtacaaggacatctacaccgccctgaagaagggcaagctgtgcttctgctgcagaaccagaagattcagcttcttcacctggagctacacctgccagttctgcaagagacccgtgtgcagccagtgctgcaagaagatgagactgcccagcaagccctacagcaccctgcccatcttcagcctgggccccagcgccctgcagagaggcgagagcagcatgagaagcgagaagcccagcaccgcccaccacagacccctgagaagcatcgccagattcagcagcaagagcaagagcatggacaagagcgacgaggagctgcagttccccaaggagctgatggaggactggagcaccatggaggtgtgcgtggactgcaagaagttcatcagcgagatcatcagcagcagcagaagaagcctggtgctggccaacaagagagccagactgaagagaaagacccagagcttctacatgagcagccccggccccagcgagtactgccccagcgagagaaccatcagcgagatctag

SEQ ID NO: 22562 - DNA, 1377 bp, Artificial Sequence
  Description of Artificial Sequence: Synthetic coding sequence
atggccaacaccgtggaggccgacggcagcaacgacgagggctacgaggccgccgaggagggcctgggcgacgaggacgagaagagaaagatcagcgccatcagaagctacagagacgtgatgaagctgtgcgccgcccacctgcccaccgagagcgacgcccccaaccactaccaggccgtgtgcagagccctgttcgccgagaccatggagctgcacaccttcctgaccaagatcaagagcgccaaggagaacctgaagaagatccaggagatggagaagagcgacgagagcagcaccgacctggaggagctgaagaacgccgactgggccagattctgggtgcaggtgatgagagacctgagaaacggcgtgaagctgaagaaggtgcaggagagacagtacaaccccctgcccatcgagtaccagctgaccccctacgagatgctgatggacgacatcagatgcaagagatacaccctgagaaaggtgatggtgaacggcgacatcccccccagactgaagaagagcgcccacgagatcatcctggacttcatcagaagcagaccccccctgaaccccgtgagcgccagaaagctgaagcccaccccccccagacccagaagcctgcacgagagaatcctggaggagatcaaggccgagagaaagctgagacccgtgagccccgaggagatcagaagaagcagactggacgtgaccacccccgagagcaccaagaacctggtggagagcagcatggtgaacggcggcctgaccagccagaccaaggagaacggcctgagcaccagccagcaggtgcccgcccagagaaagaagctgctgagagcccccaccctggccgagctggacagcagcgagagcgaggaggagaccctgcacaagagcaccagcagcagcagcgtgagccccagcttccccgaggagcccgtgctggaggccgtgagcaccagaaagaagccccccaagttcctgcccatcagcagcaccccccagcccgagagaagacagcccccccagagaagacacagcatcgagaaggagacccccaccaacgtgagacagttcctgccccccagcagacagagcagcagaagcctggaggagttctgctaccccgtggagtgcctggccctgaccgtggaggaggtgatgcacatcagacaggtgctggtgaaggccgagctggagaagtaccagcagtacaaggacatctacaccgccctgaagaagggcaagctgtgcttctgctgcagaaccagaagattcagcttcttcacctggagctacacctgccagttctgcaagagcgactgcctgttcaacggcaccgcccactgccagttctacctgggctag

SEQ ID NO: 22563 - DNA, 2271 bp, Artificial Sequence
  Description of Artificial Sequence: Synthetic coding sequence
atggcccaggccgccggccccgccggcggcggcgagcccagaaccgaggccgtgggcggcgagggccccagagagcccggcgccgccggcggcgccgccggcggcagcagagacgccctgagcctggaggagatcctgagactgtacaaccagcccatcaacgaggagcaggcctgggccgtgtgctaccagtgctgcggcagcctgagagccgccgccagaagaagacagcccagacacagagtgagaagcgccgcccagatcagagtgtggagagacggcgccgtgaccctggcccccgccgccgacgacgccggcgagcccccccccgtggccggcaagctgggctacagccagtgcatggagaccgaggtgatcgagagcctgggcatcatcatctacaaggccctggactacggcctgaaggagaacgaggagagagagctgagcccccccctggagcagctgatcgaccacatggccaacaccgtggaggccgacggcagcaacgacgagggctacgaggccgccgaggagggcctgggcgacgaggacgagaagagaaagatcagcgccatcagaagctacagagacgtgatgaagctgtgcgccgcccacctgcccaccgagagcgacgcccccaaccactaccaggccgtgtgcagagccctgttcgccgagaccatggagctgcacaccttcctgaccaagatcaagagcgccaaggagaacctgaagaagatccaggagatggagaagagcgacgagagcagcaccgacctggaggagctgaagaacgccgactgggccagattctgggtgcaggtgatgagagacctgagaaacggcgtgaagctgaagaaggtgcaggagagacagtacaaccccctgcccatcgagtaccagctgaccccctacgagatgctgatggacgacatcagatgcaagagatacaccctgagaaaggtgatggtgaacggcgacatcccccccagactgaagaagagcgcccacgagatcatcctggacttcatcagaagcagaccccccctgaaccccgtgagcgccagaaagctgaagcccaccccccccagacccagaagcctgcacgagagaatcctggaggagatcaaggccgagagaaagctgagacccgtgagccccgaggagatcagaagaagcagactggccatgagacccctgagcatgagctacagcttcgacctgagcgacgtgaccacccccgagagcaccaagaacctggtggagagcagcatggtgaacggcggcctgaccagccagaccaaggagaacggcctgagcaccagccagcaggtgcccgcccagagaaagaagctgctgagagcccccaccctggccgagctggacagcagcgagagcgaggaggagaccctgcacaagagcaccagcagcagcagcgtgagccccagcttccccgaggagcccgtgctggaggccgtgagcaccagaaagaagccccccaagttcctgcccatcagcagcaccccccagcccgagagaagacagcccccccagagaagacacagcatcgagaaggagacccccaccaacgtgagacagttcctgccccccagcagacagagcagcagaagcctggaggagttctgctaccccgtggagtgcctggccctgaccgtggaggaggtgatgcacatcagacaggtgctggtgaaggccgagctggagaagtaccagcagtacaaggacatctacaccgccctgaagaagggcaagctgtgcttctgctgcagaaccagaagattcagcttcttcacctggagctacacctgccagttctgcaagagacccgtgtgcagccagtgctgcaagaagatgagactgcccagcaagccctacagcaccctgcccatcttcagcctgggccccagcgccctgcagagaggcgagagcagcatgagaagcgagaagcccagcaccgcccaccacagacccctgagaagcatcgccagattcagcagcaagagcaagagcatggacaagagcgacgaggagctgcagttccccaaggagctgatggaggactggagcaccatggaggtgtgcgtggactgcaagaagttcatcagcgagatcatcagcagcagcagaagaagcctggtgctggccaacaagagagccagactgaagagaaagacccagagcttctacatgagcagccccggccccagcgagtactgccccagcgagagaaccatcagcgagatctag

SEQ ID NO: 22564 - DNA, 2229 bp, Artificial Sequence
  Description of Artificial Sequence: Synthetic coding sequence
atggcccaggccgccggccccgccggcggcggcgagcccagaaccgaggccgtgggcggcgagggccccagagagcccggcgccgccggcggcgccgccggcggcagcagagacgccctgagcctggaggagatcctgagactgtacaaccagcccatcaacgaggagcaggcctgggccgtgtgctaccagtgctgcggcagcctgagagccgccgccagaagaagacagcccagacacagagtgagaagcgccgcccagatcagagtgtggagagacggcgccgtgaccctggcccccgccgccgacgacgccggcgagcccccccccgtggccggcaagctgggctacagccagtgcatggagaccgaggtgatcgagagcctgggcatcatcatctacaaggccctggactacggcctgaaggagaacgaggagagagagctgagcccccccctggagcagctgatcgaccacatggccaacaccgtggaggccgacggcagcaacgacgagggctacgaggccgccgaggagggcctgggcgacgaggacgagaagagaaagatcagcgccatcagaagctacagagacgtgatgaagctgtgcgccgcccacctgcccaccgagagcgacgcccccaaccactaccaggccgtgtgcagagccctgttcgccgagaccatggagctgcacaccttcctgaccaagatcaagagcgccaaggagaacctgaagaagatccaggagatggagaagagcgacgagagcagcaccgacctggaggagctgaagaacgccgactgggccagattctgggtgcaggtgatgagagacctgagaaacggcgtgaagctgaagaaggtgcaggagagacagtacaaccccctgcccatcgagtaccagctgaccccctacgagatgctgatggacgacatcagatgcaagagatacaccctgagaaaggtgatggtgaacggcgacatcccccccagactgaagaagagcgcccacgagatcatcctggacttcatcagaagcagaccccccctgaaccccgtgagcgccagaaagctgaagcccaccccccccagacccagaagcctgcacgagagaatcctggaggagatcaaggccgagagaaagctgagacccgtgagccccgaggagatcagaagaagcagactggacgtgaccacccccgagagcaccaagaacctggtggagagcagcatggtgaacggcggcctgaccagccagaccaaggagaacggcctgagcaccagccagcaggtgcccgcccagagaaagaagctgctgagagcccccaccctggccgagctggacagcagcgagagcgaggaggagaccctgcacaagagcaccagcagcagcagcgtgagccccagcttccccgaggagcccgtgctggaggccgtgagcaccagaaagaagccccccaagttcctgcccatcagcagcaccccccagcccgagagaagacagcccccccagagaagacacagcatcgagaaggagacccccaccaacgtgagacagttcctgccccccagcagacagagcagcagaagcctggaggagttctgctaccccgtggagtgcctggccctgaccgtggaggaggtgatgcacatcagacaggtgctggtgaaggccgagctggagaagtaccagcagtacaaggacatctacaccgccctgaagaagggcaagctgtgcttctgctgcagaaccagaagattcagcttcttcacctggagctacacctgccagttctgcaagagacccgtgtgcagccagtgctgcaagaagatgagactgcccagcaagccctacagcaccctgcccatcttcagcctgggccccagcgccctgcagagaggcgagagcagcatgagaagcgagaagcccagcaccgcccaccacagacccctgagaagcatcgccagattcagcagcaagagcaagagcatggacaagagcgacgaggagctgcagttccccaaggagctgatggaggactggagcaccatggaggtgtgcgtggactgcaagaagttcatcagcgagatcatcagcagcagcagaagaagcctggtgctggccaacaagagagccagactgaagagaaagacccagagcttctacatgagcagccccggccccagcgagtactgccccagcgagagaaccatcagcgagatctag

SEQ ID NO: 22565 - DNA, 1869 bp, Artificial Sequence
  Description of Artificial Sequence: Synthetic coding sequence
atggagaccgaggtgatcgagagcctgggcatcatcatctacaaggccctggactacggcctgaaggagaacgaggagagagagctgagcccccccctggagcagctgatcgaccacatggccaacaccgtggaggccgacggcagcaacgacgagggctacgaggccgccgaggagggcctgggcgacgaggacgagaagagaaagatcagcgccatcagaagctacagagacgtgatgaagctgtgcgccgcccacctgcccaccgagagcgacgcccccaaccactaccaggccgtgtgcagagccctgttcgccgagaccatggagctgcacaccttcctgaccaagatcaagagcgccaaggagaacctgaagaagatccaggagatggagaagagcgacgagagcagcaccgacctggaggagctgaagaacgccgactgggccagattctgggtgcaggtgatgagagacctgagaaacggcgtgaagctgaagaaggtgcaggagagacagtacaaccccctgcccatcgagtaccagctgaccccctacgagatgctgatggacgacatcagatgcaagagatacaccctgagaaaggtgatggtgaacggcgacatcccccccagactgaagaagagcgcccacgagatcatcctggacttcatcagaagcagaccccccctgaaccccgtgagcgccagaaagctgaagcccaccccccccagacccagaagcctgcacgagagaatcctggaggagatcaaggccgagagaaagctgagacccgtgagccccgaggagatcagaagaagcagactggacgtgaccacccccgagagcaccaagaacctggtggagagcagcatggtgaacggcggcctgaccagccagaccaaggagaacggcctgagcaccagccagcaggtgcccgcccagagaaagaagctgctgagagcccccaccctggccgagctggacagcagcgagagcgaggaggagaccctgcacaagagcaccagcagcagcagcgtgagccccagcttccccgaggagcccgtgctggaggccgtgagcaccagaaagaagccccccaagttcctgcccatcagcagcaccccccagcccgagagaagacagcccccccagagaagacacagcatcgagaaggagacccccaccaacgtgagacagttcctgccccccagcagacagagcagcagaagcctggaggagttctgctaccccgtggagtgcctggccctgaccgtggaggaggtgatgcacatcagacaggtgctggtgaaggccgagctggagaagtaccagcagtacaaggacatctacaccgccctgaagaagggcaagctgtgcttctgctgcagaaccagaagattcagcttcttcacctggagctacacctgccagttctgcaagagacccgtgtgcagccagtgctgcaagaagatgagactgcccagcaagccctacagcaccctgcccatcttcagcctgggccccagcgccctgcagagaggcgagagcagcatgagaagcgagaagcccagcaccgcccaccacagacccctgagaagcatcgccagattcagcagcaagagcaagagcatggacaagagcgacgaggagctgcagttccccaaggagctgatggaggactggagcaccatggaggtgtgcgtggactgcaagaagttcatcagcgagatcatcagcagcagcagaagaagcctggtgctggccaacaagagagccagactgaagagaaagacccagagcttctacatgagcagccccggccccagcgagtactgccccagcgagagaaccatcagcgagatctag

SEQ ID NO: 22566 - DNA, 624 bp, Artificial Sequence
  Description of Artificial Sequence: Synthetic coding sequence
atggccctgctgttcgccagaagcctgagactgtgcagatggggcgccaagagactgggcgtggccagcaccgaggcccagagaggcgtgagcttcaagctggaggagaagaccgcccacagcagcctggccctgttcagagacgacatgggcgtgaagtacggcctggtgggcctggagcccaccaaggtggccctgaacgtggagagattcagagagtgggccgtggtgctggccgacaccgccgtgaccagcggcagacactactgggaggtgaccgtgaagagaagccagcagttcagaatcggcgtggccgacgtggacatgagcagagacagctgcatcggcgtggacgacagaagctgggtgttcacctacgcccagagaaagtggtacaccatgctggccaacgagaaggcccccgtggagggcatcggccagcccgagaaggtgggcctgctgctggagtacgaggcccagaagctgagcctggtggacgtgagccaggtgagcgtggtgcacaccctgcagaccgacttcagaggccccgtggtgcccgccttcgccctgtgggacggcgagctgctgacccacagcggcctggaggtgcccgagggcctgtag

SEQ ID NO: 22567 - DNA, 390 bp, Artificial Sequence
  Description of Artificial Sequence: Synthetic coding sequence
atgtggagcgccagcggcagcggcagacactactgggaggtgaccgtgaagagaagccagcagttcagaatcggcgtggccgacgtggacatgagcagagacagctgcatcggcgtggacgacagaagctgggtgttcacctacgcccagagaaagtggtacaccatgctggccaacgagaaggcccccgtggagggcatcggccagcccgagaaggtgggcctgctgctggagtacgaggcccagaagctgagcctggtggacgtgagccaggtgagcgtggtgcacaccctgcagaccgacttcagaggccccgtggtgcccgccttcgccctgtgggacggcgagctgctgacccacagcggcctggaggtgcccgagggcctgtag

SEQ ID NO: 22568 - DNA, 1257 bp, Artificial Sequence
  Description of Artificial Sequence: Synthetic coding sequence
atgagaaccaaggccgccggctgcgccgagagaagacccctgcagcccagaaccgaggccgccgccgcccccgccggcagagccatgcccagcgagtacacctacgtgaagctgagaagcgactgcagcagacccagcctgcagtggtacaccagagcccagagcaagatgagaagacccagcctgctgctgaaggacatcctgaagtgcaccctgctggtgttcggcgtgtggatcctgtacatcctgaagctgaactacaccaccgaggagtgcgacatgaagaagatgcactacgtggaccccgaccacgtgaagagagcccagaagtacgcccagcaggtgctgcagaaggagtgcagacccaagttcgccaagaccagcatggccctgctgttcgagcacagatacagcgtggacctgctgcccttcgtgcagaaggcccccaaggacagcgaggccgagagcaagtacgacccccccttcggcttcagaaagttcagcagcaaggtgcagaccctgctggagctgctgcccgagcacgacctgcccgagcacctgaaggccaagacctgcagaagatgcgtggtgatcggcagcggcggcatcctgcacggcctggagctgggccacaccctgaaccagttcgacgtggtgatcagactgaacagcgcccccgtggagggctacagcgagcacgtgggcaacaagaccaccatcagaatgacctaccccgagggcgcccccctgagcgacctggagtactacagcaacgacctgttcgtggccgtgctgttcaagagcgtggacttcaactggctgcaggccatggtgaagaaggagaccctgcccttctgggtgagactgttcttctggaagcaggtggccgagaagatccccctgcagcccaagcacttcagaatcctgaaccccgtgatcatcaaggagaccgccttcgacatcctgcagtacagcgagccccagagcagattctggggcagagacaagaacgtgcccaccatcggcgtgatcgccgtggtgctggccacccacctgtgcgacgaggtgagcctggccggcttcggctacgacctgaaccagcccagaacccccctgcactacttcgacagccagtgcatggccgccatgaacttccagaccatgcacaacgtgaccaccgagaccaagttcctgctgaagctggtgaaggagggcgtggtgaaggacctgagcggcggcatcgacagagagttctag

SEQ ID NO: 22569 - DNA, 372 bp, Artificial Sequence
  Description of Artificial Sequence: Synthetic coding sequence
atgtacgagatcgccgcccccaacgtggccttcatgaccctgagaagcatgtgcaacaccagcaagatggtgacctgcgccaagatcttcttctacttcctggtgttcttcagcctgagccagaacgtgcccaccatcggcgtgatcgccgtggtgctggccacccacctgtgcgacgaggtgagcctggccggcttcggctacgacctgaaccagcccagaacccccctgcactacttcgacagccagtgcatggccgccatgaacttccagaccatgcacaacgtgaccaccgagaccaagttcctgctgaagctggtgaaggagggcgtggtgaaggacctgagcggcggcatcgacagagagttctag

SEQ ID NO: 22570 - DNA, 1173 bp, Artificial Sequence
  Description of Artificial Sequence: Synthetic coding sequence
atgcccagcgagtacacctacgtgaagctgagaagcgactgcagcagacccagcctgcagtggtacaccagagcccagagcaagatgagaagacccagcctgctgctgaaggacatcctgaagtgcaccctgctggtgttcggcgtgtggatcctgtacatcctgaagctgaactacaccaccgaggagtgcgacatgaagaagatgcactacgtggaccccgaccacgtgaagagagcccagaagtacgcccagcaggtgctgcagaaggagtgcagacccaagttcgccaagaccagcatggccctgctgttcgagcacagatacagcgtggacctgctgcccttcgtgcagaaggcccccaaggacagcgaggccgagagcaagtacgacccccccttcggcttcagaaagttcagcagcaaggtgcagaccctgctggagctgctgcccgagcacgacctgcccgagcacctgaaggccaagacctgcagaagatgcgtggtgatcggcagcggcggcatcctgcacggcctggagctgggccacaccctgaaccagttcgacgtggtgatcagactgaacagcgcccccgtggagggctacagcgagcacgtgggcaacaagaccaccatcagaatgacctaccccgagggcgcccccctgagcgacctggagtactacagcaacgacctgttcgtggccgtgctgttcaagagcgtggacttcaactggctgcaggccatggtgaagaaggagaccctgcccttctgggtgagactgttcttctggaagcaggtggccgagaagatccccctgcagcccaagcacttcagaatcctgaaccccgtgatcatcaaggagaccgccttcgacatcctgcagtacagcgagccccagagcagattctggggcagagacaagaacgtgcccaccatcggcgtgatcgccgtggtgctggccacccacctgtgcgacgaggtgagcctggccggcttcggctacgacctgaaccagcccagaacccccctgcactacttcgacagccagtgcatggccgccatgaacttccagaccatgcacaacgtgaccaccgagaccaagttcctgctgaagctggtgaaggagggcgtggtgaaggacctgagcggcggcatcgacagagagttctag

SEQ ID NO: 22571 - DNA, 1188 bp, Artificial Sequence
  Description of Artificial Sequence: Synthetic coding sequence
atggccagcgtgcccatgcccagcgagtacacctacgtgaagctgagaagcgactgcagcagacccagcctgcagtggtacaccagagcccagagcaagatgagaagacccagcctgctgctgaaggacatcctgaagtgcaccctgctggtgttcggcgtgtggatcctgtacatcctgaagctgaactacaccaccgaggagtgcgacatgaagaagatgcactacgtggaccccgaccacgtgaagagagcccagaagtacgcccagcaggtgctgcagaaggagtgcagacccaagttcgccaagaccagcatggccctgctgttcgagcacagatacagcgtggacctgctgcccttcgtgcagaaggcccccaaggacagcgaggccgagagcaagtacgacccccccttcggcttcagaaagttcagcagcaaggtgcagaccctgctggagctgctgcccgagcacgacctgcccgagcacctgaaggccaagacctgcagaagatgcgtggtgatcggcagcggcggcatcctgcacggcctggagctgggccacaccctgaaccagttcgacgtggtgatcagactgaacagcgcccccgtggagggctacagcgagcacgtgggcaacaagaccaccatcagaatgacctaccccgagggcgcccccctgagcgacctggagtactacagcaacgacctgttcgtggccgtgctgttcaagagcgtggacttcaactggctgcaggccatggtgaagaaggagaccctgcccttctgggtgagactgttcttctggaagcaggtggccgagaagatccccctgcagcccaagcacttcagaatcctgaaccccgtgatcatcaaggagaccgccttcgacatcctgcagtacagcgagccccagagcagattctggggcagagacaagaacgtgcccaccatcggcgtgatcgccgtggtgctggccacccacctgtgcgacgaggtgagcctggccggcttcggctacgacctgaaccagcccagaacccccctgcactacttcgacagccagtgcatggccgccatgaacttccagaccatgcacaacgtgaccaccgagaccaagttcctgctgaagctggtgaaggagggcgtggtgaaggacctgagcggcggcatcgacagagagttctag

SEQ ID NO: 22572 - DNA, 420 bp, Artificial Sequence
  Description of Artificial Sequence: Synthetic coding sequence
atgcccagcgagtacacctacgtgaagctgagaagcgactgcagcagacccagcctgcagtggtacaccagagcccagagcaagatgagaagacccagcctgctgctgaaggacatcctgaagtgcaccctgctggtgttcggcgtgtggatcctgtacatcctgaagctgaactacaccaccgaggagtgcgacatgaagaagatgcactacgtggaccccgaccacgtgaagagagcccagaagtacgcccagcaggtgctgcagaaggagtgcagacccaagttcgccaagaccagcatggccctgctgttcgagcacagatacagcgtggacctgctgcccttcgtgcagaaggcccccaaggacagcgaggccgagagcaagtacgacccccccttcggcttcagaaagttctag

SEQ ID NO: 22573 - DNA, 663 bp, Artificial Sequence
  Description of Artificial Sequence: Synthetic coding sequence
atgagaaccaaggccgccggctgcgccgagagaagacccctgcagcccagaaccgaggccgccgccgcccccgccggcagagccatgcccagcgagtacacctacgtgaagctgagaagcgactgcagcagacccagcctgcagtggtacaccagagcccagagcaagatgagaagacccagcctgctgctgaaggacatcctgaagtgcaccctgctggtgttcggcgtgtggatcctgtacatcctgaagctgaactacaccaccgaggagtgcgacatgaagaagatgcactacgtggaccccgaccacgtgaagaccctgagcccctgcggctggcactgcgtgcagctgatcatggccagatggacccagcccctgctgcacagactgctgagcgacagcgccgacctgcacagagccttcaagggcagcagagccctgcccgccgaggccttcagcgagcccagacaccagcacctgcagaccgagagcttcctgagcctggtgctgctgcccgccttccaggccttcctgggctacctgagagcccccgagggcgccgccctggccctgagacacttcctgctgagctgcgagctgtgggccagcagcggcggcggcagagagcagctgaagcagatgcccgtgcagctgacctag

SEQ ID NO: 22574 - DNA, 1803 bp, Artificial Sequence
  Description of Artificial Sequence: Synthetic coding sequence
atgagaagctgcctgtggagatgcagacacctgagccagggcgtgcagtggagcctgctgctggccgtgctggtgttcttcctgttcgccctgcccagcttcatcaaggagccccagaccaagcccagcagacaccagagaaccgagaacatcaaggagagaagcctgcagagcctggccaagcccaagagccaggcccccaccagagccagaagaaccaccatctacgccgagcccgtgcccgagaacaacgccctgaacacccagacccagcccaaggcccacaccaccggcgacagaggcaaggaggccaaccaggccccccccgaggagcaggacaaggtgccccacaccgcccagagagccgcctggaagagccccgagaaggagaagaccatggtgaacaccctgagccccagaggccaggacgccggcatggccagcggcagaaccgaggcccagagctggaagagccaggacaccaagaccacccagggcaacggcggccagaccagaaagctgaccgccagcagaaccgtgagcgagaagcaccagggcaaggccgccaccaccgccaagaccctgatccccaagagccagcacagaatgctggcccccaccggcgccgtgagcaccagaaccagacagaagggcgtgaccaccgccgtgatcccccccaaggagaagaagccccaggccacccccccccccgcccccttccagagccccaccacccagagaaaccagagactgaaggccgccaacttcaagagcgagcccagatgggacttcgaggagaagtacagcttcgagatcggcggcctgcagaccacctgccccgacagcgtgaagatcaaggccagcaagagcctgtggctgcagaagctgttcctgcccaacctgaccctgttcctggacagcagacacttcaaccagagcgagtgggacagactggagcacttcgccccccccttcggcttcatggagctgaactacagcctggtgcagaaggtggtgaccagattcccccccgtgccccagcagcagctgctgctggccagcctgcccgccggcagcctgagatgcatcacctgcgccgtggtgggcaacggcggcatcctgaacaacagccacatgggccaggagatcgacagccacgactacgtgttcagactgagcggcgccctgatcaagggctacgagcaggacgtgggcaccagaaccagcttctacggcttcaccgccttcagcctgacccagagcctgctgatcctgggcaacagaggcttcaagaacgtgcccctgggcaaggacgtgagatacctgcacttcctggagggcaccagagactacgagtggctggaggccctgctgatgaaccagaccgtgatgagcaagaacctgttctggttcagacacagaccccaggaggccttcagagaggccctgcacatggacagatacctgctgctgcaccccgacttcctgagatacatgaagaacagattcctgagaagcaagaccctggacggcgcccactggagaatctacagacccaccaccggcgccctgctgctgctgaccgccctgcagctgtgcgaccaggtgagcgcctacggcttcatcaccgagggccacgagagattcagcgaccactactacgacaccagctggaagagactgatcttctacatcaaccacgacttcaagctggagagagaggtgtggaagagactgcacgacgagggcatcatcagactgtaccagagacccggccccggcaccgccaaggccaagaactag

SEQ ID NO: 22575 - DNA, 1416 bp, Artificial Sequence
  Description of Artificial Sequence: Synthetic coding sequence
atgagaagctgcctgtggagatgcagacacctgagccagggcgtgcagtggagcctgctgctggccgtgctggtgttcttcctgttcgccctgcccagcttcatcaaggagccccagaccaagcccagcagacaccagagaaccgagaacatcaaggagagaagcctgcagagcctggccaagcccaagagccaggcccccaccagagccagaagaaccaccatctacgccgagcccgtgcccgagaacaacgccctgaacacccagacccagcccaaggcccacaccaccggcgacagaggcaaggaggccaaccaggccccccccgaggagcaggacaaggtgccccacaccgcccagagagccgcctggaagagccccgagaaggagaagaccatggtgaacaccctgagccccagaggccaggacgccggcatggccagcggcagaaccgaggcccagagctggaagagccaggacaccaagaccacccagggcaacggcggccagaccagaaagctgaccgccagcagaaccgtgagcgagaagcaccagggcaaggccgccaccaccgccaagaccctgatccccaagagccagcacagaatgctggcccccaccggcgccgtgagcaccagaaccagacagaagggcgtgaccaccgccgtgatcccccccaaggagaagaagccccaggccacccccccccccgcccccttccagagccccaccacccagagaaaccagagactgaaggccgccaacttcaagagcgagcccagatgggacttcgaggagaagtacagcttcgagatcggcggcctgcagaccacctgccccgacagcgtgaagatcaaggccagcaagagcctgtggctgcagaagctgttcctgcccaacctgaccctgttcctggacagcagacacttcaaccagagcgagtgggacagactggagcacttcgccccccccttcggcttcatggagctgaactacagcctggtgcagaaggtggtgaccagattcccccccgtgccccagcagcagctgctgctggccagcctgcccgccggcagcctgagatgcatcacctgcgccgtggtgggcaacggcggcatcctgaacaacagccacatgggccaggagatcgacagccacgactacgtgttcagactgagcggcgccctgatcaagggctacgagcaggacgtgggcaccagaaccagcttctacggcttcaccgccttcagcctgacccagagcctgctgatcctgggcaacagaggcttcaagaacgtgcccctgggcaaggcccagacccccggcagcttcagcggcagccccgcccacggccaggtgcccgtggccgcccccagactgagccccatccacgaggagcaggtgagcgaggtgtag

SEQ ID NO: 22576 - DNA, 2238 bp, Artificial Sequence
  Description of Artificial Sequence: Synthetic coding sequence
atgggcgtgcccttcttcagcagcctgagatgcatggtggacctgggcccctgctgggccggcggcctgaccgccgagatgaagctgctgctggccctggccggcctgctggccatcctggccaccccccagcccagcgagggcgccgcccccgccgtgctgggcgaggtggacaccagcctggtgctgagcagcatggaggaggccaagcagctggtggacaaggcctacaaggagagaagagagagcatcaagcagagactgagaagcggcagcgccagccccatggagctgctgagctacttcaagcagcccgtggccgccaccagaaccgccgtgagagccgccgactacctgcacgtggccctggacctgctggagagaaagctgagaagcctgtggagaagacccttcaacgtgaccgacgtgctgacccccgcccagctgaacgtgctgagcaagagcagcggctgcgcctaccaggacgtgggcgtgacctgccccgagcaggacaagtacagaaccatcaccggcatgtgcaacaacagaagaagccccaccctgggcgccagcaacagagccttcgtgagatggctgcccgccgagtacgaggacggcttcagcctgccctacggctggacccccggcgtgaagagaaacggcttccccgtggccctggccagagccgtgagcaacgagatcgtgagattccccaccgaccagctgacccccgaccaggagagaagcctgatgttcatgcagtggggccagctgctggaccacgacctggacttcacccccgagcccgccgccagagccagcttcgtgaccggcgtgaactgcgagaccagctgcgtgcagcagcccccctgcttccccctgaagatcccccccaacgaccccagaatcaagaaccaggccgactgcatccccttcttcagaagctgccccgcctgccccggcagcaacatcaccatcagaaaccagatcaacgccctgaccagcttcgtggacgccagcatggtgtacggcagcgaggagcccctggccagaaacctgagaaacatgagcaaccagctgggcctgctggccgtgaaccagagattccaggacaacggcagagccctgctgcccttcgacaacctgcacgacgacccctgcctgctgaccaacagaagcgccagaatcccctgcttcctggccggcgacaccagaagcagcgagatgcccgagctgaccagcatgcacaccctgctgctgagagagcacaacagactggccaccgagctgaagagcctgaaccccagatgggacggcgagagactgtaccaggaggccagaaagatcgtgggcgccatggtgcagatcatcacctacagagactacctgcccctggtgctgggccccaccgccatgagaaagtacctgcccacctacagaagctacaacgacagcgtggaccccagaatcgccaacgtgttcaccaacgccttcagatacggccacaccctgatccagcccttcatgttcagactggacaacagataccagcccatggagcccaaccccagagtgcccctgagcagagtgttcttcgccagctggagagtggtgctggagggcggcatcgaccccatcctgagaggcctgatggccacccccgccaagctgaacagacagaaccagatcgccgtggacgagatcagagagagactgttcgagcaggtgatgagaatcggcctggacctgcccgccctgaacatgcagagaagcagagaccacggcctgcccggctacaacgcctggagaagattctgcggcctgccccagcccgagaccgtgggccagctgggcaccgtgctgagaaacctgaagctggccagaaagctgatggagcagtacggcacccccaacaacatcgacatctggatgggcggcgtgagcgagcccctgaagagaaagggcagagtgggccccctgctggcctgcatcatcggcacccagttcagaaagctgagagacggcgacagattctggtgggagaacgagggcgtgttcagcatgcagcagagacaggccctggcccagatcagcctgcccagaatcatctgcgacaacaccggcatcaccaccgtgagcaagaacaacatcttcatgagcaacagctaccccagagacttcgtgaactgcagcaccctgcccgccctgaacctggccagctggagagaggccagctag

SEQ ID NO: 22577 - DNA, 918 bp, Artificial Sequence
  Description of Artificial Sequence: Synthetic coding sequence
atggcctgcatcctgaagagaaagagcgtgatcgccgtgagcttcatcgccgccttcctgttcctgctggtggtgagactggtgaacgaggtgaacttccccctgctgctgaactgcttcggccagcccggcaccaagtggatccccttcagctacacctacagaagacccctgagaacccactacggctacatcaacgtgaagacccaggagcccctgcagctggactgcgacctgtgcgccatcgtgagcaacagcggccagatggtgggccagaaggtgggcaacgagatcgacagaagcagctgcatctggagaatgaacaacgcccccaccaagggctacgaggaggacgtgggcagaatgaccatgatcagagtggtgagccacaccagcgtgcccctgctgctgaagaaccccgactacttcttcaaggaggccaacaccaccatctacgtgatctggggccccttcagaaacatgagaaaggacggcaacggcatcgtgtacaacatgctgaagaagaccgtgggcatctaccccaacgcccagatctacgtgaccaccgagaagagaatgagctactgcgacggcgtgttcaagaaggagaccggcaaggacagagtgcagagcggcagctacctgagcaccggctggttcaccttcctgctggccatggacgcctgctacggcatccacgtgtacggcatgatcaacgacacctactgcaagaccgagggctacagaaaggtgccctaccactactacgagcagggcagagacgagtgcgacgagtacttcctgcacgagcacgccccctacggcggccacagattcatcaccgagaagaaggtgttcgccaagtgggccaagaagcacagaatcatcttcacccaccccaactggaccctgagctag

SEQ ID NO: 22578 - DNA, 915 bp, Artificial Sequence
  Description of Artificial Sequence: Synthetic coding sequence
gtgtgcatcagaaagagaaagagcgtgatcgccgtgagcttcatcgccgccttcctgttcctgctggtggtgagactggtgaacgaggtgaacttccccctgctgctgaactgcttcggccagcccggcaccaagtggatccccttcagctacacctacagaagacccctgagaacccactacggctacatcaacgtgaagacccaggagcccctgcagctggactgcgacctgtgcgccatcgtgagcaacagcggccagatggtgggccagaaggtgggcaacgagatcgacagaagcagctgcatctggagaatgaacaacgcccccaccaagggctacgaggaggacgtgggcagaatgaccatgatcagagtggtgagccacaccagcgtgcccctgctgctgaagaaccccgactacttcttcaaggaggccaacaccaccatctacgtgatctggggccccttcagaaacatgagaaaggacggcaacggcatcgtgtacaacatgctgaagaagaccgtgggcatctaccccaacgcccagatctacgtgaccaccgagaagagaatgagctactgcgacggcgtgttcaagaaggagaccggcaaggacagagtgcagagcggcagctacctgagcaccggctggttcaccttcctgctggccatggacgcctgctacggcatccacgtgtacggcatgatcaacgacacctactgcaagaccgagggctacagaaaggtgccctaccactactacgagcagggcagagacgagtgcgacgagtacttcctgcacgagcacgccccctacggcggccacagattcatcaccgagaagaaggtgttcgccaagtgggccaagaagcacagaatcatcttcacccaccccaactggaccctgagctag

SEQ ID NO: 22579 - DNA, 633 bp, Artificial Sequence
  Description of Artificial Sequence: Synthetic coding sequence
atggcctgcatcctgaaggtgaccacctggatcgccgtgagcttcatcgccgccttcctgttcctgctggtggtgagactggtgaacgaggtgaacttccccctgctgctgaactgcttcggccagcccggcaccaagtggatccccttcagctacacctacagaagacccctgagaacccactacggctacatcaacgtgaagacccaggagcccctgcagctggactgcgacctgtgcgccatcgtgagcaacagcggccagatggtgggccagaaggtgggcaacgagatcgacagaagcagctgcatctggagaatgaacaacgcccccaccaagggctacgaggaggacgtgggcagaatgaccatgatcagagtggtgagccacaccagcgtgcccctgctgctgaagaaccccgactacttcttcaaggaggccaacaccaccatctacgtgatctggggccccttcagaaacatgagaaaggacggcaacggcatcgtgtacaacatgctgaagaagaccgtgggcatctaccccaacgcccagatctacgtgaccaccgagaagagaatgagctactgcgacggcgtgttcaagaaggagaccggcaaggacagcaccgagtag

SEQ ID NO: 22580 - DNA, 612 bp, Artificial Sequence
  Description of Artificial Sequence: Synthetic coding sequence
ttcagcatcttccagcccctgcagctggactgcgacctgtgcgccatcgtgagcaacagcggccagatggtgggccagaaggtgggcaacgagatcgacagaagcagctgcatctggagaatgaacaacgcccccaccaagggctacgaggaggacgtgggcagaatgaccatgatcagagtggtgagccacaccagcgtgcccctgctgctgaagaaccccgactacttcttcaaggaggccaacaccaccatctacgtgatctggggccccttcagaaacatgagaaaggacggcaacggcatcgtgtacaacatgctgaagaagaccgtgggcatctaccccaacgcccagatctacgtgaccaccgagaagagaatgagctactgcgacggcgtgttcaagaaggagaccggcaaggacagaaccgagggctacagaaaggtgccctaccactactacgagcagggcagagacgagtgcgacgagtacttcctgcacgagcacgccccctacggcggccacagattcatcaccgagaagaaggtgttcgccaagtgggccaagaagcacagaatcatcttcacccaccccaactggaccctgagctag

SEQ ID NO: 22581 - DNA, 909 bp, Artificial Sequence
  Description of Artificial Sequence: Synthetic coding sequence
atgaaggcccccggcagactggtgctgatcatcctgtgcagcgtggtgttcagcgccgtgtacatcctgctgtgctgctgggccggcctgcccctgtgcctggccacctgcctggaccaccacttccccaccggcagcagacccaccgtgcccggccccctgcacttcagcggctacagcagcgtgcccgacggcaagcccctggtgagagagccctgcagaagctgcgccgtggtgagcagcagcggccagatgctgggcagcggcctgggcgccgagatcgacagcgccgagtgcgtgttcagaatgaaccaggcccccaccgtgggcttcgaggccgacgtgggccagagaagcaccctgagagtggtgagccacaccagcgtgcccctgctgctgagaaactacagccactacttccagaaggccagagacaccctgtacatggtgtggggccagggcagacacatggacagagtgctgggcggcagaacctacagaaccctgctgcagctgaccagaatgtaccccggcctgcaggtgtacaccttcaccgagagaatgatggcctactgcgaccagatcttccaggacgagaccggcaagaacagaagacagagcggcagcttcctgagcaccggctggttcaccatgatcctggccctggagctgtgcgaggagatcgtggtgtacggcatggtgagcgacagctactgcagagagaagagccaccccagcgtgccctaccactacttcgagaagggcagactggacgagtgccagatgtacctggcccacgagcaggcccccagaagcgcccacagattcatcaccgagaaggccgtgttcagcagatgggccaagaagagacccatcgtgttcgcccaccccagctggagaaccgagtag

SEQ ID NO: 22582 - DNA, 657 bp, Artificial Sequence
  Description of Artificial Sequence: Synthetic coding sequence
atgctgggcagcggcctgggcgccgagatcgacagcgccgagtgcgtgttcagaatgaaccaggcccccaccgtgggcttcgaggccgacgtgggccagagaagcaccctgagagtggtgagccacaccagcgtgcccctgctgctgagaaactacagccactacttccagaaggccagagacaccctgtacatggtgtggggccagggcagacacatggacagagtgctgggcggcagaacctacagaaccctgctgcagctgaccagaatgtaccccggcctgcaggtgtacaccttcaccgagagaatgatggcctactgcgaccagatcttccaggacgagaccggcaagaacagaagacagagcggcagcttcctgagcaccggctggttcaccatgatcctggccctggagctgtgcgaggagatcgtggtgtacggcatggtgagcgacagctactgcagagagaagagccaccccagcgtgccctaccactacttcgagaagggcagactggacgagtgccagatgtacctggcccacgagcaggcccccagaagcgcccacagattcatcaccgagaaggccgtgttcagcagatgggccaagaagagacccatcgtgttcgcccaccccagctggagaaccgagtag

SEQ ID NO: 22583 - DNA, 606 bp, Artificial Sequence
  Description of Artificial Sequence: Synthetic coding sequence
atgctgggcagcggcctgggcgccgagatcgacagcgccgagtgcgtgttcagaatgaaccaggcccccaccgtgggcttcgaggccgacgtgggccagagaagcaccctgagagtggtgagccacaccagcgtgcccctgctgctgagaaactacagccactacttccagaaggccagagacaccctgtacatggtgtggggccagggcagacacatggacagagtgctgggcggcagaacctacagaaccctgctgcagctgaccagaatgtaccccggcctgcaggtgtacaccttcaccgagagaatgatggcctactgcgaccagatcttccaggacgagaccggcaagaacagaagacagagcggcagcttcctgagcaccggctggttcaccatgatcctggccctggagctgtgcgaggagatcgtggtgtacggcatggtgagcgacagctactgcagagagaagagccaccccagcgtgccctaccactacttcgagaagggcagactggacgagtgccagatgtacctggcccacgagcaggcccccagaagcgcccacagattcatcaccgagaaggccgtgttcagcagatag

SEQ ID NO: 22584 - DNA, 657 bp, Artificial Sequence; identical to SEQ ID NO: 22582
  Description of Artificial Sequence: Synthetic coding sequence

SEQ ID NO: 22585 - DNA, 1002 bp, Artificial Sequence
  Description of Artificial Sequence: Synthetic coding sequence
atggcctgcagcagaccccccagccagtgcgagcccaccagcctgccccccggcccccccgccggcagaagacacctgcccctgagcagaagaagaagagagatgagcagcaacaaggagcagagaagcgccgtgttcgtgatcctgttcgccctgatcaccatcctgatcctgtacagcagcaacagcgccaacgaggtgttccactacggcagcctgagaggcagaagcagaagacccgtgaacctgaagaagtggagcatcaccgacggctacgtgcccatcctgggcaacaagaccctgcccagcagatgccaccagtgcgtgatcgtgagcagcagcagccacctgctgggcaccaagctgggccccgagatcgagagagccgagtgcaccatcagaatgaacgacgcccccaccaccggctacagcgccgacgtgggcaacaagaccacctacagagtggtggcccacagcagcgtgttcagagtgctgagaagaccccaggagttcgtgaacagaacccccgagaccgtgttcatcttctggggcccccccagcaagatgcagaagccccagggcagcctggtgagagtgatccagagagccggcctggtgttccccaacatggaggcctacgccgtgagccccggcagaatgagacagttcgacgacctgttcagaggcgagaccggcaaggacagagagaagagccacagctggctgagcaccggctggttcaccatggtgatcgccgtggagctgtgcgaccacgtgcacgtgtacggcatggtgccccccaactactgcagccagagacccagactgcagagaatgccctaccactactacgagcccaagggccccgacgagtgcgtgacctacatccagaacgagcacagcagaaagggcaaccaccacagattcatcaccgagaagagagtgttcagcagctgggcccagctgtacggcatcaccttcagccaccccagctggacctag

SEQ ID NO: 22586 - DNA, 900 bp, Artificial Sequence
  Description of Artificial Sequence: Synthetic coding sequence
atgagcagcaacaaggagcagagaagcgccgtgttcgtgatcctgttcgccctgatcaccatcctgatcctgtacagcagcaacagcgccaacgaggtgttccactacggcagcctgagaggcagaagcagaagacccgtgaacctgaagaagtggagcatcaccgacggctacgtgcccatcctgggcaacaagaccctgcccagcagatgccaccagtgcgtgatcgtgagcagcagcagccacctgctgggcaccaagctgggccccgagatcgagagagccgagtgcaccatcagaatgaacgacgcccccaccaccggctacagcgccgacgtgggcaacaagaccacctacagagtggtggcccacagcagcgtgttcagagtgctgagaagaccccaggagttcgtgaacagaacccccgagaccgtgttcatcttctggggcccccccagcaagatgcagaagccccagggcagcctggtgagagtgatccagagagccggcctggtgttccccaacatggaggcctacgccgtgagccccggcagaatgagacagttcgacgacctgttcagaggcgagaccggcaaggacagagagaagagccacagctggctgagcaccggctggttcaccatggtgatcgccgtggagctgtgcgaccacgtgcacgtgtacggcatggtgccccccaactactgcagccagagacccagactgcagagaatgccctaccactactacgagcccaagggccccgacgagtgcgtgacctacatccagaacgagcacagcagaaagggcaaccaccacagattcatcaccgagaagagagtgttcagcagctgggcccagctgtacggcatcaccttcagccaccccagctggacctag

SEQ ID NO: 22587 - DNA, 1125 bp, Artificial Sequence
  Description of Artificial Sequence: Synthetic coding sequence
atggcctgcagcagaccccccagccagtgcgagcccaccagcctgccccccggcccccccgccggcagaagacacctgcccctgagcagaagaagaagagagatgagcagcaacaaggagcagagaagcgccgtgttcgtgatcctgttcgccctgatcaccatcctgatcctgtacagcagcaacagcgccaacgaggtgttccactacggcagcctgagaggcagaagcagaagacccgtgaacctgaagaagtggagcatcaccgacggctacgtgcccatcctgggcaacaagaccctgcccagcagatgccaccagtgcgtgatcgtgagcagcagcagccacctgctgggcaccaagctgggccccgagatcgagagagccgagtgcaccatcagaatgaacgacgcccccaccaccggctacagcgccgacgtgggcaacaagaccacctacagagtggtggcccacagcagcgtgttcagagtgctgagaagaccccaggagttcgtgaacagaacccccgagaccgtgttcatcttctggggcccccccagcaagatgcagaagccccagggcagcctggtgagagtgatccagagagccggcctggtgttccccaacatggaggcctacgccgtgagccccggcagaatgagacagttcgacgacctgttcagaggcgagaccggcaaggacagagagaagagccacagctggctgagcaccggctggttcaccatggtgatcgccgtggagctgtgcgaccacgtgcacgtgtacggcatggtgccccccaactactgcagcggccccgccagcagcgcctgccccaccaccaccaccagccccagaggcagaaccaacgtgagccccaccagcagaatgagcaccgtggccagagccaccaccaccgccagcagccccagaaagggcagcagccacagaggccccagctgcatggccagccccagccccaccccccccggccccagaccccccagcctgtgggacctgagaagagtgagaggcgaggccgccagcgcccagcccctgggccagggccccagcagcggccagagcagactggccggcgtgagccccagccagagcggcccctag

SEQ ID NO: 22588 - DNA, 900 bp, Artificial Sequence; identical to SEQ ID NO: 22586
  Description of Artificial Sequence: Synthetic coding sequence

SEQ ID NO: 22589 - DNA, 1002 bp, Artificial Sequence; identical to SEQ ID NO: 22585
  Description of Artificial Sequence: Synthetic coding sequence

SEQ ID NO: 22590 - DNA, 603 bp, Artificial Sequence
  Description of Artificial Sequence: Synthetic coding sequence
atgagcagcaacaaggagcagagaagcgccgtgttcgtgatcctgttcgccctgatcaccatcctgatcctgtacagcagcaacagcgccaacgaggtgttccactacggcagcctgagaggcagaagcagaagacccgtgaacctgaagaagtggagcatcaccgacggctacgtgcccatcctgggcaacaagaccctgcccagcagatgccaccagtgcgtgatcgtgagcagcagcagccacctgctgggcaccaagctgggccccgagatcgagagagccgagtgcaccatcagaatgaacgacgcccccaccaccggctacagcgccgacgtgggcaacaagaccacctacagagtggtggcccacagcagcgtgttcagagtgctgagaagaccccaggagttcgtgaacagaacccccgagaccgtgttcatcttctggggcccccccagcaagatgcagaagccccagggcagcctggtgagagtgatccagagagccggcctggtgttccccaacatggaggcctacgccgtgagccccggcagaatgagacagttcgacgacctgttcagaggcgagaccggcaaggactag

SEQ ID NO: 22591 - DNA, 402 bp, Artificial Sequence
  Description of Artificial Sequence: Synthetic coding sequence
atgagaagcagcatcaccgccccctgcggcgccgtggccgccgacctgagcaccagcagaagcggcgccagcctgaccgccatgagccccttcagcgccaccagagagaagagccacagctggctgagcaccggctggttcaccatggtgatcgccgtggagctgtgcgaccacgtgcacgtgtacggcatggtgccccccaactactgcagccagagacccagactgcagagaatgccctaccactactacgagcccaagggccccgacgagtgcgtgacctacatccagaacgagcacagcagaaagggcaaccaccacagattcatcaccgagaagagagtgttcagcagctgggcccagctgtacggcatcaccttcagccaccccagctggacctag

SEQ ID NO: 22592 - DNA, 1590 bp, Artificial Sequence
  Description of Artificial Sequence: Synthetic coding sequence
atgaagccccacctgaagcagtggagacagagaatgctgttcggcatcttcgcctggggcctgctgttcctgctgatcttcatctacttcaccgacagcaaccccgccgagcccgtgcccagcagcctgagcttcctggagaccagaagactgctgcccgtgcagggcaagcagagagccatcatgggcgccgcccacgagcccagcccccccggcggcctggacgccagacaggccctgcccagagcccaccccgccggcagcttccacgccggccccggcgacctgcagaagtgggcccagagccaggacggcttcgagcacaaggagttcttcagcagccaggtgggcagaaagagccagagcgccttctaccccgaggacgacgactacttcttcgccgccggccagcccggctggcacagccacacccagggcaccctgggcttccccagccccggcgagcccggccccagagagggcgccttccccgccgcccaggtgcagagaagaagagtgaagaagagacacagaagacagagaagaagccacgtgctggaggagggcgacgacggcgacagactgtacagcagcatgagcagagccttcctgtacagactgtggaagggcaacgtgagcagcaagatgctgaaccccagactgcagaaggccatgaaggactacctgaccgccaacaagcacggcgtgagattcagaggcaagagagaggccggcctgagcagagcccagctgctgtgccagctgagaagcagagccagagtgagaaccctggacggcaccgaggcccccttcagcgccctgggctggagaagactggtgcccgccgtgcccctgagccagctgcaccccagaggcctgagaagctgcgccgtggtgatgagcgccggcgccatcctgaacagcagcctgggcgaggagatcgacagccacgacgccgtgctgagattcaacagcgcccccaccagaggctacgagaaggacgtgggcaacaagaccaccatcagaatcatcaacagccagatcctgaccaaccccagccaccacttcatcgacagcagcctgtacaaggacgtgatcctggtggcctgggaccccgccccctacagcgccaacctgaacctgtggtacaagaagcccgactacaacctgttcaccccctacatccagcacagacagagaaaccccaaccagcccttctacatcctgcaccccaagttcatctggcagctgtgggacatcatccaggagaacaccaaggagaagatccagcccaacccccccagcagcggcttcatcggcatcctgatcatgatgagcatgtgcagagaggtgcacgtgtacgagtacatccccagcgtgagacagaccgagctgtgccactaccacgagctgtactacgacgccgcctgcaccctgggcgcctaccaccccctgctgtacgagaagctgctggtgcagagactgaacatgggcacccagggcgacctgcacagaaagggcaaggtggtgctgcccggcttccaggccgtgcactgccccgcccccagccccgtgatcccccacagctag

SEQ ID NO: 22593 - DNA, 288 bp, Artificial Sequence
  Description of Artificial Sequence: Synthetic coding sequence
tgaagcggcttcatcggcatcctgatcatgatgagcatgtgcagagaggtgcacgtgtacgagtacatccccagcgtgagacagaccgagctgtgccactaccacgagctgtactacgacgccgcctgcaccctgggcgcctaccaccccctgctgtacgagaagctgctggtgcagagactgaacatgggcacccagggcgacctgcacagaaagggcaaggtggtgctgcccggcttccaggccgtgcactgccccgcccccagccccgtgatcccccacagctag

SEQ ID NO: 22594 - DNA, 1401 bp, Artificial Sequence
  Description of Artificial Sequence: Synthetic coding sequence
atgaagccccacctgaagcagtggagacagagaatgctgttcggcatcttcgcctggggcctgctgttcctgctgatcttcatctacttcaccgacagcaaccccgccgagcccgtgcccagcagcctgagcttcctggagaccagaagactgctgcccgtgcagggcaagcagagagccatcatgggcgccgcccacgagcccagcccccccggcggcctggacgccagacaggccctgcccagagcccaccccgccggcagcttccacgccggccccggcgacctgcagaagtgggcccagagccaggacggcttcgagcacaaggagttcttcagcagccaggtgggcagaaagagccagagcgccttctaccccgaggacgacgactacttcttcgccgccggccagcccggctggcacagccacacccagggcaccctgggcttccccagccccggcgagcccggccccagagagggcgccttccccgccgcccaggtgcagagaagaagagtgaagaagagacacagaagacagagaagaagccacgtgctggaggagggcgacgacggcgacagactgtacagcagcatgagcagagccttcctgtacagactgtggaagggcaacgtgagcagcaagatgctgaaccccagactgcagaaggccatgaaggactacctgaccgccaacaagcacggcgtgagattcagaggcaagagagaggccggcctgagcagagcccagctgctgtgccagctgagaagcagagccagagtgagaaccctggacggcaccgaggcccccttcagcgccctgggctggagaagactggtgcccgccgtgcccctgagccagctgcaccccagaggcctgagaagctgcgccgtggtgatgagcgccggcgccatcctgaacagcagcctgggcgaggagatcgacagccacgacgccgtgctgagattcaacagcgcccccaccagaggctacgagaaggacgtgggcaacaagaccaccatcagaatcatcaacagccagatcctgaccaaccccagccaccacttcatcgacagcagcctgtacaaggacgtgatcctggtggcctgggaccccgccccctacagcgccaacctgaacctgtggtacaagaagcccgactacaacctgttcaccccctacatccagcacagacagagaaaccccaaccagcccttctacatcctgcaccccaagttcatctggcagctgtgggacatcatccaggagaacaccaaggagaagatccagcccaacccccccagcagcggcttcatcggcagcttcgtgaagatcggccacatcagagcctgcagcgagcccagaagcagagactgcacccccgcctggaccaccgagtag

SEQ ID NO: 22595 - DNA, 1590 bp, Artificial Sequence; identical to SEQ ID NO: 22592
  Description of Artificial Sequence: Synthetic coding sequence

SEQ ID NO: 22596 - DNA, 108 bp, Artificial Sequence
  Description of Artificial Sequence: Synthetic coding sequence
atgaagccccacctgaagcagtggagacagagaatgctgttcggcatcttcgcctggggcctgctgttcctgctgatcttcatctacttcaccgacagcaacccctag

SEQ ID NO: 22597 - DNA, 1071 bp, Artificial Sequence
  Description of Artificial Sequence: Synthetic coding sequence
atgagcccctgcggcagagccagaagacagaccagcagaggcgccatggccgtgctggcctggaagttccccagaaccagactgcccatgggcgccagcgccctgtgcgtggtggtgctgtgctggctgtacatcttccccgtgtacagactgcccaacgagaaggagatcgtgcagggcgtgctgcagcagggcaccgcctggagaagaaaccagaccgccgccagagccttcagaaagcagatggaggactgctgcgaccccgcccacctgttcgccatgaccaagatgaacagccccatgggcaagagcatgtggtacgacggcgagttcctgtacagcttcaccatcgacaacagcacctacagcctgttcccccaggccacccccttccagctgcccctgaagaagtgcgccgtggtgggcaacggcggcatcctgaagaagagcggctgcggcagacagatcgacgaggccaacttcgtgatgagatgcaacctgccccccctgagcagcgagtacaccaaggacgtgggcagcaagagccagctggtgaccgccaaccccagcatcatcagacagagattccagaacctgctgtggagcagaaagaccttcgtggacaacatgaagatctacaaccacagctacatctacatgcccgccttcagcatgaagaccggcaccgagcccagcctgagagtgtactacaccctgagcgacgtgggcgccaaccagaccgtgctgttcgccaaccccaacttcctgagaagcatcggcaagttctggaagagcagaggcatccacgccaagagactgagcaccggcctgttcctggtgagcgccgccctgggcctgtgcgaggaggtggccatctacggcttctggcccttcagcgtgaacatgcacgagcagcccatcagccaccactactacgacaacgtgctgcccttcagcggcttccacgccatgcccgaggagttcctgcagctgtggtacctgcacaagatcggcgccctgagaatgcagctggacccctgcgaggacaccagcctgcagcccaccagctag

SEQ ID NO: 22598 - DNA, 642 bp, Artificial Sequence
  Description of Artificial Sequence: Synthetic coding sequence
atgaccggcagcttctacacccacagccccctgaccatccagctgaccctgagcagccacagatgcaacctgccccccctgagcagcgagtacaccaaggacgtgggcagcaagagccagctggtgaccgccaaccccagcatcatcagacagagattccagaacctgctgtggagcagaaagaccttcgtggacaacatgaagatctacaaccacagctacatctacatgcccgccttcagcatgaagaccggcaccgagcccagcctgagagtgtactacaccctgagcgacgtgggcgccaaccagaccgtgctgttcgccaaccccaacttcctgagaagcatcggcaagttctggaagagcagaggcatccacgccaagagactgagcaccggcctgttcctggtgagcgccgccctgggcctgtgcgaggaggtggccatctacggcttctggcccttcagcgtgaacatgcacgagcagcccatcagccaccactactacgacaacgtgctgcccttcagcggcttccacgccatgcccgaggagttcctgcagctgtggtacctgcacaagatcggcgccctgagaatgcagctggacccctgcgaggacaccagcctgcagcccaccagctag

SEQ ID NO: 22599 - DNA, 1128 bp, Artificial Sequence
  Description of Artificial Sequence: Synthetic coding sequence
atgcagctgcagttcagaagctggatgctggccgccctgaccctgctggtggtgttcctgatcttcgccgacatcagcgagatcgaggaggagatcggcaacagcggcggcagaggcaccatcagaagcgccgtgaacagcctgcacagcaagagcaacagagccgaggtggtgatcaacggcagcagcagccccgccgtggtggacagaagcaacgagagcatcaagcacaacatccagcccgccagcagcaagtggagacacaaccagaccctgagcctgagaatcagaaagcagatcctgaagttcctggacgccgagaaggacatcagcgtgctgaagggcaccctgaagcccggcgacatcatccactacatcttcgacagagacagcaccatgaacgtgagccagaacctgtacgagctgctgcccagaaccagccccctgaagaacaagcacttcggcacctgcgccatcgtgggcaacagcggcgtgctgctgaacagcggctgcggccaggagatcgacgcccacagcttcgtgatcagatgcaacctggcccccgtgcaggagtacgccagagacgtgggcctgaagaccgacctggtgaccatgaaccccagcgtgatccagagagccttcgaggacctggtgaacgccacctggagagagaagctgctgcagagactgcacagcctgaacggcagcatcctgtggatccccgccttcatggccagaggcggcaaggagagagtggagtgggtgaacgagctgatcctgaagcaccacgtgaacgtgagaaccgcctaccccagcctgagactgctgcacgccgtgagaggctactggctgaccaacaaggtgcacatcaagagacccaccaccggcctgctgatgtacaccctggccaccagattctgcaagcagatctacctgtacggcttctggcccttccccctggaccagaaccagaaccccgtgaagtaccactactacgacagcctgaagtacggctacaccagccaggccagcccccacaccatgcccctggagttcaaggccctgaagagcctgcacgagcagggcgccctgaagctgaccgtgggccagtgcgacggcgccacctag

SEQ ID NO: 22600 - DNA, 1065 bp, Artificial Sequence
  Description of Artificial Sequence: Synthetic coding sequence
atgcagctgcagttcagaagctggatgctggccgccctgaccctgctggtggtgttcctgatcttcgccgacatcagcgagatcgaggaggagatcggcgccgaggtggtgatcaacggcagcagcagccccgccgtggtggacagaagcaacgagagcatcaagcacaacatccagcccgccagcagcaagtggagacacaaccagaccctgagcctgagaatcagaaagcagatcctgaagttcctggacgccgagaaggacatcagcgtgctgaagggcaccctgaagcccggcgacatcatccactacatcttcgacagagacagcaccatgaacgtgagccagaacctgtacgagctgctgcccagaaccagccccctgaagaacaagcacttcggcacctgcgccatcgtgggcaacagcggcgtgctgctgaacagcggctgcggccaggagatcgacgcccacagcttcgtgatcagatgcaacctggcccccgtgcaggagtacgccagagacgtgggcctgaagaccgacctggtgaccatgaaccccagcgtgatccagagagccttcgaggacctggtgaacgccacctggagagagaagctgctgcagagactgcacagcctgaacggcagcatcctgtggatccccgccttcatggccagaggcggcaaggagagagtggagtgggtgaacgagctgatcctgaagcaccacgtgaacgtgagaaccgcctaccccagcctgagactgctgcacgccgtgagaggctactggctgaccaacaaggtgcacatcaagagacccaccaccggcctgctgatgtacaccctggccaccagattctgcaagcagatctacctgtacggcttctggcccttccccctggaccagaaccagaaccccgtgaagtaccactactacgacagcctgaagtacggctacaccagccaggccagcccccacaccatgcccctggagttcaaggccctgaagagcctgcacgagcagggcgccctgaagctgaccgtgggccagtgcgacggcgccacctag

SEQ ID NO: 22601 - DNA, 1143 bp, Artificial Sequence
  Description of Artificial Sequence: Synthetic coding sequence
atgagaaactgcaagatggccagagtggccagcgtgctgggcctggtgatgctgagcgtggccctgctgatcctgagcctgatcagctacgtgagcctgaagaaggagaacatcttcaccacccccaagtacgccagccccggcgcccccagaatgtacatgttccacgccggcttcagaagccagttcgccctgaagttcctggaccccagcttcgtgcccatcaccaacagcctgacccaggagctgcaggagaagcccagcaagtggaagttcaacagaaccgccttcctgcaccagagacaggagatcctgcagcacgtggacgtgatcaagaacttcagcctgaccaagaacagcgtgagaatcggccagctgatgcactacgactacagcagccacaagtacgtgttcagcatcagcaacaacttcagaagcctgctgcccgacgtgagccccatcatgaacaagcactacaacatctgcgccgtggtgggcaacagcggcatcctgaccggcagccagtgcggccaggagatcgacaagagcgacttcgtgttcagatgcaacttcgcccccaccgaggccttccagagagacgtgggcagaaagaccaacctgaccaccttcaaccccagcatcctggagaagtactacaacaacctgctgaccatccaggacagaaacaacttcttcctgagcctgaagaagctggacggcgccatcctgtggatccccgccttcttcttccacaccagcgccaccgtgaccagaaccctggtggacttcttcgtggagcacagaggccagctgaaggtgcagctggcctggcccggcaacatcatgcagcacgtgaacagatactggaagaacaagcacctgagccccaagagactgagcaccggcatcctgatgtacaccctggccagcgccatctgcgaggagatccacctgtacggcttctggcccttcggcttcgaccccaacaccagagaggacctgccctaccactactacgacaagaagggcaccaagttcaccaccaagtggcaggagagccaccagctgcccgccgagttccagctgctgtacagaatgcacggcgagggcctgaccaagctgaccctgagccactgcgcctag

SEQ ID NO: 22602 - DNA, 1464 bp, Artificial Sequence
  Description of Artificial Sequence: Synthetic coding sequence
gccggcggcagaggcagaaccgccctgagagcccccagccccagaagaagagccgccccccccagcagctgcagcgcccccggccccgccagaccctgcctgagaggccccgccgccctgagaggcagctgccagccccagccccccgcccccgtggccagcccccaccccagacccggcccccccccccccccccacgccagagcccacacccacacccacacccacacccacacccacacccacatctacacccccgccagctgctggcccctgaacggccccatcagccccgtgagcctgaaccccgcccagcccggcatgagaaactgcaagatggccagagtggccagcgtgctgggcctggtgatgctgagcgtggccctgctgatcctgagcctgatcagctacgtgagcctgaagaaggagaacatcttcaccacccccaagtacgccagccccggcgcccccagaatgtacatgttccacgccggcttcagaagccagttcgccctgaagttcctggaccccagcttcgtgcccatcaccaacagcctgacccaggagctgcaggagaagcccagcaagtggaagttcaacagaaccgccttcctgcaccagagacaggagatcctgcagcacgtggacgtgatcaagaacttcagcctgaccaagaacagcgtgagaatcggccagctgatgcactacgactacagcagccacaagtacgtgttcagcatcagcaacaacttcagaagcctgctgcccgacgtgagccccatcatgaacaagcactacaacatctgcgccgtggtgggcaacagcggcatcctgaccggcagccagtgcggccaggagatcgacaagagcgacttcgtgttcagatgcaacttcgcccccaccgaggccttccagagagacgtgggcagaaagaccaacctgaccaccttcaaccccagcatcctggagaagtactacaacaacctgctgaccatccaggacagaaacaacttcttcctgagcctgaagaagctggacggcgccatcctgtggatccccgccttcttcttccacaccagcgccaccgtgaccagaaccctggtggacttcttcgtggagcacagaggccagctgaaggtgcagctggcctggcccggcaacatcatgcagcacgtgaacagatactggaagaacaagcacctgagccccaagagactgagcaccggcatcctgatgtacaccctggccagcgccatctgcgaggagatccacctgtacggcttctggcccttcggcttcgaccccaacaccagagaggacctgccctaccactactacgacaagaagggcaccaagttcaccaccaagtggcaggagagccaccagctgcccgccgagttccagctgctgtacagaatgcacggcgagggcctgaccaagctgaccctgagccactgcgcctag

SEQ ID NO: 22603 - DNA, 405 bp, Artificial Sequence
  Description of Artificial Sequence: Synthetic coding sequence
atgagaatgctgctgcacctgagcctgctggccctgggcgccgcctacgtgtacgccatccccaccgagatccccaccagcgccctggtgaaggagaccctggccctgctgagcacccacagaaccctgctgatcgccaacgagaccctgagaatccccgtgcccgtgcacaagaaccaccagctgtgcaccgaggagatcttccagggcatcggcaccctggagagccagaccgtgcagggcggcaccgtggagagactgttcaagaacctgagcctgatcaagaagtacatcgacggccagaagaagaagtgcggcgaggagagaagaagagtgaaccagttcctggactacctgcaggagttcctgggcgtgatgaacaccgagtggatcatcgagagctag

SEQ ID NO: 22604 - DNA, 507 bp, Artificial Sequence
  Description of Artificial Sequence: Synthetic coding sequence
atgagaagcatcagaaagagatggaccatctgcaccatcagcctgctgctgatcttctacaagaccaaggagatcgccagaaccgaggagcaccaggagacccagctgatcggcgacggcgagctgagcctgagcagaagcctggtgaacagcagcgacaagatcatcagaaaggccggcagcagcatcttccagcacaacgtggagggctggaagatcaacagcagcctggtgctggagatcagaaagaacatcctgagattcctggacgccgagagagacgtgagcgtggtgaagagcagcttcaagcccggcgacgtgatccactacgtgctggacagaagaagaaccctgaacatcagccacgacctgcacagcctgctgcccgaggtgagccccatgaagaacagaagattcaagacctgcgccgtggtgggcaacagcggcatcctgctggacagcgagtgcggcaaggagatcgacagccacaacttcgtgatcagatag

SEQ ID NO: 22605 - DNA, 1131 bp, Artificial Sequence
  Description of Artificial Sequence: Synthetic coding sequence
atgagatacgccgaccccagcgccaacagagacctgctgggcagcagaaccctgctgttcatcttcatctgcgccttcgccctggtgaccctgctgcagcagatcctgtacggcagaaactacatcaagagatacttcgagttctacgagggccccttcgagtacaacagcaccagatgcctggagctgagacacgagatcctggaggtgaaggtgctgagcatggtgaagcagagcgagctgttcgacagatggaagagcctgcagatgtgcaagtgggccatgaacatcagcgaggccaaccagttcaagagcaccctgagcagatgctgcaacgcccccgccttcctgttcaccacccagaagaacacccccctgggcaccaagctgaagtacgaggtggacaccagcggcatctaccacatcaaccaggagatcttcagaatgttccccaaggacatgccctactacagaagccagttcaagaagtgcgccgtggtgggcaacggcggcatcctgaagaacagcagatgcggcagagagatcaacagcgccgacttcgtgttcagatgcaacctgccccccatcagcgagaagtacaccatggacgtgggcgtgaagaccgacgtggtgaccgtgaaccccagcatcatcaccgagagattccacaagctggagaagtggagaagacccttctacagagtgctgcaggtgtacgagaacgccagcgtgctgctgcccgccttctacaacaccagaaacaccgacgtgagcatcagagtgaagtacgtgctggacgacttcgagagcccccaggccgtgtactacttccacccccagtacctggtgaacgtgagcagatactggctgagcctgggcgtgagagccaagagaatcagcaccggcctgatcctggtgaccgccgccctggagctgtgcgaggaggtgcacctgttcggcttctgggccttccccatgaaccccagcggcctgtacatcacccaccactactacgacaacgtgaagcccagacccggcttccacgccatgcccagcgagatcttcaacttcctgcacctgcacagcagaggcatcctgagagtgcacaccggcacctgcagctgctgctag

SEQ ID NO: 22606 - DNA, 1038 bp, Artificial Sequence
  Description of Artificial Sequence: Synthetic coding sequence
atgagatacgccgaccccagcgccaacagagacctgctgggcagcagaaccctgctgttcatcttcatctgcgccttcgccctggtgaccctgctgcagcagatcctgtacggcagaaactacatcaagagagtgaagcagagcgagctgttcgacagatggaagagcctgcagatgtgcaagtgggccatgaacatcagcgaggccaaccagttcaagagcaccctgagcagatgctgcaacgcccccgccttcctgttcaccacccagaagaacacccccctgggcaccaagctgaagtacgaggtggacaccagcggcatctaccacatcaaccaggagatcttcagaatgttccccaaggacatgccctactacagaagccagttcaagaagtgcgccgtggtgggcaacggcggcatcctgaagaacagcagatgcggcagagagatcaacagcgccgacttcgtgttcagatgcaacctgccccccatcagcgagaagtacaccatggacgtgggcgtgaagaccgacgtggtgaccgtgaaccccagcatcatcaccgagagattccacaagctggagaagtggagaagacccttctacagagtgctgcaggtgtacgagaacgccagcgtgctgctgcccgccttctacaacaccagaaacaccgacgtgagcatcagagtgaagtacgtgctggacgacttcgagagcccccaggccgtgtactacttccacccccagtacctggtgaacgtgagcagatactggctgagcctgggcgtgagagccaagagaatcagcaccggcctgatcctggtgaccgccgccctggagctgtgcgaggaggtgcacctgttcggcttctgggccttccccatgaaccccagcggcctgtacatcacccaccactactacgacaacgtgaagcccagacccggcttccacgccatgcccagcgagatcttcaacttcctgcacctgcacagcagaggcatcctgagagtgcacaccggcacctgcagctgctgctag

SEQ ID NO: 22607 - DNA, 1239 bp, Artificial Sequence
  Description of Artificial Sequence: Synthetic coding sequence
atgagatacgccgaccccagcgccaacagagacctgctgggcagcagaaccctgctgttcatcttcatctgcgccttcgccctggtgaccctgctgcagcagatcctgtacggcagaaactacatcaagagaggcctgcagttcggctggcagagcggcgaccagctgaccaactggaccggcctgttcaacgtgaccgacgaccccgccgtgcagagcggcagcgacagcagcagcagatacttcgagttctacgagggccccttcgagtacaacagcaccagatgcctggagctgagacacgagatcctggaggtgaaggtgctgagcatggtgaagcagagcgagctgttcgacagatggaagagcctgcagatgtgcaagtgggccatgaacatcagcgaggccaaccagttcaagagcaccctgagcagatgctgcaacgcccccgccttcctgttcaccacccagaagaacacccccctgggcaccaagctgaagtacgaggtggacaccagcggcatctaccacatcaaccaggagatcttcagaatgttccccaaggacatgccctactacagaagccagttcaagaagtgcgccgtggtgggcaacggcggcatcctgaagaacagcagatgcggcagagagatcaacagcgccgacttcgtgttcagatgcaacctgccccccatcagcgagaagtacaccatggacgtgggcgtgaagaccgacgtggtgaccgtgaaccccagcatcatcaccgagagattccacaagctggagaagtggagaagacccttctacagagtgctgcaggtgtacgagaacgccagcgtgctgctgcccgccttctacaacaccagaaacaccgacgtgagcatcagagtgaagtacgtgctggacgacttcgagagcccccaggccgtgtactacttccacccccagtacctggtgaacgtgagcagatactggctgagcctgggcgtgagagccaagagaatcagcaccggcctgatcctggtgaccgccgccctggagctgtgcgaggaggtgcacctgttcggcttctgggccttccccatgaaccccagcggcctgtacatcacccaccactactacgacaacgtgaagcccagacccggcttccacgccatgcccagcgagatcttcaacttcctgcacctgcacagcagaggcatcctgagagtgcacaccggcacctgcagctgctgctag

SEQ ID NO: 22608 - DNA, 1197 bp, Artificial Sequence
  Description of Artificial Sequence: Synthetic coding sequence
atgagacccggcggcgccctgctggccctgctggccagcctgctgctgctgctgctgctgagactgctgtggtgccccgccgacgcccccggcagagccagaatcctggtggaggagagcagagaggccacccacggcacccccgccgccctgagaaccctgagaagccccgccaccgccgtgcccagagccaccaacagcacctacctgaacgagaagagcctgcagctgaccgagaagtgcaagaacctgcagtacggcatcgagagcttcagcaacaagaccaagggctacagcgagaacgactacctgcagatcatcaccgacatccagagctgcccctggaagagacaggccgaggagtacgccaacttcagagccaagctggccagctgctgcgacgccgtgcagaacttcgtggtgagccagaacaacacccccgtgggcaccaacatgagctacgaggtggagagcaagaaggagatccccatcaagaagaacatcttccacatgttccccgtgagccagcccttcgtggactacccctacaaccagtgcgccgtggtgggcaacggcggcatcctgaacaagagcctgtgcggcaccgagatcgacaagagcgacttcgtgttcagatgcaacctgccccccaccaccggcgacgtgagcaaggacgtgggcagcaagaccaacctggtgaccatcaaccccagcatcatcaccctgaagtacggcaacctgaaggagaagaaggccctgttcctggaggacatcgccacctacggcgacgccttcttcctgctgcccgccttcagcttcagagccaacaccggcaccagcttcaaggtgtactacaccctggaggagagcaaggccagacagaaggtgctgttcttccaccccaagtacctgaaggacctggccctgttctggagaaccaagggcgtgaccgcctacagactgagcaccggcctgatgatcaccagcgtggccgtggagctgtgcaagaacgtgaagctgtacggcttctggcccttcagcaagaccgtggaggacatccccgtgagccaccactactacgacaacaagctgcccaagcacggcttccaccagatgcccaaggagtacagccagatcctgcagctgcacatgaagggcatcctgaagctgcagttcagcaagtgcgaggtggcctag

SEQ ID NO: 22609 - DNA, 414 bp, Artificial Sequence
  Description of Artificial Sequence: Synthetic coding sequence
atgttccccgtgagccagcccttcgtggactacccctacaaccagtgcgccgtggtgggcaacggcggcatcctgaacaagagcctgtgcggcaccgagatcgacaagagcgacttcgtgttcagatgcaacctgccccccaccaccggcgacgtgagcaaggacgtgggcagcaagaccaacctggtgaccatcaaccccagcatcatcaccctgaagtacggcaacctgaaggagaagaaggccctgttcctggaggacatcgccacctacggcgacgccttcttcctgctgcccgccttcagcttcagagccaacaccggcaccagcttcaaggtgtactacaccctggaggagagcaaggccagacagaagtgcaagaccaagagaaagaccatcaacagcatcctgtag

SEQ ID NO: 22610 - DNA, 387 bp, Artificial Sequence
  Description of Artificial Sequence: Synthetic coding sequence
tgatacccctacaaccagtgcgccgtggtgggcaacggcggcatcctgaacaagagcctgtgcggcaccgagatcgacaagagcgacttcgtgttcagatgcaacctgccccccaccaccggcgacgtgagcaaggacgtgggcagcaagaccaacctggtgaccatcaaccccagcatcatcaccctgaagtacggcaacctgaaggagaagaaggccctgttcctggaggacatcgccacctacggcgacgccttcttcctgctgcccgccttcagcttcagagccaacaccggcaccagcttcaaggtgtactacaccctggaggagagcaaggccagacagaagtgcaagaccaagagaaagaccatcaacagcatcctgtag

SEQ ID NO: 22611 - DNA, 7713 bp, Artificial Sequence
  Description of Artificial Sequence: Synthetic coding sequence
atggccggccccagaggcctgctgcccctgtgcctgctggccttctgcctggccggcttcagcttcgtgagaggccaggtgctgttcaagggctgcgacgtgaagaccaccttcgtgacccacgtgccctgcaccagctgcgccgccatcaagaagcagacctgccccagcggctggctgagagagctgcccgaccagatcacccaggactgcagatacgaggtgcagctgggcggcagcatggtgagcatgagcggctgcagaagaaagtgcagaaagcaggtggtgcagaaggcctgctgccccggctactggggcagcagatgccacgagtgccccggcggcgccgagaccccctgcaacggccacggcacctgcctggacggcatggacagaaacggcacctgcgtgtgccaggagaacttcagaggcagcgcctgccaggagtgccaggaccccaacagattcggccccgactgccagagcgtgtgcagctgcgtgcacggcgtgtgcaaccacggccccagaggcgacggcagctgcctgtgcttcgccggctacaccggcccccactgcgaccaggagctgcccgtgtgccaggagctgagatgcccccagaacacccagtgcagcgccgaggcccccagctgcagatgcctgcccggctacacccagcagggcagcgagtgcagagcccccaacccctgctggcccagcccctgcagcctgctggcccagtgcagcgtgagccccaagggccaggcccagtgccactgccccgagaactaccacggcgacggcatggtgtgcctgcccaaggacccctgcaccgacaacctgggcggctgccccagcaacagcaccctgtgcgtgtaccagaagcccggccaggccttctgcacctgcagacccggcctggtgagcatcaacagcaacgccagcgccggctgcttcgccttctgcagccccttcagctgcgacagaagcgccacctgccaggtgaccgccgacggcaagaccagctgcgtgtgcagagagagcgaggtgggcgacggcagagcctgctacggccacctgctgcacgaggtgcagaaggccacccagaccggcagagtgttcctgcagctgagagtggccgtggccatgatggaccagggctgcagagagatcctgaccaccgccggccccttcaccgtgctggtgcccagcgtgagcagcttcagcagcagaaccatgaacgccagcctggcccagcagctgtgcagacagcacatcatcgccggccagcacatcctggaggacaccagaacccagcagaccagaagatggtggaccctggccggccaggagatcaccgtgaccttcaaccagttcaccaagtacagctacaagtacaaggaccagccccagcagaccttcaacatctacaaggccaacaacatcgccgccaacggcgtgttccacgtggtgaccggcctgagatggcaggcccccagcggcacccccggcgaccccaagagaaccatcggccagatcctggccagcaccgaggccttcagcagattcgagaccatcctggagaactgcggcctgcccagcatcctggacggccccggccccttcaccgtgttcgcccccagcaacgaggccgtggacagcctgagagacggcagactgatctacctgttcaccgccggcctgagcaagctgcaggagctggtgagataccacatctacaaccacggccagctgaccgtggagaagctgatcagcaagggcagaatcctgaccatggccaaccaggtgctggccgtgaacatcagcgaggagggcagaatcctgctgggccccgagggcgtgcccctgcagagagtggacgtgatggccgccaacggcgtgatccacatgctggacggcatcctgctgccccccaccatcctgcccatcctgcccaagcactgcagcgaggagcagcacaagatcgtggccggcagctgcgtggactgccaggccctgaacaccagcacctgcccccccaacagcgtgaagctggacatcttccccaaggagtgcgtgtacatccacgaccccaccggcctgaacgtgctgaagaagggctgcgccagctactgcaaccagaccatcatggagcagggctgctgcaagggcttcttcggccccgactgcacccagtgccccggcggcttcagcaacccctgctacggcaagggcaactgcagcgacggcatccagggcaacggcgcctgcctgtgcttccccgactacaagggcatcgcctgccacatctgcagcaaccccaacaagcacggcgagcagtgccaggaggactgcggctgcgtgcacggcctgtgcgacaacagacccggcagcggcggcgtgtgccagcagggcacctgcgcccccggcttcagcggcagattctgcaacgagagcatgggcgactgcggccccaccggcctggcccagcactgccacctgcacgccagatgcgtgagccaggagggcgtggccagatgcagatgcctggacggcttcgagggcgacggcttcagctgcacccccagcaacccctgcagccaccccgacagaggcggctgcagcgagaacgccgagtgcgtgcccggcagcctgggcacccaccactgcacctgccacaagggctggagcggcgacggcagagtgtgcgtggccatcgacgagtgcgagctggacatgagaggcggctgccacaccgacgccctgtgcagctacgtgggccccggccagagcagatgcacctgcaagctgggcttcgccggcgacggctaccagtgcagccccatcgacccctgcagagccggcaacggcggctgccacggcctggccacctgcagagccgtgggcggcggccagagagtgtgcacctgcccccccggcttcggcggcgacggcttcagctgctacggcgacatcttcagagagctggaggccaacgcccacttcagcatcttctaccagtggctgaagagcgccggcatcaccctgcccgccgacagaagagtgaccgccctggtgcccagcgaggccgccgtgagacagctgagccccgaggacagagccttctggctgcagcccagaaccctgcccaacctggtgagagcccacttcctgcagggcgccctgttcgaggaggagctggccagactgggcggccaggaggtggccaccctgaaccccaccaccagatgggagatcagaaacatcagcggcagagtgtgggtgcagaacgccagcgtggacgtggccgacctgctggccaccaacggcgtgctgcacatcctgagccaggtgctgctgccccccagaggcgacgtgcccggcggccagggcctgctgcagcagctggacctggtgcccgccttcagcctgttcagagagctgctgcagcaccacggcctggtgccccagatcgaggccgccaccgcctacaccatcttcgtgcccaccaacagaagcctggaggcccagggcaacagcagccacctggacgccgacaccgtgagacaccacgtggtgctgggcgaggccctgagcatggagaccctgagaaagggcggccacagaaacagcctgctgggccccgcccactggatcgtgttctacaaccacagcggccagcccgaggtgaaccacgtgcccctggagggccccatgctggaggcccccggcagaagcctgatcggcctgagcggcgtgctgaccgtgggcagcagcagatgcctgcacagccacgccgaggccctgagagagaagtgcgtgaactgcaccagaagattcagatgcacccagggcttccagctgcaggacacccccagaaagagctgcgtgtacagaagcggcttcagcttcagcagaggctgcagctacacctgcgccaagaagatccaggtgcccgactgctgccccggcttcttcggcaccctgtgcgagccctgccccggcggcctgggcggcgtgtgcagcggccacggccagtgccaggacagattcctgggcagcggcgagtgccactgccacgagggcttccacggcaccgcctgcgaggtgtgcgagctgggcagatacggccccaactgcaccggcgtgtgcgactgcgcccacggcctgtgccaggagggcctgcagggcgacggcagctgcgtgtgcaacgtgggctggcagggcctgagatgcgaccagaagatcaccagcccccagtgccccagaaagtgcgaccccaacgccaactgcgtgcaggacagcgccggcgccagcacctgcgcctgcgccgccggctacagcggcaacggcatcttctgcagcgaggtggacccctgcgcccacggccacggcggctgcagcccccacgccaactgcaccaaggtggcccccggccagagaacctgcacctgccaggacggctacatgggcgacggcgagctgtgccaggagatcaacagctgcctgatccaccacggcggctgccacatccacgccgagtgcatccccaccggcccccagcaggtgagctgcagctgcagagagggctacagcggcgacggcatcagaacctgcgagctgctggacccctgcagcaagaacaacggcggctgcagcccctacgccacctgcaagagcaccggcgacggccagagaacctgcacctgcgacaccgcccacaccgtgggcgacggcctgacctgcagagccagagtgggcctggagctgctgagagacaagcacgccagcttcttcagcctgagactgctggagtacaaggagctgaagggcgacggccccttcaccatcttcgtgccccacgccgacctgatgagcaacctgagccaggacgagctggccagaatcagagcccacagacagctggtgttcagataccacgtggtgggctgcagaagactgagaagcgaggacctgctggagcagggctacgccaccgccctgagcggccaccccctgagattcagcgagagagagggcagcatctacctgaacgacttcgccagagtggtgagcagcgaccacgaggccgtgaacggcatcctgcacttcatcgacagagtgctgctgccccccgaggccctgcactgggagcccgacgacgcccccatccccagaagaaacgtgaccgccgccgcccagggcttcggctacaagatcttcagcggcctgctgaaggtggccggcctgctgcccctgctgagagaggccagccacagacccttcaccatgctgtggcccaccgacgccgccttcagagccctgccccccgacagacaggcctggctgtaccacgaggaccacagagacaagctggccgccatcctgagaggccacatgatcagaaacgtggaggccctggccagcgacctgcccaacctgggccccctgagaaccatgcacggcacccccatcagcttcagctgcagcagaaccagagccggcgagctgatggtgggcgaggacgacgccagaatcgtgcagagacacctgcccttcgagggcggcctggcctacggcatcgaccagctgctggagccccccggcctgggcgccagatgcgaccacttcgagaccagacccctgagactgaacacctgcagcatctgcggcctggagcccccctgccccgagggcagccaggagcagggcagccccgaggcctgctggagattctaccccaagttctggaccagcccccccctgcacagcctgggcctgagaagcgtgtgggtgcaccccagcctgtggggcagaccccagggcctgggcagaggctgccacagaaactgcgtgaccaccacctggaagcccagctgctgccccggccactacggcagcgagtgccaggcctgccccggcggccccagcagcccctgcagcgacagaggcgtgtgcatggacggcatgagcggcagcggccagtgcctgtgcagaagcggcttcgccggcaccgcctgcgagctgtgcgcccccggcgccttcggcccccactgccaggcctgcagatgcaccgtgcacggcagatgcgacgagggcctgggcggcagcggcagctgcttctgcgacgagggctggaccggccccagatgcgaggtgcagctggagctgcagcccgtgtgcacccccccctgcgcccccgaggccgtgtgcagagccggcaacagctgcgagtgcagcctgggctacgagggcgacggcagagtgtgcaccgtggccgacctgtgccaggacggccacggcggctgcagcgagcacgccaactgcagccaggtgggcaccatggtgacctgcacctgcctgcccgactacgagggcgacggctggagctgcagagccagaaacccctgcaccgacggccacagaggcggctgcagcgagcacgccaactgcctgagcaccggcctgaacaccagaagatgcgagtgccacgccggctacgtgggcgacggcctgcagtgcctggaggagagcgagccccccgtggacagatgcctgggccagccccccccctgccacagcgacgccatgtgcaccgacctgcacttccaggagaagagagccggcgtgttccacctgcaggccaccagcggcccctacggcctgaacttcagcgaggccgaggccgcctgcgaggcccagggcgccgtgctggccagcttcccccagctgagcgccgcccagcagctgggcttccacctgtgcctgatgggctggctggccaacggcagcaccgcccaccccgtggtgttccccgtggccgactgcggcaacggcagagtgggcatcgtgagcctgggcgccagaaagaacctgagcgagagatgggacgcctactgcttcagagtgcaggacgtggcctgcagatgcagaaacggcttcgtgggcgacggcatcagcacctgcaacggcaagctgctggacgtgctggccgccaccgccaacttcagcaccttctacggcatgctgctgggctacgccaacgccacccagagaggcctggacttcctggacttcctggacgacgagctgacctacaagaccctgttcgtgcccgtgaacgagggcttcgtggacaacatgaccctgagcggccccgacctggagctgcacgccagcaacgccaccctgctgagcgccaacgccagccagggcaagctgctgcccgcccacagcggcctgagcctgatcatcagcgacgccggccccgacaacagcagctgggcccccgtggcccccggcaccgtggtggtgagcagaatcatcgtgtgggacatcatggccttcaacggcatcatccacgccctggccagccccctgctggcccccccccagccccaggccgtgctggcccccgaggccccccccgtggccgccggcgtgggcgccgtgctggccgccggcgccctgctgggcctggtggccggcgccctgtacctgagagccagaggcaagcccatgggcttcggcttcagcgccttccaggccgaggacgacgccgacgacgacttcagcccctggcaggagggcaccaaccccaccctggtgagcgtgcccaaccccgtgttcggcagcgacaccttctgcgagcccttcgacgacagcctgctggaggaggacttccccgacacccagagaatcctgaccgtgaagtag

SEQ ID NO: 22612 - DNA, 3003 bp, Artificial Sequence
  Description of Artificial Sequence: Synthetic coding sequence
atgggcagaagaaccctgttcatcggctgccagcccaagtgcgtgagaaccgtgatcaccagagagtgctgcgccggcttcttcggcccccagtgccagccctgccccggcaacgcccagaacgtgtgcttcggcaacggcatctgcctggacggcgtgaacggcaccggcgtgtgcgagtgcggcgagggcttcagcggcaccgcctgcgagacctgcaccgagggcaagtacggcatccactgcgaccaggcctgcagctgcgtgcacggcagatgcaaccagggccccctgggcgacggcagctgcgactgcgacgtgggctggagaggcgtgcactgcgacaacgccaccaccgaggacaactgcaacggcacctgccacaccagcgccaactgcctgaccaacagcgacggcaccgccagctgcaagtgcgccgccggcttccagggcaacggcaccatctgcaccgccatcaacgcctgcgagatcagcaacggcggctgcagcgccaaggccgactgcaagagaaccacccccggcagaagagtgtgcacctgcaaggccggctacaccggcgacggcatcgtgtgcctggagatcaacccctgcctggagaaccacggcggctgcgacaagaacgccgagtgcacccagaccggccccaaccaggccgcctgcaactgcctgcccgcctacaccggcgacggcaaggtgtgcaccctgatcaacgtgtgcctgaccaagaacggcggctgcagcgagttcgccatctgcaaccacaccggccaggtggagagaacctgcacctgcaagcccaactacatcggcgacggcttcacctgcagaggcagcatctaccaggagctgcccaagaaccccaagaccagccagtacttcttccagctgcaggagcacttcgtgaaggacctggtgggccccggccccttcaccgtgttcgcccccctgagcgccgccttcgacgaggaggccagagtgaaggactgggacaagtacggcctgatgccccaggtgctgagataccacgtggtggcctgccaccagctgctgctggagaacctgaagctgatcagcaacgccaccagcctgcagggcgagcccatcgtgatcagcgtgagccagagcaccgtgtacatcaacaacaaggccaagatcatcagcagcgacatcatcagcaccaacggcatcgtgcacatcatcgacaagctgctgagccccaagaacctgctgatcacccccaaggacaacagcggcagaatcctgcagaacctgaccaccctggccaccaacaacggctacatcaagttcagcaacctgatccaggacagcggcctgctgagcgtgatcaccgaccccatccacacccccgtgaccctgttctggcccaccgaccaggccctgcacgccctgcccgccgagcagcaggacttcctgttcaaccaggacaacaaggacaagctgaaggagtacctgaagttccacgtgatcagagacgccaaggtgctggccgtggacctgcccaccagcaccgcctggaagaccctgcagggcagcgagctgagcgtgaagtgcggcgccggcagagacatcggcgacctgttcctgaacggccagacctgcagaatcgtgcagagagagctgctgttcgacctgggcgtggcctacggcatcgactgcctgctgatcgaccccaccctgggcggcagatgcgacaccttcaccaccttcgacgccagcggcgagtgcggcagctgcgtgaacacccccagctgccccagatggagcaagcccaagggcgtgaagcagaagtgcctgtacaacctgcccttcaagagaaacctggagggctgcagagagagatgcagcctggtgatccagatccccagatgctgcaagggctacttcggcagagactgccaggcctgccccggcggccccgacgccccctgcaacaacagaggcgtgtgcctggaccagtacagcgccaccggcgagtgcaagtgcaacaccggcttcaacggcaccgcctgcgagatgtgctggcccggcagattcggccccgactgcctgccctgcggctgcagcgaccacggccagtgcgacgacggcatcaccggcagcggccagtgcctgtgcgagaccggctggaccggccccagctgcgacacccaggccgtgctgcccgccgtgtgcacccccccctgcagcgcccacgccacctgcaaggagaacaacacctgcgagtgcaacctggactacgagggcgacggcatcacctgcaccgtggtggacttctgcaagcaggacaacggcggctgcgccaaggtggccagatgcagccagaagggcaccaaggtgagctgcagctgccagaagggctacaagggcgacggccacagctgcaccgagatcgacccctgcgccgacggcctgaacggcggctgccacgagcacgccacctgcaagatgaccggccccggcaagcacaagtgcgagtgcaagagccactacgtgggcgacggcctgaactgcgagcccgagcagctgcccatcgacagatgcctgcaggacaacggccagtgccacgccgacgccaagtgcgtggacctgcacttccaggacaccaccgtgggcgtgttccacctgagaagccccctgggccagtacaagctgaccttcgacaaggccagagaggcctgcgccaacgaggccgccaccatggccacctacaaccagctgagctacgcccagaaggccaagtaccacctgtgcagcgccggctggctggagaccggcagagtggcctaccccaccgccttcgccagccagaactgcggcagcggcgtggtgggcatcgtggactacggccccagacccaacaagagcgagatgtgggacgtgttctgctacagaatgaagggcagcgccggcctgttccagcagctgagcagcagaccctgcatcagcagaacccccgactag

SEQ ID NO: 22613 - DNA, 7656 bp, Artificial Sequence
  Description of Artificial Sequence: Synthetic coding sequence
atgatgctgcagcacctggtgatcttctgcctgggcctggtggtgcagaacttctgcagccccgccgagaccaccggccaggccagaagatgcgacagaaagagcctgctgaccatcagaaccgagtgcagaagctgcgccctgaacctgggcgtgaagtgccccgacggctacaccatgatcaccagcggcagcgtgggcgtgagagactgcagatacaccttcgaggtgagaacctacagcctgagcctgcccggctgcagacacatctgcagaaaggactacctgcagcccagatgctgccccggcagatggggccccgactgcatcgagtgccccggcggcgccggcagcccctgcaacggcagaggcagctgcgccgagggcatggagggcaacggcacctgcagctgccaggagggcttcggcggcaccgcctgcgagacctgcgccgacgacaacctgttcggccccagctgcagcagcgtgtgcaactgcgtgcacggcgtgtgcaacagcggcctggacggcgacggcacctgcgagtgctacagcgcctacaccggccccaagtgcgacaagcccatccccgagtgcgccgccctgctgtgccccgagaacagcagatgcagccccagcaccgaggacgagaacaagctggagtgcaagtgcctgcccaactacagaggcgacggcaagtactgcgaccccatcaacccctgcctgagaaagatctgccacccccacgcccactgcacctacctgggccccaacagacacagctgcacctgccaggagggctacagaggcgacggccaggtgtgcctgcccgtggacccctgccagatcaacttcggcaactgccccaccaagagcaccgtgtgcaagtacgacggccccggccagagccactgcgagtgcaaggagcactaccagaacttcgtgcccggcgtgggctgcagcatgaccgacatctgcaagagcgacaacccctgccacagaaacgccaactgcaccaccgtggcccccggcagaaccgagtgcatctgccagaagggctacgtgggcgacggcctgacctgctacggcaacatcatggagagactgagagagctgaacaccgagcccagaggcaagtggcagggcagactgaccagcttcatcagcctgctggacaaggcctacgcctggcccctgagcaagctgggccccttcaccgtgctgctgcccaccgacaagggcctgaagggcttcaacgtgaacgagctgctggtggacaacaaggccgcccagtacttcgtgaagctgcacatcatcgccggccagatgaacatcgagtacatgaacaacaccgacatgttctacaccctgaccggcaagagcggcgagatcttcaacagcgacaaggacaaccagatcaagctgaagctgcacggcggcaagaagaaggtgaagatcatccagggcgacatcatcgccagcaacggcctgctgcacatcctggacagagccatggacaagctggagcccaccttcgagagcaacaacgagcagaccatcatgaccatgctgcagcccagatacagcaagttcagaagcctgctggaggagaccaacctgggccacgccctggacgaggacggcgtgggcggcccctacaccatcttcgtgcccaacaacgaggccctgaacaacatgaaggacggcaccctggactacctgctgagccccgagggcagcagaaagctgctggagctggtgagataccacatcgtgcccttcacccagctggaggtggccaccctgatcagcaccccccacatcagaagcatggccaaccagctgatccagttcaacaccaccgacaacggccagatcctggccaacgacgtggccatggaggagatcgagatcaccgccaagaacggcagaatctacaccctgaccggcgtgctgatcccccccagcatcgtgcccatcctgccccacagatgcgacgagaccaagagagagatgaagctgggcacctgcgtgagctgcagcctggtgtactggagcagatgccccgccaacagcgagcccaccgccctgttcacccacagatgcgtgtacagcggcagattcggcagcctgaagagcggctgcgccagatactgcaacgccaccgtgaagatccccaagtgctgcaagggcttctacggccccgactgcaaccagtgccccggcggcttcagcaacccctgcagcggcaacggccagtgcgccgacagcctgggcggcaacggcacctgcatctgcgaggagggcttccagggcagccagtgccagttctgcagcgaccccaacaagtacggccccagatgcaacaagaagtgcctgtgcgtgcacggcacctgcaacaacagaatcgacagcgacggcgcctgcctgaccggcacctgcagagacggcagcgccggcagactgtgcgacaagcagaccagcgcctgcggcccctacgtgcagttctgccacatccacgccacctgcgagtacagcaacggcaccgccagctgcatctgcaaggccggctacgagggcgacggcaccctgtgcagcgagatggacccctgcaccggcctgacccccggcggctgcagcagaaacgccgagtgcatcaagaccggcaccggcacccacacctgcgtgtgccagcagggctggaccggcaacggcagagactgcagcgagatcaacaactgcctgctgcccagcgccggcggctgccacgacaacgccagctgcctgtacgtgggccccggccagaacgagtgcgagtgcaagaagggcttcagaggcaacggcatcgactgcgagcccatcaccagctgcctggagcagaccggcaagtgccaccccctggccagctgccagagcaccagcagcggcgtgtggagctgcgtgtgccaggagggctacgagggcgacggcttcctgtgctacggcaacgccgccgtggagctgagcttcctgagcgaggccgccatcttcaacagatggatcaacaacgccagcctgcagcccaccctgagcgccaccagcaacctgaccgtgctggtgcccagccagcaggccaccgaggacatggaccaggacgagaagagcttctggctgagccagagcaacatccccgccctgatcaagtaccacatgctgctgggcacctacagagtggccgacctgcagaccctgagcagcagcgacatgctggccaccagcctgcagggcaacttcctgcacctggccaaggtggacggcaacatcaccatcgagggcgccagcatcgtggacggcgacaacgccgccaccaacggcgtgatccacatcatcaacaaggtgctggtgccccagagaagactgaccggcagcctgcccaacctgctgatgagactggagcagatgcccgactacagcatcttcagaggctacatcatccagtacaacctggccaacgccatcgaggccgccgacgcctacaccgtgttcgcccccaacaacaacgccatcgagaactacatcagagagaagaaggtgctgagcctggaggaggacgtgctgagataccacgtggtgctggaggagaagctgctgaagaacgacctgcacaacggcatgcacagagagaccatgctgggcttcagctacttcctgagcttcttcctgcacaacgaccagctgtacgtgaacgaggcccccatcaactacaccaacgtggccaccgacaagggcgtgatccacggcctgggcaaggtgctggagatccagaagaacagatgcgacaacaacgacaccaccatcatcagaggcagatgcagaacctgcagcagcgagctgacctgccccttcggcaccaagagcctgggcaacgagaagagaagatgcatctacaccagctacttcatgggcagaagaaccctgttcatcggctgccagcccaagtgcgtgagaaccgtgatcaccagagagtgctgcgccggcttcttcggcccccagtgccagccctgccccggcaacgcccagaacgtgtgcttcggcaacggcatctgcctggacggcgtgaacggcaccggcgtgtgcgagtgcggcgagggcttcagcggcaccgcctgcgagacctgcaccgagggcaagtacggcatccactgcgaccaggcctgcagctgcgtgcacggcagatgcaaccagggccccctgggcgacggcagctgcgactgcgacgtgggctggagaggcgtgcactgcgacaacgccaccaccgaggacaactgcaacggcacctgccacaccagcgccaactgcctgaccaacagcgacggcaccgccagctgcaagtgcgccgccggcttccagggcaacggcaccatctgcaccgccatcaacgcctgcgagatcagcaacggcggctgcagcgccaaggccgactgcaagagaaccacccccggcagaagagtgtgcacctgcaaggccggctacaccggcgacggcatcgtgtgcctggagatcaacccctgcctggagaaccacggcggctgcgacaagaacgccgagtgcacccagaccggccccaaccaggccgcctgcaactgcctgcccgcctacaccggcgacggcaaggtgtgcaccctgatcaacgtgtgcctgaccaagaacggcggctgcagcgagttcgccatctgcaaccacaccggccaggtggagagaacctgcacctgcaagcccaactacatcggcgacggcttcacctgcagaggcagcatctaccaggagctgcccaagaaccccaagaccagccagtacttcttccagctgcaggagcacttcgtgaaggacctggtgggccccggccccttcaccgtgttcgcccccctgagcgccgccttcgacgaggaggccagagtgaaggactgggacaagtacggcctgatgccccaggtgctgagataccacgtggtggcctgccaccagctgctgctggagaacctgaagctgatcagcaacgccaccagcctgcagggcgagcccatcgtgatcagcgtgagccagagcaccgtgtacatcaacaacaaggccaagatcatcagcagcgacatcatcagcaccaacggcatcgtgcacatcatcgacaagctgctgagccccaagaacctgctgatcacccccaaggacaacagcggcagaatcctgcagaacctgaccaccctggccaccaacaacggctacatcaagttcagcaacctgatccaggacagcggcctgctgagcgtgatcaccgaccccatccacacccccgtgaccctgttctggcccaccgaccaggccctgcacgccctgcccgccgagcagcaggacttcctgttcaaccaggacaacaaggacaagctgaaggagtacctgaagttccacgtgatcagagacgccaaggtgctggccgtggacctgcccaccagcaccgcctggaagaccctgcagggcagcgagctgagcgtgaagtgcggcgccggcagagacatcggcgacctgttcctgaacggccagacctgcagaatcgtgcagagagagctgctgttcgacctgggcgtggcctacggcatcgactgcctgctgatcgaccccaccctgggcggcagatgcgacaccttcaccaccttcgacgccagcggcgagtgcggcagctgcgtgaacacccccagctgccccagatggagcaagcccaagggcgtgaagcagaagtgcctgtacaacctgcccttcaagagaaacctggagggctgcagagagagatgcagcctggtgatccagatccccagatgctgcaagggctacttcggcagagactgccaggcctgccccggcggccccgacgccccctgcaacaacagaggcgtgtgcctggaccagtacagcgccaccggcgagtgcaagtgcaacaccggcttcaacggcaccgcctgcgagatgtgctggcccggcagattcggccccgactgcctgccctgcggctgcagcgaccacggccagtgcgacgacggcatcaccggcagcggccagtgcctgtgcgagaccggctggaccggccccagctgcgacacccaggccgtgctgcccgccgtgtgcacccccccctgcagcgcccacgccacctgcaaggagaacaacacctgcgagtgcaacctggactacgagggcgacggcatcacctgcaccgtggtggacttctgcaagcaggacaacggcggctgcgccaaggtggccagatgcagccagaagggcaccaaggtgagctgcagctgccagaagggctacaagggcgacggccacagctgcaccgagatcgacccctgcgccgacggcctgaacggcggctgccacgagcacgccacctgcaagatgaccggccccggcaagcacaagtgcgagtgcaagagccactacgtgggcgacggcctgaactgcgagcccgagcagctgcccatcgacagatgcctgcaggacaacggccagtgccacgccgacgccaagtgcgtggacctgcacttccaggacaccaccgtgggcgtgttccacctgagaagccccctgggccagtacaagctgaccttcgacaaggccagagaggcctgcgccaacgaggccgccaccatggccacctacaaccagctgagctacgcccagaaggccaagtaccacctgtgcagcgccggctggctggagaccggcagagtggcctaccccaccgccttcgccagccagaactgcggcagcggcgtggtgggcatcgtggactacggccccagacccaacaagagcgagatgtgggacgtgttctgctacagaatgaaggacgtgaactgcacctgcaaggtgggctacgtgggcgacggcttcagctgcagcggcaacctgctgcaggtgctgatgagcttccccagcctgaccaacttcctgaccgaggtgctggcctacagcaacagcagcgccagaggcagagccttcctggagcacctgaccgacctgagcatcagaggcaccctgttcgtgccccagaacagcggcctgggcgagaacgagaccctgagcggcagagacatcgagcaccacctggccaacgtgagcatgttcttctacaacgacctggtgaacggcaccaccctgcagaccagactgggcagcaagctgctgatcaccgccagccaggaccccctgcagcccaccgagaccagattcgtggacggcagagccatcctgcagtgggacatcttcgccagcaacggcatcatccacgtgatcagcagacccctgaaggccccccccgcccccgtgaccctgacccacaccggcctgggcgccggcatcttcttcgccatcatcctggtgaccggcgccgtggccctggccgcctacagctacttcagaatcaacagaagaaccatcggcttccagcacttcgagagcgaggaggacatcaacgtggccgccctgggcaagcagcagcccgagaacatcagcaaccccctgtacgagagcaccaccagcgccccccccgagcccagctacgaccccttcaccgacagcgaggagagacagctggagggcaacgaccccctgagaaccctgtag

SEQ ID NO: 22614 - DNA, 1077 bp, Artificial Sequence
  Description of Artificial Sequence: Synthetic coding sequence
atgggcgccgtgtggagcgccctgctggtgggcggcggcctggccggcgccctgttcgtgtggctgctgagaggcggccccggcgacaccggcaaggacggcgacgccgagcaggagaaggacgcccccctgggcggcgccgccatccccggcggccaccagagcggcagcagcggcctgagccccggccccagcggccaggagctggtgaccaagcccgagcacctgcaggagagcaacggccacctgatcagcaagaccaaggacctgggcaagctgcaggccgccagctggagactgcagaaccccagcagagaggtgtgcgacaacagcagagagcacgtgcccagcggccagttccccgacaccgaggcccccgccaccagcgagaccagcaacagcagaagctacagcgaggtgagcagaaacgagagcctggagagccccatgggcgagtggggcttccagaagggccaggagatcagcgccaaggccgccacctgcttcgccgagaagctgcccagcagcaacctgctgaagaacagagccaaggaggagatgagcctgagcgacctgaacagccaggacagagtggaccacgaggagtgggagatggtgcccagacacagcagctggggcgacgtgggcgtgggcggcagcctgaaggcccccgtgctgaacctgaaccagggcatggacaacggcagaagcaccctggtggaggccagaggccagcaggtgcacggcaagatggagagagtggccgtgatgcccgccggcagccagcaggtgagcgtgagattccaggtgcactacgtgaccagcaccgacgtgcagttcatcgccgtgaccggcgaccacgagtgcctgggcagatggaacacctacatccccctgcactacaacaaggacggcttctggagccacagcatcttcctgcccgccgacaccgtggtggagtggaagttcgtgctggtggagaacggcggcgtgaccagatgggaggagtgcagcaacagattcctggagaccggccacgaggacaaggtggtgcacgcctggtggggcatccactag

SEQ ID NO: 22615 - DNA, 630 bp, Artificial Sequence
  Description of Artificial Sequence: Synthetic coding sequence
atgggcgagtggggcttccagaagggccaggagatcagcgccaaggccgccacctgcttcgccgagaagctgcccagcagcaacctgctgaagaacagagccaaggaggagatgagcctgagcgacctgaacagccaggacagagtggaccacgaggagtgggagatggtgcccagacacagcagctggggcgacgtgggcgtgggcggcagcctgaaggcccccgtgctgaacctgaaccagggcatggacaacggcagaagcaccctggtggaggccagaggccagcaggtgcacggcaagatggagagagtggccgtgatgcccgccggcagccagcaggtgagcgtgagattccaggtgcactacgtgaccagcaccgacgtgcagttcatcgccgtgaccggcgaccacgagtgcctgggcagatggaacacctacatccccctgcactacaacaaggacggcttctggagccacagcatcttcctgcccgccgacaccgtggtggagtggaagttcgtgctggtggagaacggcggcgtgaccagatgggaggagtgcagcaacagattcctggagaccggccacgaggacaaggtggtgcacgcctggtggggcatccactag

SEQ ID NO: 22616 - DNA, 1113 bp, Artificial Sequence
  Description of Artificial Sequence: Synthetic coding sequence
atgctgcccagaagactgctggccgcctggctggccggcaccagaggcggcggcctgctggccctgctggccaaccagtgcagattcgtgaccggcctgagagtgagaagagcccagcagatcgcccagctgtacggcagactgtacagcgagagcagcagaagagtgctgctgggcagactgtggagaagactgcacggcagacccggccacgccagcgccctgatggccgccctggccggcgtgttcgtgtgggacgaggagagaatccaggaggaggagctgcagagaagcatcaacgagatgaagagactggaggagatgagcaacatgttccagagcagcggcgtgcagcaccacccccccgagcccaaggcccagaccgagggcaacgaggacagcgagggcaaggagcagagatgggagatggtgatggacaagaagcacttcaagctgtggagaagacccatcaccggcacccacctgtaccagtacagagtgttcggcacctacaccgacgtgacccccagacagttcttcaacgtgcagctggacaccgagtacagaaagaagtgggacgccctggtgatcaagctggaggtgatcgagagagacgtggtgagcggcagcgaggtgctgcactgggtgacccacttcccctaccccatgtacagcagagactacgtgtacgtgagaagatacagcgtggaccaggagaacaacatgatggtgctggtgagcagagccgtggagcaccccagcgtgcccgagagccccgagttcgtgagagtgagaagctacgagagccagatggtgatcagaccccacaagagcttcgacgagaacggcttcgactacctgctgacctacagcgacaacccccagaccgtgttccccagatactgcgtgagctggatggtgagcagcggcatgcccgacttcctggagaagctgcacatggccaccctgaaggccaagaacatggagatcaaggtgaaggactacatcagcgccaagcccctggagatgagcagcgaggccaaggccaccagccagagcagcgagagaaagaacgagggcagctgcggccccgccagaatcgagtacgcctag

SEQ ID NO: 22617 - DNA, 738 bp, Artificial Sequence
  Description of Artificial Sequence: Synthetic coding sequence
atggagagcagaaaggacatcaccaaccaggaggagatctggaagatgaagcccagaagaaacctggaggacaacgactacctgcagaccgcccacgccgacgagttcgactgccccagcgagctgcagcacgcccaggagctgttcccccagtggcacctgcccatcaagatcgccgccgtgatggccagcctgaccttcctgtacaccctgctgagagaggtgatccaccccctggccaccagccaccagcagtacttctacaagatccccatcctggtgatcaacaaggtgctgcccatggtgagcatcaccctgctggccctggtgtacctgcccggcgtgatcgccgccatcgtgcaggtgcacaacggcaccaagtacaagaagttcccccactggctggacaagtggatgctgaccagaaagcagttcggcctgctgagcctgttcttcgccgtgctgcacgccatctacaccctgagctacgccatgagaagaagctacagatacaagctgctgaactgggcctaccagcaggtgcagcagaacaaggaggacgcctggatcgagcacgacgtgtggagaatggagatctacgtgagcctgggcatcgtgggcctggccatcctggccctgctggccgtgaccagcatccccagcgtgagcgacagcctgacctggagagagttccactacatccaggtgcacggcagaatcaacttcctgaccctgtag

SEQ ID NO: 22618 - DNA, 765 bp, Artificial Sequence
  Description of Artificial Sequence: Synthetic coding sequence
atggagagcagaaaggacatcaccaaccaggaggagatctggaagatgaagcccagaagaaacctggaggacaacgactacctgcacgaggacaccggcgagaccagcatgctgaagagacccgtgctgctgcacctgcagcagaccgcccacgccgacgagttcgactgccccagcgagctgcagcacgcccaggagctgttcccccagtggcacctgcccatcaagatcgccgccgtgatggccagcctgaccttcctgtacaccctgctgagagaggtgatccaccccctggccaccagccaccagcagtacttctacaagatccccatcctggtgatcaacaaggtgctgcccatggtgagcatcaccctgctggccctggtgtacctgcccggcgtgatcgccgccatcgtgcaggtgcacaacggcaccaagtacaagaagttcccccactggctggacaagtggatgctgaccagaaagcagttcggcctgctgagcctgttcttcgccgtgctgcacgccatctacaccctgagctacgccatgagaagaagctacagatacaagctgctgaactgggcctaccagcaggtgcagcagaacaaggaggacgcctggatcgagcacgacgtgtggagaatggagatctacgtgagcctgggcatcgtgggcctggccatcctggccctgctggccgtgaccagcatccccagcgtgagcgacagcctgacctggagagagttccactacatccagtag

SEQ ID NO: 22619 - DNA, 1029 bp, Artificial Sequence
  Description of Artificial Sequence: Synthetic coding sequence
atggagagcagaaaggacatcaccaaccaggaggagatctggaagatgaagcccagaagaaacctggaggacaacgactacctgcacgaggacaccggcgagaccagcatgctgaagagacccgtgctgctgcacctgcagcagaccgcccacgccgacgagttcgactgccccagcgagctgcagcacgcccaggagctgttcccccagtggcacctgcccatcaagatcgccgccgtgatggccagcctgaccttcctgtacaccctgctgagagaggtgatccaccccctggccaccagccaccagcagtacttctacaagatccccatcctggtgatcaacaaggtgctgcccatggtgagcatcaccctgctggccctggtgtacctgcccggcgtgatcgccgccatcgtgcaggtgcacaacggcaccaagtacaagaagttcccccactggctggacaagtggatgctgaccagaaagcagttcggcctgctgagcctgttcttcgccgtgctgcacgccatctacaccctgagctacgccatgagaagaagctacagatacaagctgctgaactgggcctaccagcaggtgcagcagaacaaggaggacgcctggatcgagcacgacgtgtggagaatggagatctacgtgagcctgggcatcgtgggcctggccatcctggccctgctggccgtgaccagcatccccagcgtgagcgacagcctgacctggagagagttccactacatccaggccatcctgaccggcagcctggtggccctgtgcaacttccaggccaccaagctggccaagacccagctggtgggcacccccaacttctggcaggagcagcagtgcggcatccacttccccccccccagcaagaccagaagctacatctacttcatcctgagcgccgccagccccagcaagggcaacgtgagcagccacatgttccagctgcacctggagaacctgaacaagaaggacaagctgctgctgatcatcttccagatctag

SEQ ID NO: 22620 - DNA, 771 bp, Artificial Sequence
  Description of Artificial Sequence: Synthetic coding sequence
atgcccggccccgccaccgacgccggcaagatccccttctgcgacgccaaggaggagatcagagccggcctggagagcagcgagggcggcggcggccccgagagacccggcgccagaggccagagacagaacatcgtgtggagaaacgtggtgctgatgagcctgctgcacctgggcgccgtgtacagcctggtgctgatccccaaggccaagcccctgaccctgctgtgggcctacttctgcttcctgctggccgccctgggcgtgaccgccggcgcccacagactgtggagccacagaagctacagagccaagctgcccctgagaatcttcctggccgtggccaacagcatggccttccagaacgacatcttcgagtggagcagagaccacagagcccaccacaagtacagcgagaccgacgccgacccccacaacgccagaagaggcttcttcttcagccacatcggctggctgttcgtgagaaagcacagagacgtgatcgagaagggcagaaagctggacgtgaccgacctgctggccgaccccgtggtgagaatccagagaaacacccagcacatccagaaggagggcagagccctgaaccaggaggccgcctgcgagatgctgagagagtggcaccagggccacatcctgaaggtgaccctgcccggcctgcacatcctggccctgctgcacacccactgcaaccacagcgagaagtgctgcctgatgctgagagccctgagcgtgagcctggaggtgttctag

SEQ ID NO: 22621 - DNA, 399 bp, Artificial Sequence
  Description of Artificial Sequence: Synthetic coding sequence
atgcccggccccgccaccgacgccggcaagatccccttctgcgacgccaaggaggagatcagagccggcctggagagcagcgagggcggcggcggccccgagagacccggcgccagaggccagagacagaacatcgtgtggagaaacgtggtgctgatgagcctgctgcacctgggcgccgtgtacagcctggtgctgatccccaaggccaagcccctgaccctgctgtgggcctacttctgcttcctgctggccgccctgggcgtgaccgccggcgcccacagactgtggagccacagaagctacagagccaagctgcccctgagaatcttcctggccgtggccaacagcatggccttccaggccgccgccgaggtggtgctgacccagatgccctag

SEQ ID NO: 22622 - DNA, 993 bp, Artificial Sequence
  Description of Artificial Sequence: Synthetic coding sequence
atgcccggccccgccaccgacgccggcaagatccccttctgcgacgccaaggaggagatcagagccggcctggagagcagcgagggcggcggcggccccgagagacccggcgccagaggccagagacagaacatcgtgtggagaaacgtggtgctgatgagcctgctgcacctgggcgccgtgtacagcctggtgctgatccccaaggccaagcccctgaccctgctgtgggcctacttctgcttcctgctggccgccctgggcgtgaccgccggcgcccacagactgtggagccacagaagctacagagccaagctgcccctgagaatcttcctggccgtggccaacagcatggccttccagaacgacatcttcgagtggagcagagaccacagagcccaccacaagtacagcgagaccgacgccgacccccacaacgccagaagaggcttcttcttcagccacatcggctggctgttcgtgagaaagcacagagacgtgatcgagaagggcagaaagctggacgtgaccgacctgctggccgaccccgtggtgagaatccagagaaagtactacaagatcagcgtggtgctgatgtgcttcgtggtgcccaccctggtgccctggtacatctggggcgagagcctgtggaacagctacttcctggccagcatcctgagatacaccatcagcctgaacatcagctggctggtgaacagcgccgcccacatgtacggcaacagaccctacgacaagcacatcagccccagacagaaccccctggtggccctgggcgccatcggcgagggcttccacaactaccaccacaccttccccttcgactacagcgccagcgagttcggcctgaacttcaaccccaccacctggttcatcgacttcatgtgctggctgggcctggccaccgacagaaagagagccaccaagcccatgatcgaggccagaaaggccagaaccggcgacagcagcgcctag

SEQ ID NO: 22623 - DNA, 867 bp, Artificial Sequence
  Description of Artificial Sequence: Synthetic coding sequence
atggccgagaagagacacaccagagacagcgaggcccagagactgcccgacagcttcaaggacagccccagcaagggcctgggcccctgcggctggatcctggtggccttcagcttcctgttcaccgtgatcaccttccccatcagcatctggatgtgcatcaagatcatcaaggagtacgagagagccatcatcttcagactgggcagaatcctgcagggcggcgccaagggccccggcctgttcttcatcctgccctgcaccgacagcttcatcaaggtggacatgagaaccatcagcttcgacatccccccccaggagatcctgaccaaggacagcgtgaccatcagcgtggacggcgtggtgtactacagagtgcagaacgccaccctggccgtggccaacatcaccaacgccgacagcgccaccagactgctggcccagaccaccctgagaaacgtgctgggcaccaagaacctgagccagatcctgagcgacagagaggagatcgcccacaacatgcagagcaccctggacgacgccaccgacgcctggggcatcaaggtggagagagtggagatcaaggacgtgaagctgcccgtgcagctgcagagagccatggccgccgaggccgaggccagcagagaggccagagccaaggtgatcgccgccgagggcgagatgaacgccagcagagccctgaaggaggccagcatggtgatcaccgagagccccgccgccctgcagctgagatacctgcagaccctgaccaccatcgccgccgagaagaacagcaccatcgtgttccccctgcccatcgacatgctgcagggcatcatcggcgccaagcacagccacctgggctag

SEQ ID NO: 22624 - DNA, 372 bp, Artificial Sequence
  Description of Artificial Sequence: Synthetic coding sequence
atggccgagaagagacacaccagagacagcgaggcccagagactgcccgacagcttcaaggacagccccagcaagggcctgggcccctgcggctggatcctggtggccttcagcttcctgttcaccgtgatcaccttccccatcagcatctggatgtgcatcaaggtgatcgccgccgagggcgagatgaacgccagcagagccctgaaggaggccagcatggtgatcaccgagagccccgccgccctgcagctgagatacctgcagaccctgaccaccatcgccgccgagaagaacagcaccatcgtgttccccctgcccatcgacatgctgcagggcatcatcggcgccaagcacagccacctgggctag

SEQ ID NO: 22625 - DNA, 714 bp, Artificial Sequence
  Description of Artificial Sequence: Synthetic coding sequence
atgtgcatcaagatcatcaaggagtacgagagagccatcatcttcagactgggcagaatcctgcagggcggcgccaagggccccggcctgttcttcatcctgccctgcaccgacagcttcatcaaggtggacatgagaaccatcagcttcgacatccccccccaggagatcctgaccaaggacagcgtgaccatcagcgtggacggcgtggtgtactacagagtgcagaacgccaccctggccgtggccaacatcaccaacgccgacagcgccaccagactgctggcccagaccaccctgagaaacgtgctgggcaccaagaacctgagccagatcctgagcgacagagaggagatcgcccacaacatgcagagcaccctggacgacgccaccgacgcctggggcatcaaggtggagagagtggagatcaaggacgtgaagctgcccgtgcagctgcagagagccatggccgccgaggccgaggccagcagagaggccagagccaaggtgatcgccgccgagggcgagatgaacgccagcagagccctgaaggaggccagcatggtgatcaccgagagccccgccgccctgcagctgagatacctgcagaccctgaccaccatcgccgccgagaagaacagcaccatcgtgttccccctgcccatcgacatgctgcagggcatcatcggcgccaagcacagccacctgggctag

SEQ ID NO: 22626 - DNA, 3549 bp, Artificial Sequence
  Description of Artificial Sequence: Synthetic coding sequence
atgtgcagcaccaaccccggcaagtgggtgaccttcgacgacgaccccgccgtgcagagcagccagaagagcaagaacttccccctggagaaccagggcgtgtgcagacccaacggcctgaagctgaacctgcccggcctgagagagttccccagcggcagcagcagcaccagcagcacccccctgagcagccccatcgtggacttctacttcagccccggcccccccagcaacagccccctgagcacccccaccaaggacttccccggcttccccggcatccccaaggccggcacccacgtgctgtaccccatccccgagagcagcagcgacagccccctggccatcagcggcggcgagagcagcctgctgcccaccagacccacctgcctgagccacgccctgctgcccagcgaccacagctgcacccaccccacccccaaggtgggcctgcccgacgaggtgaacccccagcaggccgagagcctgggcttccagagcgacgacctgccccagttccagtacttcagagaggactgcgccttcagcagccccttctggaaggacgagggcagcgacagccacttcaccctggacccccccggcagcaagaagatgttcagcagcagaaacaaggagatgcccatcgaccagaagagcctgaacaagtgcagcctgaactacatctgcgagaagctggagcacctgcagagcgccgagaaccaggacagcctgagaagcctgagcatgcactgcctgtgcgccgaggagaacgccagcagcttcgtgccccacaccctgttcagaagccagcccaagagcggctggagcttcatgctgagaatccccgagaagaagaacatgatgagcagcagacagtggggccccatcttcctgaaggtgctgcccggcggcatcctgcagatgtactacgagcagggcctggagaagcccttcaaggagatccagctggacccctactgcagactgagcgagcccaaggtggagaacttcagcgtggccggcaagatccacaccgtgaagatcgagcacgtgagctacaccgagaagagaaagtaccacagcaagaccgaggtggtgcacgagcccgacatcgagcagatgctgaagctgggcagcaccagctaccacgacttcctggacttcctgaccaccgtggaggaggagctgatgaagctgcccgccgtgagcaagcccaagaagaactacgaggagcaggagatcagcctggagatcgtggacaacttctggggcaaggtgaccaaggagggcaagttcgtggagagcgccgtgatcacccagatctactgcctgtgcttcgtgaacggcaacctggagtgcttcctgaccctgaacgacctggagctgcccaagagagacgagagctactacgagaaggacagcgagaagaagggcatcgacatcctggactaccacttccacaagtgcgtgaacgtgcaggagttcgagcagagcagaatcatcaagttcgtgcccctggacgcctgcagattcgagctgatgagattcaagaccctgtacaacggcgacaacctgcccttcagcctgaagagcgtggtggtggtgcagggcgcctacgtggagctgcaggccttcgtgaacatggccagcctggcccagagaagcagctacgccggcagcctgagaagctgcgacaacatcagaatccacttccccgtgcccagccagtggatcaaggccctgtggaccatgaacctgcagagacagaagagcctgaaggccaagatgaacagaagagcctgcctgggcagcctgcaggagctggagagcgagcccgtgatccaggtgaccgtgggcagcgccaagtacgagagcgcctaccaggccgtggtgtggaagatcgacagactgcccgacaagaacagcagcctggaccacccccactgcctgagctacaagctggagctgggcagcgaccaggagatccccagcgactggtaccccttcgccaccgtgcagttcagcgtgcccgacacctgcgccagcagaaccgaggtgagaagcctgggcgtggagagcgacgtgcagccccagaagcacgtgcagcagagagcctgctacaacatccagcccaagctgtacagaagcgtgatcgaggacgtgatcgagggcgtgagaaacctgttcgccgaggagggcatcgaggagcaggtgctgaaggacctgaagcagctgtgggagaccaaggtgctgcagagcaaggccaccgaggacttcttcagaaacagcatccagagccccctgttcaccctgcagctgccccacagcctgcaccagaccctgcagagcagcaccgccagcctggtgatccccgccggcagaaccctgcccagcttcaccaccgccgagctgggcaccagcaacagcagcgccaacttcaccttccccggctaccccatccacgtgcccgccggcgtgaccctgcagaccgtgagcggccacctgtacaaggtgaacgtgcccatcatggtgaccgagaccagcggcagagccggcatcctgcagcaccccatccagcaggtgttccagcagctgggccagcccagcgtgatccagaccagcgtgccccagctgaacccctggagcctgcaggccaccaccgagaagagccagagaatcgagaccgtgctgcagcagcccgccatcctgcccagcggccccgtggacagaaagcacctggagaacgccaccagcgacatcctggtgagccccggcaacgagcacaagatcgtgcccgaggccctgctgtgccaccaggagagcagccactacatcagcctgcccggcgtggtgttcagcccccaggtgagccagaccaacagcaacgtggagagcgtgctgagcggcagcgccagcatggcccagaacctgcacgacgagagcctgagcaccagcccccacggcgccctgcaccagcacgtgaccgacatccagctgcacatcctgaagaacagaatgtacggctgcgacagcgtgaagcagcccagaaacatcgaggagcccagcaacatccccgtgagcgagaaggacagcaacagccaggtggacctgagcatcagagtgaccgacgacgacatcggcgagatcatccaggtggacggcagcggcgacaccagcagcaacgaggagatcggcagcaccagagacgccgacgagaacgagttcctgggcaacatcgacggcggcgacctgaaggtgcccgaggaggaggccgacagcatcagcaacgaggacagcgccaccaacagcagcgacaacgaggacccccaggtgaacatcgtggaggaggaccccctgaacagcggcgacgacgtgagcgagcaggacgtgcccgacctgttcgacaccgacaacgtgatcgtgtgccagtacgacaagatccacagaagcaagaacaagtggaagttctacctgaaggacggcgtgatgtgcttcggcggcagagactacgtgttcgccaaggccatcggcgacgccgagtggtag

SEQ ID NO: 22627 - DNA, 1434 bp, Artificial Sequence
  Description of Artificial Sequence: Synthetic coding sequence
gcctgcctgttcctgatccccaagctgtacagaagcgtgatcgaggacgtgatcgagggcgtgagaaacctgttcgccgaggagggcatcgaggagcaggtgctgaaggacctgaagcagctgtgggagaccaaggtgctgcagagcaaggccaccgaggacttcttcagaaacagcatccagagccccctgttcaccctgcagctgccccacagcctgcaccagaccctgcagagcagcaccgccagcctggtgatccccgccggcagaaccctgcccagcttcaccaccgccgagctgggcaccagcaacagcagcgccaacttcaccttccccggctaccccatccacgtgcccgccggcgtgaccctgcagaccgtgagcggccacctgtacaaggtgaacgtgcccatcatggtgaccgagaccagcggcagagccggcatcctgcagcaccccatccagcaggtgttccagcagctgggccagcccagcgtgatccagaccagcgtgccccagctgaacccctggagcctgcaggccaccaccgagaagagccagagaatcgagaccgtgctgcagcagcccgccatcctgcccagcggccccgtggacagaaagcacctggagaacgccaccagcgacatcctggtgagccccggcaacgagcacaagatcgtgcccgaggccctgctgtgccaccaggagagcagccactacatcagcctgcccggcgtggtgttcagcccccaggtgagccagaccaacagcaacgtggagagcgtgctgagcggcagcgccagcatggcccagaacctgcacgacgagagcctgagcaccagcccccacggcgccctgcaccagcacgtgaccgacatccagctgcacatcctgaagaacagaatgtacggctgcgacagcgtgaagcagcccagaaacatcgaggagcccagcaacatccccgtgagcgagaaggacagcaacagccaggtggacctgagcatcagagtgaccgacgacgacatcggcgagatcatccaggtggacggcagcggcgacaccagcagcaacgaggagatcggcagcaccagagacgccgacgagaacgagttcctgggcaacatcgacggcggcgacctgaaggtgcccgaggaggaggccgacagcatcagcaacgaggacagcgccaccaacagcagcgacaacgaggacccccaggtgaacatcgtggaggaggaccccctgaacagcggcgacgacgtgagcgagcaggacgtgcccgacctgttcgacaccgacaacgtgatcgtgtgccagtacgacaagatccacagaagcaagaacaagtggaagttctacctgaaggacggcgtgatgtgcttcggcggcagagactacgtgttcgccaaggccatcggcgacgccgagtggtag

SEQ ID NO: 22628 - DNA, 3408 bp, Artificial Sequence
  Description of Artificial Sequence: Synthetic coding sequence
atgtgcagcaccaaccccggcaagtgggtgaccttcgacgacgaccccgccgtgcagagcagccagaagagcaagaacttccccctggagaaccagggcgtgtgcagacccaacggcctgaagctgaacctgcccggcctgagagagttccccagcggcagcagcagcaccagcagcacccccctgagcagccccatcgtggacttctacttcagccccggcccccccagcaacagccccctgagcacccccaccaaggacttccccggcttccccggcatccccaaggccggcacccacgtgctgtaccccatccccgagagcagcagcgacagccccctggccatcagcggcggcgagagcagcctgctgcccaccagacccacctgcctgagccacgccctgctgcccagcgaccacagctgcacccaccccacccccaaggtgggcctgcccgacgaggtgaacccccagcaggccgagagcctgggcttccagagcgacgacctgccccagttccagtacttcagagaggactgcgccttcagcagccccttctggaaggacgagggcagcgacagccacttcaccctggacccccccggcagcaagaagatgttcagcagcagaaacaaggagatgcccatcgaccagaagagcctgaacaagtgcagcctgaactacatctgcgagaagctggagcacctgcagagcgccgagaaccaggacagcctgagaagcctgagcatgcactgcctgtgcgccgaggagaacgccagcagcttcgtgccccacaccctgttcagaagccagcccaagagcggctggagcttcatgctgagaatccccgagaagaagaacatgatgagcagcagacagtggggccccatcttcctgaaggtgctgcccggcggcatcctgcagatgtactacgagcagggcctggagaagcccttcaaggagatccagctggacccctactgcagactgagcgagcccaaggtggagaacttcagcgtggccggcaagatccacaccgtgaagatcgagcacgtgagctacaccgagaagagaaagtaccacagcaagaccgaggtggtgcacgagcccgacatcgagcagatgctgaagctgggcagcaccagctaccacgacttcctggacttcctgaccaccgtggaggaggagctgatgaagctgcccgccgtgagcaagcccaagaagaactacgaggagcaggagatcagcctggagatcgtggacaacttctggggcaaggtgaccaaggagggcaagttcgtggagagcgccgtgatcacccagatctactgcctgtgcttcgtgaacggcaacctggagtgcttcctgaccctgaacgacctggagctgcccaagagagacgagagctactacgagaaggacagcgagaagaagggcatcgacatcctggactaccacttccacaagtgcgtgaacgtgcaggagttcgagcagagcagaatcatcaagttcgtgcccctggacgcctgcagattcgagctgatgagattcaagaccctgtacaacggcgacaacctgcccttcagcctgaagagcgtggtggtggtgcagggcgcctacgtggagctgcaggccttcgtgaacatggccagcctggcccagagaagcagctacgccggcagcctgagaagctgcgacaacatcagaatccacttccccgtgcccagccagtggatcaaggccctgtggaccatgaacctgcagagacagaagagcctgaaggccaagatgaacagaagagcctgcctgggcagcctgcaggagctggagagcgagcccgtgatccaggtgaccgtgggcagcgccaagtacgagagcgcctaccaggccgtggtgtggaagatcgacagactgcccgacaagaacagcagcctggaccacccccactgcctgagctacaagctggagctgggcagcgaccaggagatccccagcgactggtaccccttcgccaccgtgcagttcagcgtgcccgacacctgcgccagcagaaccgaggtgagaagcctgggcgtggagagcgacgtgcagccccagaagcacgtgcagcagagagcctgctacaacatccagcccaagctgtacagaagcgtgatcgaggacgtgatcgagggcgtgagaaacctgttcgccgaggagggcatcgaggagcaggtgctgaaggacctgaagcagctgtgggagaccaaggtgctgcagagcaaggccaccgaggacttcttcagaaacagcatccagagccccctgttcaccctgcagctgccccacagcctgcaccagaccctgcagagcagcaccggccacctgtacaaggtgaacgtgcccatcatggtgaccgagaccagcggcagagccggcatcctgcagcaccccatccagcaggtgttccagcagctgggccagcccagcgtgatccagaccagcgtgccccagctgaacccctggagcctgcaggccaccaccgagaagagccagagaatcgagaccgtgctgcagcagcccgccatcctgcccagcggccccgtggacagaaagcacctggagaacgccaccagcgacatcctggtgagccccggcaacgagcacaagatcgtgcccgaggccctgctgtgccaccaggagagcagccactacatcagcctgcccggcgtggtgttcagcccccaggtgagccagaccaacagcaacgtggagagcgtgctgagcggcagcgccagcatggcccagaacctgcacgacgagagcctgagcaccagcccccacggcgccctgcaccagcacgtgaccgacatccagctgcacatcctgaagaacagaatgtacggctgcgacagcgtgaagcagcccagaaacatcgaggagcccagcaacatccccgtgagcgagaaggacagcaacagccaggtggacctgagcatcagagtgaccgacgacgacatcggcgagatcatccaggtggacggcagcggcgacaccagcagcaacgaggagatcggcagcaccagagacgccgacgagaacgagttcctgggcaacatcgacggcggcgacctgaaggtgcccgaggaggaggccgacagcatcagcaacgaggacagcgccaccaacagcagcgacaacgaggacccccaggtgaacatcgtggaggaggaccccctgaacagcggcgacgacgtgagcgagcaggacgtgcccgacctgttcgacaccgacaacgtgatcgtgtgccagtacgacaagatccacagaagcaagaacaagtggaagttctacctgaaggacggcgtgatgtgcttcggcggcagagactacgtgttcgccaaggccatcggcgacgccgagtggtag

SEQ ID NO: 22629 - DNA, 3549 bp, Artificial Sequence; identical to SEQ ID NO: 22626
  Description of Artificial Sequence: Synthetic coding sequence

SEQ ID NO: 22630 - DNA, 3549 bp, Artificial Sequence; identical to SEQ ID NO: 22626
  Description of Artificial Sequence: Synthetic coding sequence

SEQ ID NO: 22631 - DNA, 3477 bp, Artificial Sequence
  Description of Artificial Sequence: Synthetic coding sequence
atgtgcagcaccaaccccggcaagtgggtgaccttcgacgacgaccccgccgtgcagagcagccagaagagcaagaacttccccctggagaaccagggcgtgtgcagacccaacggcctgaagctgaacctgcccggcctgagagagttccccagcggcagcagcagcaccagcagcacccccctgagcagccccatcgtggacttctacttcagccccggcccccccagcaacagccccctgagcacccccaccaaggacttccccggcttccccggcatccccaaggccggcacccacgtgctgtaccccatccccgagagcagcagcgacagccccctggccatcagcggcggcgagagcagcctgctgcccaccagacccacctgcctgagccacgccctgctgcccagcgaccacagctgcacccaccccacccccaaggtgggcctgcccgacgaggtgaacccccagcaggccgagagcctgggcttccagagcgacgacctgccccagttccagtacttcagagaggactgcgccttcagcagccccttctggaaggacgagggcagcgacagccacttcaccctggacccccccggcagcaagaagatgttcagcagcagaaacaaggagatgcccatcgaccagaagagcctgaacaagtgcagcctgaactacatctgcgagaagctggagcacctgcagagcgccgagaaccaggacagcctgagaagcctgagcatgcactgcctgtgcgccgaggagaacgccagcagcttcgtgccccacaccctgttcagaagccagcccaagagcggctggagcttcatgctgagaatccccgagaagaagaacatgatgagcagcagacagtggggccccatcttcctgaaggtgctgcccggcggcatcctgcagatgtactacgagcagggcctggagaagcccttcaaggagatccagctggacccctactgcagactgagcgagcccaaggtggagaacttcagcgtggccggcaagatccacaccgtgaagatcgagcacgtgagctacaccgagaagagaaagtaccacagcaagaccgaggtggtgcacgagcccgacatcgagcagatgctgaagctgggcagcaccagctaccacgacttcctggacttcctgaccaccgtggaggaggagctgatgaagctgcccgccgtgagcaagcccaagaagaactacgaggagcaggagatcagcctggagatcgtggacaacttctggggcaaggtgaccaaggagggcaagttcgtggagagcgccgtgatcacccagatctactgcctgtgcttcgtgaacggcaacctggagtgcttcctgaccctgaacgacctggagctgcccaagagagacgagagctactacgagaaggacagcgagaagaagggcatcgacatcctggactaccacttccacaagtgcgtgaacgtgcaggagttcgagcagagcagaatcatcaagttcgtgcccctggacgcctgcagattcgagctgatgagattcaagaccctgtacaacggcgacaacctgcccttcagcctgaagagcgtggtggtggtgcagggcgcctacgtggagctgcaggccttcgtgaacatggccagcctggcccagagaagcagctacgccggcagcctgagaagctgcgacaacatcagaatccacttccccgtgcccagccagtggatcaaggccctgtggaccatgaacctgcagagacagaagagcctgaaggccaagatgaacagaagagcctgcctgggcagcctgcaggagctggagagcgagcccgtgatccaggtgaccgtgggcagcgccaagtacgagagcgcctaccaggccgtggtgtggaagatcgacagactgcccgacaagaacagcagcctggaccacccccactgcctgagctacaagctggagctgggcagcgaccaggagatccccagcgactggtaccccttcgccaccgtgcagttcagcgtgcccgacacctgcgccagcagaaccgaggtgagaagcctgggcgtggagagcgacgtgcagccccagaagcacgtgcagcagagagcctgctacaacatccagcccaagctgtacagaagcgtgatcgaggacgtgatcgagggcgtgagaaacctgttcgccgaggagggcatcgaggagcaggtgctgaaggacctgaagcagctgtgggagaccaaggtgctgcagagcaaggccaccgaggacttcttcagaaacagcatccagagccccctgttcaccctgcagctgccccacagcctgcaccagaccctgcagagcagcaccgccagcctggtgatccccgccggcagaaccctgcccagcttcaccaccgccgagctgggcaccagcaacagcagcgccaacttcaccttccccggctaccccatccacgtgcccgccggcgtgaccctgcagaccgtgagcggccacctgtacaaggtgaacgtgcccatcatggtgaccgagaccagcggcagagccggcatcctgcagcaccccatccagcaggtgttccagcagctgggccagcccagcgtgatccagaccagcgtgccccagctgaacccctggagcctgcaggccaccaccgagaagagccagagaatcgagaccgtgctgcagcagcccgccatcctgcccagcggccccgtggacagaaagcacctggagaacgccaccagcgacatcctggtgagccccggcaacgagcacaagatcgtgcccgaggccctgctgtgccaccaggagagcagccactacatcagcctgcccggcgtggtgttcagcccccaggtgagccagaccaacagcaacgtggagagcgtgctgagcggcagcgccagcatggcccagaacctgcacgacgagagcctgagcaccagcccccacggcgccctgcaccagcacgtgaccgacatccagctgcacatcctgaagaacagaatgtacggctgcgacagcgtgaagcagcccagaaacatcgaggagcccagcaacatccccgtgagcgagaaggacagcaacagccaggtggacctgagcatcagagtgaccgacgacgacatcggcgagatcatccaggtggacggcagcggcgacaccagcagcaacgaggagatcggcagcaccagagacgccgacgagaacgagttcctgggcaacatcgacggcggcgacctgaaggtgcccgaggaggaggccgacagcatcagcaacgaggacagcgccaccaacagcagcgacaacgaggacccccaggtgaacatcgtggaggaggaccccctgaacagcggcgacgacgtgagcgagcaggacgtgcccgacctgttcgacaccgacaacgtgatcgtgtgccagtacgacaagcagggcgacaccagagtgagacacggccagcagtag

SEQ ID NO: 22632 - DNA, 2208 bp, Artificial Sequence
  Description of Artificial Sequence: Synthetic coding sequence
atgtgcagcaccaaccccggcaagtgggtgaccttcgacgacgaccccgccgtgcagagcagccagaagagcaagaacttccccctggagaaccagggcgtgtgcagacccaacggcctgaagctgaacctgcccggcctgagagagttccccagcggcagcagcagcaccagcagcacccccctgagcagccccatcgtggacttctacttcagccccggcccccccagcaacagccccctgagcacccccaccaaggacttccccggcttccccggcatccccaaggccggcacccacgtgctgtaccccatccccgagagcagcagcgacagccccctggccatcagcggcggcgagagcagcctgctgcccaccagacccacctgcctgagccacgccctgctgcccagcgaccacagctgcacccaccccacccccaaggtgggcctgcccgacgaggtgaacccccagcaggccgagagcctgggcttccagagcgacgacctgccccagttccagtacttcagagaggactgcgccttcagcagccccttctggaaggacgagggcagcgacagccacttcaccctggacccccccggcagcaagaagatgttcagcagcagaaacaaggagatgcccatcgaccagaagagcctgaacaagtgcagcctgaactacatctgcgagaagctggagcacctgcagagcgccgagaaccaggacagcctgagaagcctgagcatgcactgcctgtgcgccgaggagaacgccagcagcttcgtgccccacaccctgttcagaagccagcccaagagcggctggagcttcatgctgagaatccccgagaagaagaacatgatgagcagcagacagtggggccccatcttcctgaaggtgctgcccggcggcatcctgcagatgtactacgagcagggcctggagaagcccttcaaggagatccagctggacccctactgcagactgagcgagcccaaggtggagaacttcagcgtggccggcaagatccacaccgtgaagatcgagcacgtgagctacaccgagaagagaaagtaccacagcaagaccgaggtggtgcacgagcccgacatcgagcagatgctgaagctgggcagcaccagctaccacgacttcctggacttcctgaccaccgtggaggaggagctgatgaagctgcccgccgtgagcaagcccaagaagaactacgaggagcaggagatcagcctggagatcgtggacaacttctggggcaaggtgaccaaggagggcaagttcgtggagagcgccgtgatcacccagatctactgcctgtgcttcgtgaacggcaacctggagtgcttcctgaccctgaacgacctggagctgcccaagagagacgagagctactacgagaaggacagcgagaagaagggcatcgacatcctggactaccacttccacaagtgcgtgaacgtgcaggagttcgagcagagcagaatcatcaagttcgtgcccctggacgcctgcagattcgagctgatgagattcaagaccctgtacaacggcgacaacctgcccttcagcctgaagagcgtggtggtggtgcagggcgcctacgtggagctgcaggccttcgtgaacatggccagcctggcccagagaagcagctacgccggcagcctgagaagctgcgacaacatcagaatccacttccccgtgcccagccagtggatcaaggccctgtggaccatgaacctgcagagacagaagagcctgaaggccaagatgaacagaagagcctgcctgggcagcctgcaggagctggagagcgagcccgtgatccaggtgaccgtgggcagcgccaagtacgagagcgcctaccaggccgtggtgtggaagatcgacagactgcccgacaagaacagcagcctggaccacccccactgcctgagctacaagctggagctgggcagcgaccaggagatccccagcgactggtaccccttcgccaccgtgcagttcagcgtgcccgacacctgcgccagcagaaccgaggtgagaagcctgggcgtggagagcgacgtgcagccccagaagcacgtgcagcagagagcctgctacaacatccaggtggagatcgagaagaagtggatcaagatcgacggcgaggaccccgacaagatcggcgactgcatcacccagtag

SEQ ID NO: 22633 - DNA, 2208 bp, Artificial Sequence; identical to SEQ ID NO: 22632
  Description of Artificial Sequence: Synthetic coding sequence

SEQ ID NO: 22634 - DNA, 2208 bp, Artificial Sequence; identical to SEQ ID NO: 22632
  Description of Artificial Sequence: Synthetic coding sequence

SEQ ID NO: 22635 - DNA, 2718 bp, Artificial Sequence
  Description of Artificial Sequence: Synthetic coding sequence
atgaccaccctggaccacgtgatcgccacccaccagagcgagtgggtgagcttcaacgaggagccccccttccccgcccacagccagggcggcaccgaggagcacctgcccggcctgagcagcagccccgaccagagcgagagcagcagcggcgagaaccacgtggtggacggcggcagccaggaccacagccacagcgagcaggacgacagcagcgagaagatgggcctgatcagcgaggccgccagcccccccggcagccccgagcagcccccccccgacctggccagcgccatcagcaactgggtgcagttcgaggacgacaccccctgggccagcaccagccccccccaccaggagaccgccgagaccgccctgcccctgaccatgccctgctggacctgccccagcttcgacagcctgggcagatgccccctgaccagcgagagcagctggaccacccacagcgaggacaccagcagccccagcttcggctgcagctacaccgacctgcagctgatcaacgccgaggagcagaccagcggccaggccagcggcgccgacagcaccgacaacagcagcagcctgcaggaggacgaggaggtggagatggaggccatcagctggcaggccagcagccccgccatgaacggccaccccgccccccccgtgaccagcgccagattccccagctgggtgaccttcgacgacaacgaggtgagctgccccctgccccccgtgaccagccccctgaagcccaacaccccccccagcgccagcgtgatccccgacgtgccctacaacagcatgggcagcttcaagaagagagacagacccaagagcaccctgatgaacttcagcaaggtgcagaagctggacatcagcagcctgaacagaacccccagcgtgaccgaggccagcccctggagagccaccaaccccttcctgaacgagaccctgcaggacgtgcagcccagccccatcaaccccttcagcgccttcttcgaggagcaggagagaagaagccagaacagcagcatcagcagcaccaccggcaagagccagagagacagcctgatcgtgatctaccaggacgccatcagcttcgacgacagcagcaagacccagagccacagcgacgccgtggagaagctgaagcagctgcagatcgacgaccccgaccacttcggcagcgccaccctgcccgacgacgaccccgtggcctggatcgagctggacgcccacccccccggcagcgccagaagccagcccagagacggctggcccatgatgctgagaatccccgagaagaagaacatcatgagcagcagacactggggccccatcttcgtgaagctgaccgacaccggctacctgcagctgtactacgagcagggcctggagaagcccttcagagagttcaagctggagatctgccacgagatcagcgagcccagactgcagaactacgacgagaacggcagaatccacagcctgagaatcgacagagtgacctacaaggagaagaagaagtaccagcccaagcccgccgtggcccacaccgccgagagagagcaggtgatcaagctgggcaccaccaactacgacgacttcctgagcttcatccacgccgtgcaggacagactgatggacctgcccgtgctgagcatggacctgagcaccgtgggcctgaactacctggaggaggagatcaccgtggacgtgagagacgagttcagcggcatcgtgagcaagggcgacaaccagatcctgcagcaccacgtgctgaccagaatccacatcctgagcttcctgagcggcctggccgagtgcagactgggcctgaacgacatcctggtgaagggcaacgagatcgtgctgagacaggacatcatgcccaccaccaccaccaagtggatcaagctgcacgagtgcagattccacggctgcgtggacgaggacgtgttccacaacagcagagtgatcctgttcaaccccctggacgcctgcagattcgagctgatgagattcagaaccgtgttcgccgagaagaccctgcccttcaccctgagaaccgccaccagcgtgaacggcgccgaggtggaggtgcagagctggctgagaatgagcaccggcttcagcgccaacagagaccccctgacccaggtgccctgcgagaacgtgatgatcagataccccgtgcccagcgagtgggtgaagaacttcagaagagagagcgtgctgggcgagaagagcctgaaggccaaggtgaacagaggcgccagcttcggcagcaccagcgtgagcggcagcgagcccgtgatgagagtgaccctgggcaccgccaagtacgagcacgccttcaacagcatcgtgtggagaatcaacagactgcccgacaagaacagcgccagcggccacccccactgcttcttctgccacctggagctgggcagcgacagagaggtgcccagcagattcgccaaccacgtgaacgtggagttcagcatgcccaccaccagcgccagcaaggccagcgtgagaagcatcagcgtggaggacaagaccgacgtgagaaagtgggtgaactacagcgcccactacagctaccaggtggccctgggcagcatctggctgatgctgcccacccccttcgtgcaccccaccaccctgcccctgctgttcctgctggccatgctgaccatgttcgcctggtag

SEQ ID NO: 22636 - DNA, 2799 bp, Artificial Sequence
  Description of Artificial Sequence: Synthetic coding sequence
ggccagcagtgcgaggacgaccagtgcctgttcagcatgaccaccctggaccacgtgatcgccacccaccagagcgagtgggtgagcttcaacgaggagccccccttccccgcccacagccagggcggcaccgaggagcacctgcccggcctgagcagcagccccgaccagagcgagagcagcagcggcgagaaccacgtggtggacggcggcagccaggaccacagccacagcgagcaggacgacagcagcgagaagatgggcctgatcagcgaggccgccagcccccccggcagccccgagcagcccccccccgacctggccagcgccatcagcaactgggtgcagttcgaggacgacaccccctgggccagcaccagccccccccaccaggagaccgccgagaccgccctgcccctgaccatgccctgctggacctgccccagcttcgacagcctgggcagatgccccctgaccagcgagagcagctggaccacccacagcgaggacaccagcagccccagcttcggctgcagctacaccgacctgcagctgatcaacgccgaggagcagaccagcggccaggccagcggcgccgacagcaccgacaacagcagcagcctgcaggaggacgaggaggtggagatggaggccatcagctggcaggccagcagccccgccatgaacggccaccccgccccccccgtgaccagcgccagattccccagctgggtgaccttcgacgacaacgaggtgagctgccccctgccccccgtgaccagccccctgaagcccaacaccccccccagcgccagcgtgatccccgacgtgccctacaacagcatgggcagcttcaagaagagagacagacccaagagcaccctgatgaacttcagcaaggtgcagaagctggacatcagcagcctgaacagaacccccagcgtgaccgaggccagcccctggagagccaccaaccccttcctgaacgagaccctgcaggacgtgcagcccagccccatcaaccccttcagcgccttcttcgaggagcaggagagaagaagccagaacagcagcatcagcagcaccaccggcaagagccagagagacagcctgatcgtgatctaccaggacgccatcagcttcgacgacagcagcaagacccagagccacagcgacgccgtggagaagctgaagcagctgcagatcgacgaccccgaccacttcggcagcgccaccctgcccgacgacgaccccgtggcctggatcgagctggacgcccacccccccggcagcgccagaagccagcccagagacggctggcccatgatgctgagaatccccgagaagaagaacatcatgagcagcagacactggggccccatcttcgtgaagctgaccgacaccggctacctgcagctgtactacgagcagggcctggagaagcccttcagagagttcaagctggagatctgccacgagatcagcgagcccagactgcagaactacgacgagaacggcagaatccacagcctgagaatcgacagagtgacctacaaggagaagaagaagtaccagcccaagcccgccgtggcccacaccgccgagagagagcaggtgatcaagctgggcaccaccaactacgacgacttcctgagcttcatccacgccgtgcaggacagactgatggacctgcccgtgctgagcatggacctgagcaccgtgggcctgaactacctggaggaggagatcaccgtggacgtgagagacgagttcagcggcatcgtgagcaagggcgacaaccagatcctgcagcaccacgtgctgaccagaatccacatcctgagcttcctgagcggcctggccgagtgcagactgggcctgaacgacatcctggtgaagggcaacgagatcgtgctgagacaggacatcatgcccaccaccaccaccaagtggatcaagctgcacgagtgcagattccacggctgcgtggacgaggacgtgttccacaacagcagagtgatcctgttcaaccccctggacgcctgcagattcgagctgatgagattcagaaccgtgttcgccgagaagaccctgcccttcaccctgagaaccgccaccagcgtgaacggcgccgaggtggaggtgcagagctggctgagaatgagcaccggcttcagcgccaacagagaccccctgacccaggtgccctgcgagaacgtgatgatcagataccccgtgcccagcgagtgggtgaagaacttcagaagagagagcgtgctgggcgagaagagcctgaaggccaaggtgaacagaggcgccagcttcggcagcaccagcgtgagcggcagcgagcccgtgatgagagtgaccctgggcaccgccaagtacgagcacgccttcaacagcatcgtgtggagaatcaacagactgcccgacaagaacagcgccagcggccacccccactgcttcttctgccacctggagctgggcagcgacagagaggtgcccagcagattcgccaaccacgtgaacgtggagttcagcatgcccaccaccagcgccagcaaggccagcgtgagaagcatcagcgtggaggacaagaccgacgtgagaaagtgggtgaactacagcgcccactacagctaccagaccaccgagaccgacaacctgcccaaccccctgtactgcagctgcctgccccacaccgacctgaagagaggcagcaagagagtggtgaagatcagatggaacgccagcctggaggtgcccctggccagcagcatcagaaccatggtgtag

SEQ ID NO: 22637 - DNA, 12 bp, Artificial Sequence
  Description of Artificial Sequence: Synthetic coding sequence
atgaccacctag

SEQ ID NO: 22638 - DNA, 153 bp, Artificial Sequence
  Description of Artificial Sequence: Synthetic coding sequence
atgaccaccctggaccacgtgatcgccacccaccagagcgagtgggtgagcttcaacgaggagccccccttccccgcccacagccagggcggcaccgaggagcacctgcccggcctgagcagcagccccgaccagagcgagagcagcagctag

SEQ ID NO: 22639 - DNA, 2763 bp, Artificial Sequence
  Description of Artificial Sequence: Synthetic coding sequence
atgaccaccctggaccacgtgatcgccacccaccagagcgagtgggtgagcttcaacgaggagccccccttccccgcccacagccagggcggcaccgaggagcacctgcccggcctgagcagcagccccgaccagagcgagagcagcagcggcgagaaccacgtggtggacggcggcagccaggaccacagccacagcgagcaggacgacagcagcgagaagatgggcctgatcagcgaggccgccagcccccccggcagccccgagcagcccccccccgacctggccagcgccatcagcaactgggtgcagttcgaggacgacaccccctgggccagcaccagccccccccaccaggagaccgccgagaccgccctgcccctgaccatgccctgctggacctgccccagcttcgacagcctgggcagatgccccctgaccagcgagagcagctggaccacccacagcgaggacaccagcagccccagcttcggctgcagctacaccgacctgcagctgatcaacgccgaggagcagaccagcggccaggccagcggcgccgacagcaccgacaacagcagcagcctgcaggaggacgaggaggtggagatggaggccatcagctggcaggccagcagccccgccatgaacggccaccccgccccccccgtgaccagcgccagattccccagctgggtgaccttcgacgacaacgaggtgagctgccccctgccccccgtgaccagccccctgaagcccaacaccccccccagcgccagcgtgatccccgacgtgccctacaacagcatgggcagcttcaagaagagagacagacccaagagcaccctgatgaacttcagcaaggtgcagaagctggacatcagcagcctgaacagaacccccagcgtgaccgaggccagcccctggagagccaccaaccccttcctgaacgagaccctgcaggacgtgcagcccagccccatcaaccccttcagcgccttcttcgaggagcaggagagaagaagccagaacagcagcatcagcagcaccaccggcaagagccagagagacagcctgatcgtgatctaccaggacgccatcagcttcgacgacagcagcaagacccagagccacagcgacgccgtggagaagctgaagcagctgcagatcgacgaccccgaccacttcggcagcgccaccctgcccgacgacgaccccgtggcctggatcgagctggacgcccacccccccggcagcgccagaagccagcccagagacggctggcccatgatgctgagaatccccgagaagaagaacatcatgagcagcagacactggggccccatcttcgtgaagctgaccgacaccggctacctgcagctgtactacgagcagggcctggagaagcccttcagagagttcaagctggagatctgccacgagatcagcgagcccagactgcagaactacgacgagaacggcagaatccacagcctgagaatcgacagagtgacctacaaggagaagaagaagtaccagcccaagcccgccgtggcccacaccgccgagagagagcaggtgatcaagctgggcaccaccaactacgacgacttcctgagcttcatccacgccgtgcaggacagactgatggacctgcccgtgctgagcatggacctgagcaccgtgggcctgaactacctggaggaggagatcaccgtggacgtgagagacgagttcagcggcatcgtgagcaagggcgacaaccagatcctgcagcaccacgtgctgaccagaatccacatcctgagcttcctgagcggcctggccgagtgcagactgggcctgaacgacatcctggtgaagggcaacgagatcgtgctgagacaggacatcatgcccaccaccaccaccaagtggatcaagctgcacgagtgcagattccacggctgcgtggacgaggacgtgttccacaacagcagagtgatcctgttcaaccccctggacgcctgcagattcgagctgatgagattcagaaccgtgttcgccgagaagaccctgcccttcaccctgagaaccgccaccagcgtgaacggcgccgaggtggaggtgcagagctggctgagaatgagcaccggcttcagcgccaacagagaccccctgacccaggtgccctgcgagaacgtgatgatcagataccccgtgcccagcgagtgggtgaagaacttcagaagagagagcgtgctgggcgagaagagcctgaaggccaaggtgaacagaggcgccagcttcggcagcaccagcgtgagcggcagcgagcccgtgatgagagtgaccctgggcaccgccaagtacgagcacgccttcaacagcatcgtgtggagaatcaacagactgcccgacaagaacagcgccagcggccacccccactgcttcttctgccacctggagctgggcagcgacagagaggtgcccagcagattcgccaaccacgtgaacgtggagttcagcatgcccaccaccagcgccagcaaggccagcgtgagaagcatcagcgtggaggacaagaccgacgtgagaaagtgggtgaactacagcgcccactacagctaccagaccaccgagaccgacaacctgcccaaccccctgtactgcagctgcctgccccacaccgacctgaagagaggcagcaagagagtggtgaagatcagatggaacgccagcctggaggtgcccctggccagcagcatcagaaccatggtgtag

SEQ ID NO: 22640 - DNA, 441 bp, Artificial Sequence
  Description of Artificial Sequence: Synthetic coding sequence
atgtggcccgccccctgcagcgtgggcagactgctgatcttcttcatgtgcagcagcagcggctacgtggtgcagggctgcggccccagccccggcgccagaaccaccctgggcagccccctgagcctgtggagcatcaagacccccagccacatcttctgcaccagaagagccatcaacctgggcttccccagcccccccctggtgcagctgatcttctggagcctgaacgccggcctggacctgtacctgtgcctgatcagcagctgcggcttcagccaggtgttctggcccgtggaggccttctgcagcttcagcctgagcttcttcgccctggccctgagccacaagttcgtgatctgcagactggaccagcacatcttcagcggcttcaccaagagcctgaagaacctgcccccctgccacagaaccgacatctag

SEQ ID NO: 22641 - DNA, 201 bp, Artificial Sequence
  Description of Artificial Sequence: Synthetic coding sequence
atggtggccaagcagagaatcagaatggccaacgagaagcacagcaagaacatcacccagagaggcaacgtggccaagaccagcagaaacgcccccgaggagaaggccagcgtgggcccctggctgctggccctgttcatcttcgtggtgtgcggcagcgccatcttccagatcatccagagcatcagaatgggcatgtag

SEQ ID NO: 22642 - DNA, 201 bp, Artificial Sequence; identical to SEQ ID NO: 22641
  Description of Artificial Sequence: Synthetic coding sequence

SEQ ID NO: 22643 - DNA, 198 bp, Artificial Sequence
  Description of Artificial Sequence: Synthetic coding sequence
atggtggccaagcagagaatcagaatggccaacgagaagcacagcaagaacatcacccagagaggcaacgtggccaagaccctgagaccccaggaggagaagtaccccgtgggcccctggctgctggccctgttcgtgttcgtggtgtgcggcagcgccatcttccagatcatccagagcatcagaatgggcatgtag

SEQ ID NO: 22644 - DNA, 2343 bp, Artificial Sequence
  Description of Artificial Sequence: Synthetic coding sequence
atggacgagcaggccggccccggcgtgttcttcagcaacaaccaccccggcgccggcggcgccaagggcctgggccccctggccgaggccgccgccgccggcgacggcgccgccgccgccggcgccgccagagcccagtacagcctgcccggcatcctgcacttcctgcagcacgagtgggccagattcgaggtggagagagcccagtgggaggtggagagagccgagctgcaggcccagatcgccttcctgcagggcgagagaaagggccaggagaacctgaagaaggacctggtgagaagaatcaagatgctggagtacgccctgaagcaggagagagccaagtaccacaagctgaagtacggcaccgagctgaaccagggcgacatgaagccccccagctacgacagcgacgagggcaacgagaccgaggtgcagccccagcagaacagccagctgatgtggaagcagggcagacagctgctgagacagtacctgcaggaggtgggctacaccgacaccatcctggacgtgaagagcaagagagtgagagccctgctgggcttcagcagcgacgtgaccgacagagaggacgacaagaaccaggacagcgtggtgaacggcaccgaggccgaggtgaaggagaccgccatgatcgccaagagcgagctgaccgacagcgccagcgtgctggacaacttcaagttcctggagagcgccgccgccgacttcagcgacgaggacgaggacgacgacgtggacggcagagagaagagcgtgatcgacaccagcaccatcgtgagaaagaaggccctgcccgacagcggcgaggacagagacaccaaggaggccctgaaggagttcgacttcctggtgaccagcgaggagggcgacaacgagagcagaagcgccggcgacggcaccgactgggagaaggaggaccagtgcctgatgcccgaggcctggaacgtggaccagggcgtgatcaccaagctgaaggagcagtacaagaaggagagaaagggcaagaagggcgtgaagagacccaacagaagcaagctgcaggacatgctggccaacctgagagacgtggacgagctgcccagcctgcagcccagcgtgggcagccccagcagacccagcagcagcagactgcccgagcacgagatcaacagagccgacgaggtggaggccctgaccttcccccccagcagcggcaagagcttcatcatgggcgccgacgaggccctggagagcgagctgggcctgggcgagctggccggcctgaccgtggccaacgaggccgacagcctgacctacgacatcgccaacaacaaggacgccctgagaaagacctggaaccccaagttcaccctgagaagccacttcgacggcatcagagccctggccttccaccccatcgagcccgtgctgatcaccgccagcgaggaccacaccctgaagatgtggaacctgcagaagaccgcccccgccaagaagagcaccagcctggacgtggagcccatctacaccttcagagcccacaagggccccgtgctgtgcgtggtgatgagcagcaacggcgagcagtgctacagcggcggcaccgacggcctgatccagggctggaacaccaccaaccccaacatcgacccctacgacagctacgaccccagcgtgctgagaggccccctgctgggccacaccgacgccgtgtggggcctggcctacagcgccgcccaccagagactgctgagctgcagcgccgacggcaccctgagactgtggaacaccaccgaggtggcccccgccctgagcgtgttcaacgacaccaaggagctgggcatccccgccagcgtggacctggtgagcagcgaccccagccacatggtggccagcttcagcaagggctacaccagcatcttcaacatggagacccagcagagaatcctgaccctggagagcaacgtggacaccaccgccaacagcagctgccagatcaacagagtgatcagccaccccaccctgcccatcagcatcaccgcccacgaggacagacacatcaagttctacgacaacaacaccggcaagctgatccacagcatggtggcccacctggaggccgtgaccagcctggccgtggaccccaacggcctgtacctgatgagcggcagccacgactgcagcatcagactgtggaacctggagagcaagacctgcatccaggagttcaccgcccacagaaagaagttcgaggagagcatccacgacgtggccttccaccccagcaagtgctacatcgccagcgccggcgccgacgccctggccaaggtgttcgtgtag

SEQ ID NO: 22645 - DNA, 2196 bp, Artificial Sequence
  Description of Artificial Sequence: Synthetic coding sequence
atggacgagcaggccggccccggcgtgttcttcagcaacaaccaccccggcgccggcggcgccaagggcctgggccccctggccggcgccgccagagcccagtacagcctgcccggcatcctgcacttcctgcagcacgagtgggccagattcgaggtggagagagcccagtgggaggtggagagagccgagctgcaggcccagatcgccttcctgcagggcgagagaaagggccaggagaacctgaagaaggacctggtgagaagaatcaagatgctggagtacgccctgaagcaggagagagccaagtaccacaagctgaagtacggcaccgagctgaaccagggcgacatgaagccccccagctacgacagcgacgagggcaacgagaccgaggtgcagccccagcagaacagccagctgatgtggaagcagggcagacagctgctgagacagtacctgcaggaggtgggctacaccgacaccatcctggacgtgaagagcaagagagtgagagccctgctgggcttcagcagcgacgtgaccgacagagaggacgacaagaaccaggacagcgtggtgaacggcaccgaggccgaggtgaaggagaccgccatgatcgccaagagcgagctgaccgacagcgccagcgtgctggacaacttcaagttcctggagagcgccgccgccgacttcagcgacgaggacgaggacgacgacgtggacggcagagagaagagcgtgatcgacaccagcaccatcgtgagaaagaaggccctgcccgacagcggcgaggacagagacaccaaggaggccctgaaggagttcgacttcctggtgaccagcgaggagggcgacaacgagagcagaagcgccggcgacggcaccgactggggccccaacagaagcaagctgcaggacatgctggccaacctgagagacgtggacgagctgcccagcctgcagcccagcgtgggcagccccagcagacccagcagcagcagactgcccgagcacgagatcaacagagccgacgaggtggaggccctgaccttcccccccagcagcggcaagagcttcatcatgggcgccgacgaggccctggagagcgagctgggcctgggcgagctggccggcctgaccgtggccaacgaggccgacagcctgacctacgacatcgccaacaacaaggacgccctgagaaagacctggaaccccaagttcaccctgagaagccacttcgacggcatcagagccctggccttccaccccatcgagcccgtgctgatcaccgccagcgaggaccacaccctgaagatgtggaacctgcagaagaccgcccccgccaagaagagcaccagcctggacgtggagcccatctacaccttcagagcccacaagggccccgtgctgtgcgtggtgatgagcagcaacggcgagcagtgctacagcggcggcaccgacggcctgatccagggctggaacaccaccaaccccaacatcgacccctacgacagctacgaccccagcgtgctgagaggccccctgctgggccacaccgacgccgtgtggggcctggcctacagcgccgcccaccagagactgctgagctgcagcgccgacggcaccctgagactgtggaacaccaccgaggtggcccccgccctgagcgtgttcaacgacaccaaggagctgggcatccccgccagcgtggacctggtgagcagcgaccccagccacatggtggccagcttcagcaagggctacaccagcatcttcaacatggagacccagcagagaatcctgaccctggagagcaacgtggacaccaccgccaacagcagctgccagatcaacagagtgatcagccaccccaccctgcccatcagcatcaccgcccacgaggacagacacatcaagttctacgacaacaacaccggcaagctgatccacagcatggtggcccacctggaggccgtgaccagcctggccgtggaccccaacggcctgtacctgatgagcggcagccacgactgcagcatcagactgtggaacctggagagcaagacctgcatccaggagttcaccgcccacagaaagaagttcgaggagagcatccacgacgtggccttccaccccagcaagtgctacatcgccagcgccggcgccgacgccctggccaaggtgttcgtgtag

SEQ ID NO: 22646 - DNA, 2268 bp, Artificial Sequence
  Description of Artificial Sequence: Synthetic coding sequence
agacccccctggaccagcagaagagtgcccgccagcagcagcgccaccaccaccagagcccagtacagcctgcccggcatcctgcacttcctgcagcacgagtgggccagattcgaggtggagagagcccagtgggaggtggagagagccgagctgcaggcccagatcgccttcctgcagggcgagagaaagggccaggagaacctgaagaaggacctggtgagaagaatcaagatgctggagtacgccctgaagcaggagagagccaagtaccacaagctgaagtacggcaccgagctgaaccagggcgacatgaagccccccagctacgacagcgacgagggcaacgagaccgaggtgcagccccagcagaacagccagctgatgtggaagcagggcagacagctgctgagacagtacctgcaggaggtgggctacaccgacaccatcctggacgtgaagagcaagagagtgagagccctgctgggcttcagcagcgacgtgaccgacagagaggacgacaagaaccaggacagcgtggtgaacggcaccgaggccgaggtgaaggagaccgccatgatcgccaagagcgagctgaccgacagcgccagcgtgctggacaacttcaagttcctggagagcgccgccgccgacttcagcgacgaggacgaggacgacgacgtggacggcagagagaagagcgtgatcgacaccagcaccatcgtgagaaagaaggccctgcccgacagcggcgaggacagagacaccaaggaggccctgaaggagttcgacttcctggtgaccagcgaggagggcgacaacgagagcagaagcgccggcgacggcaccgactgggagaaggaggaccagtgcctgatgcccgaggcctggaacgtggaccagggcgtgatcaccaagctgaaggagcagtacaagaaggagagaaagggcaagaagggcgtgaagagacccaacagaagcaagctgcaggacatgctggccaacctgagagacgtggacgagctgcccagcctgcagcccagcgtgggcagccccagcagacccagcagcagcagactgcccgagcacgagatcaacagagccgacgaggtggaggccctgaccttcccccccagcagcggcaagagcttcatcatgggcgccgacgaggccctggagagcgagctgggcctgggcgagctggccggcctgaccgtggccaacgaggccgacagcctgacctacgacatcgccaacaacaaggacgccctgagaaagacctggaaccccaagttcaccctgagaagccacttcgacggcatcagagccctggccttccaccccatcgagcccgtgctgatcaccgccagcgaggaccacaccctgaagatgtggaacctgcagaagaccgcccccgccaagaagagcaccagcctggacgtggagcccatctacaccttcagagcccacaagggccccgtgctgtgcgtggtgatgagcagcaacggcgagcagtgctacagcggcggcaccgacggcctgatccagggctggaacaccaccaaccccaacatcgacccctacgacagctacgaccccagcgtgctgagaggccccctgctgggccacaccgacgccgtgtggggcctggcctacagcgccgcccaccagagactgctgagctgcagcgccgacggcaccctgagactgtggaacaccaccgaggtggcccccgccctgagcgtgttcaacgacaccaaggagctgggcatccccgccagcgtggacctggtgagcagcgaccccagccacatggtggccagcttcagcaagggctacaccagcatcttcaacatggagacccagcagagaatcctgaccctggagagcaacgtggacaccaccgccaacagcagctgccagatcaacagagtgatcagccaccccaccctgcccatcagcatcaccgcccacgaggacagacacatcaagttctacgacaacaacaccggcaagctgatccacagcatggtggcccacctggaggccgtgaccagcctggccgtggaccccaacggcctgtacctgatgagcggcagccacgactgcagcatcagactgtggaacctggagagcaagacctgcatccaggagttcaccgcccacagaaagaagttcgaggagagcatccacgacgtggccttccaccccagcaagtgctacatcgccagcgccggcgccgacgccctggccaaggtgttcgtgtag

SEQ ID NO: 22647 - DNA, 2142 bp, Artificial Sequence
  Description of Artificial Sequence: Synthetic coding sequence
atggacgagctggccggcggcggcggcggcggccccggcatggccgccccccccagacagcagcagggccccggcggcaacctgggcctgagccccggcggcaacggcgccgccggcggcggcggcccccccgccagcgagggcgccggccccgccgccggccccgagctgagcagaccccagcagtacaccatccccggcatcctgcactacatccagcacgagtgggccagattcgagatggagagagcccactgggaggtggagagagccgagctgcaggccagaatcgccttcctgcagggcgagagaaagggccaggagaacctgaagaaggacctggtgagaagaatcaagatgctggagtacgccctgaagcaggagagagccaagtaccacaagctgaagtacggcaccgagctgaaccagggcgacctgaagatgcccaccttcgagagcgaggagaccaaggacaccgaggcccccaccgccccccagaacagccagctgacctggaagcagggcagacagctgctgagacagtacctgcaggaggtgggctacaccgacaccatcctggacgtgagaagccagagagtgagaagcctgctgggcctgagcaacagcgagcccaacggcagcgtggagaccaagaacctggagcagatcctgaacggcggcgagagccccaagcagaagggccaggagatcaagagaagcagcggcgacgtgctggagaccttcaacttcctggagaacgccgacgacagcgacgaggacgaggagaacgacatgatcgagggcatccccgagggcaaggacaagcacagaatgaacaagcacaagatcggcaacgagggcctggccgccgacctgaccgacgaccccgacaccgaggaggccctgaaggagttcgacttcctggtgaccgccgaggacggcgagggcgccggcgaggccagaagcagcggcgacggcaccgagtgggccgagcccatcaccttccccagcggcggcggcaagagcttcatcatgggcagcgacgacgtgctgctgagcgtgctgggcctgggcgacctggccgacctgaccgtgaccaacgacgccgactacagctacgacctgcccgccaacaaggacgccttcagaaagacctggaaccccaagtacaccctgagaagccacttcgacggcgtgagagccctggccttccaccccgtggagcccgtgctggtgaccgccagcgaggaccacaccctgaagctgtggaacctgcagaagaccgtgcccgccaagaagagcgccagcctggacgtggagcccatctacaccttcagagcccacatcggccccgtgctgagcctggccatcagcagcaacggcgagcagtgcttcagcggcggcatcgacgccaccatccagtggtggaacatgcccagccccagcgtggacccctacgacacctacgagcccaacgtgctggccggcaccctggtgggccacaccgacgccgtgtggggcctggcctacagcggcatcaagaaccagctgctgagctgcagcgccgacggcaccgtgagactgtggaacccccaggagaagctgccctgcatctgcacctacaacggcgacaagaagcacggcatccccaccagcgtggacttcatcggctgcgaccccgcccacatggtgaccagcttcaacaccggcagcgccgtgatctacgacctggagaccagccagagcctggtgatcctgagcagccaggtggacagcggcctgcagagcaacaaccacatcaacagagtggtgagccaccccaccctgcccgtgaccatcaccgcccacgaggacagacacatcaagttcttcgacaacaagaccggcaagatgatccacagcatggtggcccacctggacgccgtgaccagcctggccgtggaccccaacggcatctacctgatgagcggcagccacgactgcagcatcagactgtggaacctggacagcaagacctgcgtgcaggagatcaccgcccacagaaagaagctggacgagagcatctacgacgtggccttccacagcagcaaggcctacatcgccagcgccggcgccgacgccctggccaaggtgttcgtgtag

SEQ ID NO: 22648 - DNA, 2394 bp, Artificial Sequence
  Description of Artificial Sequence: Synthetic coding sequence
atggacgagctggccggcggcggcggcggcggccccggcatggccgccccccccagacagcagcagggccccggcggcaacctgggcctgagccccggcggcaacggcgccgccggcggcggcggcccccccgccagcgagggcgccggccccgccgccggccccgagctgagcagaccccagcagtacaccatccccggcatcctgcactacatccagcacgagtgggccagattcgagatggagagagcccactgggaggtggagagagccgagctgcaggccagaatcgccttcctgcagggcgagagaaagggccaggagaacctgaagaaggacctggtgagaagaatcaagatgctggagtacgccctgaagcaggagagagccaagtaccacaagctgaagtacggcaccgagctgaaccagggcgacctgaagatgcccaccttcgagagcgaggagaccaaggacaccgaggcccccaccgccccccagaacagccagctgacctggaagcagggcagacagctgctgagacagtacctgcaggaggtgggctacaccgacaccatcctggacgtgagaagccagagagtgagaagcctgctgggcctgagcaacagcgagcccaacggcagcgtggagaccaagaacctggagcagatcctgaacggcggcgagagccccaagcagaagggccaggagatcaagagaagcagcggcgacgtgctggagaccttcaacttcctggagaacgccgacgacagcgacgaggacgaggagaacgacatgatcgagggcatccccgagggcaaggacaagcacagaatgaacaagcacaagatcggcaacgagggcctggccgccgacctgaccgacgaccccgacaccgaggaggccctgaaggagttcgacttcctggtgaccgccgaggacggcgagggcgccggcgaggccagaagcagcggcgacggcaccgagtgggacaaggacgacctgagccccaccgccgaggtgtgggacgtggaccagggcctgatcagcaagctgaaggagcagtacaagaaggagagaaagggcaagaagggcgtgaagagagccaacagaaccaagctgtacgacatgatcgccgacctgggcgacgacgagctgccccacatccccagcggcatcatcaaccagagcagaagcgccagcaccagaatgaccgaccacgagggcgccagagccgaggaggccgagcccatcaccttccccagcggcggcggcaagagcttcatcatgggcagcgacgacgtgctgctgagcgtgctgggcctgggcgacctggccgacctgaccgtgaccaacgacgccgactacagctacgacctgcccgccaacaaggacgccttcagaaagacctggaaccccaagtacaccctgagaagccacttcgacggcgtgagagccctggccttccaccccgtggagcccgtgctggtgaccgccagcgaggaccacaccctgaagctgtggaacctgcagaagaccgtgcccgccaagaagagcgccagcctggacgtggagcccatctacaccttcagagcccacatcggccccgtgctgagcctggccatcagcagcaacggcgagcagtgcttcagcggcggcatcgacgccaccatccagtggtggaacatgcccagccccagcgtggacccctacgacacctacgagcccaacgtgctggccggcaccctggtgggccacaccgacgccgtgtggggcctggcctacagcggcatcaagaaccagctgctgagctgcagcgccgacggcaccgtgagactgtggaacccccaggagaagctgccctgcatctgcacctacaacggcgacaagaagcacggcatccccaccagcgtggacttcatcggctgcgaccccgcccacatggtgaccagcttcaacaccggcagcgccgtgatctacgacctggagaccagccagagcctggtgatcctgagcagccaggtggacagcggcctgcagagcaacaaccacatcaacagagtggtgagccaccccaccctgcccgtgaccatcaccgcccacgaggacagacacatcaagttcttcgacaacaagaccggcaagatgatccacagcatggtggcccacctggacgccgtgaccagcctggccgtggaccccaacggcatctacctgatgagcggcagccacgactgcagcatcagactgtggaacctggacagcaagacctgcgtgcaggagatcaccgcccacagaaagaagctggacgagagcatctacgacgtggccttccacagcagcaaggcctacatcgccagcgccggcgccgacgccctggccaaggtgttcgtgtag

SEQ ID NO: 22649 - DNA, 2118 bp, Artificial Sequence
  Description of Artificial Sequence: Synthetic coding sequence
atgaccaagttcggcttcctgagactgagctacgagaagcaggacaccctgctgaagctgctgatcctgagcatggccgccgtgctgagcttcagcaccagactgttcgccgtgctgagattcgagagcgtgatccacgagttcgacccctacttcaactacagaaccaccagattcctggccgaggagggcttctacaagttccacaactggttcgacgacagagcctggtaccccctgggcagaatcatcggcggcaccatctaccccggcctgatgatcaccagcgccgccatctaccacgtgctgcacttcttccacatcaccatcgacatcagaaacgtgtgcgtgttcctggcccccctgttcagcagcttcaccaccatcgtgacctaccacctgaccaaggagctgaaggacgccggcgccggcctgctggccgccgccatgatcgccgtggtgcccggctacatcagcagaagcgtggccggcagctacgacaacgagggcatcgccatcttctgcatgctgctgacctactacatgtggatcaaggccgtgaagaccggcagcatctgctgggccgccaagtgcgccctggcctacttctacatggtgagcagctggggcggctacgtgttcctgatcaacctgatccccctgcacgtgctggtgctgatgctgaccggcagattcagccacagaatctacgtggcctactgcaccgtgtactgcctgggcaccatcctgagcatgcagatcagcttcgtgggcttccagcccgtgctgagcagcgagcacatggccgccttcggcgtgttcggcctgtgccagatccacgccttcgtggactacctgagaagcaagctgaacccccagcagttcgaggtgctgttcagaagcgtgatcagcctggtgggcttcgtgctgctgaccgtgggcgccctgctgatgctgaccggcaagatcagcccctggaccggcagattctacagcctgctggaccccagctacgccaagaacaacatccccatcatcgccagcgtgagcgagcaccagcccaccacctggagcagctactacttcgacctgcagctgctggtgttcatgttccccgtgggcctgtactactgcttcagcaacctgagcgacgccagaatcttcatcatcatgtacggcgtgaccagcatgtacttcagcgccgtgatggtgagactgatgctggtgctggcccccgtgatgtgcatcctgagcggcatcggcgtgagccaggtgctgagcacctacatgaagaacctggacatcagcagacccgacaagaagagcaagaagcagcaggacagcacctaccccatcaagaacgaggtggccagcggcatgatcctggtgatggccttcttcctgatcacctacaccttccacagcacctgggtgaccagcgaggcctacagcagccccagcatcgtgctgagcgccagaggcggcgacggcagcagaatcatcttcgacgacttcagagaggcctactactggctgagacacaacacccccgaggacgccaaggtgatgagctggtgggactacggctaccagatcaccgccatggccaacagaaccatcctggtggacaacaacacctggaacaacacccacatcagcagagtgggccaggccatggccagcaccgaggagaaggcctacgagatcatgagagagctggacgtgagctacgtgctggtgatcttcggcggcctgaccggctacagcagcgacgacatcaacaagttcctgtggatggtgagaatcggcggcagcaccgacaccggcaagcacatcaaggagaacgactactacacccccaccggcgagttcagagtggacagagagggcagccccgtgctgctgaactgcctgatgtacaagatgtgctactacagattcggccaggtgtacaccgaggccaagagaccccccggcttcgacagagtgagaaacgccgagatcggcaacaaggacttcgagctggacgtgctggaggaggcctacaccaccgagcactggctggtgagaatctacaaggtgaaggacctggacaacagaggcctgagcagaacctag

SEQ ID NO: 22650 - DNA, 2118 bp, Artificial Sequence; identical to SEQ ID NO: 22649
  Description of Artificial Sequence: Synthetic coding sequence

SEQ ID NO: 22651 - DNA, 2481 bp, Artificial Sequence
  Description of Artificial Sequence: Synthetic coding sequence
atggccgagcccagcgcccccgagagcaagcacaagagcagcctgaacagcagcccctggagcggcctgatggccctgggcaacagcagacacggccaccacggccccggcgcccagtgcgcccacaaggccgccggcggcgccgccccccccaagcccgcccccgccggcctgagcggcggcctgagccagcccgccggctggcagagcctgctgagcttcaccatcctgttcctggcctggctggccggcttcagcagcagactgttcgccgtgatcagattcgagagcatcatccacgagttcgacccctggttcaactacagaagcacccaccacctggccagccacggcttctacgagttcctgaactggttcgacgagagagcctggtaccccctgggcagaatcgtgggcggcaccgtgtaccccggcctgatgatcaccgccggcctgatccactggatcctgaacaccctgaacatcaccgtgcacatcagagacgtgtgcgtgttcctggcccccaccttcagcggcctgaccagcatcagcaccttcctgctgaccagagagctgtggaaccagggcgccggcctgctggccgcctgcttcatcgccatcgtgcccggctacatcagcagaagcgtggccggcagcttcgacaacgagggcatcgccatcttcgccctgcagttcacctactacctgtgggtgaagagcgtgaagaccggcagcgtgttctggaccatgtgctgctgcctgagctacttctacatggtgagcgcctggggcggctacgtgttcatcatcaacctgatccccctgcacgtgttcgtgctgctgctgatgcagagatacagcaagagagtgtacatcgcctacagcaccttctacatcgtgggcctgatcctgagcatgcagatccccttcgtgggcttccagcccatcagaaccagcgagcacatggccgccgccggcgtgttcgccctgctgcaggcctacgccttcctgcagtacctgagagacagactgaccaagcaggagttccagaccctgttcttcctgggcgtgagcctggccgccggcgccgtgttcctgagcgtgatctacctgacctacaccggctacatcgccccctggagcggcagattctacagcctgtgggacaccggctacgccaagatccacatccccatcatcgccagcgtgagcgagcaccagcccaccacctgggtgagcttcttcttcgacctgcacatcctggtgtgcaccttccccgccggcctgtggttctgcatcaagaacatcaacgacgagagagtgttcgtggccctgtacgccatcagcgccgtgtacttcgccggcgtgatggtgagactgatgctgaccctgacccccgtggtgtgcatgctgagcgccatcgccttcagcaacgtgttcgagcactacctgggcgacgacatgaagagagagaacccccccgtggaggacagcagcgacgaggacgacaagagaaaccagggcaacctgtacgacaaggccggcaaggtgagaaagcacgccaccgagcaggagaagaccgaggagggcctgggccccaacatcaagagcatcgtgaccatgctgatgctgatgctgctgatgatgttcgccgtgcactgcacctgggtgaccagcaacgcctacagcagccccagcgtggtgctggccagctacaaccacgacggcaccagaaacatcctggacgacttcagagaggcctacttctggctgagacagaacaccgacgagcacgccagagtgatgagctggtgggactacggctaccagatcgccggcatggccaacagaaccaccctggtggacaacaacacctggaacaacagccacatcgccctggtgggcaaggccatgagcagcaacgagaccgccgcctacaagatcatgagaaccctggacgtggactacgtgctggtgatcttcggcggcgtgatcggctacagcggcgacgacatcaacaagttcctgtggatggtgagaatcgccgagggcgagcaccccaaggacatcagagagagcgactacttcaccccccagggcgagttcagagtggacaaggccggcagccccaccctgctgaactgcctgatgtacaagatgagctactacagattcggcgagatgcagctggacttcagaaccccccccggcttcgacagaaccagaaacgccgagatcggcaacaaggacatcaagttcaagcacctggaggaggccttcaccagcgagcactggctggtgagaatctacaaggtgaaggcccccgacaacagagagaccctggaccacaagcccagagtgaccaacatcttccccaagcagaagtacctgagcaagaagaccaccaagagaaagagaggctacatcaagaacaagctggtgttcaagaagggcaagaagatcagcaagaagaccgtgtag

SEQ ID NO: 22652 - DNA, 1005 bp, Artificial Sequence
  Description of Artificial Sequence: Synthetic coding sequence
atgctgggcatcatggcctggaacgccacctgcaagaactggctggccgccgaggccgccctggagaagtactacctgagcatcttctacggcatcgagttcgtggtgggcgtgctgggcaacaccatcgtggtgtacggctacatcttcagcctgaagaactggaacagcagcaacatctacctgttcaacctgagcgtgagcgacctggccttcctgtgcaccctgcccatgctgatcagaagctacgccaacggcaactggatctacggcgacgtgctgtgcatcagcaacagatacgtgctgcacgccaacctgtacaccagcatcctgttcctgaccttcatcagcatcgacagatacctgatcatcaagtaccccttcagagagcacctgctgcagaagaaggagttcgccatcctgatcagcctggccatctgggtgctggtgaccctggagctgctgcccatcctgcccctgatcaaccccgtgatcaccgacaacggcaccacctgcaacgacttcgccagcagcggcgaccccaactacaacctgatctacagcatgtgcctgaccctgctgggcttcctgatccccctgttcgtgatgtgcttcttctactacaagatcgccctgttcctgaagcagagaaacagacaggtggccaccgccctgcccctggagaagcccctgaacctggtgatcatggccgtggtgatcttcagcgtgctgttcaccccctaccacgtgatgagaaacgtgagaatcgccagcagactgggcagctggaagcagtaccagtgcacccaggtggtgatcaacagcttctacatcgtgaccagacccctggccttcctgaacagcgtgatcaaccccgtgttctacttcctgctgggcgaccacttcagagacatgctgatgaaccagctgagacacaacttcaagagcctgaccagcttcagcagatgggcccacgagctgctgctgagcttcagagagaagtag

SEQ ID NO: 22653 - DNA, 1323 bp, Artificial Sequence
  Description of Artificial Sequence: Synthetic coding sequence
atggccagccccgtggccgcccaggccggcaagctgctgagagccctggccctgagacccagattcctggccgccggcagccaggccgtgcagctgaccagcagaagatggctgaacctgcaggagtaccagagcaagaagctgatgagcgacaacggcgtgagagtgcagagattcttcgtggccgacaccgccaacgaggccctggaggccgccaagagactgaacgccaaggagatcgtgctgaaggcccagatcctggccggcggcagaggcaagggcgtgttcaacagcggcctgaagggcggcgtgcacctgaccaaggaccccaacgtggtgggccagctggccaagcagatgatcggctacaacctggccaccaagcagacccccaaggagggcgtgaaggtgaacaaggtgatggtggccgaggccctggacatcagcagagagacctacctggccatcctgatggacagaagctgcaacggccccgtgctggtgggcagcccccagggcggcgtggacatcgaggaggtggccgccagcaaccccgagctgatcttcaaggagcagatcgacatcttcgagggcatcaaggacagccaggcccagagaatggccgagaacctgggcttcgtgggccccctgaagagccaggccgccgaccagatcaccaagctgtacaacctgttcctgaagatcgacgccacccaggtggaggtgaaccccttcggcgagacccccgagggccaggtggtgtgcttcgacgccaagatcaacttcgacgacaacgccgagttcagacagaaggacatcttcgccatggacgacaagagcgagaacgagcccatcgagaacgaggccgccaagtacgacctgaagtacatcggcctggacggcaacatcgcctgcttcgtgaacggcgccggcctggccatggccacctgcgacatcatcttcctgaacggcggcaagcccgccaacttcctggacctgggcggcggcgtgaaggaggcccaggtgtaccaggccttcaagctgctgaccgccgaccccaaggtggaggccatcctggtgaacatcttcggcggcatcgtgaactgcgccatcatcgccaacggcatcaccaaggcctgcagagagctggagctgaaggtgcccctggtggtgagactggagggcaccttcatggagaagaagggcagctacatgcacatcaagcaggagaccggcaacagcaacgagaacatcaccggcatccaggagaacgtggcccaccagaacctgagcaagtgcgccatcagcatcttcctgtgctag

SEQ ID NO: 22654 - DNA, 1299 bp, Artificial Sequence
  Description of Artificial Sequence: Synthetic coding sequence
atggccagccccgtggccgcccaggccggcaagctgctgagagccctggccctgagacccagattcctggccgccggcagccaggccgtgcagctgaccagcagaagatggctgaacctgcaggagtaccagagcaagaagctgatgagcgacaacggcgtgagagtgcagagattcttcgtggccgacaccgccaacgaggccctggaggccgccaagagactgaacgccaaggagatcgtgctgaaggcccagatcctggccggcggcagaggcaagggcgtgttcaacagcggcctgaagggcggcgtgcacctgaccaaggaccccaacgtggtgggccagctggccaagcagatgatcggctacaacctggccaccaagcagacccccaaggagggcgtgaaggtgaacaaggtgatggtggccgaggccctggacatcagcagagagacctacctggccatcctgatggacagaagctgcaacggccccgtgctggtgggcagcccccagggcggcgtggacatcgaggaggtggccgccagcaaccccgagctgatcttcaaggagcagatcgacatcttcgagggcatcaaggacagccaggcccagagaatggccgagaacctgggcttcgtgggccccctgaagagccaggccgccgaccagatcaccaagctgtacaacctgttcctgaagatcgacgccacccaggtggaggtgaaccccttcggcgagacccccgagggccaggtggtgtgcttcgacgccaagatcaacttcgacgacaacgccgagttcagacagaaggacatcttcgccatggacgacaagagcgagaacgagcccatcgagaacgaggccgccaagtacgacctgaagtacatcggcctggacggcaacatcgcctgcttcgtgaacggcgccggcctggccatggccacctgcgacatcatcttcctgaacggcggcaagcccgccaacttcctggacctgggcggcggcgtgaaggaggcccaggtgtaccaggccttcaagctgctgaccgccgaccccaaggtggaggccatcctggtgaacatcttcggcggcatcgtgaactgcgccatcatcgccaacggcatcaccaaggcctgcagagagctggagctgaaggtgcccctggtggtgagactggagggcaccaacgtgcaggaggcccagaagatcctgaacaacagcggcctgcccatcaccagcgccatcgacctggaggacgccgccaagaaggccgtggccagcgtggccaagaagtag

SEQ ID NO: 22655 - DNA, 753 bp, Artificial Sequence
  Description of Artificial Sequence: Synthetic coding sequence
atgagcgacaacggcgtgagagtgcagagattcttcgtggccgacaccgccaacgaggccctggaggccgccaagagactgaacgccaaggagatcgtgctgaaggcccagatcctggccggcggcagaggcaagggcgtgttcaacagcggcctgaagggcggcgtgcacctgaccaaggaccccaacgtggtgggccagctggccaagcagatgatcggctacaacctggccaccaagcagacccccaaggagggcgtgaaggtgaacaaggtgatggtggccgaggccctggacatcagcagagagacctacctggccatcctgatggacagaagctgcaacggccccgtgctggtgggcagcccccagggcggcgtggacatcgaggaggtggccgccagcaaccccgagctgatcttcaaggagcagatcgacatcttcgagggcatcaaggacagccaggcccagagaatggccgagaacctgggcttcgtgggccccctgaagagccaggtggaggccatcctggtgaacatcttcggcggcatcgtgaactgcgccatcatcgccaacggcatcaccaaggcctgcagagagctggagctgaaggtgcccctggtggtgagactggagggcaccaacgtgcaggaggcccagaagatcctgaacaacagcggcctgcccatcaccagcgccatcgacctggaggacgccgccaagaaggccgtggccagcgtggccaagaagtag

SEQ ID NO: 22656 - DNA, 642 bp, Artificial Sequence
  Description of Artificial Sequence: Synthetic coding sequence
atgttcggctggagcttcgtgttcgaggacttcgtgagcgacgagctgagaaacaaggccacccagcccatgaagagcgtgctgtggtggctgcccgtggagaaggccttctggagacagcccgccggccccggcagcggcatcagagagagactggagcaccccgtgctgcacgtgagctggaacgacgccagagcctactgcgcctggagaggcaagagactgcccaccgaggaggagtgggagttcgccgccagaggcggcctgaagggccaggtgtacccctggggcaactggttccagcccaacagaaccaacctgtggcagggcaagttccccaagggcgacaaggccgaggacggcttccacggcgtgagccccgtgaacgccttccccgcccagaacaactacggcctgtacgacctgctgggcaacgtgtgggagtggaccgccagcccctaccaggccgccgagcaggacatgagagtgctgagaggcgccagctggatcgacaccgccgacggcagcgccaaccacagagccagagtgaccaccagaatgggcaacacccccgacagcgccagcgacaacctgggcttcagatgcgccgccgacgccggcagaccccccggcgagctgtag

SEQ ID NO: 22657 - DNA, 1077 bp, Artificial Sequence
  Description of Artificial Sequence: Synthetic coding sequence
atgagagcccacgcccagagaggcagaggctgcaccagaagaagcgccgccgtgctgatggccagacacggcctgcccctgctgcccctgctgagcctgctggtgggcgcctggctgaagctgggcaacggccaggccaccagcatggtgcagctgcagggcggcagattcctgatgggcaccaacagccccgacagcagagacggcgacggccccgtgagagaggccaccgtgaagcccttcgccatcgacatcttccccgtgaccaacaaggacttcagagacttcgtgagagagaagaagtacagaaccgaggccgagatgttcggctggagcttcgtgttcgaggacttcgtgagcgacgagctgagaaacaaggccacccagcccatgaagagcgtgctgtggtggctgcccgtggagaaggccttctggagacagcccgccggccccggcagcggcatcagagagagactggagcaccccgtgctgcacgtgagctggaacgacgccagagcctactgcgcctggagaggcaagagactgcccaccgaggaggagtgggagttcgccgccagaggcggcctgaagggccaggtgtacccctggggcaactggttccagcccaacagaaccaacctgtggcagggcaagttccccaagggcgacaaggccgaggacggcttccacggcgtgagccccgtgaacgccttccccgcccagaacaactacggctgggccaccctgcagatccagccccagaccaccagcgtgagcgccgtgctgcagacccaggccggcagacagggcagctgcaagcagcccggcggcgacaaggagaagagcctgctgggcagcctgagcttccccggccacgtggccaacagcgccatccccagcagcagagccagcgccagcggcaagaacttccccttccccgtgagccaccccagcgtggccggcgccagccaccagggcagaagaggcctgagcctgctgtgcttcggcgagggcgcccagtgcgtgctgaccatggccggcggccaggtgttcctgctggaggccaagtactactag

SEQ ID NO: 22658 - DNA, 711 bp, Artificial Sequence
  Description of Artificial Sequence: Synthetic coding sequence
atgagagcccacgcccagagaggcagaggctgcaccagaagaagcgccgccgtgctgatggccagacacggcctgcccctgctgcccctgctgagcctgctggtgggcgcctggctgaagctgggcaacggccaggccaccagcatggtgcagctgcagggcggcagattcctgatgggcaccaacagccccgacagcagagacggcgacggccccgtgagagaggccaccgtgaagcccttcgccatcgacatcttccccgtgaccaacaaggacttcagagacttcgtgagagagaagaagtacagaaccgaggccgagatgttcggctggagcttcgtgttcgaggacttcgtgagcgacgagctgagaaacaaggccacccagcccatgaagggcaagttccccaagggcgacaaggccgaggacggcttccacggcgtgagccccgtgaacgccttccccgcccagaacaactacggcctgtacgacctgctgggcaacgtgtgggagtggaccgccagcccctaccaggccgccgagcaggacatgagagtgctgagaggcgccagctggatcgacaccgccgacggcagcgccaaccacagagccagagtgaccaccagaatgggcaacacccccgacagcgccagcgacaacctgggcttcagatgcgccgccgacgccggcagaccccccggcgagctgtag

SEQ ID NO: 22659 - DNA, 918 bp, Artificial Sequence
  Description of Artificial Sequence: Synthetic coding sequence
atgagagcccacgcccagagaggcagaggctgcaccagaagaagcgccgccgtgctgatggccagacacggcctgcccctgctgcccctgctgagcctgctggtgggcgcctggctgaagctgggcaacggccaggccaccagcatggtgcagctgcagggcggcagattcctgatgggcaccaacagccccgacagcagagacggcgacggccccgtgagagaggccaccgtgaagcccttcgccatcgacatcttccccgtgaccaacaaggacttcagagacttcgtgagagagaagaagtacagaaccgaggccgagatgttcggctggagcttcgtgttcgaggacttcgtgagcgacgagctgagaaacaaggccacccagcccatgaagcccgccggccccggcagcggcatcagagagagactggagcaccccgtgctgcacgtgagctggaacgacgccagagcctactgcgcctggagaggcaagagactgcccaccgaggaggagtgggagttcgccgccagaggcggcctgaagggccaggtgtacccctggggcaactggttccagcccaacagaaccaacctgtggcagggcaagttccccaagggcgacaaggccgaggacggcttccacggcgtgagccccgtgaacgccttccccgcccagaacaactacggcctgtacgacctgctgggcaacgtgtgggagtggaccgccagcccctaccaggccgccgagcaggacatgagagtgctgagaggcgccagctggatcgacaccgccgacggcagcgccaaccacagagccagagtgaccaccagaatgggcaacacccccgacagcgccagcgacaacctgggcttcagatgcgccgccgacgccggcagaccccccggcgagctgtag

SEQ ID NO: 22660 - DNA, 885 bp, Artificial Sequence
  Description of Artificial Sequence: Synthetic coding sequence
atgagagcccacgcccagagaggcagaggctgcaccagaagaagcgccgccgtgctgatggccagacacggcctgcccctgctgcccctgctgagcctgctggtgggcgcctggctgaagctgggcaacggccaggccaccagcatggtgcagctgcagggcggcagattcctgatgggcaccaacagccccgacagcagagacggcgacggccccgtgagagaggccaccgtgaagcccttcgccatcgacatcttccccgtgaccaacaaggacttcagatacatcagagacttcgtgagagagaagaagtacagaaccgaggccgagatgttcggctggagcttcgtgttcgaggacttcgtgagcgacgagctgagaaacaaggccacccagcccatgaagagcgtgctgtggtggctgcccgtggagaaggccttctggagacagcccgccggccccggcagcggcatcagagagagactggagcaccccgtgctgcacgtgagctggaacgacgccagagcctactgcgcctggagaggcaagagactgcccaccgaggaggagtgggagttcgccgccagaggcggcctgaagggccaggtgtacccctggggcaactggttccagcccaacagaaccaacctgtggcagggcaagttccccaagggcgacaaggccgaggacggcttccacggcgtgagccccgtgaacgccttccccgcccagaacaactacggcctgtacgacctgctgggcaacgtgtgggagtggaccgccagcccctaccaggccgccgagcaggacatgagagtgctgagaggcgccagctggatcgacaccgccgacggcagcgccaaccacagagccagagtgacctag

SEQ ID NO: 22661 - DNA, 963 bp, Artificial Sequence
  Description of Artificial Sequence: Synthetic coding sequence
atgagagcccacgcccagagaggcagaggctgcaccagaagaagcgccgccgtgctgatggccagacacggcctgcccctgctgcccctgctgagcctgctggtgggcgcctggctgaagctgggcaacggccaggccaccagcatggtgcagctgcagggcggcagattcctgatgggcaccaacagccccgacagcagagacggcgacggccccgtgagagaggccaccgtgaagcccttcgccatcgacatcttccccgtgaccaacaaggacttcagagacttcgtgagagagaagaagtacagaaccgaggccgagatgttcggctggagcttcgtgttcgaggacttcgtgagcgacgagctgagaaacaaggccacccagcccatgaagagcgtgctgtggtggctgcccgtggagaaggccttctggagacagcccgccggccccggcagcggcatcagagagagactggagcaccccgtgctgcacgtgagctggaacgacgccagagcctactgcgcctggagaggcaagagactgcccaccgaggaggagtgggagttcgccgccagaggcggcctgaagggccaggtgtacccctggggcaactggttccagcccaacagaaccaacctgtggcagggcaagttccccaagggcgacaaggccgaggacggcttccacggcgtgagccccgtgaacgccttccccgcccagaacaactacggcctgtacgacctgctgggcaacgtgtgggagtggaccgccagcccctaccaggccgccgagcaggacatgagagtgctgagaggcgccagctggatcgacaccgccgacggcagcgccaaccacagagccagagtgaccaccagaatgggcaacacccccgacagcgccagcgacaacctgggcttcagatgcgccgccgacgccggcagaccccccggcgagctgtag

SEQ ID NO: 22662 - DNA, 1821 bp, Artificial Sequence
  Description of Artificial Sequence: Synthetic coding sequence
atggtgagaggcgccagacagccccagcagcccagaagcagactggcccccagactgaccggcaccgtggagaagccccccagaaagagaagaagcagaaccgagttcgccctgaaggagatcatgagcagcggcggcgccgaggacgacatcccccagggcgagagaaagaccgtgaccgacttctgctacctgctggacaagagcaagcagctgttcaacggcctgagagacctgccccagtacggccagaagcagtggcagagctacttcggcagaaccttcgacgtgtacaccaagctgtggaagttccagcagcagcacagacaggtgctggacaacagatacggcctgaagagatggcagatcggcgagatcgccagcaagatcggccagctgtactaccactactacctgagaaccagcgagaccagctacctgaacgaggccttcagcttctacagcgccatcagacagagaagctactacagccaggtgaacaaggaggacagacccgagctggtggtgaagaagctgagatactacgccagattcatcgtggtgtgcctgctgctgaacaagatggacgtggtgaaggacctggtgaaggagctgagcgacgagatcgaggactacacccacagattcaacaccgaggaccaggtggagtggaacctggtgctgcaggaggtggccgccttcatcgaggccgaccccgtgatggtgctgaacgacgacaacaccatcgtgatcaccagcaacagactggccgagaccggcgcccccctgctggagcagggcatgatcgtgggccagctgagcctggccgacgccctgatcatcggcaactgcaacaaccaggtgaagttcagcgagctgaccgtggacatgttcagaatgctgcaggccctggagagagagcccatgaacctggccagccagatgaacaagcccggcatgcaggagagcgccgacaagcccaccagaagagagaacccccacaagtacctgctgtacaagcccaccttcagccagctgtacaccttcctggccgccagcttcaaggagctgcccgccaacagcgtgctgctgatctacctgagcgccaccggcgtgttccccaccggcagaagcgacagcgagggcccctacgacttcggcggcgtgctgaccaacagcaacagagacatcatcaacggcgacgccatccacaagagaaaccagagccacaaggagatgcactgcctgcaccccggcgacctgtaccccttcaccagaaagcccctgttcatcatcgtggacagcagcaacagcgtggcctacaagaacttcaccaacctgttcggccagcccctggtgtgcctgctgagccccaccgcctaccccaaggccctgcaggaccagagccagagaggcagcctgttcaccctgttcctgaacaaccccctgatggccttcctgttcgtgagcggcctgagcagcatgagaagaggcctgtgggagaagtgccaggagtacctgagaaagatcaacagagacatcgcccagctgctgacccacagcagaagcatcgaccaggccttcctgcagttcttcggcgacgagttcctgagactgctgctgaccagattcatcttctgcagcgccaccatgagaatgcacaagatcttcagagagaccagaaactaccccgagagctacccccagctgcccagagacgagaccgtggagaacccccacctgcagaagcacatcctggagctggccagcatcctggacgtgagaaacgtgttcttcgagaacaccatcgacgactactag

SEQ ID NO: 22663 - DNA, 1890 bp, Artificial Sequence
  Description of Artificial Sequence: Synthetic coding sequence
atggtgagaggcgccagacagccccagcagcccagaagcagactggcccccagactgaccggcaccgtggagaagccccccagaaagagaagaagcagcatcagaggcagcggcgacagcagccacagccagagccagggcgagagataccagcacttcaccgagaagaccgagttcgccctgaaggagatcatgagcagcggcggcgccgaggacgacatcccccagggcgagagaaagaccgtgaccgacttctgctacctgctggacaagagcaagcagctgttcaacggcctgagagacctgccccagtacggccagaagcagtggcagagctacttcggcagaaccttcgacgtgtacaccaagctgtggaagttccagcagcagcacagacaggtgctggacaacagatacggcctgaagagatggcagatcggcgagatcgccagcaagatcggccagctgtactaccactactacctgagaaccagcgagaccagctacctgaacgaggccttcagcttctacagcgccatcagacagagaagctactacagccaggtgaacaaggaggacagacccgagctggtggtgaagaagctgagatactacgccagattcatcgtggtgtgcctgctgctgaacaagatggacgtggtgaaggacctggtgaaggagctgagcgacgagatcgaggactacacccacagattcaacaccgaggaccaggtggagtggaacctggtgctgcaggaggtggccgccttcatcgaggccgaccccgtgatggtgctgaacgacgacaacaccatcgtgatcaccagcaacagactggccgagaccggcgcccccctgctggagcagggcatgatcgtgggccagctgagcctggccgacgccctgatcatcggcaactgcaacaaccaggtgaagttcagcgagctgaccgtggacatgttcagaatgctgcaggccctggagagagagcccatgaacctggccagccagatgaacaagcccggcatgcaggagagcgccgacaagcccaccagaagagagaacccccacaagtacctgctgtacaagcccaccttcagccagctgtacaccttcctggccgccagcttcaaggagctgcccgccaacagcgtgctgctgatctacctgagcgccaccggcgtgttccccaccggcagaagcgacagcgagggcccctacgacttcggcggcgtgctgaccaacagcaacagagacatcatcaacggcgacgccatccacaagagaaaccagagccacaaggagatgcactgcctgcaccccggcgacctgtaccccttcaccagaaagcccctgttcatcatcgtggacagcagcaacagcgtggcctacaagaacttcaccaacctgttcggccagcccctggtgtgcctgctgagccccaccgcctaccccaaggccctgcaggaccagagccagagaggcagcctgttcaccctgttcctgaacaaccccctgatggccttcctgttcgtgagcggcctgagcagcatgagaagaggcctgtgggagaagtgccaggagtacctgagaaagatcaacagagacatcgcccagctgctgacccacagcagaagcatcgaccaggccttcctgcagttcttcggcgacgagttcctgagactgctgctgaccagattcatcttctgcagcgccaccatgagaatgcacaagatcttcagagagaccagaaactaccccgagagctacccccagctgcccagagacgagaccgtggagaacccccacctgcagaagcacatcctggagctggccagcatcctggacgtgagaaacgtgttcttcgagaacaccatcgacgactactag

SEQ ID NO: 22664 - DNA, 1746 bp, Artificial Sequence
  Description of Artificial Sequence: Synthetic coding sequence
atggtgttcagaaacgtgggcagaccccccgaggaggaggacgtggaggccgcccccgagcccggccccagcgagctgctgtgccccagacacagatgcgccctggaccccaaggccctgccccccggcctggccctggagagaacctggggccccgccgccggcctggaggcccagctggccgccctgggcctgggccagcccgccggccccggcgtgaagaccgtgggcggcggctgctgcccctgcccctgccccccccagcccccccccccccagccccagccccccgccgccgccccccaggccggcgaggaccccaccgagaccagcgacgccctgctggtgctggagggcctggagagcgaggccgagagcctggagaccaacagctgcagcgaggaggagctgagcagccccggcagaggcggcggcggcggcggcagactgctgctgcagccccccggccccgagctgccccccgtgcccttccccctgcaggacctggtgcccctgggcagactgagcagaggcgagcagcagcagcagcagcagcagcagccccccccccccccccccccccccggccccctgagacccctggccggccccagcagaaagggcagcttcaagatcagactgagcagactgttcagaaccaagagctgcaacggcggcagcggcggcggcgacggcaccggcaagagacccagcggcgagctggccgccagcgccgccagcctgaccgacatgggcggcagcgccggcagagagctggacgccggcagaaagcccaagctgaccagaacccagagcgccttcagccccgtgagcttcagccccctgttcaccggcgagaccgtgagcctggtggacgtggacatcagccagagaggcctgaccagcccccacccccccacccccccccccccccccagaagaagcctgagcctgctggacgacatcagcggcaccctgcccaccagcgtgctggtggcccccatgggcagcagcctgcagagcttccccctgcccccccccccccccccccacgcccccgacgccttccccagaatcgcccccatcagagccgccgagagcctgcacagccagcccccccagcacctgcagtgccccctgtacagacccgacagcagcagcttcgccgccagcctgagagagctggagaagtgcggctggtactggggccccatgaactgggaggacgccgagatgaagctgaagggcaagcccgacggcagcttcctggtgagagacagcagcgaccccagatacatcctgagcctgagcttcagaagccagggcatcacccaccacaccagaatggagcactacagaggcaccttcagcctgtggtgccaccccaagttcgaggacagatgccagagcgtggtggagttcatcaagagagccatcatgcacagcaagaacggcaagttcctgtacttcctgagaagcagagtgcccggcctgccccccacccccgtgcagctgctgtaccccgtgagcagattcagcaacgtgaagagcctgcagcacctgtgcagattcagaatcagacagctggtgagaatcgaccacatccccgacctgcccctgcccaagcccctgatcagctacatcagaaagttctactactacgacccccaggaggaggtgtacctgagcctgaaggaggcccagctgatcagcaagcagaagcaggaggtggagcccagcacctag

SEQ ID NO: 22665 - DNA, 1746 bp, Artificial Sequence; identical to SEQ ID NO: 22664
  Description of Artificial Sequence: Synthetic coding sequence

SEQ ID NO: 22666 - DNA, 2169 bp, Artificial Sequence
  Description of Artificial Sequence: Synthetic coding sequence
atgggcagaggcccctgggacgccggccccagcagaagactgctgcccctgctgctgctgctgggcctggccagaggcgccgccggcgcccccggccccgacggcctggacgtgtgcgccacctgccacgagcacgccacctgccagcagagagagggcaagaagatctgcatctgcaactacggcttcgtgggcaacggcagaacccagtgcgtggacaagaacgagtgccagttcggcgccaccctggtgtgcggcaaccacaccagctgccacaacacccccggcggcttctactgcatctgcctggagggctacagagccaccaacaacaacaagaccttcatccccaacgacggcaccttctgcaccgacatcgacgagtgcgaggtgagcggcctgtgcagacacggcggcagatgcgtgaacacccacggcagcttcgagtgctactgcatggacggctacctgcccagaaacggccccgagcccttccaccccaccaccgacgccaccagctgcaccgagatcgactgcggcaccccccccgaggtgcccgacggctacatcatcggcaactacaccagcagcctgggcagccaggtgagatacgcctgcagagagggcttcttcagcgtgcccgaggacaccgtgagcagctgcaccggcctgggcacctgggagagccccaagctgcactgccaggagatcaactgcggcaacccccccgagatgagacacgccatcctggtgggcaaccacagcagcagactgggcggcgtggccagatacgtgtgccaggagggcttcgagagccccggcggcaagatcaccagcgtgtgcaccgagaagggcacctggagagagagcaccctgacctgcaccgagatcctgaccaagatcaacgacgtgagcctgttcaacgacacctgcgtgagatggcagatcaacagcagaagaatcaaccccaagatcagctacgtgatcagcatcaagggccagagactggaccccatggagagcgtgagagaggagaccgtgaacctgaccaccgacagcagaacccccgaggtgtgcctggccctgtaccccggcaccaactacaccgtgaacatcagcaccgccccccccagaagaagcatgcccgccgtgatcggcttccagaccgccgaggtggacctgctggaggacgacggcagcttcaacatcagcatcttcaacgagacctgcctgaagctgaacagaagaagcagaaaggtgggcagcgagcacatgtaccagttcaccgtgctgggccagagatggtacctggccaacttcagccacgccaccagcttcaacttcaccaccagagagcaggtgcccgtggtgtgcctggacctgtaccccaccaccgactacaccgtgaacgtgaccctgctgagaagccccaagagacacagcgtgcagatcaccatcgccaccccccccgccgtgaagcagaccatcagcaacatcagcggcttcaacgagacctgcctgagatggagaagcatcaagaccgccgacatggaggagatgtacctgttccacatctggggccagagatggtaccagaaggagttcgcccaggagatgaccttcaacatcagcagcagcagcagagaccccgaggtgtgcctggacctgagacccggcaccaactacaacgtgagcctgagagccctgagcagcgagctgcccgtggtgatcagcctgaccacccagatcaccgagccccccctgcccgaggtggagttcttcaccgtgcacagaggccccctgcccagactgagactgagaaaggccaaggagaagaacggccccatcagcagctaccaggtgctggtgctgcccctggccctgcagagcaccttcagctgcgacagcgagggcgccagcagcttcttcagcaacgccagcgacgccgacggctacgtggccgccgagctgctggccaaggacgtgcccgacgacgccatggagatccccatcggcgacagactgtactacggcgagtactacaacgcccccctgaagagaggcagcgactactgcatcatcctgagaatcaccagcgagtggaacaagatcagacacagctgctgctgcagatggagagtgctggactgggtgccctggctgctgtag

SEQ ID NO: 22667 - DNA, 2274 bp, Artificial Sequence
  Description of Artificial Sequence: Synthetic coding sequence
atgggcagaggcccctgggacgccggccccagcagaagactgctgcccctgctgctgctgctgggcctggccagaggcgccgccggcgcccccggccccgacggcctggacgtgtgcgccacctgccacgagcacgccacctgccagcagagagagggcaagaagatctgcatctgcaactacggcttcgtgggcaacggcagaacccagtgcgtggacaagaacgagtgccagttcggcgccaccctggtgtgcggcaaccacaccagctgccacaacacccccggcggcttctactgcatctgcctggagggctacagagccaccaacaacaacaagaccttcatccccaacgacggcaccttctgcaccgacatcgacgagtgcgaggtgagcggcctgtgcagacacggcggcagatgcgtgaacacccacggcagcttcgagtgctactgcatggacggctacctgcccagaaacggccccgagcccttccaccccaccaccgacgccaccagctgcaccgagatcgactgcggcaccccccccgaggtgcccgacggctacatcatcggcaactacaccagcagcctgggcagccaggtgagatacgcctgcagagagggcttcttcagcgtgcccgaggacaccgtgagcagctgcaccggcctgggcacctgggagagccccaagctgcactgccaggagatcaactgcggcaacccccccgagatgagacacgccatcctggtgggcaaccacagcagcagactgggcggcgtggccagatacgtgtgccaggagggcttcgagagccccggcggcaagatcaccagcgtgtgcaccgagaagggcacctggagagagagcaccctgacctgcaccgagatcctgaccaagatcaacgacgtgagcctgttcaacgacacctgcgtgagatggcagatcaacagcagaagaatcaaccccaagatcagctacgtgatcagcatcaagggccagagactggaccccatggagagcgtgagagaggagaccgtgaacctgaccaccgacagcagaacccccgaggtgtgcctggccctgtaccccggcaccaactacaccgtgaacatcagcaccgccccccccagaagaagcatgcccgccgtgatcggcttccagaccgccgaggtggacctgctggaggacgacggcagcttcaacatcagcatcttcaacgagacctgcctgaagctgaacagaagaagcagaaaggtgggcagcgagcacatgtaccagttcaccgtgctgggccagagatggtacctggccaacttcagccacgccaccagcttcaacttcaccaccagagagcaggtgcccgtggtgtgcctggacctgtaccccaccaccgactacaccgtgaacgtgaccctgctgagaagccccaagagacacagcgtgcagatcaccatcgccaccccccccgccgtgaagcagaccatcagcaacatcagcggcttcaacgagacctgcctgagatggagaagcatcaagaccgccgacatggaggagatgtacctgttccacatctggggccagagatggtaccagaaggagttcgcccaggagatgaccttcaacatcagcagcagcagcagagaccccgaggtgtgcctggacctgagacccggcaccaactacaacgtgagcctgagagccctgagcagcgagctgcccgtggtgatcagcctgaccacccagatcaccgagccccccctgcccgaggtggagttcttcaccgtgcacagaggccccctgcccagactgagactgagaaaggccaaggagaagaacggccccatcagcagctaccaggtgctggtgctgcccctggccctgcagagcaccttcagctgcgacagcgagggcgccagcagcttcttcagcaacgccagcgacgccgacggctacgtggccgccgagctgctggccaaggacgtgcccgacgacgccatggagatccccatcggcgacagactgtactacggcgagtactacaacgcccccctgaagagaggcagcgactactgcatcatcctgagaatcaccagcgagtggaacaaggtgagaagacacagctgcgccgtgtgggcccaggtgaaggagatcccctgcaactgcaacttcctgagactgcacatccacagagccaacagcggcgacacccagatcagacacagctgctgctgcagatggagagtgctggactgggtgccctggctgctgtag

SEQ ID NO: 22668 - DNA, 2244 bp, Artificial Sequence
  Description of Artificial Sequence: Synthetic coding sequence
atgggcagaggcccctgggacgccggccccagcagaagactgctgcccctgctgctgctgctgggcctggccagaggcgccgccggcgcccccggccccgacggcctggacgtgtgcgccacctgccacgagcacgccacctgccagcagagagagggcaagaagatctgcatctgcaactacggcttcgtgggcaacggcagaacccagtgcgtggacaagaacgagtgccagttcggcgccaccctggtgtgcggcaaccacaccagctgccacaacacccccggcggcttctactgcatctgcctggagggctacagagccaccaacaacaacaagaccttcatccccaacgacggcaccttctgcaccgacatcgacgagtgcgaggtgagcggcctgtgcagacacggcggcagatgcgtgaacacccacggcagcttcgagtgctactgcatggacggctacctgcccagaaacggccccgagcccttccaccccaccaccgacgccaccagctgcaccgagatcgactgcggcaccccccccgaggtgcccgacggctacatcatcggcaactacaccagcagcctgggcagccaggtgagatacgcctgcagagagggcttcttcagcgtgcccgaggacaccgtgagcagctgcaccggcctgggcacctgggagagccccaagctgcactgccaggagatcaactgcggcaacccccccgagatgagacacgccatcctggtgggcaaccacagcagcagactgggcggcgtggccagatacgtgtgccaggagggcttcgagagccccggcggcaagatcaccagcgtgtgcaccgagaagggcacctggagagagagcaccctgacctgcaccgagatcctgaccaagatcaacgacgtgagcctgttcaacgacacctgcgtgagatggcagatcaacagcagaagaatcaaccccaagatcagctacgtgatcagcatcaagggccagagactggaccccatggagagcgtgagagaggagaccgtgaacctgaccaccgacagcagaacccccgaggtgtgcctggccctgtaccccggcaccaactacaccgtgaacatcagcaccgccccccccagaagaagcatgcccgccgtgatcggcttccagaccgccgaggtggacctgctggaggacgacggcagcttcaacatcagcatcttcaacgagacctgcctgaagctgaacagaagaagcagaaaggtgggcagcgagcacatgtaccagttcaccgtgctgggccagagatggtacctggccaacttcagccacgccaccagcttcaacttcaccaccagagagcaggtgcccgtggtgtgcctggacctgtaccccaccaccgactacaccgtgaacgtgaccctgctgagaagccccaagagacacagcgtgcagatcaccatcgccaccccccccgccgtgaagcagaccatcagcaacatcagcggcttcaacgagacctgcctgagatggagaagcatcaagaccgccgacatggaggagatgtacctgttccacatctggggccagagatggtaccagaaggagttcgcccaggagatgaccttcaacatcagcagcagcagcagagaccccgaggtgtgcctggacctgagacccggcaccaactacaacgtgagcctgagagccctgagcagcgagctgcccgtggtgatcagcctgaccacccagatcaccgagccccccctgcccgaggtggagttcttcaccgtgcacagaggccccctgcccagactgagactgagaaaggccaaggagaagaacggccccatcagcagctaccaggtgctggtgctgcccctggccctgcagagcaccttcagctgcgacagcgagggcgccagcagcttcttcagcaacgccagcgacgccgacggctacgtggccgccgagctgctggccaaggacgtgcccgacgacgccatggagatccccatcggcgacagactgtactacggcgagtactacaacgcccccctgaagagaggcagcgactactgcatcatcctgagaatcaccagcgagtggaacaaggtgagaagacacagctgcgccgtgtgggcccaggtgaaggacagcagcctgatgctgctgcagatggccggcgtgggcctgggcagcctggccgtggtgatcatcctgaccttcctgagcttcagcgccgtgtag

SEQ ID NO: 22669 - DNA, 2469 bp, Artificial Sequence
  Description of Artificial Sequence: Synthetic coding sequence
atgaagcccgccctgctgccctgggccctgctgctgctggccaccgccctgggccccggccccggccccaccgccgacgcccaggagagctgcagcatgagatgcggcgccctggacggcccctgcagctgccaccccacctgcagcggcctgggcacctgctgcctggacttcagagacttctgcctggagatcctgccctacagcggcagcatgatgggcggcaaggacttcgtggtgagacacttcaagatgagcagccccaccgacgccagcgtgatctgcagattcaaggacagcatccagaccctgggccacgtggacagcagcggccaggtgcactgcgtgagccccctgctgtacgagagcggcagaatccccttcaccgtgagcctggacaacggccacagcttccccagagccggcacctggctggccgtgcaccccaacaaggtgagcatgatggagaagagcgagctggtgaacgagaccagatggcagtactacggcaccgccaacaccagcggcaacctgagcctgacctggcacgtgaagagcctgcccacccagaccatcaccatcgagctgtggggctacgaggagaccggcatgccctacagccaggagtggaccgccaagtggagctacctgtaccccctggccacccacatccccaacagcggcagcttcaccttcacccccaagcccgccccccccagctaccagagatggagagtgggcgccctgagaatcatcgacagcaagaactacgccggccagaaggacgtgcaggccctgtggaccaacgaccacgccctggcctggcacctgagcgacgacttcagagaggaccccgtggcctgggccagaacccagtgccaggcctgggaggagctggaggaccagctgcccaacttcctggaggagctgcccgactgcccctgcaccctgacccaggccagagccgacagcggcagattcttcaccgactacggctgcgacatggagcagggcagcgtgtgcacctaccaccccggcgccgtgcactgcgtgagaagcgtgcaggccagcctgagatacggcagcggccagcagtgctgctacaccgccgacggcacccagctgctgaccgccgacagcagcggcggcagcacccccgacagaggccacgactggggcgccccccccttcagaaccccccccagagtgcccagcatgagccactggctgtacgacgtgctgagcttctactactgctgcctgtgggcccccgactgccccagatacatgcagagaagacccagcaacgactgcagaaactacagaccccccagactggccagcgccttcggcgacccccacttcgtgaccttcgacggcaccaacttcaccttcaacggcagaggcgagtacgtgctgctggaggccgccctgaccgacctgagagtgcaggccagagcccagcccggcaccatgagcaacggcaccgagaccagaggcaccggcctgaccgccgtggccgtgcaggagggcaacagcgacgtggtggaggtgagactggccaacagaaccggcggcctggaggtgctgctgaaccaggaggtgctgagcttcaccgagcagagctggatggacctgaagggcatgttcctgagcgtggccgccggcgacagagtgagcatcatgctggccagcggcgccggcctggaggtgagcgtgcagggccccttcctgagcgtgagcgtgctgctgcccgagaagttcctgacccacacccacggcctgctgggcaccctgaacaacgaccccaccgacgacttcaccctgcacagcggcagagtgctgccccccggcaccagcccccaggagctgttcctgttcggcgccaactggaccgtgcacaacgccagcagcctgctgacctacgacagctggttcctggtgcacaacttcctgtaccagcccaagcacgaccccaccttcgagcccctgttccccagcgagaccaccctgaaccccagcctggcccaggaggccgccaagctgtgcggcgacgaccacttctgcaacttcgacgtggccgccaccggcagcctgagcaccggcaccgccaccagagtggcccaccagctgcaccagagaagaatgcagagcctgcagcccgtggtgagctgcggctggctggcccccccccccaacggccagaaggagggcaacagatacctggccggcagcaccatctacttccactgcgacaacggctacagcctggccggcgccgagaccagcacctgccaggccgacggcacctggagcagccccacccccaagtgccagcccggcagaagctacgccgtgctgctgggcatcatcttcggcggcctggccgtggtggccgccgtggccctggtgtacgtgctgctgagaagaagaaagggcaacacccacgtgtggggcgcccagccctag

SEQ ID NO: 22670 - DNA, 729 bp, Artificial Sequence
  Description of Artificial Sequence: Synthetic coding sequence
atgaagaacatcggcctggtgatggagtgggagatccccgagatcatctgcacctgcgccaagctgagactgcccccccaggccaccttccaggtgctgagaggcaacggcgccagcgtgggcaccgtgctgatgttcagatgccccagcaaccaccagatggtgggcagcggcctgctgacctgcacctggaagggcagcatcgccgagtggagcagcggcagccccgtgtgcaagctggtgcccccccacgagaccttcggcttcaaggtggccgtgatcgccagcatcgtgagctgcgccatcatcctgctgatgagcatggccttcctgacctgctgcctgctgaagtgcgtgaagaagagcaagagaagaagaagcaacagaagcgcccagctgtggagccagctgaaggacgaggacctggagaccgtgcaggccgcctacctgggcctgaagcacttcaacaagcccgtgagcggccccagccaggcccacgacaaccacagcttcaccaccgaccacggcgagagcaccagcaagctggccagcgtgaccagaagcgtggacaaggaccccggcatccccagagccctgagcctgagcggcagcagcagcagcccccaggcccaggtgatggtgcacatggccaaccccagacagcccctgcccgccagcggcctggccaccggcatgccccagcagcccgccgcctacgccctgggctag

SEQ ID NO: 22671 - DNA, 768 bp, Artificial Sequence
  Description of Artificial Sequence: Synthetic coding sequence
atgagatgggccgccgccaccctgagaggcaaggccagacccagaggcagagccggcgtgaccacccccgcccccggcaacagaaccggcacctgcgccaagctgagactgcccccccaggccaccttccaggtgctgagaggcaacggcgccagcgtgggcaccgtgctgatgttcagatgccccagcaaccaccagatggtgggcagcggcctgctgacctgcacctggaagggcagcatcgccgagtggagcagcggcagccccgtgtgcaagctggtgcccccccacgagaccttcggcttcaaggtggccgtgatcgccagcatcgtgagctgcgccatcatcctgctgatgagcatggccttcctgacctgctgcctgctgaagtgcgtgaagaagagcaagagaagaagaagcaacagaagcgcccagctgtggagccagctgaaggacgaggacctggagaccgtgcaggccgcctacctgggcctgaagcacttcaacaagcccgtgagcggccccagccaggcccacgacaaccacagcttcaccaccgaccacggcgagagcaccagcaagctggccagcgtgaccagaagcgtggacaaggaccccggcatccccagagccctgagcctgagcggcagcagcagcagcccccaggcccaggtgatggtgcacatggccaaccccagacagcccctgcccgccagcggcctggccaccggcatgccccagcagcccgccgcctacgccctgggctag

SEQ ID NO: 22672 - DNA, 711 bp, Artificial Sequence
  Description of Artificial Sequence: Synthetic coding sequence
atgtaccacggcatgaaccccagcaacggcgacggcttcctggagcagcagcagcagcagcagcagccccagagcccccagagactgctggccgtgatcctgtggttccagctggccctgtgcttcggccccgcccagctgaccggcggcttcgacgacctgcaggtgtgcgccgaccccggcatccccgagaacggcttcagaacccccagcggcggcgtgttcttcgagggcagcgtggccagattccactgccaggacggcttcaagctgaagggcgccaccaagagactgtgcctgaagcacttcaacggcaccctgggctggatccccagcgacaacagcatctgcgtgcaggaggactgcagaatcccccagatcgaggacgccgagatccacaacaagacctacagacacggcgagaagctgatcatcacctgccacgagggcttcaagatcagataccccgacctgcacaacatggtgagcctgtgcagagacgacggcacctggaacaacctgcccatctgccagggctgcctgagacccctggccccccagcacacccccgcccagggcaccagaacccaggcccagggcagccagaagcccgtgaccgccagccaggccctgctgagctgcagcaaggtgtgcatccacctgcccggcgccaagagagcccccaccctgctgagaaccaccctgacctag

SEQ ID NO: 22673 - DNA, 321 bp, Artificial Sequence
  Description of Artificial Sequence: Synthetic coding sequence
atgtaccacggcatgaaccccagcaacggcgacggcttcctggagcagcagcagcagcagcagcagccccagagcccccagagactgctggccgtgatcctgtggttccagctggccctgtgcttcggccccgcccagctgaccggcgtgcacctgaccagagacctgctgggcttcgagggctgccccgagtgcccccccccccccggcttcaaggaggagagccaggagttcgcccagcaggtgacccccctgagaagcctgacccacgccaacccctggagcagcggccccctgtgcatccccaagagctggagctag

SEQ ID NO: 22674 - DNA, 1473 bp, Artificial Sequence
  Description of Artificial Sequence: Synthetic coding sequence
atgtaccacggcatgaaccccagcaacggcgacggcttcctggagcagcagcagcagcagcagcagccccagagcccccagagactgctggccgtgatcctgtggttccagctggccctgtgcttcggccccgcccagctgaccggcggcttcgacgacctgcaggtgtgcgccgaccccggcatccccgagaacggcttcagaacccccagcggcggcgtgttcttcgagggcagcgtggccagattccactgccaggacggcttcaagctgaagggcgccaccaagagactgtgcctgaagcacttcaacggcaccctgggctggatccccagcgacaacagcatctgcgtgcaggaggactgcagaatcccccagatcgaggacgccgagatccacaacaagacctacagacacggcgagaagctgatcatcacctgccacgagggcttcaagatcagataccccgacctgcacaacatggtgagcctgtgcagagacgacggcacctggaacaacctgcccatctgccagggctgcctgagacccctggccagcagcaacggctacgtgaacatcagcgagctgcagaccagcttccccgtgggcaccgtgatcagctacagatgcttccccggcttcaagctggacggcagcgcctacctggagtgcctgcagaacctgatctggagcagcagcccccccagatgcctggccctggaggtgtgccccctgccccccatggtgagccacggcgacttcgtgtgccaccccagaccctgcgagagatacaaccacggcaccgtggtggagttctactgcgaccccggctacagcctgaccagcgactacaagtacatcacctgccagtacggcgagtggttccccagctaccaggtgtactgcatcaagagcgagcagacctggcccagcacccacgagaccctgctgaccacctggaagatcgtggccttcaccgccaccagcgtgctgctggtgctgctgctggtgatcctggccagaatgttccagaccaagttcaaggcccacttcccccccagaggcccccccagaagcagcagcagcgaccccgacttcgtggtggtggacggcgtgcccgtgatgctgcccagctacgacgaggccgtgagcggcggcctgagcgccctgggccccggctacatggccagcgtgggccagggctgccccctgcccgtggacgaccagagcccccccgcctaccccggcagcggcgacaccgacaccggccccggcgagagcgagacctgcgacagcgtgagcggcagcagcgagctgctgcagagcctgtacagcccccccagatgccaggagagcacccaccccgccagcgacaaccccgacatcatcgccagcaccgccgaggaggtggccagcaccagccccggcatcgacatcgccgacgagatccccctgatggaggaggacccctag

SEQ ID NO: 22675 - DNA, 873 bp, Artificial Sequence
  Description of Artificial Sequence: Synthetic coding sequence
atgtaccacggcatgaaccccagcaacggcgacggcttcctggagcagcagcagcagcagcagcagccccagagcccccagagactgctggccgtgatcctgtggttccagctggccctgtgcttcggccccgcccagctgaccggcggcttcgacgacctgcaggtgtgcgccgaccccggcatccccgagaacggcttcagaacccccagcggcggcgtgttcttcgagggcagcgtggccagattccactgccaggacggcttcaagctgaagggcgccaccaagagactgtgcctgaagcacttcaacggcaccctgggctggatccccagcgacaacagcatctgcgtgcaggaggactgcagaatcccccagatcgaggacgccgagatccacaacaagacctacagacacggcgagaagctgatcatcacctgccacgagggcttcaagatcagataccccgacctgcacaacatggtgagcctgtgcagagacgacggcacctggaacaacctgcccatctgccagggctgcctgagacccctggccagcagcaacggctacgtgaacatcagcgagctgcagaccagcttccccgtgggcaccgtgatcagctacagatgcttccccggcttcaagctggacggcagcgcctacctggagtgcctgcagaacctgatctggagcagcagcccccccagatgcctggccctggagggcggcagacccgagcacctgttccccgtgctgtacttcccccacatcagactggccgccgccgtgctgtacttctgccccgtgctgaagagcagccccacccccgcccccacctgcagcagcaccagcaccaccaccagcctgttctag

SEQ ID NO: 22676 - DNA, 321 bp, Artificial Sequence; identical to SEQ ID NO: 22673
  Description of Artificial Sequence: Synthetic coding sequence

SEQ ID NO: 22677 - DNA, 1473 bp, Artificial Sequence; identical to SEQ ID NO: 22674
  Description of Artificial Sequence: Synthetic coding sequence

SEQ ID NO: 22678 - DNA, 993 bp, Artificial Sequence
  Description of Artificial Sequence: Synthetic coding sequence
atggtgagcctgtgcagagacgacggcacctggaacaacctgcccatctgccagggctgcctgagacccctggccagcagcaacggctacgtgaacatcagcgagctgcagaccagcttccccgtgggcaccgtgatcagctacagatgcttccccggcttcaagctggacggcagcgcctacctggagtgcctgcagaacctgatctggagcagcagcccccccagatgcctggccctggaggtgtgccccctgccccccatggtgagccacggcgacttcgtgtgccaccccagaccctgcgagagatacaaccacggcaccgtggtggagttctactgcgaccccggctacagcctgaccagcgactacaagtacatcacctgccagtacggcgagtggttccccagctaccaggtgtactgcatcaagagcgagcagacctggcccagcacccacgagaccctgctgaccacctggaagatcgtggccttcaccgccaccagcgtgctgctggtgctgctgctggtgatcctggccagaatgttccagaccaagttcaaggcccacttcccccccagaggcccccccagaagcagcagcagcgaccccgacttcgtggtggtggacggcgtgcccgtgatgctgcccagctacgacgaggccgtgagcggcggcctgagcgccctgggccccggctacatggccagcgtgggccagggctgccccctgcccgtggacgaccagagcccccccgcctaccccggcagcggcgacaccgacaccggccccggcgagagcgagacctgcgacagcgtgagcggcagcagcgagctgctgcagagcctgtacagcccccccagatgccaggagagcacccaccccgccagcgacaaccccgacatcatcgccagcaccgccgaggaggtggccagcaccagccccggcatcgacatcgccgacgagatccccctgatggaggaggacccctag

SEQ ID NO: 22679 - DNA, 1266 bp, Artificial Sequence
  Description of Artificial Sequence: Synthetic coding sequence
atgtaccacggcatgaaccccagcaacggcgacggcttcctggagcagcagcagcagcagcagcagccccagagcccccagagactgctggccgtgatcctgtggttccagctggccctgtgcttcggccccgcccagctgaccggcgactgcagaatcccccagatcgaggacgccgagatccacaacaagacctacagacacggcgagaagctgatcatcacctgccacgagggcttcaagatcagataccccgacctgcacaacatggtgagcctgtgcagagacgacggcacctggaacaacctgcccatctgccagggctgcctgagacccctggccagcagcaacggctacgtgaacatcagcgagctgcagaccagcttccccgtgggcaccgtgatcagctacagatgcttccccggcttcaagctggacggcagcgcctacctggagtgcctgcagaacctgatctggagcagcagcccccccagatgcctggccctggaggcccaggtgtgccccctgccccccatggtgagccacggcgacttcgtgtgccaccccagaccctgcgagagatacaaccacggcaccgtggtggagttctactgcgaccccggctacagcctgaccagcgactacaagtacatcacctgccagtacggcgagtggttccccagctaccaggtgtactgcatcaagagcgagcagacctggcccagcacccacgagaccctgctgaccacctggaagatcgtggccttcaccgccaccagcgtgctgctggtgctgctgctggtgatcctggccagaatgttccagaccaagttcaaggcccacttcccccccagaggcccccccagaagcagcagcagcgaccccgacttcgtggtggtggacggcgtgcccgtgatgctgcccagctacgacgaggccgtgagcggcggcctgagcgccctgggccccggctacatggccagcgtgggccagggctgccccctgcccgtggacgaccagagcccccccgcctaccccggcagcggcgacaccgacaccggccccggcgagagcgagacctgcgacagcgtgagcggcagcagcgagctgctgcagagcctgtacagcccccccagatgccaggagagcacccaccccgccagcgacaaccccgacatcatcgccagcaccgccgaggaggtggccagcaccagccccggcatcgacatcgccgacgagatccccctgatggaggaggacccctag

SEQ ID NO: 22680 - DNA, 1890 bp, Artificial Sequence
  Description of Artificial Sequence: Synthetic coding sequence
atgaccgccgagggccccagcccccccgccagatggcacagaagactgcccggcctgtgggccgccgccctgctgctgctgggcctgcccagactgagcgtgagagccgacggcaagttcttcgtgctggagagccagaacggcagccagggcctgcagctggaggccgccagactgagctgcaagagcagaggcgcccacctggccagcgccgacgagctgagaagagtggtgcaggactgcagcttcgccgtgtgcaccaccggctggctggccgacggcaccctgggcaccaccgtgtgcagcaagggcagcggcgagcagcagatcatgagagccgtggacgtgagaatcgagagcaaccccgtgcccggcggcacctacagcgccctgtgcatcaaggacgaggagaagccctgcggcgacccccccagcttcccccacaccatcctgcagggcagaaccggcctggagatgggcgacgagctgctgtacgtgtgcgcccccggccacatcatgggccacagagagaccgccttcaccctgctgtgcaacagctgcggcgagtggtacggcctggtgcaggcctgcggcaaggacgaggccgaggcccacatcgactacgaggacaacttccccgacgacagaagcgtgagcttcagagagctgatggaggacagcagaaccgaggccgacgaggacagaggccagggcgacagcagcgaggaggcccccaagcaggacagactggtgagcatcagcgtgggcagagagaacatcgccagagacaaggtgttcgtgcccaccaccggcctgcccggcgccggcagcagcgtgcccgccgacagccccggcagcagactgctgcagaagcacctgttctggttccccgccgaggccttccacaagcccggcctggagaaggaggtggacgacgacaccaagaagcagttcagcgccggcgacaaccacagcggcgtgaagctggtgcccggcgagcccgagaccaaggtgatctacggcaacaccgacggccccagcggccccttcgtgggcaagaacgacagcaaggccggcgaccccgtggtgagcagcagcgacgagagctggctggacggctaccccgtgaccgagggcgcctggagaaagaccgaggccgaggaggaggaggacggcgacagaggcgacggcagcgtgggcctggacgagaacgtgctggtgacccccgaccagcccatcctggtggaggtgaagaagcccaagagcagcaccctgacccccagcgagggcatgacccacagcagcgtgctgcccagccagatgctggacgtggaggccctggccctgagacccgtgaacgccagcgagaccgagggcatcggcgacggcgacctgaccaagtaccagagcaccctgccctggagattcatcaccgaggagagccccatggccaccctgagctacgagctgaccagcagcaccctggagatcctgaccgtgaacaccgtgaagcagacccccaaccacatccccagcaccatcatggccaccacccagccccccgtggagaccaccgtgcccgagatccaggacagcttcccctacctgctgagcgaggacttcttcggccaggagggccccggccccggcgccagcgaggagctgcaccccaccctggagagctgcgtgggcgacggctgccccggcctgagcagaggccccgtgatcgccaccatcgtgaccgtgctgtgcctgctgctgctgctggccggcgtgggcatggtgtggggctacagaaagtgccagcacaagagcagcgtgtacaagctgaacgtgggccagagacaggccagacactaccaccagcagatcgagatggagaaggtgtag

SEQ ID NO: 22681 - DNA, 3825 bp, Artificial Sequence
  Description of Artificial Sequence: Synthetic coding sequence
atggccagcggcagcggcgacagcgtgaccagaagaagcgtggccagccagttcttcacccaggaggagggccccggcatcgacggcatgaccaccagcgagagagtggtggacctgctgaaccaggccgccctgatcaccaacgacagcaagatcaccgtgctgaagcaggtgcaggagctgatcatcaacaaggaccccaccctgctggacaacttcctggacgagatcatcgccttccaggccgacaagagcatcgaggtgagaaagttcgtgatcggcttcatcgaggaggcctgcaagagagacatcgagctgctgctgaagctgatcgccaacctgaacatgctgctgagagacgagaacgtgaacgtggtgaagaaggccatcctgaccatgacccagctgtacaaggtggccctgcagtggatggtgaagagcagagtgatcagcgagctgcaggaggcctgctgggacatggtgagcgccatggccggcgacatcatcctgctgctggacagcgacaacgacggcatcagaacccacgccatcaagttcgtggagggcctgatcgtgaccctgagccccagaatggccgacagcgagatccccagaagacaggagcacgacatcagcctggacagaatccccagagaccacccctacatccagtacaacgtgctgtgggaggagggcaaggccgccctggagcagctgctgaagttcatggtgcaccccgccatcagcagcatcaacctgaccaccgccctgggcagcctggccaacatcgccagacagagacccatgttcatgagcgaggtgatccaggcctacgagaccctgcacgccaacctgccccccaccctggccaagagccaggtgagcagcgtgagaaagaacctgaagctgcacctgctgagcgtgctgaagcaccccgccagcctggagttccaggcccagatcaccaccctgctggtggacctgggcaccccccaggccgagatcgccagaaacatgcccagcagcaaggacaccagaaagagacccagagacgacagcgacagcaccctgaagaagatgaagctggagcccaacctgggcgaggacgacgaggacaaggacctggagcccggccccagcggcaccagcaaggccagcgcccagatcagcggccagagcgacaccgacatcaccgccgagttcctgcagcccctgctgacccccgacaacgtggccaacctggtgctgatcagcatggtgtacctgcccgaggccatgcccgccagcttccaggccatctacacccccgtggagagcgccggcaccgaggcccagatcaagcacctggccagactgatggccacccagatgaccgccgccggcctgggccccggcgtggagcagaccaagcagtgcaaggaggagcccaaggaggagaaggtggtgaagaccgagagcgtgctgatcaagagaagactgagcgcccagggccaggccatcagcgtggtgggcagcctgagcagcatgagccccctggaggaggaggccccccaggccaagagaagacccgagcccatcatccccgtgacccagcccagactggccggcgccggcggcagaaagaagatcttcagactgagcgacgtgctgaagcccctgaccgacgcccaggtggaggccatgaagctgggcgccgtgaagagaatcctgagagccgagaaggccgtggcctgcagcggcgccgcccaggtgagaatcaagatcctggccagcctggtgacccagttcaacagcggcctgaaggccgaggtgctgagcttcatcctggaggacgtgagagccagactggacctggccttcgcctggctgtaccaggagtacaacgcctacctggccgccggcgccagcggcagcctggacaagtacgaggactgcctgatcagactgctgagcggcctgcaggagaagcccgaccagaaggacggcatcttcaccaaggtggtgctggaggcccccctgatcaccgagagcgccctggaggtggtgagaaagtactgcgaggacgagagcagaacctacctgggcatgagcaccctgagagacctgatcttcaagagacccagcagacagttccagtacctgcacgtgctgctggacctgagcagccacgagaaggacaaggtgagaagccaggccctgctgttcatcaagagaatgtacgagaaggagcagctgagagagtacgtggagaagttcgccctgaactacctgcagctgctggtgcaccccaacccccccagcgtgctgttcggcgccgacaaggacaccgaggtggccgccccctggaccgaggagaccgtgaagcagtgcctgtacctgtacctggccctgctgccccagaaccacaagctgatccacgagctggccgccgtgtacaccgaggccatcgccgacatcaagagaaccgtgctgagagtgatcgagcagcccatcagaggcatgggcatgaacagccccgagctgctgctgctggtggagaactgccccaagggcgccgagaccctggtgaccagatgcctgcacagcctgaccgacaaggtgccccccagccccgagctggtgaagagagtgagagacctgtaccacaagagactgcccgacgtgagattcctgatccccgtgctgaacggcctggagaagaaggaggtgatccaggccctgcccaagctgatcaagctgaaccccatcgtggtgaaggaggtgttcaacagactgctgggcacccagcacggcgagggcaacagcgccctgagccccctgaaccccggcgagctgctgatcgccctgcacaacatcgacagcgtgaagtgcgacatgaagagcatcatcaaggccaccaacctgtgcttcgccgagagaaacgtgtacaccagcgaggtgctggccgtggtgatgcagcagctgatggagcagagccccctgcccatgctgctgatgagaaccgtgatccagagcctgaccatgtaccccagactgggcggcttcgtgatgaacatcctgagcagactgatcatgaagcaggtgtggaagtaccccaaggtgtgggagggcttcatcaagtgctgccagagaaccaagccccagagcttccaggtgatcctgcagctgcccccccagcagctgggcgccgtgttcgacaagtgccccgagctgagagagcccctgctggcccacgtgagaagcttcaccccccaccagcaggcccacatccccaacagcatcatgaccatcctggaggccagcggcaagcaggagcccgaggccaaggaggcccccgccggccccctggaggaggacgacctggagcccctgaccctggcccccgcccccgcccccagacccccccaggacctgatcggcctgagactggcccaggagaaggccctgaagagacagctggaggaggagcagaagctgaagcccggcggcgtgggcgcccccagcagcagcagccccagccccagccccagcgccagacccggccccccccccagcgaggaggccatggacttcagagaggagggccccgagtgcgagacccccggcatcttcatcagcatggacgacgacagcggcctgaccgaggccgccctgctggacagcagcctggagggccccctgcccaaggagaccgccgccggcggcctgaccctgaaggaggagagaagcccccagaccctggcccccgtgggcgaggacgccatgaagacccccagccccgccgccgaggacgccagagagcccgaggccaagggcaacagctag

SEQ ID NO: 22682 - DNA, 465 bp, Artificial Sequence
  Description of Artificial Sequence: Synthetic coding sequence
ctgaccgccgccatggccagcggcagcggcgacagcgtgaccagaagaagcgtggccagccagttcttcacccaggaggagggccccggcatcgacggcatgaccaccagcgagagagtggtggacctgctgaaccaggccgccctgatcaccaacgacagcaagatcaccgtgctgaagcaggtgcaggagctgatcatcaacaaggaccccaccctgctggacaacttcctggacgagatcatcgccttccaggccgacaagagcatcgaggtgagaaagttcgtgatcggcttcatcgaggaggcctgcaagagagacatcgagctgctgctgaagctgatcgccaacctgaacatgctgctgagagacgagaacgtgaacgtggtgaagaaggccatcctgaccatgacccagctgcccgtgcccgtgcccgcctgcccccccagaccccagctgccctag

SEQ ID NO: 22683 - DNA, 3900 bp, Artificial Sequence
  Description of Artificial Sequence: Synthetic coding sequence
atgagcagaagcagagccagcatccacagaggcagcatccccgccatgagctacgcccccttcagagacgtgagaggccccagcatgcacagaacccagtacgtgcacagcccctacgacagacccggctggaaccccagattctgcatcatcagcggcaaccagctgctgatgctggacgaggacgagatccaccccctgctgatcagagacagaagaagcgagagcagcagaaacaagctgctgagaagaaccgtgagcgtgcccgtggagggcagaccccacggcgagcacgagtaccacctgggcagaagcagaagaaagagcgtgcccggcggcaagcagtacagcatggagggcgcccccgccgcccccttcagacccagccagggcttcctgagcagaagactgaagagcagcatcaagagaaccaagagccagcccaagctggacagaaccagcagcttcagacagatcctgcccagattcagaagcgccgaccacgacagagccagactgatgcagagcttcaaggagagccacagccacgagagcctgctgagccccagcagcgccgccgaggccctggagctgaacctggacgaggacagcatcatcaagcccgtgcacagcagcatcctgggccaggagttctgcttcgaggtgaccaccagcagcggcaccaagtgcttcgcctgcagaagcgccgccgagagagacaagtggatcgagaacctgcagagagccgtgaagcccaacaaggacaacagcagaagagtggacaacgtgctgaagctgtggatcatcgaggccagagagctgccccccaagaagagatactactgcgagctgtgcctggacgacatgctgtacgccagaaccaccagcaagcccagaagcgccagcggcgacaccgtgttctggggcgagcacttcgagttcaacaacctgcccgccgtgagagccctgagactgcacctgtacagagacagcgacaagaagagaaagaaggacaaggccggctacgtgggcctggtgaccgtgcccgtggccaccctggccggcagacacttcaccgagcagtggtaccccgtgaccctgcccaccggcagcggcggcagcggcggcatgggcagcggcggcggcggcggcagcggcggcggcagcggcggcaagggcaagggcggctgccccgccgtgagactgaaggccagataccagaccatgagcatcctgcccatggagctgtacaaggagttcgccgagtacgtgaccaaccactacagaatgctgtgcgccgtgctggagcccgccctgaacgtgaagggcaaggaggaggtggccagcgccctggtgcacatcctgcagagcaccggcaaggccaaggacttcctgagcgacatggccatgagcgaggtggacagattcatggagagagagcacctgatcttcagagagaacaccctggccaccaaggccatcgaggagtacatgagactgatcggccagaagtacctgaaggacgccatcggcgagttcatcagagccctgtacgagagcgaggagaactgcgaggtggaccccatcaagtgcaccgccagcagcctggccgagcaccaggccaacctgagaatgtgctgcgagctggccctgtgcaaggtggtgaacagccactgcgtgttccccagagagctgaaggaggtgttcgccagctggagactgagatgcgccgagagaggcagagaggacatcgccgacagactgatcagcgccagcctgttcctgagattcctgtgccccgccatcatgagccccagcctgttcggcctgatgcaggagtaccccgacgagcagaccagcagaaccctgaccctgatcgccaaggtgatccagaacctggccaacttcagcaagttcaccagcaaggaggacttcctgggcttcatgaacgagttcctggagctggagtggggcagcatgcagcagttcctgtacgagatcagcaacctggacaccctgaccaacagcagcagcttcgagggctacatcgacctgggcagagagctgagcaccctgcacgccctgctgtgggaggtgctgccccagctgagcaaggaggccctgctgaagctgggccccctgcccagactgctgaacgacatcagcaccgccctgagaaaccccaacatccagagacagcccagcagacagagcgagagacccagaccccagcccgtggtgctgagaggccccagcgccgagatgcagggctacatgatgagagacctgaacagcagcatcgacctgcagagcttcatggccagaggcctgaacagcagcatggacatggccagactgcccagccccaccaaggagaagccccccccccccccccccggcggcggcaaggacctgttctacgtgagcagaccccccctggccagaagcagccccgcctactgcaccagcagcagcgacatcaccgagcccgagcagaagatgctgagcgtgaacaagagcgtgagcatgctggacctgcagggcgacggccccggcggcagactgaacagcagcagcgtgagcaacctggccgccgtgggcgacctgctgcacagcagccaggccagcctgaccgccgccctgggcctgagacccgcccccgccggcagactgagccagggcagcggcagcagcatcaccgccgccggcatgagactgagccagatgggcgtgaccaccgacggcgtgcccgcccagcagctgagaatccccctgagcttccagaaccccctgttccacatggccgccgacggccccggcccccccggcggccacggcggcggcggcggccacggcccccccagcagccaccaccaccaccaccaccaccaccaccacagaggcggcgagccccccggcgacaccttcgcccccttccacggctacagcaagagcgaggacctgagcagcggcgtgcccaagccccccgccgccagcatcctgcacagccacagctacagcgacgagttcggccccagcggcaccgacttcaccagaagacagctgagcctgcaggacaacctgcagcacatgctgagccccccccagatcaccatcggcccccagagacccgcccccagcggccccggcggcggcagcggcggcggcagcggcggcggcggcggcggccagcccccccccctgcagagaggcaagagccagcagctgaccgtgagcgccgcccagaagcccagacccagcagcggcaacctgctgcagagccccgagcccagctacggccccgccagacccagacagcagagcctgagcaaggagggcagcatcggcggcagcggcggcagcggcggcggcggcggcggcggcctgaagcccagcatcaccaagcagcacagccagacccccagcaccctgaaccccaccatgcccgccagcgagagaaccgtggcctgggtgagcaacatgccccacctgagcgccgacatcgagagcgcccacatcgagagagaggagtacaagctgaaggagtacagcaagagcatggacgagagcagactggacagagtgaaggagtacgaggaggagatccacagcctgaaggagagactgcacatgagcaacagaaagctggaggagtacgagagaagactgctgagccaggaggagcagaccagcaagatcctgatgcagtaccaggccagactggagcagagcgagaagagactgagacagcagcaggccgagaaggacagccagatcaagagcatcatcggcagactgatgctggtggaggaggagctgagaagagaccaccccgccatggccgagcccctgcccgagcccaagaagagactgctggacgcccagctgctgatcagatag

SEQ ID NO: 22684 - DNA, 1464 bp, Artificial Sequence
  Description of Artificial Sequence: Synthetic coding sequence
gaggacttcctgggcttcatgaacgagttcctggagctggagtggggcagcatgcagcagttcctgtacgagatcagcaacctggacaccctgaccaacagcagcagcttcgagggctacatcgacctgggcagagagctgagcaccctgcacgccctgctgtgggaggtgctgccccagctgagcaaggaggccctgctgaagctgggccccctgcccagactgctgaacgacatcagcaccgccctgagaaaccccaacatccagagacagcccagcagacagagcgagagacccagaccccagcccgtggtgctgagaggccccagcgccgagatgcagggctacatgatgagagacctgaacagcagcatggacatggccagactgcccagccccaccaaggagaagccccccccccccccccccggcggcggcaaggacctgttctacgtgagcagaccccccctggccagaagcagccccgcctactgcaccagcagcagcgacatcaccgagcccgagcagaagatgctgagcgtgaacaagagcgtgagcatgctggacctgcagggcgacggccccggcggcagactgaacagcagcagcgtgagcaacctggccgccgtgggcgacctgctgcacagcagccaggccagcctgaccgccgccctgggcctgagacccgcccccgccggcagactgagccagggcagcggcagcagcatcaccgccgccggcatgagactgagccagatgggcgtgaccaccgacggcgtgcccgcccagcagctgagaatccccctgagcttccagaaccccctgttccacatggccgccgacggccccggcccccccggcggccacggcggcggcggcggccacggcccccccagcagccaccaccaccaccaccaccaccaccaccacagaggcggcgagccccccggcgacaccttcgcccccttccacggctacagcaagagcgaggacctgagcagcggcgtgcccaagccccccgccgccagcatcctgcacagccacagctacagcgacgagttcggccccagcggcaccgacttcaccagaagacagctgagcctgcaggacaacctgcagcacatgctgagccccccccagatcaccatcggcccccagagacccgcccccagcggccccggcggcggcagcggcggcggcagcggcggcggcggcggcggccagcccccccccctgcagagaggcaagagccagcagctgaccgtgagcgccgcccagaagcccagacccagcagcggcaacctgctgcagagccccgagcccagctacggccccgccagacccagacagcagagcctgagcaaggagggcagcatcggcggcagcggcggcagcggcggcggcggcggcggcggcctgaagcccagcatcaccaagcagcacagccagacccccagcacctag

SEQ ID NO: 22685 - DNA, 3900 bp, Artificial Sequence; identical to SEQ ID NO: 22683
  Description of Artificial Sequence: Synthetic coding sequence

SEQ ID NO: 22686 - DNA, 3855 bp, Artificial Sequence
  Description of Artificial Sequence: Synthetic coding sequence
atgggcctgagaccccccacccccagccccagcggcggcagctgcagcggcagcctgcccccccccagcagatgccagcccctgagaagaagatgcagcagctgctgcttccccggcgagtaccacctgggcagaagcagaagaaagagcgtgcccggcggcaagcagtacagcatggagggcgcccccgccgcccccttcagacccagccagggcttcctgagcagaagactgaagagcagcatcaagagaaccaagagccagcccaagctggacagaaccagcagcttcagacagatcctgcccagattcagaagcgccgaccacgacagagccagactgatgcagagcttcaaggagagccacagccacgagagcctgctgagccccagcagcgccgccgaggccctggagctgaacctggacgaggacagcatcatcaagcccgtgcacagcagcatcctgggccaggagttctgcttcgaggtgaccaccagcagcggcaccaagtgcttcgcctgcagaagcgccgccgagagagacaagtggatcgagaacctgcagagagccgtgaagcccaacaaggacaacagcagaagagtggacaacgtgctgaagctgtggatcatcgaggccagagagctgccccccaagaagagatactactgcgagctgtgcctggacgacatgctgtacgccagaaccaccagcaagcccagaagcgccagcggcgacaccgtgttctggggcgagcacttcgagttcaacaacctgcccgccgtgagagccctgagactgcacctgtacagagacagcgacaagaagagaaagaaggacaaggccggctacgtgggcctggtgaccgtgcccgtggccaccctggccggcagacacttcaccgagcagtggtaccccgtgaccctgcccaccggcagcggcggcagcggcggcatgggcagcggcggcggcggcggcagcggcggcggcagcggcggcaagggcaagggcggctgccccgccgtgagactgaaggccagataccagaccatgagcatcctgcccatggagctgtacaaggagttcgccgagtacgtgaccaaccactacagaatgctgtgcgccgtgctggagcccgccctgaacgtgaagggcaaggaggaggtggccagcgccctggtgcacatcctgcagagcaccggcaaggccaaggacttcctgagcgacatggccatgagcgaggtggacagattcatggagagagagcacctgatcttcagagagaacaccctggccaccaaggccatcgaggagtacatgagactgatcggccagaagtacctgaaggacgccatcggcgagttcatcagagccctgtacgagagcgaggagaactgcgaggtggaccccatcaagtgcaccgccagcagcctggccgagcaccaggccaacctgagaatgtgctgcgagctggccctgtgcaaggtggtgaacagccactgcgtgttccccagagagctgaaggaggtgttcgccagctggagactgagatgcgccgagagaggcagagaggacatcgccgacagactgatcagcgccagcctgttcctgagattcctgtgccccgccatcatgagccccagcctgttcggcctgatgcaggagtaccccgacgagcagaccagcagaaccctgaccctgatcgccaaggtgatccagaacctggccaacttcagcaagttcaccagcaaggaggacttcctgggcttcatgaacgagttcctggagctggagtggggcagcatgcagcagttcctgtacgagatcagcaacctggacaccctgaccaacagcagcagcttcgagggctacatcgacctgggcagagagctgagcaccctgcacgccctgctgtgggaggtgctgccccagctgagcaaggaggccctgctgaagctgggccccctgcccagactgctgaacgacatcagcaccgccctgagaaaccccaacatccagagacagcccagcagacagagcgagagacccagaccccagcccgtggtgctgagaggccccagcgccgagatgcagggctacatgatgagagacctgaacagcagcatcgacctgcagagcttcatggccagaggcctgaacagcagcatggacatggccagactgcccagccccaccaaggagaagccccccccccccccccccggcggcggcaaggacctgttctacgtgagcagaccccccctggccagaagcagccccgcctactgcaccagcagcagcgacatcaccgagcccgagcagaagatgctgagcgtgaacaagagcgtgagcatgctggacctgcagggcgacggccccggcggcagactgaacagcagcagcgtgagcaacctggccgccgtgggcgacctgctgcacagcagccaggccagcctgaccgccgccctgggcctgagacccgcccccgccggcagactgagccagggcagcggcagcagcatcaccgccgccggcatgagactgagccagatgggcgtgaccaccgacggcgtgcccgcccagcagctgagaatccccctgagcttccagaaccccctgttccacatggccgccgacggccccggcccccccggcggccacggcggcggcggcggccacggcccccccagcagccaccaccaccaccaccaccaccaccaccacagaggcggcgagccccccggcgacaccttcgcccccttccacggctacagcaagagcgaggacctgagcagcggcgtgcccaagccccccgccgccagcatcctgcacagccacagctacagcgacgagttcggccccagcggcaccgacttcaccagaagacagctgagcctgcaggacaacctgcagcacatgctgagccccccccagatcaccatcggcccccagagacccgcccccagcggccccggcggcggcagcggcggcggcagcggcggcggcggcggcggccagcccccccccctgcagagaggcaagagccagcagctgaccgtgagcgccgcccagaagcccagacccagcagcggcaacctgctgcagagccccgagcccagctacggccccgccagacccagacagcagagcctgagcaaggagggcagcatcggcggcagcggcggcagcggcggcggcggcggcggcggcctgaagcccagcatcaccaagcagcacagccagacccccagcaccctgaaccccaccatgcccgccagcgagagaaccgtggcctgggtgagcaacatgccccacctgagcgccgacatcgagagcgcccacatcgagagagaggagtacaagctgaaggagtacagcaagagcatggacgagagcagactggacagagtgaaggagtacgaggaggagatccacagcctgaaggagagactgcacatgagcaacagaaagctggaggagtacgagagaagactgctgagccaggaggagcagaccagcaagatcctgatgcagtaccaggccagactggagcagagcgagaagagactgagacagcagcaggccgagaaggacagccagatcaagagcatcatcggcagactgatgctggtggaggaggagctgagaagagaccaccccgccatggccgagcccctgcccgagcccaagaagagactgctggacgcccaggagagacagctgccccccctgggccccaccaaccccagagtgaccctggcccccccctggaacggcctggccccccccgcccccccccccccccccagactgcagatcaccgagaacggcgagttcagaaacaccgccgaccactag

SEQ ID NO: 22687 - DNA, 4032 bp, Artificial Sequence
  Description of Artificial Sequence: Synthetic coding sequence
atgagcagaagcagagccagcatccacagaggcagcatccccgccatgagctacgcccccttcagagacgtgagaggccccagcatgcacagaacccagtacgtgcacagcccctacgacagacccggctggaaccccagattctgcatcatcagcggcaaccagctgctgatgctggacgaggacgagatccaccccctgctgatcagagacagaagaagcgagagcagcagaaacaagctgctgagaagaaccgtgagcgtgcccgtggagggcagaccccacggcgagcacgagtaccacctgggcagaagcagaagaaagagcgtgcccggcggcaagcagtacagcatggagggcgcccccgccgcccccttcagacccagccagggcttcctgagcagaagactgaagagcagcatcaagagaaccaagagccagcccaagctggacagaaccagcagcttcagacagatcctgcccagattcagaagcgccgaccacgacagagccagactgatgcagagcttcaaggagagccacagccacgagagcctgctgagccccagcagcgccgccgaggccctggagctgaacctggacgaggacagcatcatcaagcccgtgcacagcagcatcctgggccaggagttctgcttcgaggtgaccaccagcagcggcaccaagtgcttcgcctgcagaagcgccgccgagagagacaagtggatcgagaacctgcagagagccgtgaagcccaacaaggacaacagcagaagagtggacaacgtgctgaagctgtggatcatcgaggccagagagctgccccccaagaagagatactactgcgagctgtgcctggacgacatgctgtacgccagaaccaccagcaagcccagaagcgccagcggcgacaccgtgttctggggcgagcacttcgagttcaacaacctgcccgccgtgagagccctgagactgcacctgtacagagacagcgacaagaagagaaagaaggacaaggccggctacgtgggcctggtgaccgtgcccgtggccaccctggccggcagacacttcaccgagcagtggtaccccgtgaccctgcccaccggcagcggcggcagcggcggcatgggcagcggcggcggcggcggcagcggcggcggcagcggcggcaagggcaagggcggctgccccgccgtgagactgaaggccagataccagaccatgagcatcctgcccatggagctgtacaaggagttcgccgagtacgtgaccaaccactacagaatgctgtgcgccgtgctggagcccgccctgaacgtgaagggcaaggaggaggtggccagcgccctggtgcacatcctgcagagcaccggcaaggccaaggacttcctgagcgacatggccatgagcgaggtggacagattcatggagagagagcacctgatcttcagagagaacaccctggccaccaaggccatcgaggagtacatgagactgatcggccagaagtacctgaaggacgccatcggcgagttcatcagagccctgtacgagagcgaggagaactgcgaggtggaccccatcaagtgcaccgccagcagcctggccgagcaccaggccaacctgagaatgtgctgcgagctggccctgtgcaaggtggtgaacagccactgcgtgttccccagagagctgaaggaggtgttcgccagctggagactgagatgcgccgagagaggcagagaggacatcgccgacagactgatcagcgccagcctgttcctgagattcctgtgccccgccatcatgagccccagcctgttcggcctgatgcaggagtaccccgacgagcagaccagcagaaccctgaccctgatcgccaaggtgatccagaacctggccaacttcagcaagttcaccagcaaggaggacttcctgggcttcatgaacgagttcctggagctggagtggggcagcatgcagcagttcctgtacgagatcagcaacctggacaccctgaccaacagcagcagcttcgagggctacatcgacctgggcagagagctgagcaccctgcacgccctgctgtgggaggtgctgccccagctgagcaaggaggccctgctgaagctgggccccctgcccagactgctgaacgacatcagcaccgccctgagaaaccccaacatccagagacagcccagcagacagagcgagagacccagaccccagcccgtggtgctgagaggccccagcgccgagatgcagggctacatgatgagagacctgaacagcagcatcgacctgcagagcttcatggccagaggcctgaacagcagcatggacatggccagactgcccagccccaccaaggagaagccccccccccccccccccggcggcggcaaggacctgttctacgtgagcagaccccccctggccagaagcagccccgcctactgcaccagcagcagcgacatcaccgagcccgagcagaagatgctgagcgtgaacaagagcgtgagcatgctggacctgcagggcgacggccccggcggcagactgaacagcagcagcgtgagcaacctggccgccgtgggcgacctgctgcacagcagccaggccagcctgaccgccgccctgggcctgagacccgcccccgccggcagactgagccagggcagcggcagcagcatcaccgccgccggcatgagactgagccagatgggcgtgaccaccgacggcgtgcccgcccagcagctgagaatccccctgagcttccagaaccccctgttccacatggccgccgacggccccggcccccccggcggccacggcggcggcggcggccacggcccccccagcagccaccaccaccaccaccaccaccaccaccacagaggcggcgagccccccggcgacaccttcgcccccttccacggctacagcaagagcgaggacctgagcagcggcgtgcccaagccccccgccgccagcatcctgcacagccacagctacagcgacgagttcggccccagcggcaccgacttcaccagaagacagctgagcctgcaggacaacctgcagcacatgctgagccccccccagatcaccatcggcccccagagacccgcccccagcggccccggcggcggcagcggcggcggcagcggcggcggcggcggcggccagcccccccccctgcagagaggcaagagccagcagctgaccgtgagcgccgcccagaagcccagacccagcagcggcaacctgctgcagagccccgagcccagctacggccccgccagacccagacagcagagcctgagcaaggagggcagcatcggcggcagcggcggcagcggcggcggcggcggcggcggcctgaagcccagcatcaccaagcagcacagccagacccccagcaccctgaaccccaccatgcccgccagcgagagaaccgtggcctgggtgagcaacatgccccacctgagcgccgacatcgagagcgcccacatcgagagagaggagtacaagctgaaggagtacagcaagagcatggacgagagcagactggacagagtgaaggagtacgaggaggagatccacagcctgaaggagagactgcacatgagcaacagaaagctggaggagtacgagagaagactgctgagccaggaggagcagaccagcaagatcctgatgcagtaccaggccagactggagcagagcgagaagagactgagacagcagcaggccgagaaggacagccagatcaagagcatcatcggcagactgatgctggtggaggaggagctgagaagagaccaccccgccatggccgagcccctgcccgagcccaagaagagactgctggacgcccaggagagacagctgccccccctgggccccaccaaccccagagtgaccctggcccccccctggaacggcctggccccccccgcccccccccccccccccagactgcagatcaccgagaacggcgagttcagaaacaccgccgaccactag

SEQ ID NO: 22688 - DNA, 3879 bp, Artificial Sequence
  Description of Artificial Sequence: Synthetic coding sequence
atgagcagaagcagagccagcatccacagaggcagcatccccgccatgagctacgcccccttcagagacgtgagaggccccagcatgcacagaacccagtacgtgcacagcccctacgacagacccggctggaaccccagattctgcatcatcagcggcaaccagctgctgatgctggacgaggacgagatccaccccctgctgatcagagacagaagaagcgagagcagcagaaacaagctgctgagaagaaccgtgagcgtgcccgtggagggcagaccccacggcgagcacgagtaccacctgggcagaagcagaagaaagagcgtgcccggcggcaagcagtacagcatggagggcgcccccgccgcccccttcagacccagccagggcttcctgagcagaagactgaagagcagcatcaagagaaccaagagccagcccaagctggacagaaccagcagcttcagacagatcctgcccagattcagaagcgccgaccacgacagagccagactgatgcagagcttcaaggagagccacagccacgagagcctgctgagccccagcagcgccgccgaggccctggagctgaacctggacgaggacagcatcatcaagcccgtgcacagcagcatcctgggccaggagttctgcttcgaggtgaccaccagcagcggcaccaagtgcttcgcctgcagaagcgccgccgagagagacaagtggatcgagaacctgcagagagccgtgaagcccaacaaggacaacagcagaagagtggacaacgtgctgaagctgtggatcatcgaggccagagagctgccccccaagaagagatactactgcgagctgtgcctggacgacatgctgtacgccagaaccaccagcaagcccagaagcgccagcggcgacaccgtgttctggggcgagcacttcgagttcaacaacctgcccgccgtgagagccctgagactgcacctgtacagagacagcgacaagaagagaaagaaggacaaggccggctacgtgggcctggtgaccgtgcccgtggccaccctggccggcagacacttcaccgagcagtggtaccccgtgaccctgcccaccggcagcggcggcagcggcggcatgggcagcggcggcggcggcggcagcggcggcggcagcggcggcaagggcaagggcggctgccccgccgtgagactgaaggccagataccagaccatgagcatcctgcccatggagctgtacaaggagttcgccgagtacgtgaccaaccactacagaatgctgtgcgccgtgctggagcccgccctgaacgtgaagggcaaggaggaggtggccagcgccctggtgcacatcctgcagagcaccggcaaggccaaggacttcctgagcgacatggccatgagcgaggtggacagattcatggagagagagcacctgatcttcagagagaacaccctggccaccaaggccatcgaggagtacatgagactgatcggccagaagtacctgaaggacgccatcggcgagttcatcagagccctgtacgagagcgaggagaactgcgaggtggaccccatcaagtgcaccgccagcagcctggccgagcaccaggccaacctgagaatgtgctgcgagctggccctgtgcaaggtggtgaacagccactgcgtgttccccagagagctgaaggaggtgttcgccagctggagactgagatgcgccgagagaggcagagaggacatcgccgacagactgatcagcgccagcctgttcctgagattcctgtgccccgccatcatgagccccagcctgttcggcctgatgcaggagtaccccgacgagcagaccagcagaaccctgaccctgatcgccaaggtgatccagaacctggccaacttcagcaagttcaccagcaaggaggacttcctgggcttcatgaacgagttcctggagctggagtggggcagcatgcagcagttcctgtacgagatcagcaacctggacaccctgaccaacagcagcagcttcgagggctacatcgacctgggcagagagctgagcaccctgcacgccctgctgtgggaggtgctgccccagctgagcaaggaggccctgctgaagctgggccccctgcccagactgctgaacgacatcagcaccgccctgagaaaccccaacatccagagacagcccagcagacagagcgagagacccagaccccagcccgtggtgctgagaggccccagcgccgagatgcagggctacatgatgagagacctgaacagcagcatggacatggccagactgcccagccccaccaaggagaagccccccccccccccccccggcggcggcaaggacctgttctacgtgagcagaccccccctggccagaagcagccccgcctactgcaccagcagcagcgacatcaccgagcccgagcagaagatgctgagcgtgaacaagagcgtgagcatgctggacctgcagggcgacggccccggcggcagactgaacagcagcagcgtgagcaacctggccgccgtgggcgacctgctgcacagcagccaggccagcctgaccgccgccctgggcctgagacccgcccccgccggcagactgagccagggcagcggcagcagcatcaccgccgccggcatgagactgagccagatgggcgtgaccaccgacggcgtgcccgcccagcagctgagaatccccctgagcttccagaaccccctgttccacatggccgccgacggccccggcccccccggcggccacggcggcggcggcggccacggcccccccagcagccaccaccaccaccaccaccaccaccaccacagaggcggcgagccccccggcgacaccttcgcccccttccacggctacagcaagagcgaggacctgagcagcggcgtgcccaagccccccgccgccagcatcctgcacagccacagctacagcgacgagttcggccccagcggcaccgacttcaccagaagacagctgagcctgcaggacaacctgcagcacatgctgagccccccccagatcaccatcggcccccagagacccgcccccagcggccccggcggcggcagcggcggcggcagcggcggcggcggcggcggccagcccccccccctgcagagaggcaagagccagcagctgaccgtgagcgccgcccagaagcccagacccagcagcggcaacctgctgcagagccccgagcccagctacggccccgccagacccagacagcagagcctgagcaaggagggcagcatcggcggcagcggcggcagcggcggcggcggcggcggcggcctgaagcccagcatcaccaagcagcacagccagacccccagcaccctgaaccccaccatgcccgccagcgagagaaccgtggcctgggtgagcaacatgccccacctgagcgccgacatcgagagcgcccacatcgagagagaggagtacaagctgaaggagtacagcaagagcatggacgagagcagactggacagagagtacgaggaggagatccacagcctgaaggagagactgcacatgagcaacagaaagctggaggagtacgagagaagactgctgagccaggaggagcagaccagcaagatcctgatgcagtaccaggccagactggagcagagcgagaagagactgagacagcagcaggccgagaaggacagccagatcaagagcatcatcggcagactgatgctggtggaggaggagctgagaagagaccaccccgccatggccgagcccctgcccgagcccaagaagagactgctggacgcccagagaggcagcttccccccctgggtgcagcagaccagagtgtag

SEQ ID NO: 22689 - DNA, 4032 bp, Artificial Sequence; identical to SEQ ID NO: 22687
  Description of Artificial Sequence: Synthetic coding sequence

SEQ ID NO: 22690 - DNA, 3900 bp, Artificial Sequence; identical to SEQ ID NO: 22683
  Description of Artificial Sequence: Synthetic coding sequence

SEQ ID NO: 22691 - DNA, 2049 bp, Artificial Sequence
  Description of Artificial Sequence: Synthetic coding sequence
atggaggagggcttcagagacagagccgccttcatcagaggcgccaaggacatcgccaaggaggtgaagaagcacgccgccaagaaggtggtgaagggcctggacagagtgcaggacgagtacagcagaagaagctacagcagattcgaggaggaggacgacgacgacgacttccccgcccccagcgacggctactacagaggcgagggcacccaggacgaggaggagggcggcgccagcagcgacgccaccgagggccacgacgaggacgacgagatctacgagggcgagtaccagggcatccccagagccgagagcggcggcaagggcgagagaatggccgacggcgcccccctggccggcgtgagaggcggcctgagcgacggcgagggcccccccggcggcagaggcgaggcccagagaagaaaggagagagaggagctggcccagcagtacgaggccatcctgagagagtgcggccacggcagattccagtggaccctgtacttcgtgctgggcctggccctgatggccgacggcgtggaggtgttcgtggtgggcttcgtgctgcccagcgccgagaaggacatgtgcctgagcgacagcaacaagggcatgctgggcctgatcgtgtacctgggcatgatggtgggcgccttcctgtggggcggcctggccgacagactgggcagaagacagtgcctgctgatcagcctgagcgtgaacagcgtgttcgccttcttcagcagcttcgtgcagggctacggcaccttcctgttctgcagactgctgagcggcgtgggcatcggcggcagcatccccatcgtgttcagctacttcagcgagttcctggcccaggagaagagaggcgagcacctgagctggctgtgcatgttctggatgatcggcggcgtgtacgccgccgccatggcctgggccatcatcccccactacggctggagcttccagatgggcagcgcctaccagttccacagctggagagtgttcgtgctggtgtgcgccttccccagcgtgttcgccatcggcgccctgaccacccagcccgagagccccagattcttcctggagaacggcaagcacgacgaggcctggatggtgctgaagcaggtgcacgacaccaacatgagagccaagggccaccccgagagagtgttcagcgtgacccacatcaagaccatccaccaggaggacgagctgatcgagatccagagcgacaccggcacctggtaccagagatggggcgtgagagccctgagcctgggcggccaggtgtggggcaacttcctgagctgcttcggccccgagtacagaagaatcaccctgatgatgatgggcgtgtggttcaccatgagcttcagctactacggcctgaccgtgtggttccccgacatgatcagacacctgcaggccgtggactacgccagcagaaccaaggtgttccccggcgagagagtggagcacgtgaccttcaacttcaccctggagaaccagatccacagaggcggccagtacttcaacgacaagttcatcggcctgagactgaagagcgtgagcttcgaggacagcctgttcgaggagtgctacttcgaggacgtgaccagcagcaacaccttcttcagaaactgcaccttcatcaacaccgtgttctacaacaccgacctgttcgagtacaagttcgtgaacagcagactgatcaacagcaccttcctgcacaacaaggagggctgccccctggacgtgaccggcaccggcgagggcgcctacatggtgtacttcgtgagcttcctgggcaccctggccgtgctgcccggcaacatcgtgagcgccctgctgatggacaagatcggcagactgagaatgctggccggcagcagcgtgatgagctgcgtgagctgcttcttcctgagcttcggcaacagcgagagcgccatgatcgccctgctgtgcctgttcggcggcgtgagcatcgccagctggaacgccctggacgtgctgaccgtggagctgtaccccagcgacaagagatag

SEQ ID NO: 22692 - DNA, 2229 bp, Artificial Sequence
  Description of Artificial Sequence: Synthetic coding sequence
atggaggagggcttcagagacagagccgccttcatcagaggcgccaaggacatcgccaaggaggtgaagaagcacgccgccaagaaggtggtgaagggcctggacagagtgcaggacgagtacagcagaagaagctacagcagattcgaggaggaggacgacgacgacgacttccccgcccccagcgacggctactacagaggcgagggcacccaggacgaggaggagggcggcgccagcagcgacgccaccgagggccacgacgaggacgacgagatctacgagggcgagtaccagggcatccccagagccgagagcggcggcaagggcgagagaatggccgacggcgcccccctggccggcgtgagaggcggcctgagcgacggcgagggcccccccggcggcagaggcgaggcccagagaagaaaggagagagaggagctggcccagcagtacgaggccatcctgagagagtgcggccacggcagattccagtggaccctgtacttcgtgctgggcctggccctgatggccgacggcgtggaggtgttcgtggtgggcttcgtgctgcccagcgccgagaaggacatgtgcctgagcgacagcaacaagggcatgctgggcctgatcgtgtacctgggcatgatggtgggcgccttcctgtggggcggcctggccgacagactgggcagaagacagtgcctgctgatcagcctgagcgtgaacagcgtgttcgccttcttcagcagcttcgtgcagggctacggcaccttcctgttctgcagactgctgagcggcgtgggcatcggcggcagcatccccatcgtgttcagctacttcagcgagttcctggcccaggagaagagaggcgagcacctgagctggctgtgcatgttctggatgatcggcggcgtgtacgccgccgccatggcctgggccatcatcccccactacggctggagcttccagatgggcagcgcctaccagttccacagctggagagtgttcgtgctggtgtgcgccttccccagcgtgttcgccatcggcgccctgaccacccagcccgagagccccagattcttcctggagaacggcaagcacgacgaggcctggatggtgctgaagcaggtgcacgacaccaacatgagagccaagggccaccccgagagagtgttcagcgtgacccacatcaagaccatccaccaggaggacgagctgatcgagatccagagcgacaccggcacctggtaccagagatggggcgtgagagccctgagcctgggcggccaggtgtggggcaacttcctgagctgcttcggccccgagtacagaagaatcaccctgatgatgatgggcgtgtggttcaccatgagcttcagctactacggcctgaccgtgtggttccccgacatgatcagacacctgcaggccgtggactacgccagcagaaccaaggtgttccccggcgagagagtggagcacgtgaccttcaacttcaccctggagaaccagatccacagaggcggccagtacttcaacgacaagttcatcggcctgagactgaagagcgtgagcttcgaggacagcctgttcgaggagtgctacttcgaggacgtgaccagcagcaacaccttcttcagaaactgcaccttcatcaacaccgtgttctacaacaccgacctgttcgagtacaagttcgtgaacagcagactgatcaacagcaccttcctgcacaacaaggagggctgccccctggacgtgaccggcaccggcgagggcgcctacatggtgtacttcgtgagcttcctgggcaccctggccgtgctgcccggcaacatcgtgagcgccctgctgatggacaagatcggcagactgagaatgctggccggcagcagcgtgatgagctgcgtgagctgcttcttcctgagcttcggcaacagcgagagcgccatgatcgccctgctgtgcctgttcggcggcgtgagcatcgccagctggaacgccctggacgtgctgaccgtggagctgtaccccagcgacaagagaaccaccgccttcggcttcctgaacgccctgtgcaagctggccgccgtgctgggcatcagcatcttcaccagcttcgtgggcatcaccaaggccgcccccatcctgttcgccagcgccgccctggccctgggcagcagcctggccctgaagctgcccgagaccagaggccaggtgctgcagtag

SEQ ID NO: 22693 - DNA, 2052 bp, Artificial Sequence
  Description of Artificial Sequence: Synthetic coding sequence
atggacgactacaagtaccaggacaactacggcggctacgcccccagcgacggctactacagaggcaacgagagcaaccccgaggaggacgcccagagcgacgtgaccgagggccacgacgaggaggacgagatctacgagggcgagtaccagggcatcccccaccccgacgacgtgaaggccaagcaggccaagatggcccccagcagaatggacagcctgagaggccagaccgacctgatggccgagagactggaggacgaggagcagctggcccaccagtacgagaccatcatggacgagtgcggccacggcagattccagtggatcctgttcttcgtgctgggcctggccctgatggccgacggcgtggaggtgttcgtggtgagcttcgccctgcccagcgccgagaaggacatgtgcctgagcagcagcaagaagggcatgctgggcatgatcgtgtacctgggcatgatggccggcgccttcatcctgggcggcctggccgacaagctgggcagaaagagagtgctgagcatgagcctggccgtgaacgccagcttcgccagcctgagcagcttcgtgcagggctacggcgccttcctgttctgcagactgatcagcggcatcggcatcggcggcgccctgcccatcgtgttcgcctacttcagcgagttcctgagcagagagaagagaggcgagcacctgagctggctgggcatcttctggatgaccggcggcctgtacgccagcgccatggcctggagcatcatcccccactacggctggggcttcagcatgggcaccaactaccacttccacagctggagagtgttcgtgatcgtgtgcgccctgccctgcaccgtgagcatggtggccctgaagttcatgcccgagagccccagattcctgctggagatgggcaagcacgacgaggcctggatgatcctgaagcaggtgcacgacaccaacatgagagccaagggcacccccgagaaggtgttcaccgtgagcaacatcaagacccccaagcagatggacgagttcatcgagatccagagcagcaccggcacctggtaccagagatggctggtgagattcaagaccatcttcaagcaggtgtgggacaacgccctgtactgcgtgatgggcccctacagaatgaacaccctgatcctggccgtggtgtggttcgccatggccttcagctactacggcctgaccgtgtggttccccgacatgatcagatacttccaggacgaggagtacaagagcaagatgaaggtgttcttcggcgagcacgtgtacggcgccaccatcaacttcaccatggagaaccagatccaccagcacggcaagctggtgaacgacaagttcaccagaatgtacttcaagcacgtgctgttcgaggacaccttcttcgacgagtgctacttcgaggacgtgaccagcaccgacacctacttcaagaactgcaccatcgagagcaccatcttctacaacaccgacctgtacgagcacaagttcatcaactgcagattcatcaacagcaccttcctggagcagaaggagggctgccacatggacctggagcaggacaacgacttcctgatctacctggtgagcttcctgggcagcctgagcgtgctgcccggcaacatcatcagcgccctgctgatggacagaatcggcagactgaagatgatcggcggcagcatgctgatcagcgccgtgtgctgcttcttcctgttcttcggcaacagcgagagcgccatgatcggctggcagtgcctgttctgcggcaccagcatcgccgcctggaacgccctggacgtgatcaccgtggagctgtaccccaccaaccagagagccaccgccttcggcatcctgaacggcctgtgcaagttcggcgccatcctgggcaacaccatcttcgccagcttcgtgggcatcaccaaggtggtgcccatcctgctggccgccgccagcctggtgggcggcggcctgatcgccctgagactgcccgagaccagagagcaggtgctgatgtag

SEQ ID NO: 22694 - DNA, 2052 bp, Artificial Sequence; identical to SEQ ID NO: 22693
  Description of Artificial Sequence: Synthetic coding sequence

SEQ ID NO: 22695 - DNA, 1599 bp, Artificial Sequence
  Description of Artificial Sequence: Synthetic coding sequence
atgatcgtgtacctgggcatgatggccggcgccttcatcctgggcggcctggccgacaagctgggcagaaagagagtgctgagcatgagcctggccgtgaacgccagcttcgccagcctgagcagcttcgtgcagggctacggcgccttcctgttctgcagactgatcagcggcatcggcatcggcggcgccctgcccatcgtgttcgcctacttcagcgagttcctgagcagagagaagagaggcgagcacctgagctggctgggcatcttctggatgaccggcggcctgtacgccagcgccatggcctggagcatcatcccccactacggctggggcttcagcatgggcaccaactaccacttccacagctggagagtgttcgtgatcgtgtgcgccctgccctgcaccgtgagcatggtggccctgaagttcatgcccgagagccccagattcctgctggagatgggcaagcacgacgaggcctggatgatcctgaagcaggtgcacgacaccaacatgagagccaagggcacccccgagaaggtgttcaccgtgagcaacatcaagacccccaagcagatggacgagttcatcgagatccagagcagcaccggcacctggtaccagagatggctggtgagattcaagaccatcttcaagcaggtgtgggacaacgccctgtactgcgtgatgggcccctacagaatgaacaccctgatcctggccgtggtgtggttcgccatggccttcagctactacggcctgaccgtgtggttccccgacatgatcagatacttccaggacgaggagtacaagagcaagatgaaggtgttcttcggcgagcacgtgtacggcgccaccatcaacttcaccatggagaaccagatccaccagcacggcaagctggtgaacgacaagttcaccagaatgtacttcaagcacgtgctgttcgaggacaccttcttcgacgagtgctacttcgaggacgtgaccagcaccgacacctacttcaagaactgcaccatcgagagcaccatcttctacaacaccgacctgtacgagcacaagttcatcaactgcagattcatcaacagcaccttcctggagcagaaggagggctgccacatggacctggagcaggacaacgacttcctgatctacctggtgagcttcctgggcagcctgagcgtgctgcccggcaacatcatcagcgccctgctgatggacagaatcggcagactgaagatgatcggcggcagcatgctgatcagcgccgtgtgctgcttcttcctgttcttcggcaacagcgagagcgccatgatcggctggcagtgcctgttctgcggcaccagcatcgccgcctggaacgccctggacgtgatcaccgtggagctgtaccccaccaaccagagagccaccgccttcggcatcctgaacggcctgtgcaagttcggcgccatcctgggcaacaccatcttcgccagcttcgtgggcatcaccaaggtggtgcccatcctgctggccgccgccagcctggtgggcggcggcctgatcgccctgagactgcccgagaccagagagcaggtgctgatgtag

SEQ ID NO: 22696 - DNA, 2052 bp, Artificial Sequence; identical to SEQ ID NO: 22693
  Description of Artificial Sequence: Synthetic coding sequence

SEQ ID NO: 22697 - DNA, 2031 bp, Artificial Sequence
  Description of Artificial Sequence: Synthetic coding sequence
atggaggacagctacaaggacagaaccagcctgatgaagggcgccaaggacatcgccagagaggtgaagaagcagaccgtgaagaaggtgaaccaggccgtggacagagcccaggacgagtacacccagagaagctacagcagattccaggacgaggaggacgacgacgactactaccccgccggcgagacctacaacggcgaggccaacgacgacgagggcagcagcgaggccaccgagggccacgacgaggacgacgagatctacgagggcgagtaccagggcatccccagcatgaaccaggccaaggacagcatcgtgagcgtgggccagcccaagggcgacgagtacaaggacagaagagagctggagagcgagagaagagccgacgaggaggagctggcccagcagtacgagctgatcatccaggagtgcggccacggcagattccagtgggccctgttcttcgtgctgggcatggccctgatggccgacggcgtggaggtgttcgtggtgggcttcgtgctgcccagcgccgagaccgacctgtgcatccccaacagcggcagcggctggctgggcagcatcgtgtacctgggcatgatggtgggcgccttcttctggggcggcctggccgacaaggtgggcagaaagcagagcctgctgatctgcatgagcgtgaacggcttcttcgccttcctgagcagcttcgtgcagggctacggcttcttcctgttctgcagactgctgagcggcttcggcatcggcggcgccatccccaccgtgttcagctacttcgccgaggtgctggccagagagaagagaggcgagcacctgagctggctgtgcatgttctggatgatcggcggcatctacgccagcgccatggcctgggccatcatcccccactacggctggagcttcagcatgggcagcgcctaccagttccacagctggagagtgttcgtgatcgtgtgcgccctgccctgcgtgagcagcgtggtggccctgaccttcatgcccgagagccccagattcctgctggaggtgggcaagcacgacgaggcctggatgatcctgaagctgatccacgacaccaacatgagagccagaggccagcccgagaaggtgttcaccgtgaacaagatcaagacccccaagcagatcgacgagctgatcgagatcgagagcgacaccggcacctggtacagaagatgcttcgtgagaatcagaaccgagctgtacggcatctggctgaccttcatgagatgcttcaactaccccgtgagagacaacaccatcaagctgaccatcgtgtggttcaccctgagcttcggctactacggcctgagcgtgtggttccccgacgtgatcaagcccctgcagagcgacgagtacgccctgctgaccagaaacgtggagagagacaagtacgccaacttcaccatcaacttcaccatggagaaccagatccacaccggcatggagtacgacaacggcagattcatcggcgtgaagttcaagagcgtgaccttcaaggacagcgtgttcaagagctgcaccttcgaggacgtgaccagcgtgaacacctacttcaagaactgcaccttcatcgacaccgtgttcgacaacaccgacttcgagccctacaagttcatcgacagcgagttcaagaactgcagcttcttccacaacaagaccggctgccagatcaccttcgacgacgactacagcgcctactggatctacttcgtgaacttcctgggcaccctggccgtgctgcccggcaacatcgtgagcgccctgctgatggacagaatcggcagactgaccatgctgggcggcagcatggtgctgagcggcatcagctgcttcttcctgtggttcggcaccagcgagagcatgatgatcggcatgctgtgcctgtacaacggcctgaccatcagcgcctggaacagcctggacgtggtgaccgtggagctgtaccccaccgacagaagaagaagagtgctgccctgctgccccggctag

SEQ ID NO: 22698 - DNA, 2184 bp, Artificial Sequence
  Description of Artificial Sequence: Synthetic coding sequence
atggaggacagctacaaggacagaaccagcctgatgaagggcgccaaggacatcgccagagaggtgaagaagcagaccgtgaagaaggtgaaccaggccgtggacagagcccaggacgagtacacccagagaagctacagcagattccaggacgaggaggacgacgacgactactaccccgccggcgagacctacaacggcgaggccaacgacgacgagggcagcagcgaggccaccgagggccacgacgaggacgacgagatctacgagggcgagtaccagggcatccccagcatgaaccaggccaaggacagcatcgtgagcgtgggccagcccaagggcgacgagtacaaggacagaagagagctggagagcgagagaagagccgacgaggaggagctggcccagcagtacgagctgatcatccaggagtgcggccacggcagattccagtgggccctgttcttcgtgctgggcatggccctgatggccgacggcgtggaggtgttcgtggtgggcttcgtgctgcccagcgccgagaccgacctgtgcatccccaacagcggcagcggctggctgggcagcatcgtgtacctgggcatgatggtgggcgccttcttctggggcggcctggccgacaaggtgggcagaaagcagagcctgctgatctgcatgagcgtgaacggcttcttcgccttcctgagcagcttcgtgcagggctacggcttcttcctgttctgcagactgctgagcggcttcggcatcggcggcgccatccccaccgtgttcagctacttcgccgaggtgctggccagagagaagagaggcgagcacctgagctggctgtgcatgttctggatgatcggcggcatctacgccagcgccatggcctgggccatcatcccccactacggctggagcttcagcatgggcagcgcctaccagttccacagctggagagtgttcgtgatcgtgtgcgccctgccctgcgtgagcagcgtggtggccctgaccttcatgcccgagagccccagattcctgctggaggtgggcaagcacgacgaggcctggatgatcctgaagctgatccacgacaccaacatgagagccagaggccagcccgagaaggtgttcaccgtgaacaagatcaagacccccaagcagatcgacgagctgatcgagatcgagagcgacaccggcacctggtacagaagatgcttcgtgagaatcagaaccgagctgtacggcatctggctgaccttcatgagatgcttcaactaccccgtgagagacaacaccatcaagctgaccatcgtgtggttcaccctgagcttcggctactacggcctgagcgtgtggttccccgacgtgatcaagcccctgcagagcgacgagtacgccctgctgaccagaaacgtggagagagacaagtacgccaacttcaccatcaacttcaccatggagaaccagatccacaccggcatggagtacgacaacggcagattcatcggcgtgaagttcaagagcgtgaccttcaaggacagcgtgttcaagagctgcaccttcgaggacgtgaccagcgtgaacacctacttcaagaactgcaccttcatcgacaccgtgttcgacaacaccgacttcgagccctacaagttcatcgacagcgagttcaagaactgcagcttcttccacaacaagaccggctgccagatcaccttcgacgacgactacagcgcctactggatctacttcgtgaacttcctgggcaccctggccgtgctgcccggcaacatcgtgagcgccctgctgatggacagaatcggcagactgaccatgctgggcggcagcatggtgctgagcggcatcagctgcttcttcctgtggttcggcaccagcgagagcatgatgatcggcatgctgtgcctgtacaacggcctgaccatcagcgcctggaacagcctggacgtggtgaccgtggagctgtaccccaccgacagaagagccaccggcttcggcttcctgaacgccctgtgcaaggccgccgccgtgctgggcaacctgatcttcggcagcctggtgagcatcaccaagagcatccccatcctgctggccagcaccgtgctggtgtgcggcggcctggtgggcctgtgcctgcccgacaccagaacccaggtgctgatgtag

SEQ ID NO: 22699 - DNA, 780 bp, Artificial Sequence
  Description of Artificial Sequence: Synthetic coding sequence
atggcccccaacatctacctggtgagacagagaatcagcagactgggccagagaatgagcggcttccagatcaacctgaaccccctgaaggagcccctgggcttcatcaaggtgctggagtggatcgccagcatcttcgccttcgccacctgcggcggcttcaagggccagaccgagatccaggtgaactgcccccccgccgtgaccgagaacaagaccgtgaccgccaccttcggctaccccttcagactgaacgaggccagcttccagcccccccccggcgtgaacatctgcgacgtgaactggaaggactacgtgctgatcggcgactacagcagcagcgcccagttctacgtgaccttcgccgtgttcgtgttcctgtactgcatcgccgccctgctgctgtacgtgggctacaccagcctgtacctggacagcagaaagctgcccatgatcgacttcgtggtgaccctggtggccaccttcctgtggctggtgagcaccagcgcctgggccaaggccctgaccgacatcaagatcgccaccggccacaacatcatcgacgagctgcccccctgcaagaagaaggccgtgctgtgctacttcggcagcgtgaccagcatgggcagcctgaacgtgagcgtgatcttcggcttcctgaacatgatcctgtggggcggcaacgcctggttcgtgtacaaggagaccagcctgcacagccccagcaacaccagcgccccccacagccagggcggcatccccccccccaccggcatctag

SEQ ID NO: 22700 - DNA, 726 bp, Artificial Sequence
  Description of Artificial Sequence: Synthetic coding sequence
atgagcggcttccagatcaacctgaaccccctgaaggagcccctgggcttcatcaaggtgctggagtggatcgccagcatcttcgccttcgccacctgcggcggcttcaagggccagaccgagatccaggtgaactgcccccccgccgtgaccgagaacaagaccgtgaccgccaccttcggctaccccttcagactgaacgaggccagcttccagcccccccccggcgtgaacatctgcgacgtgaactggaaggactacgtgctgatcggcgactacagcagcagcgcccagttctacgtgaccttcgccgtgttcgtgttcctgtactgcatcgccgccctgctgctgtacgtgggctacaccagcctgtacctggacagcagaaagctgcccatgatcgacttcgtggtgaccctggtggccaccttcctgtggctggtgagcaccagcgcctgggccaaggccctgaccgacatcaagatcgccaccggccacaacatcatcgacgagctgcccccctgcaagaagaaggccgtgctgtgctacttcggcagcgtgaccagcatgggcagcctgaacgtgagcgtgatcttcggcttcctgaacatgatcctgtggggcggcaacgcctggttcgtgtacaaggagaccagcctgcacagccccagcaacaccagcgccccccacagccagggcggcatccccccccccaccggcatctag

SEQ ID NO: 22701 - DNA, 819 bp, Artificial Sequence
  Description of Artificial Sequence: Synthetic coding sequence
atgagcagcaccgagagcgccggcagaaccgccgacaagagccccagacagcaggtggacagactgctggtgggcctgagatggagaagactggaggagcccctgggcttcatcaaggtgctgcagtggctgttcgccatcttcgccttcggcagctgcggcagctacagcggcgagaccggcgccatggtgagatgcaacaacgaggccaaggacgtgagcagcatcatcgtggccttcggctaccccttcagactgcacagaatccagtacgagatgcccctgtgcgacgaggagagcagcagcaagaccatgcacctgatgggcgacttcagcgcccccgccgagttcttcgtgaccctgggcatcttcagcttcttctacaccatggccgccctggtgatctacctgagattccacaacctgtacaccgagaacaagagattccccctggtggacttctgcgtgaccgtgagcttcaccttcttctggctggtggccgccgccgcctggggcaagggcctgaccgacgtgaagggcgccaccagacccagcagcctgaccgccgccatgagcgtgtgccacggcgaggaggccgtgtgcagcgccggcgccacccccagcatgggcctggccaacatcagcgtgctgttcggcttcatcaacttcttcctgtgggccggcaactgctggttcgtgttcaaggagaccccctggcacggccagggccagggccaggaccaggaccaggaccaggaccagggccagggccccagccaggagagcgccgccgagcagggcgccgtggagaagcagtag

SEQ ID NO: 22702 - DNA, 627 bp, Artificial Sequence
  Description of Artificial Sequence: Synthetic coding sequence
atgagcagcaccgagagcgccggcagaaccgccgacaagagccccagacagcaggtggacagactgctggtgggcctgagatggagaagactggaggagcccctgggcttcatcaaggtgctgcagtggctgttcgccatcttcgccttcggcagctgcggcagctacagcggcgagaccggcgccatggtgagatgcaacaacgaggccaaggacgtgagcagcatcatcgtggccttcggctaccccttcagactgcacagaatccagtacgagatgcccctgtgcgacgaggagagcagcagcaagaccatgcacctgatgggcgacttcagcgcccccgccgagttcttcgtgaccctgggcatcttcagcttcttctacaccatggccgccctggtgatctacctgagattccacaacctgtacaccgagaacaagagattccccctggtgctgttcggcttcatcaacttcttcctgtgggccggcaactgctggttcgtgttcaaggagaccccctggcacggccagggccagggccaggaccaggaccaggaccaggaccagggccagggccccagccaggagagcgccgccgagcagggcgccgtggagaagcagtag

SEQ ID NO: 22703 - DNA, 798 bp, Artificial Sequence
  Description of Artificial Sequence: Synthetic coding sequence
atgtgcatggtgatcttcgcccccctgttcgccatcttcgccttcgccacctgcggcggctacagcggcggcctgagactgagcgtggactgcgtgaacaagaccgagagcaacctgagcatcgacatcgccttcgcctaccccttcagactgcaccaggtgaccttcgaggtgcccacctgcgagggcaaggagagacagaagctggccctgatcggcgacagcagcagcagcgccgagttcttcgtgaccgtggccgtgttcgccttcctgtacagcctggccgccaccgtggtgtacatcttcttccagaacaagtacagagagaacaacagaggccccctgatcgacttcatcgtgaccgtggtgttcagcttcctgtggctggtgggcagcagcgcctgggccaagggcctgagcgacgtgaaggtggccaccgaccccaaggaggtgctgctgctgatgagcgcctgcaagcagcccagcaacaagtgcatggccatccacagccccgtgatgagcagcctgaacaccagcgtggtgttcggcttcctgaacttcatcctgtgggccggcaacatctggttcgtgttcaaggagaccggctggcacagcagcggccagagatacctgagcgaccccatggagaagcacagcagcagctacaaccagggcggctacaaccaggacagctacggcagcagcagcggctacagccagcaggccagcctgggccccaccagcgacgagttcggccagcagcccaccggccccaccagcttcaccaaccagatctag

SEQ ID NO: 22704 - DNA, 831 bp, Artificial Sequence
  Description of Artificial Sequence: Synthetic coding sequence
atgtgcatggtgatcttcgccccccacaacgaggagtgcaagagccacttccacctgctgttcgccatcttcgccttcgccacctgcggcggctacagcggcggcctgagactgagcgtggactgcgtgaacaagaccgagagcaacctgagcatcgacatcgccttcgcctaccccttcagactgcaccaggtgaccttcgaggtgcccacctgcgagggcaaggagagacagaagctggccctgatcggcgacagcagcagcagcgccgagttcttcgtgaccgtggccgtgttcgccttcctgtacagcctggccgccaccgtggtgtacatcttcttccagaacaagtacagagagaacaacagaggccccctgatcgacttcatcgtgaccgtggtgttcagcttcctgtggctggtgggcagcagcgcctgggccaagggcctgagcgacgtgaaggtggccaccgaccccaaggaggtgctgctgctgatgagcgcctgcaagcagcccagcaacaagtgcatggccatccacagccccgtgatgagcagcctgaacaccagcgtggtgttcggcttcctgaacttcatcctgtgggccggcaacatctggttcgtgttcaaggagaccggctggcacagcagcggccagagatacctgagcgaccccatggagaagcacagcagcagctacaaccagggcggctacaaccaggacagctacggcagcagcagcggctacagccagcaggccagcctgggccccaccagcgacgagttcggccagcagcccaccggccccaccagcttcaccaaccagatctag

SEQ ID NO: 22705 - DNA, 858 bp, Artificial Sequence
  Description of Artificial Sequence: Synthetic coding sequence
atggaccccgtgagccagctggccagcgccggcaccttcagagtgctgaaggagcccctggccttcctgagagccctggagctgctgttcgccatcttcgccttcgccacctgcggcggctacagcggcggcctgagactgagcgtggactgcgtgaacaagaccgagagcaacctgagcatcgacatcgccttcgcctaccccttcagactgcaccaggtgaccttcgaggtgcccacctgcgagggcaaggagagacagaagctggccctgatcggcgacagcagcagcagcgccgagttcttcgtgaccgtggccgtgttcgccttcctgtacagcctggccgccaccgtggtgtacatcttcttccagaacaagtacagagagaacaacagaggccccctgatcgacttcatcgtgaccgtggtgttcagcttcctgtggctggtgggcagcagcgcctgggccaagggcctgagcgacgtgaaggtggccaccgaccccaaggaggtgctgctgctgatgagcgcctgcaagcagcccagcaacaagtgcatggccatccacagccccgtgatgagcagcctgaacaccagcgtggtgttcggcttcctgaacttcatcctgtgggccggcaacatctggttcgtgttcaaggagaccggctggcacagcagcggccagagatacctgagcgaccccatggagaagcacagcagcagctacaaccagggcggctacaaccaggacagctacggcagcagcagcggctacagccagcaggccagcctgggccccaccagcgacgagttcggccagcagcccaccggccccaccagcttcaccaaccagatctag

SEQ ID NO: 22706 - DNA, 177 bp, Artificial Sequence
  Description of Artificial Sequence: Synthetic coding sequence
atgagcggccagaccctgaccgacagaatcgccgccgcccagtacagcgtgaccggcagcgccgtggccagagccgtgtgcaaggccaccacccacgaggtgatgggccccaagaagaagcacctggactacctgcagaccttcttccagcaggtgctgcccaacttcgagatctag

SEQ ID NO: 22707 - DNA, 2634 bp, Artificial Sequence
  Description of Artificial Sequence: Synthetic coding sequence
atgagcggccagaccctgaccgacagaatcgccgccgcccagtacagcgtgaccggcagcgccgtggccagagccgtgtgcaaggccaccacccacgaggtgatgggccccaagaagaagcacctggactacctgatccaggccaccaacgagaccaacgtgaacatcccccagatggccgacaccctgttcgagagagccaccaacagcagctgggtggtggtgttcaaggccctggtgaccacccaccacctgatggtgcacggcaacgagagattcatccagtacctggccagcagaaacaccctgttcaacctgagcaacttcctggacaagagcggcagccacggctacgacatgagcaccttcatcagaagatacagcagatacctgaacgagaaggccttcagctacagacagatggccttcgacttcgccagagtgaagaagggcgccgacggcgtgatgagaaccatggcccccgagaagctgctgaagagcatgcccatcctgcagggccagatcgacgccctgctggagttcgacgtgcaccccaacgagctgaccaacggcgtgatcaacgccgccttcatgctgctgttcaaggacctgatcaagctgttcgcctgctacaacgacggcgtgatcaacctgctggagaagttcttcgagatgaagaagggccagtgcaaggacgccctggagatctacaagagattcctgaccagaatgaccagagtgagcgagttcctgaaggtggccgagcaggtgggcatcgacaagggcgacatccccgacctgacccaggcccccagcagcctgatggagaccctggagcagcacctgaacaccctggagggcaagaagcccggcaacaagagcggcgcccccagccccctgagcaagagcagccccgccaccaccgtgaccagccccaacagcacccccgccaagaccatcgacaccagcccccccgtggacctgttcgccaccgccagcgccgccgtgcccgtgagcaccagcaagcccagcagcgacctgctggacctgcagcccgacttcagcagcggcggcgccgccgccgccgccgcccccgccccccccccccccgccggcggcgccaccgcctggggcgacctgctgggcgaggacagcctggccgccctgagcagcgtgcccagcgaggcccagatcagcgaccccttcgcccccgagcccaccccccccaccaccaccgccgagatcgccaccgccagcgccagcgccagcaccaccaccaccgtgaccgccgtgaccgccgaggtggacctgttcggcgacgccttcgccgccagccccggcgaggcccccgccgccagcgagggcgccgccgcccccgccacccccacccccgtggccgccgccctggacgcctgcagcggcaacgaccccttcgcccccagcgagggcagcgccgaggccgcccccgagctggacctgttcgccatgaagccccccgagaccagcgtgcccgtggtgacccccaccgccagcaccgccccccccgtgcccgccaccgcccccagccccgcccccgccgtggccgccgccgccgccgccaccaccgccgccaccgccgccgccaccaccaccaccaccaccagcgccgccaccgccaccaccgccccccccgccctggacatcttcggcgacctgttcgagagcacccccgaggtggccgccgcccccaagcccgacgccgcccccagcatcgacctgttcagcaccgacgccttcagcagccccccccagggcgccagccccgtgcccgagagcagcctgaccgccgacctgctgagcgacgccttcggcagcagcgccagcgagccccagcccgccagccaggccgccagcagcagcagcgccagcgccgacctgctggccggcttcggcggcagcttcatggcccccagccccagccccgtgacccccgcccagaacaacctgctgcagcccaacttcgaggccgccttcggcaccacccccagcaccagcagcagcagcagcttcgaccccagcgtgttcgacggcctgggcgacctgctgatgcccaccatggcccccgccggccagcccgcccccgtgagcatggtgccccccagccccgccatggccgccagcaaggccctgggcagcgacctggacagcagcctggccagcctggtgggcaacctgggcatcagcggcaccaccaccaagaagggcgacctgcagtggaacgccggcgagaagaagctgaccggcggcgccaactggcagcccaaggtggcccccgccacctggagcgccggcgtgccccccagcgcccccctgcagggcgccgtgccccccaccagcagcgtgccccccgtggccggcgcccccagcgtgggccagcccggcgccggcttcggcatgccccccgccggcaccggcatgcccatgatgccccagcagcccgtgatgttcgcccagcccatgatgagaccccccttcggcgccgccgccgtgcccggcacccagctgagccccagccccacccccgccagccagagccccaagaagccccccgccaaggaccccctggccgacctgaacatcaaggacttcctgtag

SEQ ID NO: 22708 - DNA, 2709 bp, Artificial Sequence
  Description of Artificial Sequence: Synthetic coding sequence
atgagcggccagaccctgaccgacagaatcgccgccgcccagtacagcgtgaccggcagcgccgtggccagagccgtgtgcaaggccaccacccacgaggtgatgggccccaagaagaagcacctggactacctgatccaggccaccaacgagaccaacgtgaacatcccccagatggccgacaccctgttcgagagagccaccaacagcagctgggtggtggtgttcaaggccctggtgaccacccaccacctgatggtgcacggcaacgagagattcatccagtacctggccagcagaaacaccctgttcaacctgagcaacttcctggacaagagcggcagccacggctacgacatgagcaccttcatcagaagatacagcagatacctgaacgagaaggccttcagctacagacagatggccttcgacttcgccagagtgaagaagggcgccgacggcgtgatgagaaccatggcccccgagaagctgctgaagagcatgcccatcctgcagggccagatcgacgccctgctggagttcgacgtgcaccccaacgagctgaccaacggcgtgatcaacgccgccttcatgctgctgttcaaggacctgatcaagctgttcgcctgctacaacgacggcgtgatcaacctgctggagaagttcttcgagatgaagaagggccagtgcaaggacgccctggagatctacaagagattcctgaccagaatgaccagagtgagcgagttcctgaaggtggccgagcaggtgggcatcgacaagggcgacatccccgacctgacccaggcccccagcagcctgatggagaccctggagcagcacctgaacaccctggagggcaagaagcccggcaacaacgagggcagcggcgcccccagccccctgagcaagagcagccccgccaccaccgtgaccagccccaacagcacccccgccaagaccatcgacaccagcccccccgtggacctgttcgccaccgccagcgccgccgtgcccgtgagcaccagcaagcccagcagcgacctgctggacctgcagcccgacttcagcagcggcggcgccgccgccgccgccgcccccgccccccccccccccgccggcggcgccaccgcctggggcgacctgctgggcgaggacagcctggccgccctgagcagcgtgcccagcgaggcccagatcagcgaccccttcgcccccgagcccaccccccccaccaccaccgccgagatcgccaccgccagcgccagcgccagcaccaccaccaccgtgaccgccgtgaccgccgaggtggacctgttcggcgacgccttcgccgccagccccggcgaggcccccgccgccagcgagggcgccgccgcccccgccacccccacccccgtggccgccgccctggacgcctgcagcggcaacgaccccttcgcccccagcgagggcagcgccgaggccgcccccgagctggacctgttcgccatgaagccccccgagaccagcgtgcccgtggtgacccccaccgccagcaccgccccccccgtgcccgccaccgcccccagccccgcccccgccgtggccgccgccgccgccgccaccaccgccgccaccgccgccgccaccaccaccaccaccaccagcgccgccaccgccaccaccgccccccccgccctggacatcttcggcgacctgttcgagagcacccccgaggtggccgccgcccccaagcccgacgccgcccccagcatcgacctgttcagcaccgacgccttcagcagccccccccagggcgccagccccgtgcccgagagcagcctgaccgccgacctgctgagcgtggacgccttcgccgcccccagccccgccaccaccgccagccccgccaaggtggacagcagcggcgtgatcgacctgttcggcgacgccttcggcagcagcgccagcgagccccagcccgccagccaggccgccagcagcagcagcgccagcgccgacctgctggccggcttcggcggcagcttcatggcccccagccccagccccgtgacccccgcccagaacaacctgctgcagcccaacttcgaggccgccttcggcaccacccccagcaccagcagcagcagcagcttcgaccccagcggcgacctgctgatgcccaccatggcccccgccggccagcccgcccccgtgagcatggtgccccccagccccgccatggccgccagcaaggccctgggcagcgacctggacagcagcctggccagcctggtgggcaacctgggcatcagcggcaccaccaccaagaagggcgacctgcagtggaacgccggcgagaagaagctgaccggcggcgccaactggcagcccaaggtggcccccgccacctggagcgccggcgtgccccccagcgcccccctgcagggcgccgtgccccccaccagcagcgtgccccccgtggccggcgcccccagcgtgggccagcccggcgccggcttcggcatgccccccgccggcaccggcatgcccatgatgccccagcagcccgtgatgttcgcccagcccatgatgagaccccccttcggcgccgccgccgtgcccggcacccagctgagccccagccccacccccgccagccagagccccaagaagccccccgccaaggaccccctggccgacctgaacatcaaggacttcctgtag

SEQ ID NO: 22709 - DNA, 450 bp, Artificial Sequence
  Description of Artificial Sequence: Synthetic coding sequence
atgagcggccagaccctgaccgacagaatcgccgccgcccagtacagcgtgaccggcagcgccgtggccagagccgtgtgcaaggccaccacccacgaggtgatgggccccaagaagaagcacctggactacctgatccaggccaccaacgagaccaacgtgaacatcccccagatggccgacaccctgttcgagagagccaccaacagcagctgggtggtggtgttcaaggccctggtgaccacccaccacctgatggtgcacggcaacgagagattcatccagtacctggccagcagaaacaccctgttcaacctgagcaacttcctggacaagagcggcagccacggctacgacatgagcaccttcatcagaagatacagcagatacctgaacgagaaggccttcagctacagacagatggccttcgacttcgccagagtgaagtag

SEQ ID NO: 22710 - DNA, 2724 bp, Artificial Sequence
  Description of Artificial Sequence: Synthetic coding sequence
atgagcggccagaccctgaccgacagaatcgccgccgcccagtacagcgtgaccggcagcgccgtggccagagccgtgtgcaaggccaccacccacgaggtgatgggccccaagaagaagcacctggactacctgatccaggccaccaacgagaccaacgtgaacatcccccagatggccgacaccctgttcgagagagccaccaacagcagctgggtggtggtgttcaaggccctggtgaccacccaccacctgatggtgcacggcaacgagagattcatccagtacctggccagcagaaacaccctgttcaacctgagcaacttcctggacaagagcggcagccacggctacgacatgagcaccttcatcagaagatacagcagatacctgaacgagaaggccttcagctacagacagatggccttcgacttcgccagagtgaagaagggcgccgacggcgtgatgagaaccatggcccccgagaagctgctgaagagcatgcccatcctgcagggccagatcgacgccctgctggagttcgacgtgcaccccaacgagctgaccaacggcgtgatcaacgccgccttcatgctgctgttcaaggacctgatcaagctgttcgcctgctacaacgacggcgtgatcaacctgctggagaagttcttcgagatgaagaagggccagtgcaaggacgccctggagatctacaagagattcctgaccagaatgaccagagtgagcgagttcctgaaggtggccgagcaggtgggcatcgacaagggcgacatccccgacctgacccaggcccccagcagcctgatggagaccctggagcagcacctgaacaccctggagggcaagaagcccggcaacaacgagggcagcggcgcccccagccccctgagcaagagcagccccgccaccaccgtgaccagccccaacagcacccccgccaagaccatcgacaccagcccccccgtggacctgttcgccaccgccagcgccgccgtgcccgtgagcaccagcaagcccagcagcgacctgctggacctgcagcccgacttcagcagcggcggcgccgccgccgccgccgcccccgccccccccccccccgccggcggcgccaccgcctggggcgacctgctgggcgaggacagcctggccgccctgagcagcgtgcccagcgaggcccagatcagcgaccccttcgcccccgagcccaccccccccaccaccaccgccgagatcgccaccgccagcgccagcgccagcaccaccaccaccgtgaccgccgtgaccgccgaggtggacctgttcggcgacgccttcgccgccagccccggcgaggcccccgccgccagcgagggcgccgccgcccccgccacccccacccccgtggccgccgccctggacgcctgcagcggcaacgaccccttcgcccccagcgagggcagcgccgaggccgcccccgagctggacctgttcgccatgaagccccccgagaccagcgtgcccgtggtgacccccaccgccagcaccgccccccccgtgcccgccaccgcccccagccccgcccccgccgtggccgccgccgccgccgccaccaccgccgccaccgccgccgccaccaccaccaccaccaccagcgccgccaccgccaccaccgccccccccgccctggacatcttcggcgacctgttcgagagcacccccgaggtggccgccgcccccaagcccgacgccgcccccagcatcgacctgttcagcaccgacgccttcagcagccccccccagggcgccagccccgtgcccgagagcagcctgaccgccgacctgctgagcgtggacgccttcgccgcccccagccccgccaccaccgccagccccgccaaggtggacagcagcggcgtgatcgacctgttcggcgacgccttcggcagcagcgccagcgagccccagcccgccagccaggccgccagcagcagcagcgccagcgccgacctgctggccggcttcggcggcagcttcatggcccccagccccagccccgtgacccccgcccagaacaacctgctgcagcccaacttcgaggccgccttcggcaccacccccagcaccagcagcagcagcagcttcgaccccagcgtgttcgacggcctgggcgacctgctgatgcccaccatggcccccgccggccagcccgcccccgtgagcatggtgccccccagccccgccatggccgccagcaaggccctgggcagcgacctggacagcagcctggccagcctggtgggcaacctgggcatcagcggcaccaccaccaagaagggcgacctgcagtggaacgccggcgagaagaagctgaccggcggcgccaactggcagcccaaggtggcccccgccacctggagcgccggcgtgccccccagcgcccccctgcagggcgccgtgccccccaccagcagcgtgccccccgtggccggcgcccccagcgtgggccagcccggcgccggcttcggcatgccccccgccggcaccggcatgcccatgatgccccagcagcccgtgatgttcgcccagcccatgatgagaccccccttcggcgccgccgccgtgcccggcacccagctgagccccagccccacccccgccagccagagccccaagaagccccccgccaaggaccccctggccgacctgaacatcaaggacttcctgtag

SEQ ID NO: 22711 - DNA, 2724 bp, Artificial Sequence
  Description of Artificial Sequence: Synthetic coding sequence
atgagcggccagaccctgaccgacagaatcgccgccgcccagtacagcgtgaccggcagcgccgtggccagagccgtgtgcaaggccaccacccacgaggtgatgggccccaagaagaagcacctggactacctgatccaggccaccaacgagaccaacgtgaacatcccccagatggccgacaccctgttcgagagagccaccaacagcagctgggtggtggtgttcaaggccctggtgaccacccaccacctgatggtgcacggcaacgagagattcatccagtacctggccagcagaaacaccctgttcaacctgagcaacttcctggacaagagcggcagccacggctacgacatgagcaccttcatcagaagatacagcagatacctgaacgagaaggccttcagctacagacagatggccttcgacttcgccagagtgaagaagggcgccgacggcgtgatgagaaccatggcccccgagaagctgctgaagagcatgcccatcctgcagggccagatcgacgccctgctggagttcgacgtgcaccccaacgagctgaccaacggcgtgatcaacgccgccttcatgctgctgttcaaggacctgatcaagctgttcgcctgctacaacgacggcgtgatcaacctgctggagaagttcttcgagatgaagaagggccagtgcaaggacgccctggagatctacaagagattcctgaccagaatgaccagagtgagcgagttcctgaaggtggccgagcaggtgggcatcgacaagggcgacatccccgacctgacccaggcccccagcagcctgatggagaccctggagcagcacctgaacaccctggagggcaagaagcccggcaacaacaagatcagcggcgcccccagccccctgagcaagagcagccccgccaccaccgtgaccagccccaacagcacccccgccaagaccatcgacaccagcccccccgtggacctgttcgccaccgccagcgccgccgtgcccgtgagcaccagcaagcccagcagcgacctgctggacctgcagcccgacttcagcagcggcggcgccgccgccgccgccgcccccgccccccccccccccgccggcggcgccaccgcctggggcgacctgctgggcgaggacagcctggccgccctgagcagcgtgcccagcgaggcccagatcagcgaccccttcgcccccgagcccaccccccccaccaccaccgccgagatcgccaccgccagcgccagcgccagcaccaccaccaccgtgaccgccgtgaccgccgaggtggacctgttcggcgacgccttcgccgccagccccggcgaggcccccgccgccagcgagggcgccgccgcccccgccacccccacccccgtggccgccgccctggacgcctgcagcggcaacgaccccttcgcccccagcgagggcagcgccgaggccgcccccgagctggacctgttcgccatgaagccccccgagaccagcgtgcccgtggtgacccccaccgccagcaccgccccccccgtgcccgccaccgcccccagccccgcccccgccgtggccgccgccgccgccgccaccaccgccgccaccgccgccgccaccaccaccaccaccaccagcgccgccaccgccaccaccgccccccccgccctggacatcttcggcgacctgttcgagagcacccccgaggtggccgccgcccccaagcccgacgccgcccccagcatcgacctgttcagcaccgacgccttcagcagccccccccagggcgccagccccgtgcccgagagcagcctgaccgccgacctgctgagcgtggacgccttcgccgcccccagccccgccaccaccgccagccccgccaaggtggacagcagcggcgtgatcgacctgttcggcgacgccttcggcagcagcgccagcgagccccagcccgccagccaggccgccagcagcagcagcgccagcgccgacctgctggccggcttcggcggcagcttcatggcccccagccccagccccgtgacccccgcccagaacaacctgctgcagcccaacttcgaggccgccttcggcaccacccccagcaccagcagcagcagcagcttcgaccccagcgtgttcgacggcctgggcgacctgctgatgcccaccatggcccccgccggccagcccgcccccgtgagcatggtgccccccagccccgccatggccgccagcaaggccctgggcagcgacctggacagcagcctggccagcctggtgggcaacctgggcatcagcggcaccaccaccaagaagggcgacctgcagtggaacgccggcgagaagaagctgaccggcggcgccaactggcagcccaaggtggcccccgccacctggagcgccggcgtgccccccagcgcccccctgcagggcgccgtgccccccaccagcagcgtgccccccgtggccggcgcccccagcgtgggccagcccggcgccggcttcggcatgccccccgccggcaccggcatgcccatgatgccccagcagcccgtgatgttcgcccagcccatgatgagaccccccttcggcgccgccgccgtgcccggcacccagctgagccccagccccacccccgccagccagagccccaagaagccccccgccaaggaccccctggccgacctgaacatcaaggacttcctgtag

SEQ ID NO: 22712 - DNA, 1803 bp, Artificial Sequence
  Description of Artificial Sequence: Synthetic coding sequence
atgagcggccagaccctgaccgacagaatcgccgccgcccagtacagcgtgaccggcagcgccgtggccagagccgtgtgcaaggccaccacccacgaggtgatgggccccaagaagaagcacctggactacctgatccaggccaccaacgagaccaacgtgaacatcccccagatggccgacaccctgttcgagagagccaccaacagcagctgggtggtggtgttcaaggccctggtgaccacccaccacctgatggtgcacggcaacgagagattcatccagtacctggccagcagaaacaccctgttcaacctgagcaacttcctggacaagagcggcagccacggctacgacatgagcaccttcatcagaagatacagcagatacctgaacgagaaggccttcagctacagacagatggccttcgacttcgccagagtgaagaagggcgccgacggcgtgatgagaaccatggcccccgagaagctgctgaagagcatgcccatcctgcagggccagatcgacgccctgctggagttcgacgtgcaccccaacgagctgaccaacggcgtgatcaacgccgccttcatgctgctgttcaaggacctgatcaagctgttcgcctgctacaacgacggcgtgatcaacctgctggagaagttcttcgagatgaagaagggccagtgcaaggacgccctggagatctacaagagattcctgaccagaatgaccagagtgagcgagttcctgaaggtggccgaggcccccagcagcctgatggagaccctggagcagcacctgaacaccctggagggcaagaagcccggcaacaagagcggcgcccccagccccctgagcaagagcagccccgccaccaccgtgaccagccccaacagcacccccgccaagaccatcgacaccagcccccccgtggacctgttcgccaccgccagcgccgccgtgcccgtgagcaccagcaagcccagcagcgacctgctggacctgcagcccgacttcagcagcggcggcgccgccgccgccgccgcccccgccccccccccccccgccggcggcgccaccgcctggggcggcttcggcggcagcttcatggcccccagccccagccccgtgacccccgcccagaacaacctgctgcagcccaacttcgaggccgccttcggcaccacccccagcaccagcagcagcagcagcttcgaccccagcgtgttcgacggcctgggcgacctgctgatgcccaccatggcccccgccggccagcccgcccccgtgagcatggtgccccccagccccgccatggccgccagcaaggccctgggcagcgacctggacagcagcctggccagcctggtgggcaacctgggcatcagcggcaccaccaccaagaagggcgacctgcagtggaacgccggcgagaagaagctgaccggcggcgccaactggcagcccaaggtggcccccgccacctggagcgccggcgtgccccccagcgcccccctgcagggcgccgtgccccccaccagcagcgtgccccccgtggccggcgcccccagcgtgggccagcccggcgccggcttcggcatgccccccgccggcaccggcatgcccatgatgccccagcagcccgtgatgttcgcccagcccatgatgagaccccccttcggcgccgccgccgtgcccggcacccagctgagccccagccccacccccgccagccagagccccaagaagccccccgccaaggaccccctggccgacctgaacatcaaggacttcctgtag

SEQ ID NO: 22713 - DNA, 2724 bp, Artificial Sequence; identical to SEQ ID NO: 22710
  Description of Artificial Sequence: Synthetic coding sequence

SEQ ID NO: 22714 - DNA, 633 bp, Artificial Sequence
  Description of Artificial Sequence: Synthetic coding sequence
atggagaccctggagcagcacctgaacaccctggagggcaagaagcccggcaacaagtacgccagcggcgcccccagccccctgagcaagagcagccccgccaccaccgtgaccagccccaacagcacccccgccaagaccatcgacaccagcccccccgtggacctgttcgccaccgccagcgccgccgtgcccgtgagcaccagcaagcccagcagcgacctgctggacctgcagcccgacttcagcagcggcggcgccgccgccgccgccgcccccgccccccccccccccgccggcggcgccaccgcctggggcgacctgctgggcgaggacagcctggccgccctgagcagcgtgcccagcgaggcccagatcagcgaccccttcgcccccgagcccaccccccccaccaccaccgccgagatcgccaccgccagcgccagcgccagcaccaccaccaccgtgaccgccgtgaccgccgaggtggacctgttcggcggcagcgccgaggccgcccccgagctggacctgttcgccatgaagccccccgagaccagcgtgcccgtggtgacccccaccgccagcaccgccccccccgtgcccgccaccgcccccagccccgccccctag

SEQ ID NO: 22715 - DNA, 456 bp, Artificial Sequence
  Description of Artificial Sequence: Synthetic coding sequence
atgagcggccagaccctgaccgacagaatcgccgccgcccagtacagcgtgaccggcagcgccgtggccagagccgtgtgcaaggccaccacccacgaggtgatgggccccaagaagaagcacctggactacctgatccaggccaccaacgagaccaacgtgaacatcccccagatggccgacaccctgttcgagagagccaccaacagcagctgggtggtggtgttcaaggccctggtgaccacccaccacctgatggtgcacggcaacgagagattcatccagtacctggccagcagaaacaccctgttcaacctgagcaacttcctggacaagagcggcagccacggctacgacatgagcaccttcatcagaagatacagcagatacctgaacgagaaggccttcagctacagacagatggccttcgacttcgccagagtgaagaagggctag

SEQ ID NO: 22716 - DNA, 459 bp, Artificial Sequence
  Description of Artificial Sequence: Synthetic coding sequence
atgagcggccagaccctgaccgacagaatcgccgccgcccagtacagcgtgaccggcagcgccgtggccagagccgtgtgcaaggccaccacccacgaggtgatgggccccaagaagaagcacctggactacctgatccaggccaccaacgagaccaacgtgaacatcccccagatggccgacaccctgttcgagagagccaccaacagcagctgggtggtggtgttcaaggccctggtgaccacccaccacctgatggtgcacggcaacgagagattcatccagtacctggccagcagaaacaccctgttcaacctgagcaacttcctggacaagagcggcagccacggctacgacatgagcaccttcatcagaagatacagcagatacctgaacgagaaggccttcagctacagacagatggccttcgacttcgccagagtgaagaagggcgcctag

SEQ ID NO: 22717 - DNA, 201 bp, Artificial Sequence
  Description of Artificial Sequence: Synthetic coding sequence
atgagcggccagaccctgaccgacagaatcgccgccgcccagtacagcgtgaccggcagcgccgtggccagagccgtgtgcaaggccaccacccacgaggtgatgggccccaagaagaagcacctggactacctgatccaggccaccaacgagaccaacgtgaacatcccccagatggccgacaccctgttcgagagatag

SEQ ID NO: 22718 - DNA, 1803 bp, Artificial Sequence; identical to SEQ ID NO: 22712
  Description of Artificial Sequence: Synthetic coding sequence

SEQ ID NO: 22719 - DNA, 2709 bp, Artificial Sequence; identical to SEQ ID NO: 22708
  Description of Artificial Sequence: Synthetic coding sequence

SEQ ID NO: 22720 - DNA, 2724 bp, Artificial Sequence; identical to SEQ ID NO: 22710
  Description of Artificial Sequence: Synthetic coding sequence

SEQ ID NO: 22721 - DNA, 354 bp, Artificial Sequence
  Description of Artificial Sequence: Synthetic coding sequence
atgagcggccagaccctgaccgacagaatcgccgccgcccagtacagcgtgaccggcagcgccgtggccagagccgtgtgcaaggccaccacccacgaggtgatgggccccaagaagaagcacctggactacctgatccaggccaccaacgagaccaacgtgaacatcccccagatggccgacaccctgttcgagagagccaccaacagcagctgggtggtggtgttcaaggccctggtgaccacccaccacctgatggtgcacggcaacgagagattcatccagtacctggccagcagaaacaccctgttcaacctgagcaacttcctggacaagagcggcagccacggctag

SEQ ID NO: 22722 - DNA, 1689 bp, Artificial Sequence
  Description of Artificial Sequence: Synthetic coding sequence
atggccaccgagcacgtgaacggcaacggcaccgaggagcccatggacaccaccagcgccgtgatccacagcgagaacttccagaccctgctggacgccggcctgccccagaaggtggccgagaagctggacgagatctacgtggccggcctggtggcccacagcgacctggacgagagagccatcgaggccctgaaggagttcaacgaggacggcgccctggccgtgctgcagcagttcaaggacagcgacctgagccacgtgcagaacaagagcgccttcctgtgcggcgtgatgaagacctacagacagagagagaagcagggcaccaaggtggccgacagcagcaagggccccgacgaggccaagatcaaggccctgctggagagaaccggctacaccctggacgtgaccaccggccagagaaagtacggcggccccccccccgacagcgtgtacagcggccagcagcccagcgtgggcaccgagatcttcgtgggcaagatccccagagacctgttcgaggacgagctggtgcccctgttcgagaaggccggccccatctgggacctgagactgatgatggaccccctgaccggcctgaacagaggctacgccttcgtgaccttctgcaccaaggaggccgcccaggaggccgtgaagctgtacaacaaccacgagatcagaagcggcaagcacatcggcgtgtgcatcagcgtggccaacaacagactgttcgtgggcagcatccccaagagcaagaccaaggagcagatcctggaggagttcagcaaggtgaccgagggcctgaccgacgtgatcctgtaccaccagcccgacgacaagaagaagaacagaggcttctgcttcctggagtacgaggaccacaagaccgccgcccaggccagaagaagactgatgagcggcaaggtgaaggtgtggggcaacgtgggcaccgtggagtgggccgaccccatcgaggaccccgaccccgaggtgatggccaaggtgaaggtgctgttcgtgagaaacctggccaacaccgtgaccgaggagatcctggagaaggccttcagccagttcggcaagctggagagagtgaagaagctgaaggactacgccttcatccacttcgacgagagagacggcgccgtgaaggccatggaggagatgaacggcaaggacctggagggcgagaacatcgagatcgtgttcgccaagccccccgaccagaagagaaaggagagaaaggcccagagacaggccgccaagaaccagatgtacgacgactactactactacggccccccccacatgcccccccccaccagaggcagaggcagaggcggcagaggcggctacggctacccccccgactactacggctacgaggactactacgactactacggctacgactaccacaactacagaggcggctacgaggacccctactacggctacgaggacttccaggtgggcgccagaggcagaggcggcagaggcgccagaggcgccgcccccagcagaggcagaggcgccgccccccccagaggcagagccggctacagccagagaggcggccccggcagcgccagaggcgtgagaggcgccagaggcggcgcccagcagcagagaggcagaggccagggcaagggcgtggaggccggccccgacctgctgcagtag

SEQ ID NO: 22723 - DNA, 1872 bp, Artificial Sequence
  Description of Artificial Sequence: Synthetic coding sequence
atggccaccgagcacgtgaacggcaacggcaccgaggagcccatggacaccaccagcgccgtgatccacagcgagaacttccagaccctgctggacgccggcctgccccagaaggtggccgagaagctggacgagatctacgtggccggcctggtggcccacagcgacctggacgagagagccatcgaggccctgaaggagttcaacgaggacggcgccctggccgtgctgcagcagttcaaggacagcgacctgagccacgtgcagaacaagagcgccttcctgtgcggcgtgatgaagacctacagacagagagagaagcagggcaccaaggtggccgacagcagcaagggccccgacgaggccaagatcaaggccctgctggagagaaccggctacaccctggacgtgaccaccggccagagaaagtacggcggccccccccccgacagcgtgtacagcggccagcagcccagcgtgggcaccgagatcttcgtgggcaagatccccagagacctgttcgaggacgagctggtgcccctgttcgagaaggccggccccatctgggacctgagactgatgatggaccccctgaccggcctgaacagaggctacgccttcgtgaccttctgcaccaaggaggccgcccaggaggccgtgaagctgtacaacaaccacgagatcagaagcggcaagcacatcggcgtgtgcatcagcgtggccaacaacagactgttcgtgggcagcatccccaagagcaagaccaaggagcagatcctggaggagttcagcaaggtgaccgagggcctgaccgacgtgatcctgtaccaccagcccgacgacaagaagaagaacagaggcttctgcttcctggagtacgaggaccacaagaccgccgcccaggccagaagaagactgatgagcggcaaggtgaaggtgtggggcaacgtgggcaccgtggagtgggccgaccccatcgaggaccccgaccccgaggtgatggccaaggtgaaggtgctgttcgtgagaaacctggccaacaccgtgaccgaggagatcctggagaaggccttcagccagttcggcaagctggagagagtgaagaagctgaaggactacgccttcatccacttcgacgagagagacggcgccgtgaaggccatggaggagatgaacggcaaggacctggagggcgagaacatcgagatcgtgttcgccaagccccccgaccagaagagaaaggagagaaaggcccagagacaggccgccaagaaccagatgtacgacgactactactactacggccccccccacatgcccccccccaccagaggcagaggcagaggcggcagaggcggctacggctacccccccgactactacggctacgaggactactacgactactacggctacgactaccacaactacagaggcggctacgaggacccctactacggctacgaggacttccaggtgggcgccagaggcagaggcggcagaggcgccagaggcgccgcccccagcagaggcagaggcgccgccccccccagaggcagagccggctacagccagagaggcggccccggcagcgccagaggcgtgagaggcgccagaggcggcgcccagcagcagagaggcagaggcgtgagaggcgccagaggcggcagaggcggcaacgtgggcggcaagagaaaggccgacggctacaaccagcccgacagcaagagaagacagaccaacaaccagaactggggcagccagcccatcgcccagcagcccctgcagggcggcgaccacagcggcaactacggctacaagagcgagaaccaggagttctaccaggacaccttcggccagcagtggaagtag

SEQ ID NO: 22724 - DNA, 558 bp, Artificial Sequence
  Description of Artificial Sequence: Synthetic coding sequence
atggccaccgagcacgtgaacggcaacggcaccgaggagcccatggacaccaccagcgccgtgatccacagcgagaacttccagaccctgctggacgccggcctgccccagaaggtggccgagaagctggacgagatctacgtggccggcctggtggcccacagcgacctggacgagagagccatcgaggccctgaaggagttcaacgaggacggcgccctggccgtgctgcagcagttcaaggacagcgacctgagccacgtgcagaacaagagcgccttcctgtgcggcgtgatgaagacctacagacagagagagaagcagggcaccaaggtggccgacagcagcaagggccccgacgaggccaagatcaaggccctgctggagagaaccggctacaccctggacgtgaccaccggccagagaaagtacggcggccccccccccgacagcgtgtacagcggccagcagcccagcgtgggcaccgagatcttcgtgggcaagatccccagagacctgttcgaggacgagctggtgcccctgttcgagaaggcctag

SEQ ID NO: 22725 - DNA, 1260 bp, Artificial Sequence
  Description of Artificial Sequence: Synthetic coding sequence
atgagaaacatcttcaagagaaaccaggagcccatcgtggcccccgccaccaccaccgccaccatgcccatcggccccgtggacaacagcaccgagagcggcggcgccggcgagagccaggaggacatgttcgccaagctgaaggagaagctgttcaacgagatcaacaagatccccctgcccccctgggccctgatcgccatcgccgtggtggccggcctgctgctgctgacctgctgcttctgcatctgcaagaagtgctgctgcaagaagaagaagaacaagaaggagaagggcaagggcatgaagaacgccatgaacatgaaggacatgaagggcggccaggacgacgacgacgccgagaccggcctgaccgagggcgagggcgagggcgaggaggagaaggagcccgagaacctgggcaagctgcagttcagcctggactacgacttccaggccaaccagctgaccgtgggcgtgctgcaggccgccgagctgcccgccctggacatgggcggcaccagcgacccctacgtgaaggtgttcctgctgcccgacaagaagaagaagtacgagaccaaggtgcacagaaagaccctgaaccccgccttcaacgagaccttcaccttcaaggtgccctaccaggagctgggcggcaagaccctggtgatggccatctacgacttcgacagattcagcaagcacgacatcatcggcgaggtgaaggtgcccatgaacaccgtggacctgggccagcccatcgaggagtggagagacctgcagggcggcgagaaggaggagcccgagaagctgggcgacatctgcaccagcctgagatacgtgcccaccgccggcaagctgaccgtgtgcatcctggaggccaagaacctgaagaagatggacgtgggcggcctgagcgacccctacgtgaagatccacctgatgcagaacggcaagagactgaagaagaagaagaccaccgtgaagaagaagaccctgaacccctacttcaacgagagcttcagcttcgagatccccttcgagcagatccagaaggtgcaggtggtggtgaccgtgctggactacgacaagctgggcaagaacgaggccatcggcaagatcttcgtgggcagcaacgccaccggcaccgagctgagacactggagcgacatgctggccaaccccagaagacccatcgcccagtggcacagcctgaagcccgaggaggaggtggacgccctgctgggcaagaacaagtag

SEQ ID NO: 22726 - DNA, 1260 bp, Artificial Sequence; identical to SEQ ID NO: 22725
  Description of Artificial Sequence: Synthetic coding sequence

SEQ ID NO: 22727 - DNA, 1206 bp, Artificial Sequence
  Description of Artificial Sequence: Synthetic coding sequence
atgctgcacctgcacggctggcagaccatgcagggcagaaagatgggccacccccccgtgagccccagcgcccccgcccccgccggcaccaccgccatccccggcctgatccccgacctggtggccggcaccccctggcccagatgggccctgatcgccggcgccctggccgccggcgtgctgctggtgagctgcctgctgtgcgccgcctgctgctgctgcagaagacacagaaagaagcccagagacaaggagagcgtgggcctgggcagcgccagaggcaccaccaccacccacctggtgcagcccgacgtggacggcctggagagcagccccggcgacgcccagcagtggggctgcctgcagctgagcctggagttcgacttcggcagccaggagatcagagtgggcctgagacaggccgccgacctgagacccggcggcaccgtggacccctacgccagagtgagcgtgagcacccaggccggccacagacacgagaccaaggtgcacagaggcaccctgtgccccgtgttcgacgagacctgctgcttccacatcccccaggccgagctgcccggcgccaccctgcaggtgcagctgttcaacttcaagagattcagcggccacgagcccctgggcgagctgagactgcccctgggcaccgtggacctgcagcacgtgctggagcactggtacctgctgggcccccccgccgccacccagcccgagcaggtgggcgagctgtgcttcagcctgagatacgtgcccagcagcggcagactgaccgtggtggtgctggaggccagaggcctgagacccggcctggccgagccctacgtgaaggtgcagctgatgctgaaccagagaaagtggaagaagagaaagaccgccaccaagaagggcaccgccgccccctacttcaacgaggccttcaccttcctggtgcccttcagccaggtgcagaacgtggacctggtgctggccgtgtgggacagaagcctgcccctgagaaccgagcccgtgggcaaggtgcacctgggcgccagagccagcggccagcccctgcagcactgggccgacatgctggcccacgccagaagacccatcgcccagagacaccccctgagacccgccagagaggtggacagaatgctggccctgcagcccagactgagactgagactgcccctgccccacagctag

SEQ ID NO: 22728 - DNA, 477 bp, Artificial Sequence
  Description of Artificial Sequence: Synthetic coding sequence
atgggccacccccccgtgagccccagcgcccccgcccccgccggcaccaccgccatccccggcctgatccccgacctggtggccggcaccccctggcccagatgggccctgatcgccggcgccctggccgccggcgtgctgctggtgagctgcctgctgtgcgccgcctgctgctgctgcagaagacacagaaagaagcccagagacaaggagagcgtgggcctgggcagcgccagaggcaccaccaccacccacctggtgcagcccgacgtggacggcctggagagcagccccggcgacgcccagcagtggggctgcctgcagctgagcctggagttcgacttcggcagccaggaggtgaagggccccgccgcccaggaccagagattctgcgagttccccgagagagtgaccggcgagggccagaccccctgccccggctggtggggcgccgacagagccggcgccctgggctag

SEQ ID NO: 22729 - DNA, 933 bp, Artificial Sequence
  Description of Artificial Sequence: Synthetic coding sequence
atgcccagcagcaagcccggcagccccgccccccaggaccccagccccagctgcagaacctgcagcaaccaggtgcagcccggccacctgctgctgcccctgaccaaggccagcctgaccggccccagccccccccccgccaagctgggcagagcccagggcgcccccagccccaagggccccctggagatcggctggagccccgacgcccagcccctgagactgggcgagaccttcctgcccaagggcgtggcccagctgagcagagccagcagcagcggccacaaggtgggcttcctgcagccctggcccccccaccccctgctgccccaggagagagtgcccagacaccagagacagtgctgccccagagccggccccgccttcggctgcctgagaggcagacccggcggctggcccgccaccggcagcggcggcagacagcagggcagaaagatgggccacccccccgtgagccccagcgcccccgcccccgccggcaccaccgccatccccggcctgatccccgacctggtggccggcaccccctggcccagatgggccctgatcgccggcgccctggccgccggcgtgctgctggtgagctgcctgctgtgcgccgcctgctgctgctgcagaagacacagaaagaagcccagagacaaggagagcgtgggcctgggcagcgccagaggcaccaccaccacccacctggtgcagcccgacgtggacggcctggagagcagccccggcgacgcccagcagtggggctgcctgcagctgagcctggagttcgacttcggcagccaggaggtgaagggccccgccgcccaggaccagagattctgcgagttccccgagagagtgaccggcgagggccagaccccctgccccggctggtggggcgccgacagagccggcgccctgggctag

SEQ ID NO: 22730 - DNA, 570 bp, Artificial Sequence
  Description of Artificial Sequence: Synthetic coding sequence
atgctgggcagcagagccgtgatgctgctgctgctgctgccctggaccgcccagggcagagccgtgcccggcggcagcagccccgcctggacccagtgccagcagctgagccagaagctgtgcaccctggcctggagcgcccaccccctggtgggccacatggacctgagagaggagggcgacgaggagaccaccaacgacgtgccccacatccagtgcggcgacggctgcgacccccagggcctgagagacaacagccagttctgcctgcagagaatccaccagggcctgatcttctacgagaagctgctgggcagcgacatcttcaccggcgagcccagcctgctgcccgacagccccgtgggccagctgcacgccagcctgctgggcctgagccagctgctgcagcccgagggccaccactgggagacccagcagatccccagcctgagccccagccagccctggcagagactgctgctgagattcaagatcctgagaagcctgcaggccttcgtggccgtggccgccagagtgttcgcccacggcgccgccaccctgagcccctag

SEQ ID NO: 22731 - DNA, 1029 bp, Artificial Sequence
  Description of Artificial Sequence: Synthetic coding sequence
atgcaggtgagcagcgtggacttcagcatgggcaccgagcccgtgctgcagagaggcgagaccaccaccagcatcggcagaatcaagcccgagctgtacaagcagaagagcgtggacagcgagggcaaccagaacgaggacgtgaagatctgcggcaagctgaacttcaccctgcagtacgactacgagaacgagctgctggtggtgaagatcatcaaggccctggacctgcccgccaaggacttcaccggcaccagcgacccctacgtgaagatgtacctgctgcccgacagaaagaagaagttccagaccagagtgcacagaaagaccctgaaccccctgttcgacgagaccttccagttccccgtggcctacgaccagctgagcaacagaaagctgcacttcagcgtgtacgacttcgacagattcagcagacacgacatgatcggcgaggtgatcctggacaacctgttcgaggtgagcgacctgagcagagaggccaccgtgtggaaggacatccactgcgccaccaccgagagcatcgacctgggcgagatcatgttcagcctgtgctacctgcccaccgccggcagaatgaccctgaccgtgatcaagtgcagaaacctgaaggccatggacatcaccggcagcagcgacccctacgtgaaggtgagcctgatgtgcgagggcagaagactgaagaagagaaagaccaccaccaagaagaacaccctgaaccccgtgtacaacgaggccatcatcttcgacatcccccccgagaacgtggaccaggtgagcctgagcatcgccgtgatggactacgacagagtgggccacaacgaggtgatcggcgtgtgcagaaccggcctggacgccgagggcctgggcagagaccactggaacgagatgctggcctaccacagaaagcccatcacccactggcaccccctgctggagctgcccggcagagccaccagcttcgacagccagggcagctgccccagccccaagccccccagcaccccctag

SEQ ID NO: 22732 - DNA, 1296 bp, Artificial Sequence
  Description of Artificial Sequence: Synthetic coding sequence
atggccgagatcaccaacatcagacccagcttcgacgtgagccccgtggtggccggcctgatcggcgccagcgtgctggtggtgtgcgtgagcgtgaccgtgttcgtgtggagctgctgccaccagcaggccgagaagaagcagaagaaccccccctacaagttcatccacatgctgaagggcatcagcatctaccccgagaccctgagcaacaagaagaagatcatcaaggtgagaagagacaaggacggccccggcagagagggcggcagaagaaacctgctggtggacgccgccgaggccggcctgctgagcagagacaaggaccccagaggccccagcagcggcagctgcatcgaccagctgcccatcaagatggactacggcgaggagctgagaagccccatcaccagcctgacccccggcgagagcaagaccaccagccccagcagccccgaggaggacgtgatgctgggcagcctgaccttcagcgtggactacaacttccccaagaaggccctggtggtgaccatccaggaggcccacggcctgcccgtgatggacgaccagacccagggcagcgacccctacatcaagatgaccatcctgcccgacaagagacacagagtgaagaccagagtgctgagaaagaccctggaccccgtgttcgacgagaccttcaccttctacggcatcccctacagccagctgcaggacctggtgctgcacttcctggtgctgagcttcgacagattcagcagagacgacgtgatcggcgaggtgatggtgcccctggccggcgtggaccccagcaccggcaaggtgcagctgaccagagacatcatcaagagaaacatccagaagtgcatcagcagaggcgagctgcaggtgagcctgagctaccagcccgtggcccagagaatgaccgtggtggtgctgaaggccagacacctgcccaagatggacatcaccggcctgagcggcaacccctacgtgaaggtgaacgtgtactacggcagaaagagaatcgccaagaagaagacccacgtgaagaagtgcaccctgaaccccatcttcaacgagagcttcatctacgacatccccaccgacctgctgcccgacatcagcatcgagttcctggtgatcgacttcgacagaaccaccaagaacgaggtggtgggcagactgatcctgggcgcccacagcgtgaccgccagcggcgccgagcactggagagaggtgtgcgagagccccagaaagcccgtggccaagtggcacagcctgagcgagtactag

SEQ ID NO: 22733 - DNA, 375 bp, Artificial Sequence
  Description of Artificial Sequence: Synthetic coding sequence
atgaccgtggtggtgctgaaggccagacacctgcccaagatggacatcaccggcctgagcggcaacccctacgtgaaggtgaacgtgtactacggcagaaagagaatcgccaagaagaagacccacgtgaagaagtgcaccctgaaccccatcttcaacgagagcttcatctacgacatccccaccgacctgctgcccgacatcagcatcgagttcctggtgatcgacttcgacagaaccaccaagaacgaggtggtgggcagactgatcctgggcgcccacagcgtgaccgccagcggcgccgagcactggagagaggtgtgcgagagccccagaaagcccgtggccaagtggcacagcctgagcgagtactag

SEQ ID NO: 22734 - DNA, 1425 bp, Artificial Sequence
  Description of Artificial Sequence: Synthetic coding sequence
atggcctacatccagctggagcccctgaacgagggcttcctgagcagaatcagcggcctgctgctgtgcagatggacctgcagacactgctgccagaagtgctacgagagcagctgctgccagagcagcgaggacgaggtggagatcctgggccccttccccgcccagacccccccctggctgatggccagcagaagcagcgacaaggacggcgacagcgtgcacaccgccagcgaggtgcccctgacccccagaaccaacagccccgacggcagaagaagcagcagcgacaccagcaagagcacctacagcctgaccagaagaatcagcagcctggagagcagaagacccagcagccccctgatcgacatcaagcccatcgagttcggcgtgctgagcgccaagaaggagcccatccagcccagcgtgctgagaagaacctacaaccccgacgactacttcagaaagttcgagccccacctgtacagcctggacagcaacagcgacgacgtggacagcctgaccgacgaggagatcctgagcaagtaccagctgggcatgctgcacttcagcacccagtacgacctgctgcacaaccacctgaccgtgagagtgatcgaggccagagacctgcccccccccatcagccacgacggcagcagacaggacatggcccacagcaacccctacgtgaagatctgcctgctgcccgaccagaagaacagcaagcagaccggcgtgaagagaaagacccagaagcccgtgttcgaggagagatacaccttcgagatccccttcctggaggcccagagaagaaccctgctgctgaccgtggtggacttcgacaagttcagcagacactgcgtgatcggcaaggtgagcgtgcccctgtgcgaggtggacctggtgaagggcggccactggtggaaggccctgatccccagcagccagaacgaggtggagctgggcgagctgctgctgagcctgaactacctgcccagcgccggcagactgaacgtggacgtgatcagagccaagcagctgctgcagaccgacgtgagccagggcagcgaccccttcgtgaagatccagctggtgcacggcctgaagctggtgaagaccaagaagaccagcttcctgagaggcaccatcgaccccttctacaacgagagcttcagcttcaaggtgccccaggaggagctggagaacgccagcctggtgttcaccgtgttcggccacaacatgaagagcagcaacgacttcatcggcagaatcgtgatcggccagtacagcagcggccccagcgagaccaaccactggagaagaatgctgaacacccacagaaccgccgtggagcagtggcacagcctgagaagcagagccgagtgcgacagagtgagccccgccagcctggaggtgacctag

SEQ ID NO: 22735 - DNA, 1431 bp, Artificial Sequence
  Description of Artificial Sequence: Synthetic coding sequence
atggccagccccgagcccagaagaggcggcgacggcgccgcccaggccgccagaaagaccagagtggaggccaacagccccctgcccaagaacagcggcagcctgaacgaggccgaggccctgaaccccgaggtgaccctgagcagcgagggcagcctgaacctggaggacatcctgtacctggaggacaccggcgacctggacgagaccctgtacgtgcaggagaccgagaaggccgaggaggccctgtacatcgaggaggccatgcagcccgacgaggccctgcacgtggaggagcccggcaaccccgaggagaccgtgtgcgtggaggagaccaccgagcccgacagaatccagttcgtggagggccccgtggagcccggcaagcccaccagccccgagcacgtggtgtacgagggcgagaccgtgaccagagccgagaagagcaaccccgaggagagcctgagagccgagcagagccccagcatggaggagaacctgagcatcgaggacctggagctgctggagggcagattccagcagtgcgtgcaggccgtggcccagctggaggaggagagagaccagctgatccacgagctggtgctgctgagagagcccgccctgcaggaggtgcagcaggtgcaccaggacatcctggccgcctacaagctgcacgcccaggccgagctggagagagacggcctgagagaggagatcagactggtgaagcagaagctgttcaaggtgaccaaggagtgcgtggcctaccagtaccagctggagtgcagacagcaggacgtggcccagttcgccgacttcagagaggtgctgaccaccagagccacccagctgagcgaggagctggcccagctgagagacgcctaccagaagcagaaggagcagctgagacagcagctggaggccccccccagccagagagacggccacttcctgcaggagagcagaagactgagcgcccagttcgagaacctgatggccgagagcagacaggacctggaggaggagtacgagccccagttcctgagactgctggagagaaaggaggccggcaccaaggccctgcagagaacccaggccgagatccaggagatgaaggaggccctgagacccctgcaggccgaggccagacagctgagactgcagaacagaaacctggaggaccagatcgccctggtgagacagaagagagacgaggaggtgcagcagtacagagagcagctggaggagatggaggagagacagagacagctgagaaacggcgtgcagctgcagcagcagaagaacaaggagatggagcagctgagactgagcctggccgaggagctgagcacctacaagggctgcctggagatctacggccagatctgcaaccccgagaccgccaagaacttcctggccaaggaccactag

SEQ ID NO: 22736 - DNA, 1449 bp, Artificial Sequence
  Description of Artificial Sequence: Synthetic coding sequence
atggccagccccgagcccagaagaggcggcgacggcgccgcccaggccgccagaaagaccagagtggaggccaacagccccctgcccaagaacagcggcagcctgaacgaggccgaggccctgaaccccgaggtgaccctgagcagcgagggcagcctgaacctggaggacatcctgtacctggaggacaccggcgacctggacgagaccctgtacgtgcaggagaccgagaaggccgaggaggccctgtacatcgaggaggccatgcagcccgacgaggccctgcacgtggaggagcccggcaaccccgaggagaccgtgtgcgtggaggagaccaccgagcccgacagaatccagttcgtggagggccccgtggagcccggcaagcccaccagccccgagcacgtggtgtacgagggcgagaccgtgaccagagccgagaagagcaaccccgaggagagcctgagagccgagcagagccccagcatggaggagaacctgagcatcgaggacctggagctgctggagggcagattccagcagtgcgtgcaggccgtggcccagctggaggaggagagagaccagctgatccacgagctggtgctgctgagagagcccgccctgcaggaggtgcagcaggtgcaccaggacatcctggccgcctacaagctgcacgcccaggccgagctggagagagacggcctgagagaggagatcagactggtgaagcagaagctgttcaaggtgaccaaggagtgcgtggcctaccagtaccagctggagtgcagacagcaggacgtggcccagttcgccgacttcagagaggtgctgaccaccagagccacccagctgagcgaggagctggcccagctgagagacgcctaccagaagcagaaggagcagctgagacagcagctggaggccccccccagccagagagacggccacttcctgcaggagagcagaagactgagcgcccagttcgagaacctgatggccgagagcagacaggacctggaggaggagtacgagccccagttcctgagactgctggagagaaaggaggccggcaccaaggccctgcagagaacccaggccgagatccaggagatgaaggaggccctgagacccctgcaggccgaggccagacagctgagactgcagaacagaaacctggaggaccagatcgccctggtgagacagaagagagacgaggaggtgcagcagtacagagagcagctggaggagatggaggagagacagagacagctgagaaacggcgtgcagctgcagcagcagaagaacaaggagatggagcagctgagactgagcctggccgaggagctgagcacctacaaggccatgctgctgcccaagagcctggagcaggccgacgcccccaccagccaggccggcggcatggagacccagagccagggcgccgtgtag

SEQ ID NO: 22737 - DNA, 273 bp, Artificial Sequence
  Description of Artificial Sequence: Synthetic coding sequence
atgcagcccgacgaggccctgcacgtggaggagcccggcaaccccgaggagaccgtgtgcgtggaggagaccaccgagcccgacagaatccagttcgtggagggccccgtggagcccggcaagcccaccagccccgagcacgtggtgtacgagggcgagaccgtgaccagagccgagaagagcaaccccgaggagagcctgagagccgagcagagccccagcatggaggagaacctgagcatcgaggacctggagctgctggagggcagatag

SEQ ID NO: 22738 - DNA, 213 bp, Artificial Sequence
  Description of Artificial Sequence: Synthetic coding sequence
atgcagcccgacgaggccctgcacgtggaggagcccggcaaccccgaggagaccgtgtgcgtggaggagaccaccgagcccgacagaatccagttcgtggagggccccgtggagcccggcaagcccaccagccccgagcacgtggtgtacgagggcgagaccgtgaccagagccgagaagagcaaccccgaggagagcctgagagccgagtag

SEQ ID NO: 22739 - DNA, 405 bp, Artificial Sequence
  Description of Artificial Sequence: Synthetic coding sequence
atgagccccctgagacccctgctgctggccctggccctggccagcgtgccctgcgcccagggcgcctgccccgccagcgccgacctgaagcacagcgacggcaccagaacctgcgccaagctgtacgacaagagcgacccctactacgagaactgctgcggcggcgccgagctgagcctggagagcggcgccgacctgccctacctgcccagcaactgggccaacaccgccagcagcctggtggtggcccccagatgcgagctgaccgtgtggagcagacagggcaaggccggcaagacccacaagttcagcgccggcacctaccccagactggaggagtacagaagaggcatcctgggcgactggagcaacgccatcagcgccctgtactgcagatgcagctag

SEQ ID NO: 22740 - DNA, 897 bp, Artificial Sequence
  Description of Artificial Sequence: Synthetic coding sequence
atgagcctgtaccccagcctggaggacctgaaggtggacaaggtgatccaggcccagaccgccttcagcgccaaccccgccaaccccgccatcctgagcgaggccagcgcccccatcccccacgacggcaacctgtaccccagactgtaccccgagctgagccagtacatgggcctgagcctgaacgaggaggagatcagagccaacgtggccgtggtgagcggcgcccccctgcagggccagctggtggccagacccagcagcatcaactacatggtggcccccgtgaccggcaacgacgtgggcatcagaagagccgagatcaagcagggcatcagagaggtgatcctgtgcaaggaccaggacggcaagatcggcctgagactgaagagcatcgacaacggcatcttcgtgcagctggtgcaggccaacagccccgccagcctggtgggcctgagattcggcgaccaggtgctgcagatcaacggcgagaactgcgccggctggagcagcgacaaggcccacaaggtgctgaagcaggccttcggcgagaagatcaccatgaccatcagagacagacccttcgagagaaccatcaccatgcacaaggacagcaccggccacgtgggcttcatcttcaagaacggcaagatcaccagcatcgtgaaggacagcagcgccgccagaaacggcctgctgaccgagcacaacatctgcgagatcaacggccagaacgtgatcggcctgaaggacagccagatcgccgacatcctgagcaccagcggcaccgtggtgaccatcaccatcatgcccgccttcatcttcgagcacatcatcaagagaatggcccccagcatcatgaagagcctgatggaccacaccatccccgaggtgtag

SEQ ID NO: 22741 - DNA, 897 bp, Artificial Sequence; identical to SEQ ID NO: 22740
  Description of Artificial Sequence: Synthetic coding sequence

SEQ ID NO: 22742 - DNA, 894 bp, Artificial Sequence
  Description of Artificial Sequence: Synthetic coding sequence
atgagcctgtaccccagcctggaggacctgaaggtggacaaggtgatccaggcccagaccgccttcagcgccaaccccgccaaccccgccatcctgagcgaggccagcgcccccatcccccacgacggcaacctgtaccccagactgtaccccgagctgagccagtacatgggcctgagcctgaacgaggaggagatcagagccaacgtggccgtggtgagcggcgcccccctgcagggcctggtggccagacccagcagcatcaactacatggtggcccccgtgaccggcaacgacgtgggcatcagaagagccgagatcaagcagggcatcagagaggtgatcctgtgcaaggaccaggacggcaagatcggcctgagactgaagagcatcgacaacggcatcttcgtgcagctggtgcaggccaacagccccgccagcctggtgggcctgagattcggcgaccaggtgctgcagatcaacggcgagaactgcgccggctggagcagcgacaaggcccacaaggtgctgaagcaggccttcggcgagaagatcaccatgaccatcagagacagacccttcgagagaaccatcaccatgcacaaggacagcaccggccacgtgggcttcatcttcaagaacggcaagatcaccagcatcgtgaaggacagcagcgccgccagaaacggcctgctgaccgagcacaacatctgcgagatcaacggccagaacgtgatcggcctgaaggacagccagatcgccgacatcctgagcaccagcggcaccgtggtgaccatcaccatcatgcccgccttcatcttcgagcacatcatcaagagaatggcccccagcatcatgaagagcctgatggaccacaccatccccgaggtgtag

SEQ ID NO: 22743 - DNA, 879 bp, Artificial Sequence
  Description of Artificial Sequence: Synthetic coding sequence
atgagcctgtaccccagcctggaggacctgaaggcccagaccgccttcagcgccaaccccgccaaccccgccatcctgagcgaggccagcgcccccatcccccacgacggcaacctgtaccccagactgtaccccgagctgagccagtacatgggcctgagcctgaacgaggaggagatcagagccaacgtggccgtggtgagcggcgcccccctgcagggccagctggtggccagacccagcagcatcaactacatggtggcccccgtgaccggcaacgacgtgggcatcagaagagccgagatcaagcagggcatcagagaggtgatcctgtgcaaggaccaggacggcaagatcggcctgagactgaagagcatcgacaacggcatcttcgtgcagctggtgcaggccaacagccccgccagcctggtgggcctgagattcggcgaccaggtgctgcagatcaacggcgagaactgcgccggctggagcagcgacaaggcccacaaggtgctgaagcaggccttcggcgagaagatcaccatgaccatcagagacagacccttcgagagaaccatcaccatgcacaaggacagcaccggccacgtgggcttcatcttcaagaacggcaagatcaccagcatcgtgaaggacagcagcgccgccagaaacggcctgctgaccgagcacaacatctgcgagatcaacggccagaacgtgatcggcctgaaggacagccagatcgccgacatcctgagcaccagcggcaccgtggtgaccatcaccatcatgcccgccttcatcttcgagcacatcatcaagagaatggcccccagcatcatgaagagcctgatggaccacaccatccccgaggtgtag

SEQ ID NO: 22744 - DNA, 894 bp, Artificial Sequence; identical to SEQ ID NO: 22742
  Description of Artificial Sequence: Synthetic coding sequence

SEQ ID NO: 22745 - DNA, 879 bp, Artificial Sequence
  Description of Artificial Sequence: Synthetic coding sequence
atgagcagcctgtaccccagcctggaggacctgaaggtggaccaggccatccaggcccaggtgagagccagccccaagatgcccgccctgcccgtgcaggccaccgccatcagccccccccccgtgctgtaccccaacctggccgagctggagaactacatgggcctgagcctgagcagccaggaggtgcaggagagcctgctgcagatccccgagggcgacagcaccgccgtgagcggccccggccccggccagatggtggcccccgtgaccggctacagcctgggcgtgagaagagccgagatcaagcccggcgtgagagagatccacctgtgcaaggacgagagaggcaagaccggcctgagactgagaaaggtggaccagggcctgttcgtgcagctggtgcaggccaacacccccgccagcctggtgggcctgagattcggcgaccagctgctgcagatcgacggcagagactgcgccggctggagcagccacaaggcccaccaggtggtgaagaaggccagcggcgacaagatcgtggtggtggtgagagacagacccttccagagaaccgtgaccatgcacaaggacagcatgggccacgtgggcttcgtgatcaagaagggcaagatcgtgagcctggtgaagggcagcagcgccgccagaaacggcctgctgaccaaccactacgtgtgcgaggtggacggccagaacgtgatcggcctgaaggacaagaagatcatggagatcctggccaccgccggcaacgtggtgaccctgaccatcatccccagcgtgatctacgagcacatggtgaagaagctgccccccgtgctgctgcaccacaccatggaccacagcatccccgacgcctag

SEQ ID NO: 22746 - DNA, 879 bp, Artificial Sequence; identical to SEQ ID NO: 22745
  Description of Artificial Sequence: Synthetic coding sequence

SEQ ID NO: 22747 - DNA, 624 bp, Artificial Sequence
  Description of Artificial Sequence: Synthetic coding sequence
atggtggcccccgtgaccggctacagcctgggcgtgagaagagccgagatcaagcccggcgtgagagagatccacctgtgcaaggacgagagaggcaagaccggcctgagactgagaaaggtggaccagggcctgttcgtgcagctggtgcaggccaacacccccgccagcctggtgggcctgagattcggcgaccagctgctgcagatcgacggcagagactgcgccggctggagcagccacaaggcccaccaggtggtgaagaaggccagcggcgacaagatcgtggtggtggtgagagacagacccttccagagaaccgtgaccatgcacaaggacagcatgggccacgtgggcttcgtgatcaagaagggcaagatcgtgagcctggtgaagggcagcagcgccgccagaaacggcctgctgaccaaccactacgtgtgcgaggtggacggccagaacgtgatcggcctgaaggacaagaagatcatggagatcctggccaccgccggcaacgtggtgaccctgaccatcatccccagcgtgatctacgagcacatggtgaagaagctgccccccgtgctgctgcaccacaccatggaccacagcatccccgacgcctag

SEQ ID NO: 22748 - DNA, 879 bp, Artificial Sequence; identical to SEQ ID NO: 22745
  Description of Artificial Sequence: Synthetic coding sequence

SEQ ID NO: 22749 - DNA, 750 bp, Artificial Sequence
  Description of Artificial Sequence: Synthetic coding sequence
atgagcctggaggaccccttcttcgtggtgagaggcgaggtgcagaaggccgtgaacaccgccagaggcctgtaccagagatggtgcgagctgctgcaggagagcgccgccgtgggcagagaggagctggactggaccaccaacgagctgagaaacggcctgagaagcatcgagtgggacctggaggacctggaggagaccatcggcatcgtggaggccaaccccggcaagttcaagctgcccgccggcgacctgcaggagagaaaggtgttcgtggagagaatgagagaggccgtgcaggagatgaaggaccacatggtgagccccaccgccgtggccttcctggagagaaacaacagagagatcctggccggcaagcccgccgcccagaagagccccagcgacctgctggacgccagcgccgtgagcgccaccagcagatacatcgaggagcagcaggccacccagcagctgatcatggacgagcaggaccagcagctggagatggtgagcggcagcatccaggtgctgaagcacatgagcggcagagtgggcgaggagctggacgagcagggcatcatgctggacgccttcgcccaggagatggaccacacccagagcagaatggacggcgtgctgagaaagctggccaaggtgagccacatgaccagcgacagaagacagtggtgcgccatcgccgtgctggtgggcgtgctgctgctggtgctgatcctgctgttcagcctgtag

SEQ ID NO: 22750 - DNA, 603 bp, Artificial Sequence
  Description of Artificial Sequence: Synthetic coding sequence
atgagcctggaggaccccttcttcgtggtgagaggcgaggtgcagaaggccgtgaacaccgccagaggcctgtaccagagatggtgcgagctgctgcaggagagcgccgccgtgggcagagaggagctggactggaccaccaacgagctgagaaacggcctgagaagcatcgagtgggacctggaggacctggaggagaccatcggcatcgtggaggccaaccccggcaagcccgccgcccagaagagccccagcgacctgctggacgccagcgccgtgagcgccaccagcagatacatcgaggagcagcaggccacccagcagctgatcatggacgagcaggaccagcagctggagatggtgagcggcagcatccaggtgctgaagcacatgagcggcagagtgggcgaggagctggacgagcagggcatcatgctggacgccttcgcccaggagatggaccacacccagagcagaatggacggcgtgctgagaaagctggccaaggtgagccacatgaccagcgacagaagacagtggtgcgccatcgccgtgctggtgggcgtgctgctgctggtgctgatcctgctgttcagcctgtag

SEQ ID NO: 22751 - DNA, 741 bp, Artificial Sequence
  Description of Artificial Sequence: Synthetic coding sequence
atgagcctggaggaccccttcttcgtggtgagaggcgaggtgcagaaggccgtgaacaccgccagaggcctgtaccagagatggtgcgagctgctgcaggagagcgccgccgtgggcagagaggagctggactggaccaccaacgagctgagaaacggcctgagaagcatcgagtgggacctggaggacctggaggagaccatcggcatcgtggaggccaaccccggcaagttcaagctgcccgccggcgacctgcaggagagaaaggtgttcgtggagagaatgagagaggccgtgcaggagatgaaggaccacatggtgagccccaccgccgtggccttcctggagagaaacaacagagagatcctggccggcaagcccgccgcccagaagagccccagcgacctgctggacgccagcgccgtgagcgccaccagcagatacatcgaggagcagcaggccacccagcagctgatcatggacgagcaggaccagcagctggagatggtgagcggcagcatccaggtgctgaagcacatgagcggcagagtgggcgaggagctggacgagcagggcatcatgctggacgccttcgcccaggagatggaccacacccagagcagaatggacggcgtgctgagaaagctggccaaggtgagccacatgaccagcggcgagagcccccagggcagaggccagagctggtggggccaggtggtgggcggcaccctgagcccctag

SEQ ID NO: 22752 - DNA, 750 bp, Artificial Sequence; identical to SEQ ID NO: 22749
  Description of Artificial Sequence: Synthetic coding sequence

SEQ ID NO: 22753 - DNA, 741 bp, Artificial Sequence; identical to SEQ ID NO: 22751
  Description of Artificial Sequence: Synthetic coding sequence

SEQ ID NO: 22754 - DNA, 831 bp, Artificial Sequence
  Description of Artificial Sequence: Synthetic coding sequence
atgagctacggccccctggacatgtacagaaaccccggccccagcggcccccagctgagagacttcagcagcatcatccagacctgcagcggcaacatccagagaatcagccaggccaccgcccagatcaagaacctgatgagccagctgggcaccaagcaggacagcagcaagctgcaggagaacctgcagcagctgcagcacagcaccaaccagctggccaaggagaccaacgagctgctgaaggagctgggcagcctgcccctgcccctgagcaccagcgagcagagacagcagagactgcagaaggagagactgatgaacgacttcagcgccgccctgaacaacttccaggccgtgcagagaagagtgagcgagaaggagaaggagagcatcgccagagccagagccggcagcagactgagcgccgaggagagacagagagaggagcagctggtgagcttcgacagccacgaggagtggaaccagatgcagagccaggaggacgaggtggccatcaccgagcaggacctggagctgatcaaggagagagagaccgccatcagacagctggaggccgacatcctggacgtgaaccagatcttcaaggacctggccatgatgatccacgaccagggcgacctgatcgacagcatcgaggccaacgtggagagcagcgaggtgcacgtggagagagccaccgagcagctgcagagagccgcctactaccagaagaagagcagaaagaagatgtgcatcctggtgctggtgctgagcgtgatcatcctgatcctgggcctgatcatctggctggtgtacaagaccaagtag

SEQ ID NO: 22755 - DNA, 705 bp, Artificial Sequence
  Description of Artificial Sequence: Synthetic coding sequence
atgagctacggccccctggacatgtacagaaaccccggccccagcggcccccagctgagagacttcagcagcatcatccagacctgcagcggcaacatccagagaatcagccaggccaccgcccagatcaagaacctgatgagccagctgggcaccaagcaggacagcagcaagctgcaggagaacctgcagcagctgcagcacagcaccaaccagctggccaaggagaccaacgagctgctgaaggagctgggcagcctgcccctgcccctgagcaccagcgagcagagacagcagagactgcagaaggagagactgatgaacgacttcagcgccgccctgaacaacttccaggccgtgcagagaagagtgagcgagaaggagaaggagagcatcgccagagccagagccggcagcagactgagcgccgaggagagacagagagaggagcagctggtgagcttcgacagcagcctgctgctggacatgaagaacgtggccctgcaggacttcatcgacagcagaggcctggagccctgccacgaggagtggaaccagatgcagagccaggaggacgaggtggccatcaccgagcaggacctggagctgatcaaggagagagagaccgccatcagacagctggaggccgacatcctggacgtgaaccagatcttcaaggacctggccatgatgatccacgactag

SEQ ID NO: 22756 - DNA, 1008 bp, Artificial Sequence
  Description of Artificial Sequence: Synthetic coding sequence
atggccgtggacatcaccctgctgttcagagccagcgtgaagaccgtgaagaccagaaacaaggccctgggcgtggccgtgggcggcggcgtggacggcagcagagacgagctgttcagaagaagccccagacccaagggcgacttcagcagcagagccagagaggtgatcagccacatcggcaagctgagagacttcctgctggagcacagaaaggactacatcaacgcctacagccacaccatgagcgagtacggcagaatgaccgacaccgagagagaccagatcgaccaggacgcccagatcttcatgagaacctgcagcgaggccatccagcagctgagaaccgaggcccacaaggagatccacagccagcaggtgaaggagcacagaaccgccgtgctggacttcatcgaggactacctgaagagagtgtgcaagctgtacagcgagcagagagccatcagagtgaagagagtggtggacaagaagagactgagcaagctggagcccgagcccaacaccaagaccagagagagcaccagcagcgagaaggtgagccagagccccagcaaggacagcgaggagaaccccgccaccgaggagagacccgagaagatcctggccgagacccagcccgagctgggcacctggggcgacggcaagggcgaggacgagctgagccccgaggagatccagatgttcgagcaggagaaccagagactgatcggcgagatgaacagcctgttcgacgaggtgagacagatcgagggcagagtggtggagatcagcagactgcaggagatcttcaccgagaaggtgctgcagcaggaggccgagatcgacagcatccaccagctggtggtgggcgccaccgagaacatcaaggagggcaacgaggacatcagagaggccatcaagaacaacgccggcttcagagtgtggatcctgttcttcctggtgatgtgcagcttcagcctgctgttcctggactggtacgacagctag

SEQ ID NO: 22757 - DNA, 768 bp, Artificial Sequence
  Description of Artificial Sequence: Synthetic coding sequence
atgagcatggaggaccccttcttcgtggtgaagggcgaggtgcagaaggccgtgaacaccgcccagggcctgttccagagatggaccgagctgctgcaggaccccagcaccgccaccagagaggagatcgactggaccaccaacgagctgagaaacaacctgagaagcatcgagtgggacctggaggacctggacgagaccatcagcatcgtggaggccaaccccagaaagttcaacctggacgccaccgagctgagcatcagaaaggccttcatcaccagcaccagacaggtggtgagagacatgaaggaccagatgagcaccagcagcgtgcaggccctggccgagagaaagaacagacaggccctgctgggcgacagcggcagccagaactggagcaccggcaccaccgacaagtacggcagactggacagagagctgcagagagccaacagccacttcatcgaggagcagcaggcccagcagcagctgatcgtggagcagcaggacgagcagctggagctggtgagcggcagcatcggcgtgctgaagaacatgagccagagaatcggcggcgagctggaggagcaggccgtgatgctggaggacttcagccacgagctggagagcacccagagcagactggacaacgtgatgaagaagctggccaaggtgagccacatgaccagcgacagaagacagtggtgcgccatcgccatcctgttcgccgtgctgctggtggtgctgatcctgttcctggtgctgtag

SEQ ID NO: 22758 - DNA, 465 bp, Artificial Sequence
  Description of Artificial Sequence: Synthetic coding sequence
atgaaggaccagatgagcaccagcagcgtgcaggccctggccgagagaaagaacagacaggccctgctgggcgacagcggcagccagaactggagcaccggcaccaccgacaagtacggcagactggacagagagctgcagagagccaacagccacttcatcgaggagcagcaggcccagcagcagctgatcgtggagcagcaggacgagcagctggagctggtgagcggcagcatcggcgtgctgaagaacatgagccagagaatcggcggcgagctggaggagcaggccgtgatgctggaggacttcagccacgagctggagagcacccagagcagactggacaacgtgatgaagaagctggccaaggtgagccacatgaccagcgacagaagacagtggtgcgccatcgccatcctgttcgccgtgctgctggtggtgctgatcctgttcctggtgctgtag

SEQ ID NO: 22759 - DNA, 1779 bp, Artificial Sequence
  Description of Artificial Sequence: Synthetic coding sequence
atggccccccccgtggccgagagaggcctgaagagcgtggtgtggcagaagatcaaggccaccgtgttcgacgactgcaagaaggagggcgagtggaagatcatgctgctggacgagttcaccaccaagctgctggccagctgctgcaagatgaccgacctgctggaggagggcatcaccgtggtggagaacatctacaagaacagagagcccgtgagacagatgaaggccctgtacttcatcacccccaccagcaagagcgtggactgcttcctgcacgacttcgccagcaagagcgagaacaagtacaaggccgcctacatctacttcaccgacttctgccccgacaacctgttcaacaagatcaaggccagctgcagcaagagcatcagaagatgcaaggagatcaacatcagcttcatcccccacgagagccaggtgtacaccctggacgtgcccgacgccttctactactgctacagccccgaccccggcaacgccaagggcaaggacgccatcatggagaccatggccgaccagatcgtgaccgtgtgcgccaccctggacgagaaccccggcgtgagatacaagagcaagcccctggacaacgccagcaagctggcccagctggtggagaagaagctggaggactactacaagatcgacgagaagagcctgatcaagggcaagacccacagccagctgctgatcatcgacagaggcttcgaccccgtgagcaccgtgctgcacgagctgaccttccaggccatggcctacgacctgctgcccatcgagaacgacacctacaagtacaagaccgacggcaaggagaaggaggccatcctggaggaggaggacgacctgtgggtgagaatcagacacagacacatcgccgtggtgctggaggagatccccaagctgatgaaggagatcagcagcaccaagaaggccaccgagggcaagaccagcctgagcgccctgacccagctgatgaagaagatgccccacttcagaaagcagatcaccaagcaggtggtgcacctgaacctggccgaggactgcatgaacaagttcaagctgaacatcgagaagctgtgcaagaccgagcaggacctggccctgggcaccgacgccgagggccagaaggtgaaggacagcatgagagtgctgctgcccgtgctgctgaacaagaaccacgacaactgcgacaagatcagagccatcctgctgtacatcttcagcatcaacggcaccaccgaggagaacctggacagactgatccagaacgtgaagatcgagaacgagagcgacatgatcagaaactggagctacctgggcgtgcccatcgtgccccagagccagcagggcaagcccctgagaaaggacagaagcgccgaggagaccttccagctgagcagatggacccccttcatcaaggacatcatggaggacgccatcgacaacagactggacagcaaggagtggccctactgcagccagtgccccgccgtgtggaacggcagcggcgccgtgagcgccagacagaagcccagagccaactacctggaggacagaaagaacggcagcaagctgatcgtgttcgtgatcggcggcatcacctacagcgaggtgagatgcgcctacgaggtgagccaggcccacaagagctgcgaggtgatcatcggcagcacccacgtgctgacccccaagaagctgctggacgacatcaagatgctgaacaagcccaaggacaaggtgagcctgatcaaggacgagtag

SEQ ID NO: 22760 - DNA, 2616 bp, Artificial Sequence
  Description of Artificial Sequence: Synthetic coding sequence
agaatctgcagccaggaggaggtggtgatcccctgcgcctacgacagcgacagcgagagcgtggacctggagctgagcaacctggagatcatcaagaagggcagcagcagcatcgagctgaccgacctggacatccccgacatccccggcctgcactgcgagcccctgagccacagccccagacacctgacccagcaggaccccctgagcgaggccatcgtggagaagctgatccagagcatccagaaggtgttcaacggcgagctgaagggcgagctggagaagctgaagttcctgggcgacctgagcagcctgagccaggccctgccctacgacgagaccgccaagagcttcatccacagccacatcgccgacatcgtgcacaccctgaacgtgctggtgcaggaggagagaccccacagcctgagcagcagcatgagacaggaggtgttcgtgaccatcgccgacctgagctaccaggacgtgcacctgctgctgggcagcgaggacagagccgagctgttcagcctgaccatcaagagcatcatcaccctgcccagcgtgagaaccctgacccagatccaggagatcatgcccaacggcacctgcaacaccgagtgcctgtacagacagaccttccaggccttcagcgagatgctgcagagcctggtggtgaaggacccccacctggagaacctggacaccatcatcaagctgcccctgagattccagagactgggccacctggtggccctgatggccctgctgtgcggcgacccccaggagaaggtggccgaggaggccgccgagggcatccacagcctgctgcacatcaccctgagactgaagtacatcacccacgacaagaaggaccagcagaacctgaagagagccctgaccaagtgcagagagttcctggagctgcacagcagcgccgccaagtgcttctacaactgccccttcagaatcgcccaggtgcccgagatcatgggcgtgatctgcgcccagctgagcatcatcagccagcccagagtgagacagcagatcatcaacaccgtgagcctgttcatcagcagacccaagtacaccgacatcgtgctgagcttcctgctgtgccaccccgtgccctacaacagacacctggccgaggtgtggagaatgctgagcgtggagctgcccagcaccacctggatcctgtggagactgctgagaaagctgcagaagtgccacaacgagcccgcccaggagaagatggcctacgtggccgtggccgccaccgacgccctgtacgaggtgttcctgggcaacagactgagagccgccaccttcagactgttcccccagctgctgatgaccctgctgatccagatccaccacagcatcggcctgaccatgagcgacgtggacatccccagcggcctgtacaccgagcaggaggtgcccagcgaggtgacccccctgtgcttcgccatgcaggccaccaagaccctgctgctgagaacctgctgcctgcaggagttcaacatcatggagaagaacaagggctgggccctgctgggcggcaaggacggccacctgcagggcctgttcctgctggccaacgccctgctggagagaaaccagctgctggcccagaaggtgatgtacctgctggtgcccctgctgaacagaggcaacgacaagcacaagctgaccagcgccggcttcttcgtggagctgctgagaagccccgtggccaagagactgcccagcatctacagcgtggccagattcaaggactggctgcaggacggcaaccacctgttcagaatcctgggcctgagaggcctgtacaacctggtgggccaccaggagatgagagaggacatcaagagcctgctgccctacatcgtggacagcctgagagagaccgacgagaagatcgtgctgagcgccatccagatcctgctgcagctggtgagaaccatggacttcaccaccctggccgccatgatgagaaccctgttcagcctgttcggcgacgtgagaagcgacgtgcacagattcagcgtgaccctgttcggcgccgccatcaagagcgtgaagaaccccgacaagaagagcatcgagaaccaggtgctggacagcctggtgcccctgctgctgtacagccaggacgagaacgacgccgtggccgaggagagcagacaggtgctgaccatctgcgcccagttcctgaagtggaagctgccccaggaggtgtacagcaaggacccctggcacatcaagcccaccgaggccggcaccatctgcagattcttcgagaagaagtgcaagggcaagatcaacatcctggagcagaccctgatgtacagcaagaaccccaagctgcccatcagaagaagcgccgtgctgttcgtgggcctgctgagcaagtacatggaccacaacgagctgagaagaatgggcaccgactggatcgaggacgacctgagagacctgctgtgcgaccccgagcccagcctgtgcatcatcgccagccagaccctgctgctggtgcagatggccagagccgagcccaagcccaagcagagagtgaactggctgcagaagctgatgggcagaagcagcgcctag

SEQ ID NO: 22761 - DNA, 1620 bp, Artificial Sequence
  Description of Artificial Sequence: Synthetic coding sequence
atgggcaccgagggcccccccccccccgccgccagcagaggcagacagggctgcctgctggtgcccgccagaaccaagaccaccatcgccctgctgtacgacgaggagagcgagaacgcctacgacatcagactgaagctgaccaaggaggtgctgaccatccagaagcaggacgtggtgtgcgtgggcggcagccaccagggcagaaacagaagaaccgtgaccctgagaagacagcccgtgggcggcctgggcctgagcatcaagggcggcagcgagcacaacgtgcccgtggtgatcagcaagatcttcgaggaccaggccgccgaccagaccggcatgctgttcgtgggcgacgccgtgctgcaggtgaacggcatccacgtggagaacgccacccacgaggaggtggtgcacctgctgagaaacgccggcgacgaggtgaccatcaccgtggagtacctgagagaggcccccgccttcctgaagctgcccctgggcagccccggccccagcagcgaccacagcagcggcgccagcagccccctgttcgacagcggcctgcacctgaacggcaacagcagcaccaccgcccccagcagccccagcagccccatcgccaaggaccccagatacgagaagagatggctggacaccctgagcgtgcccctgagcatggccagaatcagcagatacaaggccggcaccgagaagctgagatggaacgccttcgaggtgctggccctggacggcgtgagcagcggcatcctgagattctacaccgcccaggacggcaccgactggctgagagccgtgagcgccaacatcagagagctgaccctgcagaacatgaagatggccaacaagtgctgcagccccagcgaccaggtggtgcacatgggctgggtgaacgagaagctgcagggcgccgacagcagccagaccttcagacccaagttcctggccctgaagggccccagcttctacgtgttcagcaccccccccgtgagcaccttcgactgggtgagagccgagagaacctaccacctgtgcgaggtgctgttcaaggtgcacaagttctggctgaccgaggactgctggctgcaggccaacctgtacctgggcctgcaggacttcgacttcgaggaccagagaccctactgcttcagcatcgtggccggccacggcaagagccacgtgttcaacgtggagctgggcagcgagctggccatgtgggagaagagcttccagagagccaccttcatggaggtgcagagaaccggcagcagaacctacatgtgcagctggcagggcgagatgctgtgcttcaccgtggacttcgccctgggcttcacctgcttcgagagcaagaccaagaacgtgctgtggagattcaagttcagccagctgaagggcagcagcgacgacggcaagaccagagtgaagctgctgttccagaacctggacaccaagcagatcgagaccaaggagctggagttccaggacctgagagccgtgctgcactgcatccacagcttcatcgccgccaaggtggccagcgtggaccccggcttcatggacagccagagcctggccagaaagtacatgtacagcagctag

SEQ ID NO: 22762 - DNA, 540 bp, Artificial Sequence
  Description of Artificial Sequence: Synthetic coding sequence
tgagacctgaagaacgtgttcccccccgaggtggccgtgttcgagcccagcgaggccgagatcagccacacccagaaggccaccctggtgtgcctggccaccggcttctaccccgaccacgtggagctgagctggtgggtgaacggcaaggaggtgcacagcggcgtgagcaccgacccccagcccctgaaggagcagcccgccctgaacgacagcagatactgcctgagcagcagactgagagtgagcgccaccttctggcagaaccccagaaaccacttcagatgccaggtgcagttctacggcctgagcgagaacgacgagtggacccaggacagagccaagcccgtgacccagatcgtgagcgccgaggcctggggcagagccgactgcggcttcaccagcgagagctaccagcagggcgtgctgagcgccaccatcctgtacgagatcctgctgggcaaggccaccctgtacgccgtgctggtgagcgccctggtgctgatggccatggtgaagagaaaggacagcagaggctag

SEQ ID NO: 22763 - DNA, 465 bp, Artificial Sequence
  Description of Artificial Sequence: Synthetic coding sequence
tgaagccagccccacaccaagcccagcgtgttcgtgatgaagaacggcaccaacgtggcctgcctggtgaaggagttctaccccaaggacatcagaatcaacctggtgagcagcaagaagatcaccgagttcgaccccgccatcgtgatcagccccagcggcaagtacaacgccgtgaagctgggcaagtacgaggacagcaacagcgtgacctgcagcgtgcagcacgacaacaagaccgtgcacagcaccgacttcgaggtgaagaccgacagcaccgaccacgtgaagcccaaggagaccgagaacaccaagcagcccagcaagagctgccacaagcccaaggccatcgtgcacaccgagaaggtgaacatgatgagcctgaccgtgctgggcctgagaatgctgttcgccaagaccgtggccgtgaacttcctgctgaccgccaagctgttcttcctgtag

SEQ ID NO: 22764 - DNA, 357 bp, Artificial Sequence
  Description of Artificial Sequence: Synthetic coding sequence
atgagatgggccctgctggtgctgctggccttcctgagccccgccagccagaagagcagcaacctggagggcagaaccaagagcgtgaccagacagaccggcagcagcgccgagatcacctgcgacctgaccgtgaccaacaccttctacatccactggtacctgcaccaggagggcaaggccccccagagactgctgtactacgacgtgagcaccgccagagacgtgctggagagcggcctgagccccggcaagtactacacccacacccccagaagatggagctggatcctgagactgcagaacctgatcgagaacgacagcggcgtgtactactgcgccacctgggacagatag

SEQ ID NO: 22765 - DNA, 816 bp, Artificial Sequence
  Description of Artificial Sequence: Synthetic coding sequence
atgatccccaagctgctgagcctgctgtgcttcagactgtgcgtgggccagggcgacaccagaggcgacggcagcctgcccaagcccagcctgagcgcctggcccagcagcgtggtgcccgccaacagcaacgtgaccctgagatgctggacccccgccagaggcgtgagcttcgtgctgagaaagggcggcatcatcctggagagccccaagcccctggacagcaccgagggcgccgccgagttccacctgaacaacctgaaggtgagaaacgccggcgagtacacctgcgagtactacagaaaggccagcccccacatcctgagccagagaagcgacgtgctgctgctgctggtgaccggccacctgagcaagcccttcctgagaacctaccagagaggcaccgtgaccgccggcggcagagtgaccctgcagtgccagaagagagaccagctgttcgtgcccatcatgttcgccctgctgaaggccggcacccccagccccatccagctgcagagccccgccggcaaggagatcgacttcagcctggtggacgtgaccgccggcgacgccggcaactacagctgcatgtactaccagaccaagagccccttctgggccagcgagcccagcgaccagctggagatcctggtgaccgtgccccccggcaccaccagcagcaactacagcctgggcaacttcgtgagactgggcctggccgccgtgatcgtggtgatcatgggcgccttcctggtggaggcctggtacagcagaaacgtgagccccggcgagagcgaggccttcaagcccgagtag

SEQ ID NO: 22766 - DNA, 840 bp, Artificial Sequence
  Description of Artificial Sequence: Synthetic coding sequence
atgaaggagagaaagaagaaggagagaaaggagagaaagagaaagaaggagagaaacggcctgtgcgtgggccagggcgacaccagaggcgacggcagcctgcccaagcccagcctgagcgcctggcccagcagcgtggtgcccgccaacagcaacgtgaccctgagatgctggacccccgccagaggcgtgagcttcgtgctgagaaagggcggcatcatcctggagagccccaagcccctggacagcaccgagggcgccgccgagttccacctgaacaacctgaaggtgagaaacgccggcgagtacacctgcgagtactacagaaaggccagcccccacatcctgagccagagaagcgacgtgctgctgctgctggtgaccggccacctgagcaagcccttcctgagaacctaccagagaggcaccgtgaccgccggcggcagagtgaccctgcagtgccagaagagagaccagctgttcgtgcccatcatgttcgccctgctgaaggccggcacccccagccccatccagctgcagagccccgccggcaaggagatcgacttcagcctggtggacgtgaccgccggcgacgccggcaactacagctgcatgtactaccagaccaagagccccttctgggccagcgagcccagcgaccagctggagatcctggtgaccgtgccccccggcaccaccagcagcaactacagcctgggcaacttcgtgagactgggcctggccgccgtgatcgtggtgatcatgggcgccttcctggtggaggcctggtacagcagaaacgtgagccccggcgagagcgaggccttcaagcccgagtag

SEQ ID NO: 22767 - DNA, 951 bp, Artificial Sequence
  Description of Artificial Sequence: Synthetic coding sequence
atggccctgcagaccctgcagagcagctgggtgaccttcagaaagatcctgagccacttccccgaggagctgagcctggccttcgtgtacggcagcggcgtgtacagacaggccggccccagcagcgaccagaagaacgccatgctggacttcgtgttcaccgtggacgaccccgtggcctggcacagcaagaacctgaagaagaactggagccactacagcttcctgaaggtgctgggccccaagatcatcaccagcatccagaacaactacggcgccggcgtgtactacaacagcctgatcatgtgcaacggcagactgatcaagtacggcgtgatcagcaccaacgtgctgatcgaggacctgctgaactggaacaacctgtacatcgccggcagactgcagaagcccgtgaagatcatcagcgtgaacgaggacgtgaccctgagaagcgccctggacagaaacctgaagagcgccgtgaccgccgccttcctgatgctgcccgagagcttcagcgaggaggacctgttcatcgagatcgccggcctgagctacagcggcgacttcagaatggtggtgggcgaggacaagaccaaggtgctgaacatcgtgaagcccaacatcgcccacttcagagagctgtacggcagcatcctgcaggagaacccccaggtggtgtacaagagccagcagggctggctggagatcgacaagagccccgagggccagttcacccagctgatgaccctgcccaagaccctgcagcagcagatcaaccacatcatggacccccccggcaagaacagagacgtggaggagaccctgttccaggtggcccacgaccccgactgcggcgacgtggtgagactgggcctgaagaagagcgtgatctacagcagcctgaagctgcacaagatgtggaagggctggctgagaaagaccagctag

SEQ ID NO: 22768 - DNA, 2190 bp, Artificial Sequence
  Description of Artificial Sequence: Synthetic coding sequence
atgcagagcaccagcaaccacctgtggctgctgagcgacatcctgggccagggcgccaccgccaacgtgttcagaggcagacacaagaagaccggcgacctgttcgccatcaaggtgttcaacaacatcagcttcctgagacccgtggacgtgcagatgagagagttcgaggtgctgaagaagctgaaccacaagaacatcgtgaagctgttcgccatcgaggaggagaccaccaccagacacaaggtgctgatcatggagttctgcccctgcggcagcctgtacaccgtgctggaggagcccagcaacgcctacggcctgcccgagagcgagttcctgatcgtgctgagagacgtggtgggcggcatgaaccacctgagagagaacggcatcgtgcacagagacatcaagcccggcaacatcatgagagtgatcggcgaggacggccagagcgtgtacaagctgaccgacttcggcgccgccagagagctggaggacgacgagcagttcgtgagcctgtacggcaccgaggagtacctgcaccccgacatgtacgagagagccgtgctgagaaaggaccaccagaagaagtacggcgccaccgtggacctgtggagcatcggcgtgaccttctaccacgccgccaccggcagcctgcccttcagacccttcgagggccccagaagaaacaaggaggtgatgtacaagatcatcaccggcaagcccagcggcgccatcagcggcgtgcagaaggccgagaacggccccatcgactggagcggcgacatgcccgtgagctgcagcctgagcagaggcctgcaggtgctgctgacccccgtgctggccaacatcctggaggccgaccaggagaagtgctggggcttcgaccagttcttcgccgagaccagcgacatcctgcacagaatggtgatccacgtgttcagcctgcagcagatgaccgcccacaagatctacatccacagctacaacaccgccaccatcttccacgagctggtgtacaagcagaccaagatcatcagcagcaaccaggagctgatctacgagggcagaagactggtgctggagcccggcagactggcccagcacttccccaagaccaccgaggagaaccccatcttcgtggtgagcagagagcccctgaacaccatcggcctgatctacgagaagatcagcctgcccaaggtgcaccccagatacgacctggacggcgacgccagcatggccaaggccatcaccggcgtggtgtgctacgcctgcagaatcgccagcaccctgctgctgtaccaggagctgatgagaaagggcatcagatggctgatcgagctgatcaaggacgactacaacgagaccgtgcacaagaagaccgaggtggtgatcaccctggacttctgcatcagaaacatcgagaagaccgtgaaggtgtacgagaagctgatgaagatcaacctggaggccgccgagctgggcgagatcagcgacatccacaccaagctgctgagactgagcagcagccagggcaccatcgagaccagcctgcaggacatcgacagcagactgagccccggcggcagcctggccgacgcctgggcccaccaggagggcacccaccccaaggacagaaacgtggagaagctgcaggtgctgctgaactgcatgaccgagatctactaccagttcaagaaggacaaggccgagagaagactggcctacaacgaggagcagatccacaagttcgacaagcagaagctgtactaccacgccaccaaggccatgacccacttcaccgacgagtgcgtgaagaagtacgaggccttcctgaacaagagcgaggagtggatcagaaagatgctgcacctgagaaagcagctgctgagcctgaccaaccagtgcttcgacatcgaggaggaggtgagcaagtaccaggagtacaccaacgagctgcaggagaccctgccccagaagatgttcaccgccagcagcggcatcaagcacaccatgacccccatctaccccagcagcaacaccctggtggagatgaccctgggcatgaagaagctgaaggaggagatggagggcgtggtgaaggagctggccgagaacaaccacatcctggagagattcggcagcctgaccatggacggcggcctgagaaacgtggactgcctgtag

SEQ ID NO: 22769 - DNA, 312 bp, Artificial Sequence
  Description of Artificial Sequence: Synthetic coding sequence
atgcagagcaccagcaaccacctgtggctgctgagcgacatcctgggccagggcgccaccgccaacgtgttcagaggcagacacaagaagaccggcgacctgttcgccatcaaggtgttcaacaacatcagcttcctgagacccgtggacgtgcagatgagagagttcgaggtgctgaagaagctgaaccacaagaacatcgtgaagctgttcgccatcgaggaggagaccaccaccagacacaaggtgctgatcatggagttctgcccctgcggcagcctgtacaccgtgctggaggagcccagcaactag

SEQ ID NO: 22770 - DNA, 297 bp, Artificial Sequence
  Description of Artificial Sequence: Synthetic coding sequence
atgcagagcaccagcaaccacctgtggctgctgagcgacatcctgggccagggcgccaccgccaacgtgttcagaggcagacacaagaagaccggcgacctgttcgccatcaaggtgttcaacaacatcagcttcctgagacccgtggacgtgcagatgagagagttcgaggtgctgaagaagctgaaccacaagaacatcgtgaagctgttcgccatcgaggaggagaccaccaccagacacaaggtgctgatcatggagttctgcccctgcggcagcctgtacaccgtgctgtag

SEQ ID NO: 22771 - DNA, 924 bp, Artificial Sequence
  Description of Artificial Sequence: Synthetic coding sequence
atgcacgacgacgagagcaccatcaacagcagcagcagcgtggtgcacaagaaggaccacgtgttcatcagagacgaggccggccacggcgaccccagacccgagcccagacccacccagagcgtgcagagccaggccctgcactacagaaacagagagagattcgccaccatcaagagcgccagcctggtgaccagacagatccacgagcacgagcaggagaacgagctgagagagcagatgagcggctacaagagaatgagaagacagcaccagaagcagctgatcgccctggagaacaagctgaaggccgagatggacgagcacagactgaagctgcagaaggaggtggagacccacgccaacaacagcagcatcgagctggagaagctggccaagaagcaggtggccatcatcgagaaggaggccaaggtggccgccgccgacgagaagaagttccagcagcagatcctggcccagcagaagaaggacctgaccaccttcctggagagccagaagaagcagtacaagatctgcaaggagaagatcaaggaggagatgaacgaggaccacagcacccccaagaaggagaagcaggagagaatcagcaagcacaaggagaacctgcagcacacccaggccgaggaggaggcccacctgctgacccagcagagactgtactacgacaagaactgcagattcttcaagagaaagatcatgatcaagagacacgaggtggagcagcagaacatcagagaggagctgaacaagaagagaaccgagggcgacggcgcctgccacgccaaccccgacgagagcaccagagagctggagtacagacagctgcacaccctgcagaagctgcacggcagcgaccccttcaccgcccccgacggcaccggcaagcccgccggcgtgcagtag

SEQ ID NO: 22772 - DNA, 2697 bp, Artificial Sequence
  Description of Artificial Sequence: Synthetic coding sequence
atgagaaagggcgtgctgaaggaccccgagatcgccgacctgttctacaaggacgaccccgaggagctgttcatcggcctgcacgagatcggccacggcagcttcggcgccgtgtacttcgccaccaacgcccacaccagcgaggtggtggccatcaagaagatgagctacagcggcaagcagacccacgagaagtggcaggacatcctgaaggaggtgaagttcctgagacagctgaagcaccccaacaccatcgagtacaagggctgctacctgaaggagcacaccgcctggctggtgatggagtactgcctgggcagcgccagcgacctgctggaggtgcacaagaagcccctgcaggaggtggagatcgccgccatcacccacggcgccctgcacggcctggcctacctgcacagccacgccctgatccacagagacatcaaggccggcaacatcctgctgaccgagcccggccaggtgaagctggccgacttcggcagcgccagcatggccagccccgccaacagcttcgtgggcaccccctactggatggcccccgaggtgatcctggccatggacgagggccagtacgacggcaaggtggacatctggagcctgggcatcacctgcatcgagctggccgagagaaagccccccctgttcaacatgaacgccatgagcgccctgtaccacatcgcccagaacgacagccccaccctgcagagcaacgagtggaccgacagcttcagaagattcgtggactactgcctgcagaagatcccccaggagagacccaccagcgccgagctgctgagacacgacttcgtgagaagagacagacccctgagagtgctgatcgacctgatccagagaaccaaggacgccgtgagagagctggacaacctgcagtacagaaagatgaagaagatcctgttccaggagaccagaaacggccccctgaacgagagccaggaggacgaggaggacagcgagcacggcaccagcctgaacagagagatggacagcctgggcagcaaccacagcatccccagcatgagcgtgagcaccggcagccagagcagcagcgtgaacagcatgcaggaggtgatggacgagagcagcagcgagctggtgatgatgcacgacgacgagagcaccatcaacagcagcagcagcgtggtgcacaagaaggaccacgtgttcatcagagacgaggccggccacggcgaccccagacccgagcccagacccacccagagcgtgcagagccaggccctgcactacagaaacagagagagattcgccaccatcaagagcgccagcctggtgaccagacagatccacgagcacgagcaggagaacgagctgagagagcagatgagcggctacaagagaatgagaagacagcaccagaagcagctgatcgccctggagaacaagctgaaggccgagatggacgagcacagactgaagctgcagaaggaggtggagacccacgccaacaacagcagcatcgagctggagaagctggccaagaagcaggtggccatcatcgagaaggaggccaaggtggccgccgccgacgagaagaagttccagcagcagatcctggcccagcagaagaaggacctgaccaccttcctggagagccagaagaagcagtacaagatctgcaaggagaagatcaaggaggagatgaacgaggaccacagcacccccaagaaggagaagcaggagagaatcagcaagcacaaggagaacctgcagcacacccaggccgaggaggaggcccacctgctgacccagcagagactgtactacgacaagaactgcagattcttcaagagaaagatcatgatcaagagacacgaggtggagcagcagaacatcagagaggagctgaacaagaagagaacccagaaggagatggagcacgccatgctgatcagacacgacgagagcaccagagagctggagtacagacagctgcacaccctgcagaagctgagaatggacctgatcagactgcagcaccagaccgagctggagaaccagctggagtacaacaagagaagagagagagagctgcacagaaagcacgtgatggagctgagacagcagcccaagaacctgaaggccatggagatgcagatcaagaagcagttccaggacacctgcaaggtgcagaccaagcagtacaaggccctgaagaaccaccagctggaggtgacccccaagaacgagcacaagaccatcctgaagaccctgaaggacgagcagaccagaaagctggccatcctggccgagcagtacgagcagagcatcaacgagatgatggccagccaggccctgagactggacgaggcccaggaggccgagtgccaggccctgagactgcagctgcagcaggagatggagctgctgaacgcctaccagagcaagatcaagatgcagaccgaggcccagcacgagagagagctgcagaagctggagcagagagtgagcctgagaagagcccacctggagcagaagatcgaggaggagctggccgccctgcagaaggagagaagcgagagaatcaagaacctgctggagagacaggagagagagatcgagaccttcgacatggagagcctgagaatgggcttcggcaacctggtgaccctggacttccccaaggaggactacagatag

SEQ ID NO: 22773 - DNA, 2697 bp, Artificial Sequence; identical to SEQ ID NO: 22772
  Description of Artificial Sequence: Synthetic coding sequence

SEQ ID NO: 22774 - DNA, 411 bp, Artificial Sequence
  Description of Artificial Sequence: Synthetic coding sequence
atgagaaagggcgtgctgaaggaccccgagatcgccgacctgttctacaaggacgaccccgaggagctgttcatcggcctgcacgagatcggccacggcagcttcggcgccgtgtacttcgccaccaacgcccacaccagcgaggtggtggccatcaagaagatgagctacagcggcaagcagacccacgagaagtggcaggacatcctgaaggaggtgaagttcctgagacagctgaagcaccccaacaccatcgagtacaagggctgctacctgaaggagcacaccgcctggctggtgatggagtactgcctgggcagcgccagcgacctgctggaggtgcacaagaagcccctgcaggaggtggagatcgccgccatcacccacggcgccctgcacggcctggcctag

SEQ ID NO: 22775 - DNA, 57 bp, Artificial Sequence
  Description of Artificial Sequence: Synthetic coding sequence
atgagaaagggcgtgctgaaggaccccgagatcgccgacctgttctacaaggactag

SEQ ID NO: 22776 - DNA, 282 bp, Artificial Sequence
  Description of Artificial Sequence: Synthetic coding sequence
atgagaaagggcgtgctgaaggaccccgagatcgccgacctgttctacaaggacgaccccgaggagctgttcatcggcctgcacgagatcggccacggcagcttcggcgccgtgtacttcgccaccaacgcccacaccagcgaggtggtggccatcaagaagatgagctacagcggcaagcagacccacgagaagtggcaggacatcctgaaggaggtgaagttcctgagacagctgaagcaccccaacaccatcgagtacaagggctgctacctgaagtag

SEQ ID NO: 22777 - DNA, 66 bp, Artificial Sequence
  Description of Artificial Sequence: Synthetic coding sequence
atgagaaagggcgtgctgaaggaccccgagatcgccgacctgttctacaaggacgaccccgagtag

SEQ ID NO: 22778 - DNA, 189 bp, Artificial Sequence
  Description of Artificial Sequence: Synthetic coding sequence
atgagaaagggcgtgctgaaggaccccgagatcgccgacctgttctacaaggacgaccccgaggagctgttcatcggcctgcacgagatcggccacggcagcttcggcgccgtgtacttcgccaccaacgcccacaccagcgaggtggtggccatcaagaagatgagctacagcggcaagcagacctag

SEQ ID NO: 22779 - DNA, 111 bp, Artificial Sequence
  Description of Artificial Sequence: Synthetic coding sequence
atgagaaagggcgtgctgaaggaccccgagatcgccgacctgttctacaaggacgaccccgaggagctgttcatcggcctgcacgagatcggccacggcagcttcggctag

SEQ ID NO: 22780 - DNA, 174 bp, Artificial Sequence
  Description of Artificial Sequence: Synthetic coding sequence
atgagaaagggcgtgctgaaggaccccgagatcgccgacctgttctacaaggacgaccccgaggagctgttcatcggcctgcacgagatcggccacggcagcttcggcgccgtgtacttcgccaccaacgcccacaccagcgaggtggtggccatcaagaagatgagctactag

SEQ ID NO: 22781 - DNA, 1407 bp, Artificial Sequence
  Description of Artificial Sequence: Synthetic coding sequence
atgggcacccaggagggctggtgcctgctgctgtgcctggccctgagcggcgccgccgagaccaagccccaccccgccgagggccagtggagagccgtggacgtggtgctggactgcttcctggccaaggacggcgcccacagaggcgccctggccagcagcgaggacagagccagagccagcctggtgctgaagcaggtgcccgtgctggacgacggcagcctggaggacttcaccgacttccagggcggcaccctggcccaggacgacccccccatcatcttcgaggccagcgtggacctggtgcagatcccccaggccgaggccctgctgcacgccgactgcagcggcaaggaggtgacctgcgagatcagcagatacttcctgcagatgaccgagaccaccgtgaagaccgccgcctggttcatggccaacatgcaggtgagcggcggcggccccagcatcagcctggtgatgaagacccccagagtgaccaagaacgaggccctgtggcaccccaccctgaacctgcccctgagcccccagggcaccgtgagaaccgccgtggagttccaggtgatgacccagacccagagcctgagcttcctgctgggcagcagcgccagcctggactgcggcttcagcatggcccccggcctggacctgatcagcgtggagtggagactgcagcacaagggcagaggccagctggtgtacagctggaccgccggccagggccaggccgtgagaaagggcgccaccctggagcccgcccagctgggcatggccagagacgccagcctgaccctgcccggcctgaccatccaggacgagggcacctacatctgccagatcaccaccagcctgtacagagcccagcagatcatccagctgaacatccaggccagccccaaggtgagactgagcctggccaacgaggccctgctgcccaccctgatctgcgacatcgccggctactaccccctggacgtggtggtgacctggaccagagaggagctgggcggcagccccgcccaggtgagcggcgccagcttcagcagcctgagacagagcgtggccggcacctacagcatcagcagcagcctgaccgccgagcccggcagcgccggcgccacctacacctgccaggtgacccacatcagcctggaggagcccctgggcgccagcacccaggtggtgccccccgagagaagaaccgccctgggcgtgatcttcgccagcagcctgttcctgctggccctgatgttcctgggcctgcagagaagacaggcccccaccggcctgggcctgctgcaggccgagagatgggagaccaccagctgcgccgacacccagagcagccacctgcacgaggacagaaccgccagagtgagccagcccagctag

SEQ ID NO: 22782 - DNA, 1200 bp, Artificial Sequence
  Description of Artificial Sequence: Synthetic coding sequence
atgtgcgtgcagaactgcggccccagcttccagagcctgatcgtgaagaaggagttcgtgaaggagaacctggtgaagctgctgaaccccagatacaacctgcccctggacatccagaacagaatcctgaacttcatcaagacctggagccagggcttccccggcggcgtggacgtgagcgaggtgaaggaggtgtacctggacctggtgaagaagggcgtgcagttcccccccagcgaggccgaggccgagaccgccagacaggagaccgcccagatcagcagcaacccccccaccagcgtgcccaccgcccccgccctgagcagcgtgatcgcccccaagaacagcaccgtgaccctggtgcccgagcagatcggcaagctgcacagcgagctggacatggtgaagatgaacgtgagagtgatgagcgccatcctgatggagaacacccccggcagcgagaaccacgaggacatcgagctgctgcagaagctgtacaagaccggcagagagatgcaggagagaatcatggacctgctggtggtggtggagaacgaggacgtgaccgtggagctgatccaggtgaacgaggacctgaacaacgccatcctgggctacgagagattcaccagaaaccagcagagaatcctggagcagaacaagaaccagaaggaggccaccaacaccaccagcgagcccagcgcccccagccaggacctgctggacctgagccccagccccagaatgcccagagccaccctgggcgagctgaacaccatgaacaaccagctgagcggcctgaacttcagcctgcccagcagcgacgtgaccaacaacctgaagcccagcctgcacccccagatgaacctgctggccctggagaacaccgagatcccccccttcgcccagagaaccagccagaacctgaccagcagccacgcctacgacaacttcctggagcacagcaacagcgtgttcctgcagcccgtgagcctgcagaccatcgccgccgcccccagcaaccagagcctgccccccctgcccagcaaccaccccgccatgaccaagagcgacctgcagccccccaactactacgaggtgatggagttcgaccccctggcccccgccgtgaccaccgaggccatctacgaggagatcgacgcccaccagcacaagggcgcccagaacgacggcgactag

SEQ ID NO: 22783 - DNA, 1431 bp, Artificial Sequence
  Description of Artificial Sequence: Synthetic coding sequence
atggccttcggcaagagccacagagacccctacgccaccagcgtgggccacctgatcgagaaggccaccttcgccggcgtgcagaccgaggactggggccagttcatgcacatctgcgacatcatcaacaccacccaggacggccccaaggacgccgtgaaggccctgaagaagagaatcagcaagaactacaaccacaaggagatccagctgaccctgagcctgatcgacatgtgcgtgcagaactgcggccccagcttccagagcctgatcgtgaagaaggagttcgtgaaggagaacctggtgaagctgctgaaccccagatacaacctgcccctggacatccagaacagaatcctgaacttcatcaagacctggagccagggcttccccggcggcgtggacgtgagcgaggtgaaggaggtgtacctggacctggtgaagaagggcgtgcagttcccccccagcgaggccgaggccgagaccgccagacaggagaccgcccagatcagcagcaacccccccaccagcgtgcccaccgcccccgccctgagcagcgtgatcgcccccaagaacagcaccgtgaccctggtgcccgagcagatcggcaagctgcacagcgagctggacatggtgaagatgaacgtgagagtgatgagcgccatcctgatggagaacacccccggcagcgagaaccacgaggacatcgagctgctgcagaagctgtacaagaccggcagagagatgcaggagagaatcatggacctgctggtggtggtggagaacgaggacgtgaccgtggagctgatccaggtgaacgaggacctgaacaacgccatcctgggctacgagagattcaccagaaaccagcagagaatcctggagcagaacaagaaccagaaggaggccaccaacaccaccagcgagcccagcgcccccagccaggacctgctggacctgagccccagccccagaatgcccagagccaccctgggcgagctgaacaccatgaacaaccagctgagcggcctgaacttcagcctgcccagcagcgacgtgaccaacaacctgaagcccagcctgcacccccagatgaacctgctggccctggagaacaccgagatcccccccttcgcccagagaaccagccagaacctgaccagcagccacgcctacgacaacttcctggagcacagcaacagcgtgttcctgcagcccgtgagcctgcagaccatcgccgccgcccccagcaaccagagcctgccccccctgcccagcaaccaccccgccatgaccaagagcgacctgcagccccccaactactacgaggtgatggagttcgaccccctggcccccgccgtgaccaccgaggccatctacgaggagatcgacgcccaccagcacaagggcgcccagaacgacggcgactag

SEQ ID NO: 22784 - DNA, 1200 bp, Artificial Sequence; identical to SEQ ID NO: 22782
  Description of Artificial Sequence: Synthetic coding sequence

SEQ ID NO: 22785 - DNA, 1095 bp, Artificial Sequence
  Description of Artificial Sequence: Synthetic coding sequence
atgtgcgtgcagaactgcggccccagcttccagagcctgatcgtgaagaaggagttcgtgaaggagaacctggtgaagctgctgaaccccagatacaacctgcccctggacatccagaacagaatcctgaacttcatcaagacctggagccagggcttccccggcggcgtggacgtgagcgaggtgaaggaggtgtacctggacctggtgaagaagggcgtgcagttcccccccagcgaggccgaggccgagaccgccagacaggagatcggcaagctgcacagcgagctggacatggtgaagatgaacgtgagagtgatgagcgccatcctgatggagaacacccccggcagcgagaaccacgaggacatcgagctgctgcagaagctgtacaagaccggcagagagatgcaggagagaatcatggacctgctggtggtggtggagaacgaggacgtgaccgtggagctgatccaggtgaacgaggacctgaacaacgccatcctgggctacgagagattcaccagaaaccagcagagaatcctggagcagaacaagaaccagaaggaggccaccaacaccaccagcgagcccagcgcccccagccaggacctgctggacctgagccccagccccagaatgcccagagccaccctgggcgagctgaacaccatgaacaaccagctgagcggcctgaacttcagcctgcccagcagcgacgtgaccaacaacctgaagcccagcctgcacccccagatgaacctgctggccctggagaacaccgagatcccccccttcgcccagagaaccagccagaacctgaccagcagccacgcctacgacaacttcctggagcacagcaacagcgtgttcctgcagcccgtgagcctgcagaccatcgccgccgcccccagcaaccagagcctgccccccctgcccagcaaccaccccgccatgaccaagagcgacctgcagccccccaactactacgaggtgatggagttcgaccccctggcccccgccgtgaccaccgaggccatctacgaggagatcgacgcccaccagcacaagggcgcccagaacgacggcgactag

SEQ ID NO: 22786 - DNA, 1431 bp, Artificial Sequence; identical to SEQ ID NO: 22783
  Description of Artificial Sequence: Synthetic coding sequence

SEQ ID NO: 22787 - DNA, 900 bp, Artificial Sequence
  Description of Artificial Sequence: Synthetic coding sequence
atgctggagagccacctgatcatctacttcctgctggccgtgatccagttcctgctgggcatcttcaccaacggcatcatcgtggtggtgaacggcatcgacctgatcaagcacagaaagatggcccccctggacctgctgctgagctgcctggccgtgagcagaatcttcctgcagctgttcatcttctacgtgaacgtgatcgtgatcttcttcatcgagttcatcatgtgcagcgccaactgcgccatcctgctgttcatcaacgagctggagctgtggctggccacctggctgggcgtgttctactgcgccaaggtggccagcgtgagacaccccctgttcatctggctgaagatgagaatcagcaagctggtgccctggatgatcctgggcagcctgctgtacgtgagcatgatctgcgtgttccacagcaagtacgccggcttcatggtgccctacttcctgagaaagttcttcagccagaacgccaccatccagaaggaggacaccctggccatccagatcttcagcttcgtggccgagttcagcgtgcccctgctgatcttcctgttcgccgtgctgctgctgatcttcagcctgggcagacacaccagacagatgagaaacaccgtggccggcagcagagtgcccggcagaggcgcccccatcagcgccctgctgagcatcctgagcttcctgatcctgtacttcagccactgcatgatcaaggtgttcctgagcagcctgaagttccacatcagaagattcatcttcctgttcttcatcctggtgatcggcatctaccccagcggccacagcctgatcctgatcctgggcaaccccaagctgaagcagaacgccaagaagttcctgctgcacagcaagtgctgccagtag

SEQ ID NO: 22788 - DNA, 924 bp, Artificial Sequence
  Description of Artificial Sequence: Synthetic coding sequence
atgctgagagtggtggagggcatcttcatcttcgtggtggtgagcgagagcgtgttcggcgtgctgggcaacggcttcatcggcctggtgaactgcatcgactgcgccaagaacaagctgagcaccatcggcttcatcctgaccggcctggccatcagcagaatcttcctgatctggatcatcatcaccgacggcttcatccagatcttcagccccaacatctacgccagcggcaacctgatcgagtacatcagctacttctgggtgatcggcaaccagagcagcatgtggttcgccaccagcctgagcatcttctacttcctgaagatcgccaacttcagcaactacatcttcctgtggctgaagagcagaaccaacatggtgctgcccttcatgatcgtgttcctgctgatcagcagcctgctgaacttcgcctacatcgccaagatcctgaacgactacaagaccaagaacgacaccgtgtgggacctgaacatgtacaagagcgagtacttcatcaagcagatcctgctgaacctgggcgtgatcttcttcttcaccctgagcctgatcacctgcatcttcctgatcatcagcctgtggagacacaacagacagatgcagagcaacgtgaccggcctgagagacagcaacaccgaggcccacgtgaaggccatgaaggtgctgatcagcttcatcatcctgttcatcctgtacttcatcggcatggccatcgagatcagctgcttcaccgtgagagagaacaagctgctgctgatgttcggcatgaccaccaccgccatctacccctggggccacagcttcatcctgatcctgggcaacagcaagctgaagcaggccagcctgagagtgctgcagcagctgaagtgctgcgagaagagaaagaacctgagagtgacctag

SEQ ID NO: 22789 - DNA, 912 bp, Artificial Sequence
  Description of Artificial Sequence: Synthetic coding sequence
atggagagcgccctgcccagcatcttcaccctggtgatcatcgccgagttcatcatcggcaacctgagcaacggcttcatcgtgctgatcaactgcatcgactgggtgagcaagagagagctgagcagcgtggacaagctgctgatcatcctggccatcagcagaatcggcctgatctgggagatcctggtgagctggttcctggccctgcactacctggccatcttcgtgagcggcaccggcctgagaatcatgatcttcagctggatcgtgagcaaccacttcaacctgtggctggccaccatcttcagcatcttctacctgctgaagatcgccagcttcagcagccccgccttcctgtacctgaagtggagagtgaacaaggtgatcctgatgatcctgctgggcaccctggtgttcctgttcctgaacctgatccagatcaacatgcacatcaaggactggctggacagatacgagagaaacaccacctggaacttcagcatgagcgacttcgagaccttcagcgtgagcgtgaagttcaccatgaccatgttcagcctgacccccttcaccgtggccttcatcagcttcctgctgctgatcttcagcctgcagaagcacctgcagaagatgcagctgaactacaagggccacagagaccccagaaccaaggtgcacaccaacgccctgaagatcgtgatcagcttcctgctgttctacgccagcttcttcctgtgcgtgctgatcagctggatcagcgagctgtaccagaacaccgtgatctacatgctgtgcgagaccatcggcgtgttcagccccagcagccacagcttcctgctgatcctgggcaacgccaagctgagacaggccttcctgctggtggccgccaaggtgtgggccaagagatag

SEQ ID NO: 22790 - DNA, 954 bp, Artificial Sequence
  Description of Artificial Sequence: Synthetic coding sequence
atgggcggcgtgatcaagagcatcttcaccttcgtgctgatcgtggagttcatcatcggcaacctgggcaacagcttcatcgccctggtgaactgcatcgactgggtgaagggcagaaagatcagcagcgtggacagaatcctgaccgccctggccatcagcagaatcagcctggtgtggctgatcttcggcagctggtgcgtgagcgtgttcttccccgccctgttcgccaccgagaagatgttcagaatgctgaccaacatctggaccgtgatcaaccacttcagcgtgtggctggccaccggcctgggcaccttctacttcctgaagatcgccaacttcagcaacagcatcttcctgtacctgaagtggagagtgaagaaggtggtgctggtgctgctgctggtgaccagcgtgttcctgttcctgaacatcgccctgatcaacatccacatcaacgccagcatcaacggctacagaagaaacaagacctgcagcagcgacagcagcaacttcaccagattcagcagcctgatcgtgctgaccagcaccgtgttcatcttcatccccttcaccctgagcctggccatgttcctgctgctgatcttcagcatgtggaagcacagaaagaagatgcagcacaccgtgaagatcagcggcgacgccagcaccaaggcccacagaggcgtgaagagcgtgatcaccttcttcctgctgtacgccatcttcagcctgagcttcttcatcagcgtgtggaccagcgagagactggaggagaacctgatcatcctgagccaggtgatgggcatggcctaccccagctgccacagctgcgtgctgatcctgggcaacaagaagctgagacaggccagcctgagcgtgctgctgtggctgagatacatgttcaaggacggcgagcccagcggccacaaggagttcagagagagcagctag

SEQ ID NO: 22791 - DNA, 1017 bp, Artificial Sequence
  Description of Artificial Sequence: Synthetic coding sequence
atgctgggcagatgcttcccccccgacaccaaggagaagcagcagctgagaatgaccaagctgtgcgaccccgccgagagcgagctgagccccttcctgatcaccctgatcctggccgtgctgctggccgagtacctgatcggcatcatcgccaacggcttcatcatggccatccacgccgccgagtgggtgcagaacaaggccgtgagcaccagcggcagaatcctggtgttcctgagcgtgagcagaatcgccctgcagagcctgatgatgctggagatcaccatcagcagcaccagcctgagcttctacagcgaggacgccgtgtactacgccttcaagatcagcttcatcttcctgaacttctgcagcctgtggttcgccgcctggctgagcttcttctacttcgtgaagatcgccaacttcagctaccccctgttcctgaagctgagatggagaatcaccggcctgatcccctggctgctgtggctgagcgtgttcatcagcttcagccacagcatgttctgcatcaacatctgcaccgtgtactgcaacaacagcttccccatccacagcagcaacagcaccaagaagacctacctgagcgagatcaacgtggtgggcctggccttcttcttcaacctgggcatcgtgacccccctgatcatgttcatcctgaccgccaccctgctgatcctgagcctgaagagacacaccctgcacatgggcagcaacgccaccggcagcaacgaccccagcatggaggcccacatgggcgccatcaaggccatcagctacttcctgatcctgtacatcttcaacgccgtggccctgttcatctacctgagcaacatgttcgacatcaacagcctgtggaacaacctgtgccagatcatcatggccgcctaccccgccagccacagcatcctgctgatccaggacaaccccggcctgagaagagcctggaagagactgcagctgagactgcacctgtaccccaaggagtggaccctgtag

SEQ ID NO: 22792 - DNA, 957 bp, Artificial Sequence
  Description of Artificial Sequence: Synthetic coding sequence
atggccgacaaggtgcagaccaccctgctgttcctggccgtgggcgagttcagcgtgggcatcctgggcaacgccttcatcggcctggtgaactgcatggactgggtgaagaagagaaagatcgccagcatcgacctgatcctgaccagcctggccatcagcagaatctgcctgctgtgcgtgatcctgctggactgcttcatcctggtgctgtaccccgacgtgtacgccaccggcaaggagatgagaatcatcgacttcttctggaccctgaccaaccacctgagcatctggttcgccacctgcctgagcatctactacttcttcaagatcggcaacttcttccaccccctgttcctgtggatgaagtggagaatcgacagagtgatcagctggatcctgctgggctgcgtggtgctgagcgtgttcatcagcctgcccgccaccgagaacctgaacgccgacttcagattctgcgtgaaggccaagagaaagaccaacctgacctggagctgcagagtgaacaagacccagcacgccagcaccaagctgttcctgaacctggccaccctgctgcccttctgcgtgtgcctgatgagcttcttcctgctgatcctgagcctgagaagacacatcagaagaatgcagctgagcgccaccggctgcagagaccccagcaccgaggcccacgtgagagccctgaaggccgtgatcagcttcctgctgctgttcatcgcctactacctgagcttcctgatcgccaccagcagctacttcatgcccgagaccgagctggccgtgatcttcggcgagagcatcgccctgatctaccccagcagccacagcttcatcctgatcctgggcaacaacaagctgagacacgccagcctgaaggtgatctggaaggtgatgagcatcctgaagggcagaaagttccagcagcacaagcagatctag

SEQ ID NO: 22793 - DNA, 930 bp, Artificial Sequence
  Description of Artificial Sequence: Synthetic coding sequence
atgttcagccccgccgacaacatcttcatcatcctgatcaccggcgagttcatcctgggcatcctgggcaacggctacatcgccctggtgaactggatcgactggatcaagaagaagaagatcagcaccgtggactacatcctgaccaacctggtgatcgccagaatctgcctgatcagcgtgatggtggtgaacggcatcgtgatcgtgctgaaccccgacgtgtacaccaagaacaagcagcagatcgtgatcttcaccttctggaccttcgccaactacctgaacatgtggatcaccacctgcctgaacgtgttctacttcctgaagatcgccagcagcagccaccccctgttcctgtggctgaagtggaagatcgacatggtggtgcactggatcctgctgggctgcttcgccatcagcctgctggtgagcctgatcgccgccatcgtgctgagctgcgactacagattccacgccatcgccaagcacaagagaaacatcaccgagatgttccacgtgagcaagatcccctacttcgagcccctgaccctgttcaacctgttcgccatcgtgcccttcatcgtgagcctgatcagcttcttcctgctggtgagaagcctgtggagacacaccaagcagatcaagctgtacgccaccggcagcagagaccccagcaccgaggtgcacgtgagagccatcaagaccatgaccagcttcatcttcttcttcttcctgtactacatcagcagcatcctgatgaccttcagctacctgatgaccaagtacaagctggccgtggagttcggcgagatcgccgccatcctgtaccccctgggccacagcctgatcctgatcgtgctgaacaacaagctgagacagaccttcgtgagaatgctgacctgcagaaagatcgcctgcatgatctag

SEQ ID NO: 22794 - DNA, 939 bp, Artificial Sequence
  Description of Artificial Sequence: Synthetic coding sequence
atgcccagcgccatcgaggccatctacatcatcctgatcgccggcgagctgaccatcggcatctggggcaacggcttcatcgtgctggtgaactgcatcgactggctgaagagaagagacatcagcctgatcgacatcatcctgatcagcctggccatcagcagaatctgcctgctgtgcgtgatcagcctggacggcttcttcatgctgctgttccccggcacctacggcaacagcgtgctggtgagcatcgtgaacgtggtgtggaccttcgccaacaacagcagcctgtggttcaccagctgcctgagcatcttctacctgctgaagatcgccaacatcagccaccccttcttcttctggctgaagctgaagatcaacaaggtgatgctggccatcctgctgggcagcttcctgatcagcctgatcatcagcgtgcccaagaacgacgacatgtggtaccacctgttcaaggtgagccacgaggagaacatcacctggaagttcaaggtgagcaagatccccggcaccttcaagcagctgaccctgaacctgggcgtgatggtgcccttcatcctgtgcctgatcagcttcttcctgctgctgttcagcctggtgagacacaccaagcagatcagactgcacgccaccggcttcagagaccccagcaccgaggcccacatgagagccatcaaggccgtgatcatcttcctgctgctgctgatcgtgtactaccccgtgttcctggtgatgaccagcagcgccctgatcccccagggcaagctggtgctgatgatcggcgacatcgtgaccgtgatcttccccagcagccacagcttcatcctgatcatgggcaacagcaagctgagagaggccttcctgaagatgctgagattcgtgaagtgcttcctgagaagaagaaagcccttcgtgccctag

SEQ ID NO: 22795 - DNA, 3702 bp, Artificial Sequence
  Description of Artificial Sequence: Synthetic coding sequence
atgtggctgagccccgaggaggtgctggtggccaacgccctgtgggtgaccgagagagccaaccccttcttcgtgctgcagagaagaagaggccacggcagaggcggcggcctgaccggcctgctggtgggcaccctggacgtggtgctggacagcagcgccagagtggccccctacagaatcctgcaccagacccaggacagccaggtgtactggaccgtggcctgcggcagcagcagaaaggagatcaccaagcactgggagtggctggagaacaacctgctgcagaccctgagcatcttcgacagcgaggaggacatcaccaccttcgtgaagggcaagatccacggcatcatcgccgaggagaacaagaacctgcagccccagggcgacgaggaccccggcaagttcaaggaggccgagctgaagatgagaaagcagttcggcatgcccgagggcgagaagctggtgaactactacagctgcagctactggaagggcagagtgcccagacagggctggctgtacctgaccgtgaaccacctgtgcttctacagcttcctgctgggcaaggaggtgagcctggtggtgcagtgggtggacatcaccagactggagaagaacgccaccctgctgttccccgagagcatcagagtggacaccagagaccaggagctgttcttcagcatgttcctgaacatcggcgagaccttcaagctgatggagcagctggccaacctggccatgagacagctgctggacagcgagggcttcctggaggacaaggccctgcccagacccatcagaccccacagaaacatcagcgccctgaagagagacctggacgccagagccaagaacgagtgctacagagccaccttcagactgcccagagacgagagactggacggccacaccagctgcaccctgtggacccccttcaacaagctgcacatccccggccagatgttcatcagcaacaactacatctgcttcgccagcaaggaggaggacgcctgccacctgatcatccccctgagagaggtgaccatcgtggagaaggccgacagcagcagcgtgctgcccagccccctgagcatcagcaccaagagcaagatgaccttcctgttcgccaacctgaaggacagagacttcctggtgcagagaatcagcgacttcctgcagaagacccccagcaagcagcccggcagcatcggcagcagaaaggccagcgtggtggaccccagcaccgagagcagccccgccccccaggagggcagcgagcagcccgccagccccgccagccccctgagcagcagacagagcttctgcgcccaggaggcccccaccgccagccagggcctgctgaagctgttccagaagaacagccccatggaggacctgggcgccaagggcgccaaggagaagatgaaggaggagagctggcacatccacttcttcgagtacggcagaggcgtgtgcatgtacagaaccgccaagaccagagccctggtgctgaagggcatccccgagagcctgagaggcgagctgtggctgctgttcagcggcgcctggaacgagatggtgacccaccccggctactacgccgagctggtggagaagagcaccggcaagtacagcctggccaccgaggagatcgagagagacctgcacagaagcatgcccgagcaccccgccttccagaacgagctgggcatcgccgccctgagaagagtgctgaccgcctacgccttcagaaaccccaccatcggctactgccaggccatgaacatcgtgaccagcgtgctgctgctgtacggcagcgaggaggaggccttctggctgctggtggccctgtgcgagagaatgctgcccgactactacaacaccagagtggtgggcgccctggtggaccagggcatcttcgaggagctgaccagagacttcctgccccagctgagcgagaagatgcaggacctgggcgtgatcagcagcatcagcctgagctggttcctgaccctgttcctgagcgtgatgcccttcgagagcgccgtggtgatcgtggactgcttcttctacgagggcatcaaggtgatcctgcaggtggccctggccgtgctggacgccaacatggagcagctgctgggctgcagcgacgagggcgaggccatgaccatgctgggcagatacctggacaacgtggtgaacaagcagagcgtgagcccccccatcccccacctgagagccctgctgagcagcagcgacgacccccccgccgaggtggacatcttcgagctgctgaaggtgagctacgagaagttcagcagcctgagagccgaggacatcgagcagatgagattcaagcagagactgaaggtgatccagagcctggaggacaccgccaagagaagcgtggtgagagccatccccgtggacatcggcttcagcatcgaggagctggaggacctgtacatggtgttcaaggccaagcacctggccagccagtactggggctgcagcagaaccatggccggcagaagagaccccagcctgccctacctggagcagtacagaatcgacgccagccagttcagagagctgttcgccagcctgaccccctgggcctgcggcagccacacccccctgctggccggcagaatgttcagactgctggacgagaacaaggacagcctgatcaacttcaaggagttcgtgaccggcatgagcggcatgtaccacggcgacctgaccgagaagctgaaggtgctgtacaagctgcacctgccccccgccctgagccccgaggaggccgagagcgccctggaggccgcccactacttcaccgaggacagcagcagcgaggaggccctgccccaggaggagcaggagggcagcggcagcgaggagagaggcgaggagaagggcaccagcagccccgactacagacactacctgagaatgtgggccaaggagaaggaggcccagaaggagaccatcaaggacctgcccaagatgaaccaggagcagttcatcgagctgtgcaagaccctgtacaacatgttcagcgaggaccccatggagcaggacctgtaccacgccatcgccaccgtggccagcctgctgctgagaatcggcgaggtgggcaagaagttcagcgccagaaccggcagaaagcccagagactgcgccaccgaggaggacgagccccccgcccccgagctgcaccaggacgccgccagagagctgcagccccccgccgccggcgacccccaggccaaggccggcggcgacacccacctgggcaaggccccccaggagagccaggtggtggtggagggcggcagcggcgagggccagggcagccccagccagctgctgagcgacgacgagaccaaggacgacatgagcatgagcagctacagcgtggtgagcaccggcagcctgcagtgcgaggacctggccgacgacaccgtgctggtgggcggcgaggcctgcagccccaccgccagaatcggcggcaccgtggacaccgactggtgcatcagcttcgagcagatcctggccagcatcctgaccgagagcgtgctggtgaacttcttcgagaagagagtggacatcggcctgaagatcaaggaccagaagaaggtggagagacagttcagcaccgccagcgaccacgagcagcccggcgtgagcggctag

SEQ ID NO: 22796 - DNA, 3753 bp, Artificial Sequence
  Description of Artificial Sequence: Synthetic coding sequence
atgtggctgagccccgaggaggtgctggtggccaacgccctgtgggtgaccgagagagccaaccccttcttcgtgctgcagagaagaagaggccacggcagaggcggcggcctgaccggcctgctggtgggcaccctggacgtggtgctggacagcagcgccagagtggccccctacagaatcctgcaccagacccaggacagccaggtgtactggaccgtggcctgcggcagcagcagaaaggagatcaccaagcactgggagtggctggagaacaacctgctgcagaccctgagcatcttcgacagcgaggaggacatcaccaccttcgtgaagggcaagatccacggcatcatcgccgaggagaacaagaacctgcagccccagggcgacgaggaccccggcaagttcaaggaggccgagctgaagatgagaaagcagttcggcatgcccgagggcgagaagctggtgaactactacagctgcagctactggaagggcagagtgcccagacagggctggctgtacctgaccgtgaaccacctgtgcttctacagcttcctgctgggcaaggaggtgagcctggtggtgcagtgggtggacatcaccagactggagaagaacgccaccctgctgttccccgagagcatcagagtggacaccagagaccaggagctgttcttcagcatgttcctgaacatcggcgagaccttcaagctgatggagcagctggccaacctggccatgagacagctgctggacagcgagggcttcctggaggacaaggccctgcccagacccatcagaccccacagaaacatcagcgccctgaagagagacctggacgccagagccaagaacgagtgctacagagccaccttcagactgcccagagacgagagactggacggccacaccagctgcaccctgtggacccccttcaacaagctgcacatccccggccagatgttcatcagcaacaactacatctgcttcgccagcaaggaggaggacgcctgccacctgatcatccccctgagagaggtgaccatcgtggagaaggccgacagcagcagcgtgctgcccagccccctgagcatcagcaccaagagcaagatgaccttcctgttcgccaacctgaaggacagagacttcctggtgcagagaatcagcgacttcctgcagaagacccccagcaagcagcccggcagcatcggcagcagaaaggccagcgtggtggaccccagcaccgagagcagccccgccccccaggagggcagcgagcagcccgccagccccgccagccccctgagcagcagacagagcttctgcgcccaggaggcccccaccgccagccagggcctgctgaagctgttccagaagaacagccccatggaggacctgggcgccaagggcgccaaggagaagatgaaggaggagagctggcacatccacttcttcgagtacggcagaggcgtgtgcatgtacagaaccgccaagaccagagccctggtgctgaagggcatccccgagagcctgagaggcgagctgtggctgctgttcagcggcgcctggaacgagatggtgacccaccccggctactacgccgagctggtggagaagagcaccggcaagtacagcctggccaccgaggagatcgagagagacctgcacagaagcatgcccgagcaccccgccttccagaacgagctgggcatcgccgccctgagaagagtgctgaccgcctacgccttcagaaaccccaccatcggctactgccaggccatgaacatcgtgaccagcgtgctgctgctgtacggcagcgaggaggaggccttctggctgctggtggccctgtgcgagagaatgctgcccgactactacaacaccagagtggtgggcgccctggtggaccagggcatcttcgaggagctgaccagagacttcctgccccagctgagcgagaagatgcaggacctgggcgtgatcagcagcatcagcctgagctggttcctgaccctgttcctgagcgtgatgcccttcgagagcgccgtggtgatcgtggactgcttcttctacgagggcatcaaggtgatcctgcaggtggccctggccgtgctggacgccaacatggagcagctgctgggctgcagcgacgagggcgaggccatgaccatgctgggcagatacctggacaacgtggtgaacaagcagagcgtgagcccccccatcccccacctgagagccctgctgagcagcagcgacgacccccccgccgaggtggacatcttcgagctgctgaaggtgagctacgagaagttcagcagcctgagagccgaggacatcgagcagatgagattcaagcagagactgaaggtgatccagagcctggaggacaccgccaagagaagcgtggtgagagccatccccgtggacatcggcttcagcatcgaggagctggaggacctgtacatggtgttcaaggccaagcacctggccagccagtactggggctgcagcagaaccatggccggcagaagagaccccagcctgccctacctggagcagtacagaatcgacgccagccagttcagagagctgttcgccagcctgaccccctgggcctgcggcagccacacccccctgctggccggcagaatgttcagactgctggacgagaacaaggacagcctgatcaacttcaaggagttcgtgaccggcatgagcggcatgtaccacggcgacctgaccgagaagctgaaggtgctgtacaagctgcacctgccccccgccctgagccccgaggaggccgagagcgccctggaggccgcccactacttcaccgaggacagcagcagcgaggccagccccctggccagcgacctggacctgttcctgccctgggaggcccaggaggccctgccccaggaggagcaggagggcagcggcagcgaggagagaggcgaggagaagggcaccagcagccccgactacagacactacctgagaatgtgggccaaggagaaggaggcccagaaggagaccatcaaggacctgcccaagatgaaccaggagcagttcatcgagctgtgcaagaccctgtacaacatgttcagcgaggaccccatggagcaggacctgtaccacgccatcgccaccgtggccagcctgctgctgagaatcggcgaggtgggcaagaagttcagcgccagaaccggcagaaagcccagagactgcgccaccgaggaggacgagccccccgcccccgagctgcaccaggacgccgccagagagctgcagccccccgccgccggcgacccccaggccaaggccggcggcgacacccacctgggcaaggccccccaggagagccaggtggtggtggagggcggcagcggcgagggccagggcagccccagccagctgctgagcgacgacgagaccaaggacgacatgagcatgagcagctacagcgtggtgagcaccggcagcctgcagtgcgaggacctggccgacgacaccgtgctggtgggcggcgaggcctgcagccccaccgccagaatcggcggcaccgtggacaccgactggtgcatcagcttcgagcagatcctggccagcatcctgaccgagagcgtgctggtgaacttcttcgagaagagagtggacatcggcctgaagatcaaggaccagaagaaggtggagagacagttcagcaccgccagcgaccacgagcagcccggcgtgagcggctag

SEQ ID NO: 22797 - DNA, 1176 bp, Artificial Sequence
  Description of Artificial Sequence: Synthetic coding sequence
atggccggcagaagagaccccagcctgccctacctggagcagtacagaatcgacgccagccagttcagagagctgttcgccagcctgaccccctgggcctgcggcagccacacccccctgctggccggcagaatgttcagactgctggacgagaacaaggacagcctgatcaacttcaaggagttcgtgaccggcatgagcggcatgtaccacggcgacctgaccgagaagctgaaggtgctgtacaagctgcacctgccccccgccctgagccccgaggaggccgagagcgccctggaggccgcccactacttcaccgaggacagcagcagcgaggaggccctgccccaggaggagcaggagggcagcggcagcgaggagagaggcgaggagaagggcaccagcagccccgactacagacactacctgagaatgtgggccaaggagaaggaggcccagaaggagaccatcaaggacctgcccaagatgaaccaggagcagttcatcgagctgtgcaagaccctgtacaacatgttcagcgaggaccccatggagcaggacctgtaccacgccatcgccaccgtggccagcctgctgctgagaatcggcgaggtgggcaagaagttcagcgccagaaccggcagaaagcccagagactgcgccaccgaggaggacgagccccccgcccccgagctgcaccaggacgccgccagagagctgcagccccccgccgccggcgacccccaggccaaggccggcggcgacacccacctgggcaaggccccccaggagagccaggtggtggtggagggcggcagcggcgagggccagggcagccccagccagctgctgagcgacgacgagaccaaggacgacatgagcatgagcagctacagcgtggtgagcaccggcagcctgcagtgcgaggacctggccgacgacaccgtgctggtgggcggcgaggcctgcagccccaccgccagaatcggcggcaccgtggacaccgactggtgcatcagcttcgagcagatcctggccagcatcctgaccgagagcgtgctggtgaacttcttcgagaagagagtggacatcggcctgaagatcaaggaccagaagaaggtggagagacagttcagcaccgccagcgaccacgagcagcccggcgtgagcggctag

SEQ ID NO: 22798 - DNA, 975 bp, Artificial Sequence
  Description of Artificial Sequence: Synthetic coding sequence
atgggcgacctgctgcccagagcctggcccggcgccggctgcaccgagacccagaccaccagccagggcccccaggagctggccgtgcccaccgccgagtgctacagctgcagcttctacttctgcgtgtgccccgaggccctgccccaggaggagcaggagggcagcggcagcgaggagagaggcgaggagaagggcaccagcagccccgactacagacactacctgagaatgtgggccaaggagaaggaggcccagaaggagaccatcaaggacctgcccaagatgaaccaggagcagttcatcgagctgtgcaagaccctgtacaacatgttcagcgaggaccccatggagcaggacctgtaccacgccatcgccaccgtggccagcctgctgctgagaatcggcgaggtgggcaagaagttcagcgccagaaccggcagaaagcccagagactgcgccaccgaggaggacgagccccccgcccccgagctgcaccaggacgccgccagagagctgcagccccccgccgccggcgacccccaggccaaggccggcggcgacacccacctgggcaaggccccccaggagagccaggtggtggtggagggcggcagcggcgagggccagggcagccccagccagctgctgagcgacgacgagaccaaggacgacatgagcatgagcagctacagcgtggtgagcaccggcagcctgcagtgcgaggacctggccgacgacaccgtgctggtgggcggcgaggcctgcagccccaccgccagaatcggcggcaccgtggacaccgactggtgcatcagcttcgagcagatcctggccagcatcctgaccgagagcgtgctggtgaacttcttcgagaagagagtggacatcggcctgaagatcaaggaccagaagaaggtggagagacagttcagcaccgccagcgaccacgagcagcccggcgtgagcggctag

SEQ ID NO: 22799 - DNA, 1137 bp, Artificial Sequence
  Description of Artificial Sequence: Synthetic coding sequence
atgagcaaggagcccctgatcctgtggctgatgatcgagttctggtggctgtacctgacccccgtgaccagcgagaccgtggtgaccgaggtgctgggccacagagtgaccctgccctgcctgtacagcagctggagccacaacagcaacagcatgtgctggggcaaggaccagtgcccctacagcggctgcaaggaggccctgatcagaaccgacggcatgagagtgaccagcagaaagagcgccaagtacagactgcagggcaccatccccagaggcgacgtgagcctgaccatcctgaaccccagcgagagcgacagcggcgtgtactgctgcagaatcgaggtgcccggctggttcaacgacgtgaagatcaacgtgagactgaacctgcagagagccagcaccaccacccacagaaccgccaccaccaccaccagaagaaccaccaccaccagccccaccaccaccagacagatgaccaccacccccgccgccctgcccaccaccgtggtgaccacccccgacctgaccaccggcacccccctgcagatgaccaccatcgccgtgttcaccaccgccaacacctgcctgagcctgacccccagcaccctgcccgaggaggccaccggcctgctgacccccgagcccagcaaggagggccccatcctgaccgccgagagcgagaccgtgctgcccagcgacagctggagcagcgtggagagcaccagcgccgacaccgtgctgctgaccagcaaggagagcaaggtgtgggacctgcccagcaccagccacgtgagcatgtggaagaccagcgacagcgtgagcagcccccagcccggcgccagcgacaccgccgtgcccgagcagaacaagaccaccaagaccggccagatggacggcatccccatgagcatgaagaacgagatgcccatcagccagctgctgatgatcatcgcccccagcctgggcttcgtgctgttcgccctgttcgtggccttcctgctgagaggcaagctgatggagacctactgcagccagaagcacaccagactggactacatcggcgacagcaagaacgtgctgaacgacgtgcagcacggcagagaggacgaggacggcctgttcaccctgtag

SEQ ID NO: 22800 - DNA, 1053 bp, Artificial Sequence
  Description of Artificial Sequence: Synthetic coding sequence
atgagcaaggagcccctgatcctgtggctgatgatcgagttctggtggctgtacctgacccccgtgaccagcgagaccgtggtgaccgaggtgctgggccacagagtgaccctgccctgcctgtacagcagctggagccacaacagcaacagcatgtgctggggcaaggaccagtgcccctacagcggctgcaaggaggccctgatcagaaccgacggcatgagagtgaccagcagaaagagcgccaagtacagactgcagggcaccatccccagaggcgacgtgagcctgaccatcctgaaccccagcgagagcgacagcggcgtgtactgctgcagaatcgaggtgcccggctggttcaacgacgtgaagatcaacgtgagactgaacctgcagagagccagcaccaccacccacagaaccgccaccaccaccaccagaagaaccaccaccaccagccccaccaccaccagacagatgaccaccacccccgccgccctgcccaccaccgtggtgaccacccccgacctgaccaccggcacccccctgcagatgaccaccatcgccgtgttcaccaccgccaacacctgcctgagcctgacccccagcaccctgcccgaggaggccaccggcctgctgacccccgagcccagcaaggagggccccatcctgaccgccgagagcgagaccgtgctgcccagcgacagctggagcagcgtggagagcaccagcgccgacaccgtgctgctgaccagcaaggccagcgacaccgccgtgcccgagcagaacaagaccaccaagaccggccagatggacggcatccccatgagcatgaagaacgagatgcccatcagccagctgctgatgatcatcgcccccagcctgggcttcgtgctgttcgccctgttcgtggccttcctgctgagaggcaagctgatggagacctactgcagccagaagcacaccagactggactacatcggcgacagcaagaacgtgctgaacgacgtgcagcacggcagagaggacgaggacggcctgttcaccctgtag

SEQ ID NO: 22801 - DNA, 3504 bp, Artificial Sequence
  Description of Artificial Sequence: Synthetic coding sequence
atgcccaacagcgtgctgtgggccgtggacctgttcggcagagtgtacaccctgagcaccgccggccagtactgggagatgtgcaaggacagccagctggagttcaagagagtgagcgccaccacccagtgctgctggggcatcgcctgcgacaaccaggtgtacgtgtacgtgtgcgccagcgacgtgcccatcagaagaagagaggaggcctacgagaaccagagatggaaccccatgggcggcttctgcgagaagctgctgctgagcgacagatggggctggagcgacgtgagcggcctgcagcacagacccctggacagagtggccctgcccagcccccactgggagtgggagagcgactggtacgtggacgagaacttcggcggcgagcccaccgagaagggcggctggacctacgccatcgacttccccgccacctacaccaaggacaagaagtggaacagctgcgtgagaagaagaaagtggatcagatacagaagatacaagagcagagacatctgggccaagatccccagcaaggacgaccccaaggagctgcccgaccccttcaacgacctgagcgtgggcggctgggagatcaccgaggagcccgtgggcagactgagcgtgtgggccgtgagcctgcagggcaaggtgtggtacagagaggacgtgagccacagcaaccccgagggcagcagctggagcctgctggacacccccggcgaggtggtgcagatcagctgcggcccccacgacctgctgtgggccaccctgtgggagggccaggccctggtgagagagggcatcaacagaagcaaccccaagggcagcagctggagcatcgtggagccccccggcagcgagaacggcgtgatgcacatcagcgtgggcgtgagcgtggtgtgggccgtgaccaaggactggaaggtgtggttcagaagaggcgtgaacagccacaacccctgcggcaccagctggatcgagatggtgggcgagatgaccatggtgaacgtgggcatgaacgaccaggtgtggggcatcggctgcgaggacagagccgtgtacttcagacagggcgtgacccccagcgagctgagcggcaagacctggaaggccatcatcgccgccagagagtgcgacagaagccacagcggcagcagcagcagcctgctgagcgccggctgcttcttcggcgacgaggtgagaggcagcggcgagagcgcccccagcgacaccgacgccagcagcgaggtggagagacccggccccggccagatcctgcccgccgagcccctggacgacagcaagaacgccaccggcaacagcgccagcggcctgggcgccggcagaaccgccgaggacaccgtggaggacgcctgccccgccgagggcagcagagaggccagacccaacacccaccccggccccgcccccacccccgccgagctgccctggaccaacatcgacctgaaggaggccaagaaggtgcccagccacagcgccgccggcttccccgagaccaccagcctgagcagcctgggcctgctgcccctgggcctggaggagccctacggcgtggacgaccaccccctgtgggcctgggtgagcggcggcggctgcgtggtggaggcctgcgccatgcccagatggttcaccgtgcaggccgccggcctgagcagcagcgtgcacatgctgagcctgagcatcacccccgcccagaccgccgcctggagaaagcagatcttccagcagctgaccgagagaaccaagagagagctggagaacttcagacactacgagcaggccgtggagcagagcgtgtgggtgaagaccggcgccctgcagtggtggtgcgactggaagccccacaagtgggtggacgtgagactggccctggagcagttcaccggccacgacggcgtgagagacagcatcctgttcatctactacgtggtgcacgaggagaagaagtacatccacatcttcctgaacgaggtggtggccctggtgcccgtgctgaacgagaccaagcacagcttcgccctgtacacccccgagagaaccagacagagatggcccgtgagactggccgccgccaccgagcaggacatgaacgactggctggccctgctgagcctgagctgctgcgagagcagaaaggtgcagggcagacccagcccccaggccatctggagcatcacctgcaagggcgacatcttcgtgagcgagcccagccccgacctggaggcccacgagcaccccctgccctgcgaccagatgttctggagacagatgggcggccacctgagaatggtggaggccaacagcagaggcgtggtgtggggcatcggctacgaccacaccgcctgggtgtacaccggcggctacggcggcggctgcttccagggcctggccagcagcaccagcaacatctacacccagagcgacgtgaagtgcgtgcacatctacgagaaccagagatggaaccccgtgaccggctacaccagcagcagaggcctgcccaccgacagatacatgtggagcgacgccagcggcctgcaggagtgcaccaaggccggcaccaagccccccagcctgcagtgggcctgggtgagcgactggttcgtggacttcagcgtgcccggcggcaccgaccaggagggctggcagtacgccagcgacttccccgccagctaccacggcagcaagaccatgaaggacttcgtgagaagaagatgctgggccagaaagtgcaagctggtgaccagcggcccctggctggaggtgccccccatcgccctgagagacgtgagcatcatccccgagagccccggcgccgagggcagcggccacagcatcgccctgtgggccgtgagcgacaagggcgacgtgctgtgcagactgggcgtgagcgagctgaaccccgccggcagcagctggctgcacgtgggcaccgaccagcccttcgccagcatcagcatcggcgcctgctaccaggtgtgggccgtggccagagacggcagcgccttctacagaggcagcgtgtaccccagccagcccgccggcgactgctggtaccacatccccagcccccccagacagagactgaagcaggtgagcgccggccagaccagcgtgtacgccctggacgagaacggcaacctgtggtacagacagggcatcacccccagctacccccagggcagcagctgggagcacgtgagcaacaacgtgtgcagagtgagcgtgggccccctggaccaggtgtgggtgatcgccaacaaggtgcagggcagccacagcctgagcagaggcaccgtgtgccacagaaccggcgtgcagccccacgagcccaagggccacggctgggactacggcatcggcggcggctgggaccacatcagcgtgagagccaacgccaccagagcccccagaagcagcagccaggagcaggagcccagcgccccccccgaggcccacggccccgtgtgctgctag

SEQ ID NO: 22802 - DNA, 306 bp, Artificial Sequence
  Description of Artificial Sequence: Synthetic coding sequence
atgcccaacagcgtgctgtgggccgtggacctgttcggcagagtgtacaccctgagcaccgccggccagtactgggagatgtgcaaggacagccagctggagttcaagagagtgagcgccaccacccagtgctgctggggcatcgcctgcgacaaccaggtgtacgtgtacgtgtgcgccagcgacgtgcccatcagaagaagagaggaggcctacgagaaccagagatggaaccccatgggcggcttctgcgagaagctgctgctgagcgacagatggggctggagcgacgtgagcggcctgtag

SEQ ID NO: 22803 - DNA, 3498 bp, Artificial Sequence
  Description of Artificial Sequence: Synthetic coding sequence
atgcccaacagcgtgctgtgggccgtggacctgttcggcagagtgtacaccctgagcaccgccggccagtactgggagatgtgcaaggacagccagctggagttcaagagagtgagcgccaccacccagtgctgctggggcatcgcctgcgacaaccaggtgtacgtgtacgtgtgcgccagcgacgtgcccatcagaagaagagaggaggcctacgagaaccagagatggaaccccatgggcggcttctgcgagaagctgctgctgagcgacagatggggctggagcgacgtgagcggcctgcagcacagacccctggacagagtggccctgcccagcccccactgggagtgggagagcgactggtacgtggacgagaacttcggcggcgagcccaccgagaagggcggctggacctacgccatcgacttccccgccacctacaccaaggacaagaagtggaacagctgcgtgagaagaagaaagtggatcagatacagaagatacaagagcagagacatctgggccaagatccccagcaaggacgaccccaaggagctgcccgaccccttcaacgacctgagcgtgggcggctgggagatcaccgaggagcccgtgggcagactgagcgtgtgggccgtgagcctgcagggcaaggtgtggtacagagaggacgtgagccacagcaaccccgagggcagcagctggagcctgctggacacccccggcgaggtggtgcagatcagctgcggcccccacgacctgctgtgggccaccctgtgggagggccaggccctggtgagagagggcatcaacagaagcaaccccaagggcagcagctggagcatcgtggagccccccggcagcgagaacggcgtgatgcacatcagcgtgggcgtgagcgtggtgtgggccgtgaccaaggactggaaggtgtggttcagaagaggcgtgaacagccacaacccctgcggcaccagctggatcgagatggtgggcgagatgaccatggtgaacgtgggcatgaacgaccaggtgtggggcatcggctgcgaggacagagccgtgtacttcagacagggcgtgacccccagcgagctgagcggcaagacctggaaggccatcatcgccgccagagagtgcgacagaagccacagcggcagcagcagcagcctgctgagcgccggctgcttcttcggcgacgaggtgagaggcagcggcgagagcgcccccagcgacaccgacgccagcagcgaggtggagagacccggccccggccagatcctgcccgccgagcccctggacgacagcaagaacgccaccggcaacagcgccagcggcctgggcgccggcagaaccgccgaggacaccgtggaggacgcctgccccgccgagggcagcagagaggccagacccaacacccaccccggccccgcccccacccccgccgagctgccctggaccaacatcgacctgaaggaggccaagaaggtgcccagccacagcgccgccggcttccccgagaccaccagcctgagcagcctgggcctgctgcccctgggcctggaggagccctacggcgtggacgaccaccccctgtgggcctgggtgagcggcggcggctgcgtggtggaggcctgcgccatgcccagatggttcaccgtgcaggccggcctgagcagcagcgtgcacatgctgagcctgagcatcacccccgcccagaccgccgcctggagaaagcagatcttccagcagctgaccgagagaaccaagagagagctggagaacttcagacactacgagcaggccgtggagcagagcgtgtgggtgaagaccggcgccctgcagtggtggtgcgactggaagccccacaagtgggtggacgtgagactggccctggagcagttcaccggccacgacggcgtgagagacagcatcctgttcatctactacgtggtgcacgaggagaagaagtacatccacatcttcctgaacgaggtggtggccctggtgcccgtgctgaacgagaccaagcacagcttcgccctgtacacccccgagagaaccagacagagatggcccgtgagactggccgccgccaccgagcaggacatgaacgactggctggccctgctgagcctgagctgctgcgagagcagaaaggtgcagggcagacccagcccccaggccatctggagcatcacctgcaagggcgacatcttcgtgagcgagcccagccccgacctggaggcccacgagcaccccctgccctgcgaccagatgttctggagacagatgggcggccacctgagaatggtggaggccaacagcagaggcgtggtgtggggcatcggctacgaccacaccgcctgggtgtacaccggcggctacggcggcggctgcttccagggcctggccagcagcaccagcaacatctacacccagagcgacgtgaagtgcgtgcacatctacgagaaccagagatggaaccccgtgaccggctacaccagcagaggcctgcccaccgacagatacatgtggagcgacgccagcggcctgcaggagtgcaccaaggccggcaccaagccccccagcctgcagtgggcctgggtgagcgactggttcgtggacttcagcgtgcccggcggcaccgaccaggagggctggcagtacgccagcgacttccccgccagctaccacggcagcaagaccatgaaggacttcgtgagaagaagatgctgggccagaaagtgcaagctggtgaccagcggcccctggctggaggtgccccccatcgccctgagagacgtgagcatcatccccgagagccccggcgccgagggcagcggccacagcatcgccctgtgggccgtgagcgacaagggcgacgtgctgtgcagactgggcgtgagcgagctgaaccccgccggcagcagctggctgcacgtgggcaccgaccagcccttcgccagcatcagcatcggcgcctgctaccaggtgtgggccgtggccagagacggcagcgccttctacagaggcagcgtgtaccccagccagcccgccggcgactgctggtaccacatccccagcccccccagacagagactgaagcaggtgagcgccggccagaccagcgtgtacgccctggacgagaacggcaacctgtggtacagacagggcatcacccccagctacccccagggcagcagctgggagcacgtgagcaacaacgtgtgcagagtgagcgtgggccccctggaccaggtgtgggtgatcgccaacaaggtgcagggcagccacagcctgagcagaggcaccgtgtgccacagaaccggcgtgcagccccacgagcccaagggccacggctgggactacggcatcggcggcggctgggaccacatcagcgtgagagccaacgccaccagagcccccagaagcagcagccaggagcaggagcccagcgccccccccgaggcccacggccccgtgtgctgctag

SEQ ID NO: 22804 - DNA, 2331 bp, Artificial Sequence
  Description of Artificial Sequence: Synthetic coding sequence
atgggcggcttctgcgagaagctgctgctgagcgacagatggggctggagcgacgtgagcggcctgcagcacagacccctggacagagtggccctgcccagcccccactgggagtgggagagcgactggtacgtggacgagaacttcggcggcgagcccaccgagaagggcggctggacctacgccatcgacttccccgccacctacaccaaggacaagaagtggaacagctgcgtgagaagaagaaagtggatcagatacagaagatacaagagcagagacatctgggccaagatccccagcaaggacgaccccaaggagctgcccgaccccttcaacgacctgagcgtgggcggctgggagatcaccgaggagcccgtgggcagactgagcgtgtgggccgtgagcctgcagggcaaggtgctgtgcccctgcctggccagccaggtgtggtacagagaggacgtgagccacagcaaccccgagggcagcagctggagcctgctggacacccccggcgaggtggtgcagatcagctgcggcccccacgacctgctgtgggccaccctgtgggagggccaggccctggtgagagagggcatcaacagaagcaaccccaagggcagcagctggagcatcgtggagccccccggcagcgagaacggcgtgatgcacatcagcgtgggcgtgagcgtggtgtgggccgtgaccaaggactggaaggtgtggttcagaagaggcgtgaacagccacaacccctgcggcaccagctggatcgagatggtgggcgagatgaccatggtgaacgtgggcatgaacgaccaggtgtggggcatcggctgcgaggacagagccgtgtacttcagacagggcgtgacccccagcgagctgagcggcaagacctggaaggccatcatcgccgccagagagtgcgacagaagccacagcggcagcagcagcagcctgctgagcgccggctgcttcttcggcgacgaggtgagaggcagcggcgagagcgcccccagcgacaccgacgccagcagcgaggtggagagacccggccccggccagatcctgcccgccgagcccctggacgacagcaagaacgccaccggcaacagcgccagcggcctgggcgccggcagaaccgccgaggacaccgtggaggacgcctgccccgccgagggcagcagagaggccagacccaacacccaccccggccccgcccccacccccgccgagctgccctggaccaacatcgacctgaaggaggccaagaaggtgcccagccacagcgccgccggcttccccgagaccaccagcctgagcagcctgggcctgctgcccctgggcctggaggagccctacggcgtggacgaccaccccctgtgggcctgggtgagcggcggcggctgcgtggtggaggcctgcgccatgcccagatggttcaccgtgcaggccggcctgagcagcagcgtgcacatgctgagcctgagcatcacccccgcccagaccgccgcctggagaaagcagatcttccagcagctgaccgagagaaccaagagagagctggagaacttcagacactacgagcaggccgtggagcagagcgtgtgggtgaagaccggcgccctgcagtggtggtgcgactggaagccccacaagtgggtggacgtgagactggccctggagcagttcaccggccacgacggcgtgagagacagcatcctgttcatctactacgtggtgcacgaggagaagaagtacatccacatcttcctgaacgaggtggtggccctggtgcccgtgctgaacgagaccaagcacagcttcgccctgtacacccccgagagaaccagacagagatggcccgtgagactggccgccgccaccgagcaggacatgaacgactggctggccctgctgagcctgagctgctgcgagagcagaaaggtgcagggcagacccagcccccaggccatctggagcatcacctgcaagggcgacatcttcgtgagcgagcccagccccgacctggaggcccacgagcaccccctgccctgcgaccagatgttctggagacagatgggcggccacctgagaatggtggaggccaacagcagaggcgtggtgtggggcatcggctacgaccacaccgcctgggtgtacaccggcggctacggcggcggctgcttccagggcctggccagcagcaccagcaacatctacacccagagcgacgtgaagtgcgtgcacatctacgagaaccagagatggaaccccgtgaccggctacaccagcagcagagacagaatcagcccctgctggtag

SEQ ID NO: 22805 - DNA, 627 bp, Artificial Sequence
  Description of Artificial Sequence: Synthetic coding sequence
atgccccccaagaaggacgtgcccgtgaagaagcccgccggccccagcatcagcaagcccgccgccaagcccgccgccgccggcgccccccccgccaagaccaaggccgagcccgccgtgccccaggccccccagaagacccaggagccccccgtggacctgagcaaggtggtgatcgagttcaacaaggaccagctggaggagttcaaggaggccttcgagctgttcgacagagtgggcgacggcaagatcctgtacagccagtgcggcgacgtgatgagagccctgggccagaaccccaccaacgccgaggtgctgaaggtgctgggcaaccccaagagcgacgagctgaagagcagaagagtggacttcgagaccttcctgcccatgctgcaggccgtggccaagaacagaggccagggcacctacgaggactacctggagggcttcagagtgttcgacaaggagggcaacggcaaggtgatgggcgccgagctgagacacgtgctgaccaccctgggcgagaagatgaccgaggaggaggtggagaccgtgctggccggccacgaggacagcaacggctgcatcaactacgaggccttcctgaagcacatcctgagcgtgtag

SEQ ID NO: 22806 - DNA, 2790 bp, Artificial Sequence
  Description of Artificial Sequence: Synthetic coding sequence
atgaccaagaagagaaagagacagcacgacttccagaaggtgaagctgaaggtgggcaagaagaagcccaagctgcagaacgccacccccaccaacttcaagaccaagaccatccacctgcccgagcagctgaaggaggacggcaccctgcccaccaacaacagaaagctgaacatcaaggacctgctgagccagatgcaccactacaacgccggcgtgaagcagagcgccctgctgggcctgaaggacctgctgagccagtaccccttcatcatcgacgcccacctgagcaacatcctgagcgaggtgaccgccgtgttcaccgacaaggacgccaacgtgagactggccgccgtgcagctgctgcagttcctggcccccaagatcagagccgagcagatcagccccttcttccccctggtgagcgcccacctgagcagcgccatgacccacatcaccgagggcatccaggaggacagcctgaaggtgctggacatcctgctggagcagtaccccgccctgatcaccggcagaagcagcatcctgctgaagaacttcgtggagctgatcagccaccagcagctgagcaagggcctgatcaacagagacagaagccagagctggatcctgagcgtgaaccccaacagaagactgaccagccagcagtggagactgaaggtgctggtgagactgagcaagttcctgcaggccctggccgacggcagcagcagactgagagagagcgagggcctgcaggagcagaaggagaacccccacgccaccagcaacagcatcttcatcaactggaaggagcacgccaacgaccagcagcacatccaggtgtacgagaacggcggcagccagcccaacgtgagcagccagttcagactgagatacctggtgggcggcctgagcggcgtggacgagggcctgagcagcaccgagaacctgaagggcttcatcgagatcatcatccccctgctgatcgagtgctgggtggaggccgtgcccccccagctggccacccccgtgggcaacggcatcgagagagagcccctgcaggtgatgcagcaggtgctgaacatcatcagcctgctgtggaagctgagcaagcagcaggacgagacccacaagctggagagctggctgagaaagaactacctgatcgacttcaagcaccacttcatgagcagattcccctacgtgctgaaggagatcaccaagcacaagagaaaggagcccaacaagagcatcaagcactgcaccgtgctgagcaacaacatcgaccacctgctgctgaacctgaccctgagcgacatcatggtgagcctggccaacgccagcaccctgcagaaggactgcagctggatcgagatgatcagaaagttcgtgaccgagaccctggaggacggcagcagactgaacagcaagcagctgaacagactgctgggcgtgagctggagactgatgcagatccagcccaacagagaggacaccgagaccctgatcaaggccgtgtacaccctgtaccagcagagaggcctgatcctgcccgtgagaaccctgctgctgaagttcttcagcaagatctaccagaccgaggagctgagaagctgcagattcagatacagaagcaaggtgctgagcagatggctggccggcctgcccctgcagctggcccacctgggcagcagaaaccccgagctgagcacccagctgatcgacatcatccacaccgccgccgccagagccaacaaggagctgctgaagagcctgcaggccaccgccctgagaatctacgacccccaggagggcgccgtggtggtgctgcccgccgacagccagcagagactggtgcagctggtgtacttcctgcccagcctgcccgccgacctgctgagcagactgagcagatgctgcatcatgggcagactgagcagcagcctggccgccatgctgatcggcatcctgcacatgagaagcagcttcagcggctggaagtacagcgccaaggactggctgatgagcgacgtggactacttcagcttcctgttcagcaccctgaccggcttcagcaaggaggagctgacctggctgcagagcctgagaggcgtgccccacgtgatccagacccagctgagccccgtgctgctgtacctgaccgacctggaccagttcctgcaccactgggacgtgaccgaggccgtgttccacagcctgctggtgatccccgccagaagccagaacttcgacatcctgcagagcgccatcagcaagcacctggtgggcctgaccgtgatccccgacagcaccgccggctgcgtgttcggcgtgatctgcaagctgctggaccacacctgcgtggtgagcgagaccctgctgcccttcctggccagctgctgctacagcctgctgtacttcctgctgaccatcgagaagggcgaggccgagcacctgagaaagagagacaagctgtggggcgtgtgcgtgagcatcctggccctgctgcccagagtgctgagactgatgctgcagagcctgagagtgaacagagtgggccccgaggagctgcccgtggtgggccagctgctgagactgctgctgcagcacgcccccctgagaacccacatgctgaccaacgccatcctggtgcagcagatcatcaagaacatcaccaccctgaagagcggcagcgtgcaggagcagtggctgaccgacctgcactactgcttcaacgtgtacatcaccggccacccccagggccccagcgccctggccaccgtgtactag

SEQ ID NO: 22807 - DNA, 516 bp, Artificial Sequence
  Description of Artificial Sequence: Synthetic coding sequence
atgcagcaggtgctgaacatcatcagcctgctgtggaagctgagcaagcagcaggacgagacccacaagctggagagctggctgagaaagaactacctgatcgacttcaagcaccacttcatgagcagattcccctacgtgctgaaggagatcaccaagcacaagagaaaggagcccaacaagagcatcaagcactgcaccgtgctgagcaacaacatcgaccacctgctgctgaacctgaccctgagcgacatcatggtgagcctggccaacgccagcaccctgcagaaggactgcagctggatcgagatgatcagaaagttcgtgaccgagaccctggaggacggcagcagactgaacagcaagcagctgaacagactgctgggcgtgagctggagactgatgcagatccagcccaacagagaggacaccgagaccctgatcaaggccgtgtacaccctgtaccagcagagaggcctgatcctgcccgtgagaaccctgctgctgaagttctag

SEQ ID NO: 22808 - DNA, 2394 bp, Artificial Sequence
  Description of Artificial Sequence: Synthetic coding sequence
atgaccaagaagagaaagagacagcacgacttccagaaggtgaagctgaaggtgggcaagaagaagcccaagctgcagaacgccacccccaccaacttcaagaccaagaccatccacctgcccgagcagctgaaggaggacggcaccctgcccaccaacaacagaaagctgaacatcaaggacctgctgagccagatgcaccactacaacgccggcgtgaagcagagcgccctgctgggcctgaaggacctgctgagccagttcctggcccccaagatcagagccgagcagatcagccccttcttccccctggccctggccgacggcagcagcagactgagagagagcgagggcctgcaggagcagaaggagaacccccacgccaccagcaacagcatcttcatcaactggaaggagcacgccaacgaccagcagcacatccaggtgtacgagaacggcggcagccagcccaacgtgagcagccagttcagactgagatacctggtgggcggcctgagcggcgtggacgagggcctgagcagcaccgagaacctgaagggcttcatcgagatcatcatccccctgctgatcgagtgctgggtggaggccgtgcccccccagctggccacccccgtgggcaacggcatcgagagagagcccctgcaggtgatgcagcaggtgctgaacatcatcagcctgctgtggaagctgagcaagcagcaggacgagacccacaagctggagagctggctgagaaagaactacctgatcgacttcaagcaccacttcatgagcagattcccctacgtgctgaaggagatcaccaagcacaagagaaaggagcccaacaagagcatcaagcactgcaccgtgctgagcaacaacatcgaccacctgctgctgaacctgaccctgagcgacatcatggtgagcctggccaacgccagcaccctgcagaaggactgcagctggatcgagatgatcagaaagttcgtgaccgagaccctggaggacggcagcagactgaacagcaagcagctgaacagactgctgggcgtgagctggagactgatgcagatccagcccaacagagaggacaccgagaccctgatcaaggccgtgtacaccctgtaccagcagagaggcctgatcctgcccgtgagaaccctgctgctgaagttcttcagcaagatctaccagaccgaggagctgagaagctgcagattcagatacagaagcaaggtgctgagcagatggctggccggcctgcccctgcagctggcccacctgggcagcagaaaccccgagctgagcacccagctgatcgacatcatccacaccgccgccgccagagccaacaaggagctgctgaagagcctgcaggccaccgccctgagaatctacgacccccaggagggcgccgtggtggtgctgcccgccgacagccagcagagactggtgcagctggtgtacttcctgcccagcctgcccgccgacctgctgagcagactgagcagatgctgcatcatgggcagactgagcagcagcctggccgccatgctgatcggcatcctgcacatgagaagcagcttcagcggctggaagtacagcgccaaggactggctgatgagcgacgtggactacttcagcttcctgttcagcaccctgaccggcttcagcaaggaggagctgacctggctgcagagcctgagaggcgtgccccacgtgatccagacccagctgagccccgtgctgctgtacctgaccgacctggaccagttcctgcaccactgggacgtgaccgaggccgtgttccacagcctgctggtgatccccgccagaagccagaacttcgacatcctgcagagcgccatcagcaagcacctggtgggcctgaccgtgatccccgacagcaccgccggctgcgtgttcggcgtgatctgcaagctgctggaccacacctgcgtggtgagcgagaccctgctgcccttcctggccagctgctgctacagcctgctgtacttcctgctgaccatcgagaagggcgaggccgagcacctgagaaagagagacaagctgtggggcgtgtgcgtgagcatcctggccctgctgcccagagtgctgagactgatgctgcagagcctgagagtgaacagagtgggccccgaggagctgcccgtggtgggccagctgctgagactgctgctgcagcacgcccccctgagaacccacatgctgaccaacgccatcctggtgcagcagatcatcaagaacatcaccaccctgaagagcggcagcgtgcaggagcagtggctgaccgacctgcactactgcttcaacgtgtacatcaccggccacccccagggccccagcgccctggccaccgtgtactag

SEQ ID NO: 22809 - DNA, 2742 bp, Artificial Sequence
  Description of Artificial Sequence: Synthetic coding sequence
atgagcagaatgaccaagaagagaaagagacagcacgacttccagaaggtgaagctgaaggtgggcaagaagaagcccaagctgcagaacgccacccccaccaacttcaagaccaagaccatccacctgcccgagcagctgaaggaggacggcaccctgcccaccaacaacagaaagctgaacatcaaggacctgctgagccagatgcaccactacaacgccggcgtgaagcagagcgccctgctgggcctgaaggacctgctgagccagtaccccttcatcatcgacgcccacctgagcaacatcctgagcgaggtgaccgccgtgttcaccgacaaggacgccaacgtgagactggccgccgtgcagctgctgcagttcctggcccccaagatcagagccgagcagatcagccccttcttccccctggtgagcgcccacctgagcagcgccatgacccacatcaccgagggcatccaggaggacagcctgaaggtgctggacatcctgctggagcagtaccccgccctgatcaccggcagaagcagcatcctgctgaagaacttcgtggagctgatcagccaccagcagctgagcaagggcctgatcaacagagacagaagccagagctggatcctgagcgtgaaccccaacagaagactgaccagccagcagtggagactgaaggtgctggtgagactgagcaagttcctgcaggccctggccgacggcagcagcagactgagagagagcgagggcctgcaggagcagaaggagaacccccacgccaccagcaacagcatcttcatcaactggaaggagcacgccaacgaccagcagcacatccaggtgtacgagaacggcggcagccagcccaacgtgagcagccagttcagactgagatacctggtgggcggcctgagcggcgtggacgagggcctgagcagcaccgagaacctgaagggcttcatcgagatcatcatccccctgctgatcgagtgctgggtggaggccgtgcccccccagctggccacccccgtgggcaacggcatcgagagagagcccctgcaggtgatgcagcaggtgctgaacatcatcagcctgctgtggaagctgagcaagcagcaggacgagacccacaagctggagagctggctgagaaagaactacctgatcgacttcaagcaccacttcatgagcagattcccctacgtgctgaaggagatcaccaagcacaagagaaaggagcccaacaagagcatcaagcactgcaccgtgctgagcaacaacatcgaccacctgctgctgaacctgaccctgagcgacatcatggtgagcctggccaacgccagcaccctgcagaaggactgcagctggatcgagatgatcagaaagttcgtgaccgagaccctggaggacggcagcagactgaacagcaagcagctgaacagactgctgggcgtgagctggagactgatgcagatccagcccaacagagaggacaccgagaccctgatcaaggccgtgtacaccctgtaccagcagagaggcctgatcctgcccgtgagaaccctgctgctgaagttcttcagcaagatctaccagaccgaggagctgagaagctgcagattcagatacagaagcaaggtgctgagcagatggctggccggcctgcccctgcagctggcccacctgggcagcagaaaccccgagctgagcacccagctgatcgacatcatccacaccgccgccgccagagccaacaaggagctgctgaagagcctgcaggccaccgccctgagaatctacgacccccaggagggcgccgtggtggtgctgcccgccgacagccagcagagactggtgcagctggtgtacttcctgcccagcctgcccgccgacctgctgagcagactgagcagatgctgcatcatgggcagactgagcagcagcctggccgccatgctgatcggcatcctgcacatgagaagcagcttcagcggctggaagtacagcgccaaggactggctgatgagcgacgtggactacttcagcttcctgttcagcaccctgaccggcttcagcaaggaggagctgacctggctgcagagcctgagaggcgtgccccacgtgatccagacccagctgagccccgtgctgctgtacctgaccgacctggaccagttcctgcaccactgggacgtgaccgaggccgtgttccacagcctgctggtgatccccgccagaagccagaacttcgacatcctgcagagcgccatcagcaagcacctggtgggcctgaccgtgatccccgacagcaccgccggctgcgtgttcggcgtgatctgcaagctgctggaccacacctgcgtggtgagcgagaccctgctgcccttcctggccagctgctgctacagcctgctgtacttcctgctgaccatcgagaagggcgaggccgagcacctgagaaagagactgatgctgcagagcctgagagtgaacagagtgggccccgaggagctgcccgtggtgggccagctgctgagactgctgctgcagcacgcccccctgagaacccacatgctgaccaacgccatcctggtgcagcagatcatcaagaacatcaccaccctgaagagcggcagcgtgcaggagcagtggctgaccgacctgcactactgcttcaacgtgtacatcaccggccacccccagggccccagcgccctggccaccgtgtactag

SEQ ID NO: 22810 - DNA, 1302 bp, Artificial Sequence
  Description of Artificial Sequence: Synthetic coding sequence
atgcaccactacaacgccggcgtgaagcagagcgccctgctgggcctgaaggacctgctgagccagtaccccttcatcatcgacgcccacctgagcaacatcctgagcgaggtgaccgccgtgttcaccgacaaggacgccaacgtgagactggccgccgtgcagctgctgcagttcctggcccccaagatcagagccgagcagatcagccccttcttccccctggtgagcgcccacctgagcagcgccatgacccacatcaccgagggcatccaggaggacagcctgaaggtgctggacatcctgctggagcagtaccccgccctgatcaccggcagaagcagcatcctgctgaagaacttcgtggagctgatcagccaccagcagctgagcaagggcctgatcaacagagacagaagccagagctggatcctgagcgtgaaccccaacagaagactgaccagccagcagtggagactgaaggtgctggtgagactgagcaagttcctgcaggccctggccgacggcagcagcagactgagagagagcgagggcctgcaggagcagaaggagaacccccacgccaccagcaacagcatcttcatcaactggaaggagcacgccaacgaccagcagcacatccaggtgtacgagaacggcggcagccagcccaacgtgagcagccagttcagactgagatacctggtgggcggcctgagcggcgtggacgagggcctgagcagcaccgagaacctgaagggcttcatcgagatcatcatccccctgctgatcgagtgctgggtggaggccgtgcccccccagctggccacccccgtgggcaacggcatcgagagagagcccctgcaggtgatgcagcaggtgctgaacatcatcagcctgctgtggaagctgagcaagcagcaggacgagacccacaagctggagagctggctgagaaagaactacctgatcgacttcaagcaccacttcatgagcagattcccctacgtgctgaaggagatcaccaagcacaagagaaaggagcccaacaagagcatcaagcactgcaccgtgctgagcaacaacatcgaccacctgctgctgaacctgaccctgagcgacatcatggtgagcctggccaacgccagcaccctgcagaaggactgcagctggatcgagatgatcagaaagttcgtgaccgagaccctggaggacggcagcagactgaacagcaagcagctgaacagactgctgggcgtgagctggagactgatgcagatccagcccaacagaggcagatag

SEQ ID NO: 22811 - DNA, 3405 bp, Artificial Sequence
  Description of Artificial Sequence: Synthetic coding sequence
atgaccagcctgtacggcagacacgccgagaagaccaccgacatgcccaagcccagcgcccccaaggtgcacgtgcagagaagcgtgagcagagacaccatcgccatccacttcagcgccagcggcgaggaggaggaggaggaggaggaggagttcagagagtacttcgaggagggcctggacgaccagagcatcgtgaccggcctggaggccaaggaggacctgtacctggagccccaggtgggccacgaccccgccggccccgccgccagccccgtgctggccgacggcctgagcgtgagccaggcccccgccatcctgcccgtgagcaagaacaccgtgaagctgctggagagccccgtgcccgccgcccaggtgctgagcaccgtgcccctggccgtgagccccggcagcagcagcagcggccccctggccagcagccccagcgtgagcagcctgagcgagcagaagaccagcagcagcagccccctgagcagccccagcaagagccccatcctgagcagcagcgccagcaccagcaccctgagcagcgccaagcccttcatgagcctggtgaagagcctgagcaccgaggtggagcccaaggagagcccccaccccgccagacacagacacctgatgaagaccctggtgaagagcctgagcaccgacaccagcagacaggagagcgacaccgtgagctacaagccccccgacagcaagctgaacctgcacctgttcaagcagttcacccagcccagaaacaccggcggcgacagcaagaccgcccccagcagccccctgaccagccccagcgacaccagaagcttcttcaaggtgcccgagatggaggccaagatcgaggacaccaagagaagactgagcgaggtgatctacgagcccttccagctgctgagcaagatcatcggcgaggagagcggcagccacagacccaaggccctgagcagcagcgccagcgagctgagcaacctgagcagcctgaacggccacctggagagcaacaacaactacagcatcaaggaggaggagtgcgacagcgagggcgacggctacggcagcgacagcaacatccccagaagcgaccaccccaagagcaccggcgagcccaccagagagatcgagctgaagagcagccagggcagcagcctgaaggacctgggcctgaagaccagcagcctggtgctggagaagtgcagcctgagcgccctggtgagcaaggaggacgaggagttctgcgagctgtacaccgaggacttcgacctggagaccgagggcgagagcaaggtggacaagctgagcgacatccccctgaagcccgaggtgctggccgaggacggcgtggtgctggacagcgaggacgaggtggacagcgccgtgcagcaccccgagctgcccgtgaagaccctgggcttcttcatcatgtgcgtgtacgtgtacctgatcctgcccctgccccactacgtgagcggcctgttcctgggcatcggcctgggcttcatgaccgccgtgtgcgtgatctggttcttcaccccccccagcgcccacaagtaccacaagctgcacaagaacctgagacactggaacaccagaagcctggacatcaaggagcccgagatcctgaagggctggatgaacgagatctacaactacgaccccgagacctaccacgccaccctgacccacagcgtgttcgtgagactggagggcggcaccctgagactgagcaagcccaacaagaacatcagcagaagagccagctacaacgagcccaagcccgaggtgacctacatcagccagaagatctacgacctgagcgacagcaagatctacctggtgcccaagaccctggccagaaagagaatctggaacaagaagtaccccatctgcatcgagctgggccagcaggacgacttcatgagcaaggcccagaccgacaaggagaccagcgaggagaagccccccgccgagggcagcgaggaccccaagaagccccccagaccccaggagggcaccagaagcagccagagagaccagatcctgtacctgttcggcagaaccggcagagagaaggaggagtggttcagaagattcatcctggccagcaagctgaagagcgagatcaagaagagcagcggcgtgagcggcggcaagcccgcccccgtgttcctggcccccggcctgctgcccgcccacagcagacacaacagccccagcggccacctgacccacagcagaagcagcagcaagggcagcgtggaggagatcatgagccagcccaagcagaaggagctggccggcagcgtgagacagaagatgctgctggactacagcgtgtacatgggcagatgcgtgccccaggagagcagaagcccccagagaagccccctgcagagcgccgagagcagccccaccgccggcaagaagctgcccgaggtgccccccagcgaggaggaggagcaggaggcctgggtgaacgccctgctgggcagaatcttctgggacttcctgggcgagaagtactggagcgacctggtgagcaagaagatccagatgaagctgagcaagatcaagctgccctacttcatgaacgagctgaccctgaccgagctggacatgggcgtggccgtgcccaagatcctgcaggccttcaagccctacgtggaccaccagggcctgtggatcgacctggagatgagctacaacggcagcttcctgatgaccctggagaccaagatgaacctgaccaagctgggcaaggagcccctggtggaggccctgaaggtgggcgagatcggcaaggagggctgcagacccagagccttctgcctggccgacagcgacgaggagagcagcagcgccggcagcagcgaggaggacgacgcccccgagcccagcggcggcgacaagcagctgctgcccggcgccgagggctacgtgggcggccacagaaccagcaagatcatgagattcgtggacaagatcaccaagagcaagtacttccagaaggccaccgagaccgagttcatcaagaagaagatcgaggaggtgagcaacacccccctgctgctgaccgtggaggtgcaggagtgcagaggcaccctggccgtgaacatcccccccccccccaccgacagagtgtggtacggcttcagaaagcccccccacgtggagctgaaggccagacccaagctgggcgagagagaggtgaccctggtgcacgtgaccgactggatcgagaagaagctggagcaggagttccagaaggtgttcgtgatgcccaacatggacgacgtgtacatcaccatcatgcacagcgccatggaccccagaagcaccagctgcctgctgaaggacccccccgtggaggccgccgaccagccctag

SEQ ID NO: 22812 - DNA, 591 bp, Artificial Sequence
  Description of Artificial Sequence: Synthetic coding sequence
atgtggttcatgtacctgctgagctggctgagcctgttcatccaggtggccttcatcaccctggccgtggccgccggcctgtactacctggccgagctgatcgaggagtacaccgtggccaccagcagaatcatcaagtacatgatctggttcagcaccgccgtgctgatcggcctgtacgtgttcgagagattccccaccagcatgatcggcgtgggcctgttcaccaacctggtgtacttcggcctgctgcagaccttccccttcatcatgctgaccagccccaacttcatcctgagctgcggcctggtggtggtgaaccactacctggccttccagttcttcgccgaggagtactaccccttcagcgaggtgctggcctacttcaccttctgcctgtggatcatccccttcgccttcttcgtgagcctgagcgccggcgagaacgtgctgcccagcaccatgcagcccggcgacgacgtggtgagcaactacttcaccaagggcaagagaggcaagagactgggcatcctggtggtgttcagcttcatcaaggaggccatcctgcccagcagacagaagatctactag

SEQ ID NO: 22813 - DNA, 1233 bp, Artificial Sequence
  Description of Artificial Sequence: Synthetic coding sequence
atggtgctgaaggccgagcacaccagaagccccagcgccaccctgcccagcaacgtgcccagctgcagaagcctgagcagcagcgaggacggccccagcggccccagcagcctggccgacggcggcctggcccacaacctgcaggacagcgtgagacacagaatcctgtacctgagcgagcagctgagagtggagaaggccagcagagacggcaacaccgtgagctacctgaagctggtgagcaaggccgacagacaccaggtgccccacatccagcaggccttcgagaaggtgaaccagagagccagcgccaccatcgcccagatcgagcacagactgcaccagtgccaccagcagctgcaggagctggaggagggctgcagacccgagggcctgctgctgatggccgagagcgaccccgccaactgcgagccccccagcgagaaggccctgctgagcgagccccccgagcccggcggcgaggacggccccgtgaacctgccccacgccagcagacccttcatcctggagagcagattccagagcctgcagcagggcacctgcctggagaccgaggacgtggcccagcagcagaacctgctgctgcagaaggtgaaggccgagctggaggaggccaagagattccacatcagcctgcaggagagctaccacagcctgaaggagagaagcctgaccgacctgcagctgctgctggagagcctgcaggaggagaagtgcagacaggccctgatggaggagcaggtgaacggcagactgcagggccagctgaacgagatctacaacctgaagcacaacctggcctgcagcgaggagagaatggcctacctgagctacgagagagccaaggagatctgggagatcaccgagaccttcaagagcagaatcagcaagctggagatgctgcagcaggtgacccagctggaggccgccgagcacctgcagagcagacccccccagatgctgttcaagttcctgagccccagactgagcctggccaccgtgctgctggtgttcgtgagcaccctgtgcgcctgccccagcagcctgatcagcagcagactgtgcacctgcaccatgctgatgctgatcggcctgggcgtgctggcctggcagagatggagagccatccccgccaccgactggcaggagtgggtgcccagcagatgcagactgtacagcaaggacagcggcccccccgccgacggcccctag

SEQ ID NO: 22814 - DNA, 1233 bp, Artificial Sequence; identical to SEQ ID NO: 22813
  Description of Artificial Sequence: Synthetic coding sequence

SEQ ID NO: 22815 - DNA, 1068 bp, Artificial Sequence
  Description of Artificial Sequence: Synthetic coding sequence
atggaggagggcgagagaagccccctgctgagccaggagaccgccggccagaagcccctgagcgtgcacagaccccccaccagcggctgcctgggccccgtgcccagagaggaccaggccgaggcctggggctgcagctgctgcccccccgagaccaagcaccaggccctgagcggcacccccaagaagggccccgcccccagcctgagccccggcagcagctgcgtgaagtacctgatcttcctgagcaacttccccttcagcctgctgggcctgctggccctggccatcggcctgtggggcctggccgtgaagggcagcctgggcagcgacctgggcggccccctgcccgccgaccccatgctgggcctggccctgggcggcctggtggtgagcgccgtgagcctggccggctacctgggcgccctgtgcgagaacacctgcctgctgagaggcttcagcggcggcatcctggccttcctggtgctggaggccgtggccggcgccctggtggtggccctgtggggccccctgcaggacagcctggagcacaccctgagagtggccatcgcccactaccaggacgaccccgacctgagattcctgctggaccaggtgcagctgggcctgagatgctgcggcgccgccagctaccaggactggcagcagaacctgtacttcaactgcagcagccccggcgtgcaggcctgcagcctgcccgccagctgctgcatcgaccccagagaggacggcgccagcgtgaacgaccagtgcggcttcggcgtgctgagactggacgccgacgccgcccagagagtggtgtacctggagggctgcggcccccccctgagaagatggctgagagccaacctggccgccagcggcggctacgccatcgccgtggtgctgctgcagggcgccgagctgctgctggccgccagactgctgggcgccctggccgccagaagaggcgccgcctacggccccggcgccagaggcgaggacagagccggcccccagagccccagccccggcgccccccccgccgccaagcccgccagaggctag

SEQ ID NO: 22816 - DNA, 708 bp, Artificial Sequence
  Description of Artificial Sequence: Synthetic coding sequence
atggaggagggcgagagaagccccctgctgagccaggagaccgccggccagaagcccctgagcgtgcacagaccccccaccagcggctgcctgggccccgtgcccagagaggaccaggccgaggcctggggctgcagctgctgcccccccgagaccaagcaccaggccctgagcggcacccccaagaagggccccgcccccagcctgagccccggcagcagctgcgtgaagtacctgatcttcctgagcaacttccccttcagcctgctgggcctgctggccctggccatcggcctgtggggcctggccgtgaagggcagcctgggcagcgacctgggcggccccctgcccgccgaccccatgctgggcctggccctgggcggcctggtggtgagcgccgtgagcctggccggctacctgggcgccctgtgcgagaacacctgcctgctgagaggcttcagcggcggcatcctggccttcctggtgctggaggccgtggccggcgccctggtggtggccctgtggggccccctgcaggacagcctggagcacaccctgagagtggccatcgcccactaccaggacgaccccgacctgagattcctgctggaccaggtgcagctgggcctgagatgctgcggcgccgccagctaccaggactggcagcagaacctgtactgcctgagcagcccctgcagcagccagtag

SEQ ID NO: 22817 - DNA, 762 bp, Artificial Sequence
  Description of Artificial Sequence: Synthetic coding sequence
atggcccactacaagaccgagcaggacgactggctgatcatctacctgaagtacctgctgttcgtgttcaacttcttcttctgggtgggcggcgccgccgtgctggccgtgggcatctggaccctggtggagaagagcggctacctgagcgtgctggccagcagcaccttcgccgccagcgcctacatcctgatcttcgccggcgtgctggtgatggtgaccggcttcctgggcttcggcgccatcctgtgggagagaaagggctgcctgagcacctacttctgcctgctgctggtgatcttcctggtggagctggtggccggcgtgctggcccacgtgtactaccagagactgagcgacgagctgaagcagcacctgaacagaaccctggccgagaactacggccagcccggcgccacccagatcaccgccagcgtggacagactgcagcaggacttcaagtgctgcggcagcaacagcagcgccgactggcagcacagcacctacatcctgctgagagaggccgagggcagacaggtgcccgacagctgctgcaagaccgtggtggtgagatgcggccagagagcccaccccagcaacatctacaaggtggagggcggctgcctgaccaagctggagcagttcctggccgaccacctgctgctgatgggcgccgtgggcatcggcgtggcctgcctgcagatctgcggcatggtgctgacctgctgcctgcaccagagactgcagagacacttctactag

SEQ ID NO: 22818 - DNA, 732 bp, Artificial Sequence
  Description of Artificial Sequence: Synthetic coding sequence
atgagaagcggcggcggcagaaacgcctgggacaccagaggcgcctgcgagcaggtgggcggcgccgccgtgctggccgtgggcatctggaccctggtggagaagagcggctacctgagcgtgctggccagcagcaccttcgccgccagcgcctacatcctgatcttcgccggcgtgctggtgatggtgaccggcttcctgggcttcggcgccatcctgtgggagagaaagggctgcctgagcacctacttctgcctgctgctggtgatcttcctggtggagctggtggccggcgtgctggcccacgtgtactaccagagactgagcgacgagctgaagcagcacctgaacagaaccctggccgagaactacggccagcccggcgccacccagatcaccgccagcgtggacagactgcagcaggacttcaagtgctgcggcagcaacagcagcgccgactggcagcacagcacctacatcctgctgagagaggccgagggcagacaggtgcccgacagctgctgcaagaccgtggtggtgagatgcggccagagagcccaccccagcaacatctacaaggtggagggcggctgcctgaccaagctggagcagttcctggccgaccacctgctgctgatgggcgccgtgggcatcggcgtggcctgcctgcagatctgcggcatggtgctgacctgctgcctgcaccagagactgcagagacacttctactag

SEQ ID NO: 22819 - DNA, 762 bp, Artificial Sequence; identical to SEQ ID NO: 22817
  Description of Artificial Sequence: Synthetic coding sequence

SEQ ID NO: 22820 - DNA, 642 bp, Artificial Sequence
  Description of Artificial Sequence: Synthetic coding sequence
atgcactactacagatacagcaacgccaaggtgagctgctggtacaagtacctgctgttcagctacaacatcatcttctggctggccggcgtggtgttcctgggcgtgggcctgtgggcctggagcgagaagggcgtgctgagcgacctgaccaaggtgaccagaatgcacggcatcgaccccgtggtgctggtgctgatggtgggcgtggtgatgttcaccctgggcttcgccggctgcgtgggcgccctgagagagaacatctgcctgctgaacttcaaccagtgctgcggcgcctacggccccgaggactgggacctgaacgtgtacttcaactgcagcggcgccagctacagcagagagaagtgcggcgtgcccttcagctgctgcgtgcccgaccccgcccagaaggtggtgaacacccagtgcggctacgacgtgagaatccagctgaagagcaagtgggacgagagcatcttcaccaagggctgcatccaggccctggagagctggctgcccagaaacatctacatcgtggccggcgtgttcatcgccatcagcctgctgcagatcttcggcatcttcctggccagaaccctgatcagcgacatcgaggccgtgaaggccggccaccacttctag

SEQ ID NO: 22821 - DNA, 813 bp, Artificial Sequence
  Description of Artificial Sequence: Synthetic coding sequence
atgcactactacagatacagcaacgccaaggtgagctgctggtacaagtacctgctgttcagctacaacatcatcttctggctggccggcgtggtgttcctgggcgtgggcctgtgggcctggagcgagaagggcgtgctgagcgacctgaccaaggtgaccagaatgcacggcatcgaccccgtggtgctggtgctgatggtgggcgtggtgatgttcaccctgggcttcgccggctgcgtgggcgccctgagagagaacatctgcctgctgaacttcttctgcggcaccatcgtgctgatcttcttcctggagctggccgtggccgtgctggccttcctgttccaggactgggtgagagacagattcagagagttcttcgagagcaacatcaagagctacagagacgacatcgacctgcagaacctgatcgacagcctgcagaaggccaaccagtgctgcggcgcctacggccccgaggactgggacctgaacgtgtacttcaactgcagcggcgccagctacagcagagagaagtgcggcgtgcccttcagctgctgcgtgcccgaccccgcccagaaggtggtgaacacccagtgcggctacgacgtgagaatccagctgaagagcaagtgggacgagagcatcttcaccaagggctgcatccaggccctggagagctggctgcccagaaacatctacatcgtggccggcgtgttcatcgccatcagcctgctgcagatcttcggcatcttcctggccagaaccctgatcagcgacatcgaggccgtgaaggccggccaccacttctag

SEQ ID NO: 22822 - DNA, 672 bp, Artificial Sequence
  Description of Artificial Sequence: Synthetic coding sequence
atggagagaaaggtgctgccctgcttcctgtgcctgttccagggcgtgctgagcgacctgaccaaggtgaccagaatgcacggcatcgaccccgtggtgctggtgctgatggtgggcgtggtgatgttcaccctgggcttcgccggctgcgtgggcgccctgagagagaacatctgcctgctgaacttcttctgcggcaccatcgtgctgatcttcttcctggagctggccgtggccgtgctggccttcctgttccaggactgggtgagagacagattcagagagttcttcgagagcaacatcaagagctacagagacgacatcgacctgcagaacctgatcgacagcctgcagaaggccaaccagtgctgcggcgcctacggccccgaggactgggacctgaacgtgtacttcaactgcagcggcgccagctacagcagagagaagtgcggcgtgcccttcagctgctgcgtgcccgaccccgcccagaaggtggtgaacacccagtgcggctacgacgtgagaatccagctgaagagcaagtgggacgagagcatcttcaccaagggctgcatccaggccctggagagctggctgcccagaaacatctacatcgtggccggcgtgttcatcgccatcagcctgctgcagatcttcggcatcttcctgtag

SEQ ID NO: 22823 - DNA, 813 bp, Artificial Sequence; identical to SEQ ID NO: 22821
  Description of Artificial Sequence: Synthetic coding sequence

SEQ ID NO: 22824 - DNA, 450 bp, Artificial Sequence
  Description of Artificial Sequence: Synthetic coding sequence
atgcactactacagatacagcaacgccaaggtgagctgctggtacaagtacctgctgttcagctacaacatcatcttctggctggccggcgtggtgttcctgggcgtgggcctgtgggcctggagcgagaagggcgtgctgagcgacctgaccaaggtgaccagaatgcacggcatcgaccccgtggtgctggtgcaccccctgagcggcagctgccagagatacttcagctgccccgtgttcctgagcctggccttcctgagccaccccaagaacctgcccagaccctacggcagcctgcccttcttccccagacagctgctgatctgggccgtgtgcacccccagcttcgccccccccaccatgccccacgtggccgagagctgcctgagccagctgagcaccctggccttcttcagcctgtgcagcaccagacactgcaccagctag

SEQ ID NO: 22825 - DNA, 762 bp, Artificial Sequence
  Description of Artificial Sequence: Synthetic coding sequence
atgcactactacagatacagcaacgccaaggtgagctgctggtacaagtacctgctgttcagctacaacatcatcttctggggcgtgctgagcgacctgaccaaggtgaccagaatgcacggcatcgaccccgtggtgctggtgctgatggtgggcgtggtgatgttcaccctgggcttcgccggctgcgtgggcgccctgagagagaacatctgcctgctgaacttcttctgcggcaccatcgtgctgatcttcttcctggagctggccgtggccgtgctggccttcctgttccaggactgggtgagagacagattcagagagttcttcgagagcaacatcaagagctacagagacgacatcgacctgcagaacctgatcgacagcctgcagaaggccaaccagtgctgcggcgcctacggccccgaggactgggacctgaacgtgtacttcaactgcagcggcgccagctacagcagagagaagtgcggcgtgcccttcagctgctgcgtgcccgaccccgcccagaaggtggtgaacacccagtgcggctacgacgtgagaatccagctgaagagcaagtgggacgagagcatcttcaccaagggctgcatccaggccctggagagctggctgcccagaaacatctacatcgtggccggcgtgttcatcgccatcagcctgctgcagatcttcggcatcttcctggccagaaccctgatcagcgacatcgaggccgtgaaggccggccaccacttctag

SEQ ID NO: 22826 - DNA, 813 bp, Artificial Sequence; identical to SEQ ID NO: 22821
  Description of Artificial Sequence: Synthetic coding sequence

SEQ ID NO: 22827 - DNA, 444 bp, Artificial Sequence
  Description of Artificial Sequence: Synthetic coding sequence
atgcactactacagatacagcaacgccaaggtgagctgctggtacaagtacctgctgttcagctacaacatcatcttctggaaccagtgctgcggcgcctacggccccgaggactgggacctgaacgtgtacttcaactgcagcggcgccagctacagcagagagaagtgcggcgtgcccttcagctgctgcgtgcccgaccccgcccagaaggtggtgaacacccagtgcggctacgacgtgagaatccagctgaagagcaagtgggacgagagcatcttcaccaagggctgcatccaggccctggagagctggctgcccagaaacatctacatcgtggccggcgtgttcatcgccatcagcctgctgcagatcttcggcatcttcctggccagaaccctgatcagcgacatcgaggccgtgaaggccggccaccacttctag

SEQ ID NO: 22828 - DNA, 738 bp, Artificial Sequence
  Description of Artificial Sequence: Synthetic coding sequence
atggccgagatccacaccccctacagcagcctgaagaagctgctgagcctgctgaacggcttcgtggccgtgagcggcatcatcctggtgggcctgggcatcggcggcaagtgcggcggcgccagcctgaccaacgtgctgggcctgagcagcgcctacctgctgcacgtgggcaacctgtgcctggtgatgggctgcatcaccgtgctgctgggctgcgccggctggtacggcgccaccaaggagagcagaggcaccctgctgttctgcatcctgagcatggtgatcgtgctgatcatggaggtgaccgccgccaccgtggtgctgctgttcttccccatcgtgggcgacgtggccctggagcacaccttcgtgaccctgagaaagaactacagaggctacaacgagcccgacgactacagcacccagtggaacctggtgatggagaagctgaagtgctgcggcgtgaacaactacaccgacttcagcggcagcagcttcgagatgaccaccggccacacctaccccagaagctgctgcaagagcatcggcagcgtgagctgcgacggcagagacgtgagccccaacgtgatccaccagaagggctgcttccacaagctgctgaagatcaccaagacccagagcttcaccctgagcggcagcagcctgggcgccgccgtgatccagagatggggcagcagatacgtggcccaggccggcctggagctgctggcctag

SEQ ID NO: 22829 - DNA, 483 bp, Artificial Sequence
  Description of Artificial Sequence: Synthetic coding sequence
atggccgagatccacaccccctacagcagcctgaagaagctgctgagcctgctgaacggcttcgtggccgtgagcggcatcatcctggtgggcctgggcatcggcggcaagtgcggcggcgccagcctgaccaacgtgctgggcctgagcagcgcctacctgctgcacgtgggcaacctgtgcctggtgatgggctgcatcaccgtgctgctgggctgcgccggctggtacggcgccaccaaggagagcagaggcaccctgctgttctgcatcctgagcatggtgatcgtgctgatcatggaggtgaccgccgccaccgtggtgctgctgttcttccccatcgtgggcgacgtggccctggagcacaccttcgtgaccctgagaaagaactacagaggctacaacgagcccgacgactacagcacccagtggaacctggtgatggagaagggcctgagcaagtacttcttcagcagcctgtag

SEQ ID NO: 22830 - DNA, 999 bp, Artificial Sequence
  Description of Artificial Sequence: Synthetic coding sequence
atgcccggcaagcaccagcacttccaggagcccgaggtgggctgctgcggcaagtacttcctgttcggcttcaacatcgtgttctgggtgctgggcgccctgttcctggccatcggcctgtgggcctggggcgagaagggcgtgctgagcaacatcagcgccctgaccgacctgggcggcctggaccccgtgtggctgttcgtggtggtgggcggcgtgatgagcgtgctgggcttcgccggctgcatcggcgccctgagagagaacaccttcctgctgaagttcttcagcgtgttcctgggcctgatcttcttcctggagctggccaccggcatcctggccttcgtgttcaaggactggatcagagaccagctgaacctgttcatcaacaacaacgtgaaggcctacagagacgacatcgacctgcagaacctgatcgacttcgcccaggagtactggagctgctgcggcgccagaggccccaacgactggaacctgaacatctacttcaactgcaccgacctgaaccccagcagagagagatgcggcgtgcccttcagctgctgcgtgagagaccccgccgaggacgtgctgaacacccagtgcggctacgacgtgagactgaagctggtgagaggcgagctggagcagcagggcttcatccacaccaagggctgcgtgggccagttcgagaagtggctgcaggacaacctgatcgtggtggccggcgtgttcatgggcatcgccctgctgcagatcttcggcatctgcctggcccagaacctggtgagcgacatcaaggccgtgaaggccaactggagcaagtggaacgacgacttcgagaaccactggctgacccccaccatcagcgaggtgctgagcaccgccggcccccagcagaacagcctgaccggcgcccccggccccgccccccccagcagacacgtgttcttcggcctgggcggcctgtaccccgagcccaccttcaagaactggtag

SEQ ID NO: 22831 - DNA, 801 bp, Artificial Sequence
  Description of Artificial Sequence: Synthetic coding sequence
atgcccggcaagcaccagcacttccaggagcccgaggtgggctgctgcggcaagtacttcctgttcggcttcaacatcgtgttctgggtgctgggcgccctgttcctggccatcggcctgtgggcctggggcgagaagggcgtgctgagcaacatcagcgccctgaccgacctgggcggcctggaccccgtgtggctgttcgtggtggtgggcggcgtgatgagcgtgctgggcttcgccggctgcatcggcgccctgagagagaacaccttcctgctgaagttcttcagcgtgttcctgggcctgatcttcttcctggagctggccaccggcatcctggccttcgtgttcaaggactggatcagagaccagctgaacctgttcatcaacaacaacgtgaaggcctacagagacgacatcgacctgcagaacctgatcgacttcgcccaggagtactggagctgctgcggcgccagaggccccaacgactggaacctgaacatctacttcaactgcaccgacctgaaccccagcagagagagatgcggcgtgcccttcagctgctgcgtgagagaccccgccgaggacgtgctgaacacccagtgcggctacgacgtgagactgaagctggtgagaggcgagctggagcagcagggcttcatccacaccaagggctgcgtgggccagttcgagaagtggctgcaggacaacctgatcgtggtggccggcgtgttcatgggcatcgccctgctgcagatcttcggcatctgcctggcccagaacctggagcagatggagtag

SEQ ID NO: 22832 - DNA, 990 bp, Artificial Sequence
  Description of Artificial Sequence: Synthetic coding sequence
atgcccggcaagcaccagcacttccaggagcccgaggtgggctgctgcggcaagtacttcctgttcggcttcaacatcgtgttctgggtgctgggcgccctgttcctggccatcggcctgtgggcctggggcgagaagggcgtgctgagcaacatcagcgccctgaccgacctgggcggcctggaccccgtgtggctgttcgtggtggtgggcggcgtgatgagcgtgctgggcttcgccggctgcatcggcgccctgagagagaacaccttcctgctgaagttcttcagcgtgttcctgggcctgatcttcttcctggagctggccaccggcatcctggccttcgtgttcaaggactggatcagagaccagctgaacctgttcatcaacaacaacgtgaaggcctacagagacgacatcgacctgcagaacctgatcgacttcgcccaggagtactggagctgctgcggcgccagaggccccaacgactggaacctgaacatctacttcaactgcaccgacctgaaccccagcagagagagatgcggcgtgcccttcagctgctgcgtgagagaccccgccgaggacgtgctgaacacccagtgcggctacgacgtgagactgaagctggagctggagcagcagggcttcatccacaccaagggctgcgtgggccagttcgagaagtggctgcaggacaacctgatcgtggtggccggcgtgttcatgggcatcgccctgctgcagatcttcggcatctgcctggcccagaacctggtgagcgacatcaaggccgtgaaggccaactggagcaagtggaacgacgacttcgagaaccactggctgacccccaccatcagcgaggtgctgagcaccgccggcccccagcagaacagcctgaccggcgcccccggccccgccccccccagcagacacgtgttcttcggcctgggcggcctgtaccccgagcccaccttcaagaactggtag

SEQ ID NO: 22833 - DNA, 792 bp, Artificial Sequence
  Description of Artificial Sequence: Synthetic coding sequence
atgcccggcaagcaccagcacttccaggagcccgaggtgggctgctgcggcaagtacttcctgttcggcttcaacatcgtgttctgggtgctgggcgccctgttcctggccatcggcctgtgggcctggggcgagaagggcgtgctgagcaacatcagcgccctgaccgacctgggcggcctggaccccgtgtggctgttcgtggtggtgggcggcgtgatgagcgtgctgggcttcgccggctgcatcggcgccctgagagagaacaccttcctgctgaagttcttcagcgtgttcctgggcctgatcttcttcctggagctggccaccggcatcctggccttcgtgttcaaggactggatcagagaccagctgaacctgttcatcaacaacaacgtgaaggcctacagagacgacatcgacctgcagaacctgatcgacttcgcccaggagtactggagctgctgcggcgccagaggccccaacgactggaacctgaacatctacttcaactgcaccgacctgaaccccagcagagagagatgcggcgtgcccttcagctgctgcgtgagagaccccgccgaggacgtgctgaacacccagtgcggctacgacgtgagactgaagctggagctggagcagcagggcttcatccacaccaagggctgcgtgggccagttcgagaagtggctgcaggacaacctgatcgtggtggccggcgtgttcatgggcatcgccctgctgcagatcttcggcatctgcctggcccagaacctggagcagatggagtag

SEQ ID NO: 22834 - DNA, 747 bp, Artificial Sequence
  Description of Artificial Sequence: Synthetic coding sequence
atggagggcgactgcctgagctgcatgaagtacctgatgttcgtgttcaacttcttcatcttcctgggcggcgcctgcctgctggccatcggcatctgggtgatggtggaccccaccggcttcagagagatcgtggccgccaaccccctgctgctgaccggcgcctacatcctgctggccatgggcggcctgctgttcctgctgggcttcctgggctgctgcggcgccgtgagagagaacaagtgcctgctgctgttcttcttcctgttcatcctgatcatcttcctggccgagctgagcgccgccatcctggccttcatcttcagagagaacctgaccagagagttcttcaccaaggagctgaccaagcactaccagggcaacaacgacaccgacgtgttcagcgccacctggaacagcgtgatgatcaccttcggctgctgcggcgtgaacggccccgaggacttcaagttcgccagcgtgttcagactgctgaccctggacagcgaggaggtgcccgaggcctgctgcagaagagagccccagagcagagacggcgtgctgctgagcagagaggagtgcctgctgggcagaagcctgttcctgaacaagcagggctgctacaccgtgatcctgaacaccttcgagacctacgtgtacctggccggcgccctggccatcggcgtgctggccatcgagctgttcgccatgatcttcgccatgtgcctgttcagaggcatccagtag

SEQ ID NO: 22835 - DNA, 816 bp, Artificial Sequence
  Description of Artificial Sequence: Synthetic coding sequence
tgatggagcaccatggagggcgactgcctgagctgcatgaagtacctgatgttcgtgttcaacttcttcatcttcctgggcggcgcctgcctgctggccatcggcatctgggtgatggtggaccccaccggcttcagagagatcgtggccgccaaccccctgctgctgaccggcgcctacatcctgctggccatgggcggcctgctgttcctgctgggcttcctgggctgctgcggcgccgtgagagagaacaagtgcctgctgctgttcttcttcctgttcatcctgatcatcttcctggccgagctgagcgccgccatcctggccttcatcttcagagagaacctgaccagagagttcttcaccaaggagctgaccaagcactaccagggcaacaacgacaccgacgtgttcagcgccacctggaacagcgtgatgatcaccttcggctgctgcggcgtgaacggccccgaggacttcaagttcgccagcgtgttcagactgctgaccctggacagcgaggaggtgcccgaggcctgctgcagaagagagccccagagcagagacggcgtgctgctgagcagagaggagtgcctgctgggcagaagcctgttcctgaacaagcagggctgctacaccgtgatcctgaacaccttcgagacctacgtgtacctggccggcgccctggccatcggcgtgctggccatcgaggaggagagagcccacagcgtgagccaggccaccggcatcctgtaccagctgcccgccagcccccaggccttccagagccccggcaccctgggcgccaccgcctag

SEQ ID NO: 22836 - DNA, 747 bp, Artificial Sequence; identical to SEQ ID NO: 22834
  Description of Artificial Sequence: Synthetic coding sequence

SEQ ID NO: 22837 - DNA, 240 bp, Artificial Sequence
  Description of Artificial Sequence: Synthetic coding sequence
atggagggcgactgcctgagctgcatgaagtacctgatgttcgtgttcaacttcttcatcttcctgggcggcgcctgcctgctggccatcggcatctgggtgatggtggaccccaccggcttcagagagatcgtggccgccaaccccctgctgctgaccggcgcctacatcctgctggccatgggcggcctgctgttcctgctgggcttcctgggctgctgcggcgccgtgagagagtag

SEQ ID NO: 22838 - DNA, 441 bp, Artificial Sequence
  Description of Artificial Sequence: Synthetic coding sequence
atggagggcgactgcctgagctgcatgaagtacctgatgttcgtgttcaacttcttcatcttcctgggcggcgcctgcctgctggccatcggcatctgggtgatggtggaccccaccggcttcagagagatcgtggccgccaaccccctgctgctgaccggcgcctacatcctgctggccatgggcggcctgctgttcctgctgggcttcctgggctgctgcggcgccgtgagagagaacaagtgcctgctgctgttcttcttcctgttcatcctgatcatcttcctggccgagctgagcgccgccatcctggccttcatcttcagagagaacctgaccagagagttcttcaccaaggagctgaccaagcactaccagggcaacaacgacaccgacgtgttcagcgccacctggaacagcgtgatgatcaccgtgagctag

SEQ ID NO: 22839 - DNA, 852 bp, Artificial Sequence
  Description of Artificial Sequence: Synthetic coding sequence
atggccagaagacccagagcccccgccgccagcggcgaggagttcagcttcgtgagccccctggtgaagtacctgctgttcttcttcaacatgctgttctgggtgatcagcatggtgatggtggccgtgggcgtgtacgccagactgatgaagcacgccgaggccgccctggcctgcctggccgtggaccccgccatcctgctgatcgtggtgggcgtgctgatgttcctgctgaccttctgcggctgcatcggcagcctgagagagaacatctgcctgctgcagaccttcagcctgtgcctgaccgccgtgttcctgctgcagctggccgccggcatcctgggcttcgtgttcagcgacaaggccagaggcaaggtgagcgagatcatcaacaacgccatcgtgcactacagagacgacctggacctgcagaacctgatcgacttcggccagaagaagttcagctgctgcggcggcatcagctacaaggactggagccagaacatgtacttcaactgcagcgaggacaaccccagcagagagagatgcagcgtgccctacagctgctgcctgcccacccccgaccaggccgtgatcaacaccatgtgcggccagggcatgcaggccttcgactacctggaggccagcaaggtgatctacaccaacggctgcatcgacaagctggtgaactggatccacagcaacctgttcctgctgggcggcgtggccctgggcctggccatcccccagctggtgggcatcctgctgagccagatcctggtgaaccagatcaaggaccagatcaagctgcagctgtacaaccagcagcacagagccgacccctggtactag

SEQ ID NO: 22840 - DNA, 1338 bp, Artificial Sequence
  Description of Artificial Sequence: Synthetic coding sequence
atggccgagtacgacctgaccaccagaatcgcccacttcctggacagacacctggtgttccccctgctggagttcctgagcgtgaaggagatctacaacgagaaggagctgctgcagggcaagctggacctgctgagcgacaccaacatggtggacttcgccatggacgtgtacaagaacctgtacagcgacgacatcccccacgccctgagagagaagagaaccaccgtggtggcccagctgaagcagctgcaggccgagaccgagcccatcgtgaagatgttcgaggaccccgagaccaccagacagatgcagagcaccagagacggcagaatgctgttcgactacctggccgacaagcacggcttcagacaggagtacctggacaccctgtacagatacgccaagttccagtacgagtgcggcaactacagcggcgccgccgagtacctgtacttcttcagagtgctggtgcccgccaccgacagaaacgccctgagcagcctgtggggcaagctggccagcgagatcctgatgcagaactgggacgccgccatggaggacctgaccagactgaaggagaccatcgacaacaacagcgtgagcagccccctgcagagcctgcagcagagaacctggctgatccactggagcctgttcgtgttcttcaaccaccccaagggcagagacaacatcatcgacctgttcctgtaccagccccagtacctgaacgccatccagaccatgtgcccccacatcctgagatacctgaccaccgccgtgatcaccaacaaggacgtgagaaagagaagacaggtgctgaaggacctggtgaaggtgatccagcaggagagctacacctacaaggaccccatcaccgagttcgtggagtgcctgtacgtgaacttcgacttcgacggcgcccagaagaagctgagagagtgcgagagcgtgctggtgaacgacttcttcctggtggcctgcctggaggacttcatcgagaacgccagactgttcatcttcgagaccttctgcagaatccaccagtgcatcagcatcaacatgctggccgacaagctgaacatgacccccgaggaggccgagagatggatcgtgaacctgatcagaaacgccagactggacgccaagatcgacagcaagctgggccacgtggtgatgggcaacaacgccgtgagcccctaccagcaggtgatcgagaagaccaagagcctgagcttcagaagccagatgctggccatgaacatcgagaagaagctgaaccagaacagcagaagcgaggcccccaactgggccacccaggacagcggcttctactag

SEQ ID NO: 22841 - DNA, 5586 bp, Artificial Sequence
  Description of Artificial Sequence: Synthetic coding sequence
atgctgaaggccgtgctgaagaagagcagagagggcggcaagggcggcaagaaggaggccggcagcgacttcggccccgagaccagccccgtgctgcacctggaccacagcgccgacagccccgtgagcagcctgcccaccgccgaggacacctacagagtgagcctggccaagggcgtgagcatgagcctgcccagcagccccctgctgcccagacagagccacctggtgcagagcagagtgaacaagaagagccccggccccgtgagaaagcccaagtacgtggagagccccagagtgcccggcgacgccgtgatcatgcccttcagagaggtggccaagcccaccgagcccgacgagcacgaggccaaggccgacaacgagcccagctgcagccccgccgcccaggagctgctgaccagactgggcttcctgctgggcgagggcatccccagcgccacccacatcaccatcgaggacaagaacgagaccatgtgcaccgccctgagccagggcatcagcccctgcagcaccctgaccagcagcaccgccagccccagcaccgacagcccctgcagcaccctgaacagctgcgtgagcaagaccgccgccaacaagagcccctgcgagaccatcagcagccccagcagcaccctggagagcaaggacagcggcatcatcgccaccatcaccagcagcagcgagaacgacgacagaagcggcagcagcctggagtggaacaaggacggcaacctgagactgggcgtgcagaagggcgtgctgcacgacagaagagccgacaactgcagccccgtggccgaggaggagaccaccggcagcgccgagagcaccctgcccaaggccgagagcagcgccggcgacggccccgtgccctacagccagggcagcagcagcctgatcatgcccagacccaacagcgtggccgccaccagcagcaccaagctggaggacctgagctacctggacggccagagaaacgcccccctgagaaccagcatcagactgccctggcacaacaccgccggcggcagagcccaggaggtgaaggccagattcgccccctacaagccccaggacatcctgctgaagcccctgctgttcgaggtgcccagcatcaccaccgacagcgtgttcgtgggcagagactggctgttccaccagatcgaggagaacctgagaaacaccgagctggccgagaacagaggcgccgtggtggtgggcaacgtgggcttcggcaagaccgccatcatcagcaagctggtggccctgagctgccacggcagcagaatgagacagatcgccagcaacagccccggcagcagccccaagaccagcgaccccacccaggacctgcacttcacccccctgctgagccccagcagcagcaccagcgccagcagcaccgccaagacccccctgggcagcatcagcgccgagaaccagagacccagagaggacgccgtgaagtacctggccagcaaggtggtggcctaccactactgccaggccgacaacacctacacctgcctggtgcccgagttcgtgcacagcatcgccgccctgctgtgcagaagccaccagctggccgcctacagagacctgctgatcaaggagccccagctgcagagcatgctgagcctgagaagctgcgtgcaggaccccgtggccgccttcaagagaggcgtgctggagcccctgaccaacctgagaaacgagcagaagatccccgaggaggagtacatcatcctgatcgacggcctgaacgaggccgagttccacaagcccgactacggcgacaccctgagcagcttcatcaccaagatcatcagcaagttccccgcctggctgaagctgatcgtgaccgtgagagccaacttccaggagatcatcagcgccctgcccttcgtgaagctgagcctggacgacttccccgacaacaaggacatccacagcgacctgcacgcctacgtgcagcacagagtgcacagcagccaggacatcctgagcaacatcagcctgaacggcaaggccgacgccaccctgatcggcaaggtgagcagccacctggtgctgagaagcctgggcagctacctgtacctgaagctgaccctggacctgttccagagaggccacctggtgatcaagagcgccagctacaaggtggtgcccgtgagcctgagcgagctgtacctgctgcagtgcaacatgaagttcatgacccagagcgccttcgagagagccctgcccatcctgaacgtggccctggccagcctgcaccccatgaccgacgagcagatcttccaggccatcaacgccggccacatccagggcgagcagggctgggaggacttccagcagagaatggacgccctgagctgcttcctgatcaagagaagagacaagaccagaatgttctgccaccccagcttcagagagtggctggtgtggagagccgacggcgagaacaccgccttcctgtgcgagcccagaaacggccacgccctgctggccttcatgttcagcagacaggagggcaagctgaacagacagcagaccatggagctgggccaccacatcctgaaggcccacatcttcaagggcctgagcaagaagaccggcatcagcagcagccacctgcaggccctgtggatcggctacagcaccgagggcctgagcgccgccctggccagcctgagaaacctgtacacccccaacgtgaaggtgagcagactgctgatcctgggcggcgccaacgtgaactacagaaccgaggtgctgaacaacgcccccatcctgtgcgtgcagagccacctgggccacgaggaggtggtgaccctgctgctggagttcggcgcctgcctggacggcaccagcgagaacggcatgaccgccctgtgctacgccgccgccgccggccacatgaagctggtgtgcctgctgaccaagaagggcgtgagagtggaccacctggacaagaagggccagtgcgccctggtgcacagcgccctgagaggccacggcgacatcctgcagtacctgctgacctgcgagtggagccccggccccccccagcccggcaccctgagaaagagccacgccctgcagcaggccctgaccgccgccgccagcatgggccacagcagcgtggtgcagtgcctgctgggcatggagaaggagcacgaggtggaggtgaacggcaccgacaccctgtggggcgagaccgccctgaccgccgccgccggcagaggcaagctggaggtgtgcgagctgctgctgggccacggcgccgccgtgagcagaaccaacagaagaggcgtgccccccctgttctgcgccgccagacagggccactggcagatcgtgagactgctgctggagagaggctgcgacgtgaacctgagcgacaagcagggcagaacccccctgatggtggccgcctgcgagggccacctgagcaccgtggagttcctgctgagcaagggcgccgccctgagcagcctggacaaggagggcctgagcgccctgagctgggcctgcctgaagggccacagagccgtggtgcagtacctggtggaggagggcgccgccatcgaccagaccgacaagaacggcagaacccccctggacctggccgccttctacggcgacgccgagaccgtgctgtacctggtggagaagggcgccgtgatcgagcacgtggaccacagcggcatgagacccctggacagagccatcggctgcagaaacaccagcgtggtggtggccctgctgagaaagggcgccaagctgggcaacgccgcctgggccatggccaccagcaagcccgacatcctgatcatcctgctgcagaagctgatggaggagggcaacgtgatgtacaagaagggcaagatgaaggaggccgcccagagataccagtacgccctgagaaagttccccagagagggcttcggcgaggacatgagacccttcaacgagctgagagtgagcctgtacctgaacctgagcagatgcagaagaaagaccaacgacttcggcatggccgaggagttcgccagcaaggccctggagctgaagcccaagagctacgaggccttctacgccagagccagagccaagagaaacagcagacagttcgtggccgccctggccgacctgcaggaggccgtgaagctgtgccccaccaaccaggaggtgaagagactgctggccagagtggaggaggagtgcaagcagctgcagagaagccagcagcagaagcagcagggccccctgcccgcccccctgaacgacagcgagaacgaggaggacacccccacccccggcctgagcgaccacttccacagcgaggagaccgaggaggaggagaccagcccccaggaggagagcgtgagccccacccccagaagccagcccagcagcagcgtgcccagcagctacatcagaaacctgcaggagggcctgcagagcaagggcagacccgtgagcccccagagcagagccggcatcggcaagagcctgagagagcccgtggcccagcccggcctgctgctgcagcccagcaagcaggcccagatcgtgaagaccagccagcacctgggcagcggccagagcgccgtgagaaacggcagcatgaaggtgcagatcagcagccagaaccccccccccagccccatgcccggcagaatcgccgccacccccgccggcagcagaacccagcacctggagggcaccggcaccttcaccaccagagccggctgcggccacttcggcgacagactgggccccagccagaacgtgagactgcagtgcggcgagaacggccccgcccaccccctgcccagcaagaccaagaccaccgagagactgctgagccacagcagcgtggccgtggacgccgccccccccaaccagggcggcctggccacctgcagcgacgtgagacaccccgccagcctgaccagcagcggcagcagcggcagccccagcagcagcatcaagatgagcagcagcaccagcagcctgaccagcagcagcagcttcagcgacggcttcaaggtgcagggccccgacaccagaatcaaggacaaggtggtgacccacgtgcagagcggcaccgccgagcacagacccagaaacacccccttcatgggcatcatggacaagaccgccagattccagcagcagagcaacccccccagcagaagctggcactgccccgcccccgagggcctgctgaccaacaccagcagcgccgccggcctgcagagcgccaacaccgagaagcccagcctgatgcaggtgggcggctacaacaaccaggccaagacctgcagcgtgagcaccctgagcgccagcgtgcacaacggcgcccaggtgaaggagctggaggagagcaagtgccagatccccgtgcacagccaggagaacagaatcaccaagaccgtgagccacctgtaccaggagagcatcagcaagcagcagccccacatcagcaacgaggcccacagaagccacctgaccgccgccaagcccaagagaagcttcatcgagagcaacgtgtag

SEQ ID NO: 22842 - DNA, 5268 bp, Artificial Sequence
  Description of Artificial Sequence: Synthetic coding sequence
atgctgaaggccgtgctgaagaagagcagagagggcggcaagggcggcaagaaggaggccggcagcgacttcggccccgagaccagccccgtgctgcacctggaccacagcgccgacagccccgtgagcagcctgcccaccgccgaggacacctacagagtgagcctggccaagggcgtgagcatgagcctgcccagcagccccctgctgcccagacagagccacctggtgcagagcagagtgaacaagaagagccccggccccgtgagaaagcccaagtacgtggagagccccagagtgcccggcgacgccgtgatcatgcccttcagagaggtggccaagcccaccgagcccgacgagcacgccaccatcaccagcagcagcgagaacgacgacagaagcggcagcagcctggagtggaacaaggacggcaacctgagactgggcgtgcagaagggcgtgctgcacgacagaagagccgacaactgcagccccgtggccgaggaggagaccaccggcagcgccgagagcaccctgcccaaggccgagagcagcgccggcgacggccccgtgccctacagccagggcagcagcagcctgatcatgcccagacccaacagcgtggccgccaccagcagcaccaagctggaggacctgagctacctggacggccagagaaacgcccccctgagaaccagcatcagactgccctggcacaacaccgccggcggcagagcccaggaggtgaaggccagattcgccccctacaagccccaggacatcctgctgaagcccctgctgttcgaggtgcccagcatcaccaccgacagcgtgttcgtgggcagagactggctgttccaccagatcgaggagaacctgagaaacaccgagctggccgagaacagaggcgccgtggtggtgggcaacgtgggcttcggcaagaccgccatcatcagcaagctggtggccctgagctgccacggcagcagaatgagacagatcgccagcaacagccccggcagcagccccaagaccagcgaccccacccaggacctgcacttcacccccctgctgagccccagcagcagcaccagcgccagcagcaccgccaagacccccctgggcagcatcagcgccgagaaccagagacccagagaggacgccgtgaagtacctggccagcaaggtggtggcctaccactactgccaggccgacaacacctacacctgcctggtgcccgagttcgtgcacagcatcgccgccctgctgtgcagaagccaccagctggccgcctacagagacctgctgatcaaggagccccagctgcagagcatgctgagcctgagaagctgcgtgcaggaccccgtggccgccttcaagagaggcgtgctggagcccctgaccaacctgagaaacgagcagaagatccccgaggaggagtacatcatcctgatcgacggcctgaacgaggccgagttccacaagcccgactacggcgacaccctgagcagcttcatcaccaagatcatcagcaagttccccgcctggctgaagctgatcgtgaccgtgagagccaacttccaggagatcatcagcgccctgcccttcgtgaagctgagcctggacgacttccccgacaacaaggacatccacagcgacctgcacgcctacgtgcagcacagagtgcacagcagccaggacatcctgagcaacatcagcctgaacggcaaggccgacgccaccctgatcggcaaggtgagcagccacctggtgctgagaagcctgggcagctacctgtacctgaagctgaccctggacctgttccagagaggccacctggtgatcaagagcgccagctacaaggtggtgcccgtgagcctgagcgagctgtacctgctgcagtgcaacatgaagttcatgacccagagcgccttcgagagagccctgcccatcctgaacgtggccctggccagcctgcaccccatgaccgacgagcagatcttccaggccatcaacgccggccacatccagggcgagcagggctgggaggacttccagcagagaatggacgccctgagctgcttcctgatcaagagaagagacaagaccagaatgttctgccaccccagcttcagagagtggctggtgtggagagccgacggcgagaacaccgccttcctgtgcgagcccagaaacggccacgccctgctggccttcatgttcagcagacaggagggcaagctgaacagacagcagaccatggagctgggccaccacatcctgaaggcccacatcttcaagggcctgagcaagaagaccggcatcagcagcagccacctgcaggccctgtggatcggctacagcaccgagggcctgagcgccgccctggccagcctgagaaacctgtacacccccaacgtgaaggtgagcagactgctgatcctgggcggcgccaacgtgaactacagaaccgaggtgctgaacaacgcccccatcctgtgcgtgcagagccacctgggccacgaggaggtggtgaccctgctgctggagttcggcgcctgcctggacggcaccagcgagaacggcatgaccgccctgtgctacgccgccgccgccggccacatgaagctggtgtgcctgctgaccaagaagggcgtgagagtggaccacctggacaagaagggccagtgcgccctggtgcacagcgccctgagaggccacggcgacatcctgcagtacctgctgacctgcgagtggagccccggccccccccagcccggcaccctgagaaagagccacgccctgcagcaggccctgaccgccgccgccagcatgggccacagcagcgtggtgcagtgcctgctgggcatggagaaggagcacgaggtggaggtgaacggcaccgacaccctgtggggcgagaccgccctgaccgccgccgccggcagaggcaagctggaggtgtgcgagctgctgctgggccacggcgccgccgtgagcagaaccaacagaagaggcgtgccccccctgttctgcgccgccagacagggccactggcagatcgtgagactgctgctggagagaggctgcgacgtgaacctgagcgacaagcagggcagaacccccctgatggtggccgcctgcgagggccacctgagcaccgtggagttcctgctgagcaagggcgccgccctgagcagcctggacaaggagggcctgagcgccctgagctgggcctgcctgaagggccacagagccgtggtgcagtacctggtggaggagggcgccgccatcgaccagaccgacaagaacggcagaacccccctggacctggccgccttctacggcgacgccgagaccgtgctgtacctggtggagaagggcgccgtgatcgagcacgtggaccacagcggcatgagacccctggacagagccatcggctgcagaaacaccagcgtggtggtggccctgctgagaaagggcgccaagctgggcaacgccgcctgggccatggccaccagcaagcccgacatcctgatcatcctgctgcagaagctgatggaggagggcaacgtgatgtacaagaagggcaagatgaaggaggccgcccagagataccagtacgccctgagaaagttccccagagagggcttcggcgaggacatgagacccttcaacgagctgagagtgagcctgtacctgaacctgagcagatgcagaagaaagaccaacgacttcggcatggccgaggagttcgccagcaaggccctggagctgaagcccaagagctacgaggccttctacgccagagccagagccaagagaaacagcagacagttcgtggccgccctggccgacctgcaggaggccgtgaagctgtgccccaccaaccaggaggtgaagagactgctggccagagtggaggaggagtgcaagcagctgcagagaagccagcagcagaagcagcagggccccctgcccgcccccctgaacgacagcgagaacgaggaggacacccccacccccggcctgagcgaccacttccacagcgaggagaccgaggaggaggagaccagcccccaggaggagagcgtgagccccacccccagaagccagcccagcagcagcgtgcccagcagctacatcagaaacctgcaggagggcctgcagagcaagggcagacccgtgagcccccagagcagagccggcatcggcaagagcctgagagagcccgtggcccagcccggcctgctgctgcagcccagcaagcaggcccagatcgtgaagaccagccagcacctgggcagcggccagagcgccgtgagaaacggcagcatgaaggtgcagatcagcagccagaaccccccccccagccccatgcccggcagaatcgccgccacccccgccggcagcagaacccagcacctggagggcaccggcaccttcaccaccagagccggctgcggccacttcggcgacagactgggccccagccagaacgtgagactgcagtgcggcgagaacggccccgcccaccccctgcccagcaagaccaagaccaccgagagactgctgagccacagcagcgtggccgtggacgccgccccccccaaccagggcggcctggccacctgcagcgacgtgagacaccccgccagcctgaccagcagcggcagcagcggcagccccagcagcagcatcaagatgagcagcagcaccagcagcctgaccagcagcagcagcttcagcgacggcttcaaggtgcagggccccgacaccagaatcaaggacaaggtggtgacccacgtgcagagcggcaccgccgagcacagacccagaaacacccccttcatgggcatcatggacaagaccgccagattccagcagcagagcaacccccccagcagaagctggcactgccccgcccccgagggcctgctgaccaacaccagcagcgccgccggcctgcagagcgccaacaccgagaagcccagcctgatgcaggtgggcggctacaacaaccaggccaagacctgcagcgtgagcaccctgagcgccagcgtgcacaacggcgcccaggtgaaggagctggaggagagcaagtgccagatccccgtgcacagccaggagaacagaatcaccaagaccgtgagccacctgtaccaggagagcatcagcaagcagcagccccacatcagcaacgaggcccacagaagccacctgaccgccgccaagcccaagagaagcttcatcgagagcaacgtgtag

SEQ ID NO: 22843 - DNA, 2139 bp, Artificial Sequence
  Description of Artificial Sequence: Synthetic coding sequence
atggcccagagcagcccccagctggacatccaggtgctgcacgacctgagacagagattccccgagatccccgagggcgtggtgagccagtgcatgctgcagaacaacaacaacctggaggcctgctgcagagccctgagccaggagagcagcaagtacctgtacatggagtaccacagccccgacgacaacagaatgaacagaaacagactgctgcacatcaacctgggcatccacagccccagcagctaccaccccggcgacggcgcccagctgaacggcggcagaaccctggtgcacagcagcagcgacggccacatcgacccccagcacgccgccggcaagcagctgatctgcctggtgcaggagccccacagcgcccccgccgtggtggccgccacccccaactacaaccccttcttcatgaacgagcagaacagaagcgccgccaccccccccagccagcccccccagcagcccagcagcatgcagaccggcatgaaccccagcgccatgcagggccccagcccccccccccccccccccagctacatgcacatccccagatacagcaccaaccccatcaccgtgaccgtgagccagaacctgcccagcggccagaccgtgcccagagccctgcagatcctgccccagatccccagcaacctgtacggcagccccggcagcatctacatcagacagaccagccagagcagcagcggcagacagaccccccagagcaccccctggcagagcagcccccagggccccgtgccccactacagccagagacccctgcccgtgtacccccaccagcagaactaccagcccagccagtacagccccaagcagcagcagatcccccagagcgcctaccacagccccccccccagccagtgccccagccccttcagcagcccccagcaccaggtgcagcccagccagctgggccacatcttcatgccccccagccccagcaccacccccccccacccctaccagcagggcccccccagctaccagaagcagggcagccacagcgtggcctacctgccctacaccgccagcagcctgagcaagggcagcatgaagaagatcgagatcaccgtggagcccagccagagacccggcaccgccatcaacagaagccccagccccatcagcaaccagcccagcccctggaaccagcacagcctgtacaccgccaccaccccccccagcagcagccccagcagaggcatcagcagccagcccaagccccccttcagcgtgaaccccgtgtacatcacctacacccagcccaccggccccagctgcacccccagccccagccccagagtgatccccaaccccaccaccgtgttcaagatcaccgtgggcagagccaccaccgagaacctgctgaacctggtggaccaggaggagagaagcgccgcccccgagcccatccagcccatcagcgtgatccccggcagcggcggcgagaagggcagccacaagtaccagagaagcagcagcagcggcagcgacgactacgcctacacccaggccctgctgctgcaccagagagccagaatggagagactggccaagcagctgaagctggagaaggaggagctggagagactgaagagcgaggtgaacggcatggagcacgacctgatgcagagaagactgagaagagtgagctgcaccaccgccatccccacccccgaggagatgaccagactgagaagcatgaacagacagctgcagatcaacgtggactgcaccctgaaggaggtggacctgctgcagagcagaggcaacttcgaccccaaggccatgaacaacttctacgacaacatcgagcccggccccgtggtgccccccaagcccagcaagaaggacagcagcgacccctgcaccatcgagagaaaggccagaagaatcagcgtgaccagcaaggtgcaggccgacatccacgacacccaggccgccgccgccgacgagcacagaaccggcagcacccagagccccagaacccagcccagagacgaggactacgagggcgccccctggaactgcgacagctgcaccttcctgaaccaccccgccctgaacagatgcgagcagtgcgagatgcccagatacacctag

SEQ ID NO: 22844 - DNA, 252 bp, Artificial Sequence
  Description of Artificial Sequence: Synthetic coding sequence
atggagcacgacctgatgcagagaagactgagaagagtgagctgcaccaccgccatccccacccccgaggagatgaccagactgagaagcatgaacagacagctgcagatcaacgtggactgcaccctgaaggaggtggacctgctgcagagcagagaggtgtactacagcagaagcagcctgaagctgagcttcacccagctgaccagactggagatggtgttcatcttctgcggcaagtacaccgactag

SEQ ID NO: 22845 - DNA, 2139 bp, Artificial Sequence; identical to SEQ ID NO: 22843
  Description of Artificial Sequence: Synthetic coding sequence

SEQ ID NO: 22846 - DNA, 2055 bp, Artificial Sequence
  Description of Artificial Sequence: Synthetic coding sequence
atggcccagagcagcccccagctggacatccaggtgctgcacgacctgagacagagattccccgagatccccgagggcgtggtgagccagtgcatgctgcagaacaacaacaacctggaggcctgctgcagagccctgagccaggagagcagcaagtacctgtacatggagtaccacagccccgacgacaacagaatgaacagaaacagactgctgcacatcaacctgggcatccacagccccagcagctaccaccccggcgacggcgcccagctgaacggcggcagaaccctggtgcacagcagcagcgacggccacatcgacccccagcacgccgccggcaagcagctgatctgcctggtgcaggagccccacagcgcccccgccgtggtggccgccacccccaactacaaccccttcttcatgaacgagcagaacagaagcgccgccaccccccccagccagcccccccagcagcccagcagcatgcagaccggcatgaaccccagcgccatgcagggccccagcccccccccccccccccccagctacatgcacatccccagatacagcaccaaccccatcaccgtgaccgtgagccagaacctgcccagcggccagaccgtgcccagagccctgcagatcctgccccagatccccagcaacctgtacggcagccccggcagcatctacatcagacagaccagccagagcagcagcggcagacagaccccccagagcaccccctggcagagcagcccccagggccccgtgccccactacagccagagacccctgcccgtgtacccccaccagcagaactaccagcccagccagtacagccccaagcagcagcagatcccccagagcgcctaccacagccccccccccagccagtgccccagccccttcagcagcccccagcaccaggtgcagcccagccagctgggccacatcttcatgccccccagccccagcaccacccccccccacccctaccagcagggcccccccagctaccagaagcagggcagccacagcgtggcctacctgccctacaccgccagcagcctgagcaagggcagcatgaagaagatcgagatcaccgtggagcccagccagagacccggcaccgccatcaacagaagccccagccccatcagcaaccagcccagcccctggaaccagcacagcctgtacaccgccaccaccccccccagcagcagccccagcagaggcatcagcagccagcccaagccccccttcagcgtgaaccccgtgtacatcacctacacccagcccaccggccccagctgcacccccagccccagccccagagtgatccccaaccccaccaccgtgttcaagatcaccgtgggcagagccaccaccgagaacctgctgaacctggtggaccaggaggagagaagcgccgcccccgagcccatccagcccatcagcgtgatccccggcagcggcggcgagaagggcagccacaagtaccagagaagcagcagcagcggcagcgacgactacgcctacacccaggccctgctgctgcaccagagagccagaatggagagactggccaagcagctgaagctggagaaggaggagctggagagactgaagagcgaggtgaacggcatggagcacgacctgatgcagagaagactgagaagagtgagctgcaccaccgccatccccacccccgaggagatgaccagactgagaagcatgaacagacagctgcagatcaacgtggactgcaccctgaaggaggtggacctgctgcagagcagagacagcagcgacccctgcaccatcgagagaaaggccagaagaatcagcgtgaccagcaaggtgcaggccgacatccacgacacccaggccgccgccgccgacgagcacagaaccggcagcacccagagccccagaacccagcccagagacgaggactacgagggcgccccctggaactgcgacagctgcaccttcctgaaccaccccgccctgaacagatgcgagcagtgcgagatgcccagatacacctag

SEQ ID NO: 22847 - DNA, 2139 bp, Artificial Sequence; identical to SEQ ID NO: 22843
  Description of Artificial Sequence: Synthetic coding sequence

SEQ ID NO: 22848 - DNA, 723 bp, Artificial Sequence
  Description of Artificial Sequence: Synthetic coding sequence
atgctgagaagctgcgccgccagactgagaaccctgggcgccctgtgcctgccccccgtgggcagaagactgcccggcagcgagcccagacccgagctgagaagcttcagcagcgaggaggtgatcctgaaggactgcagcgtgcccaaccccagctggaacaaggacctgagactgctgttcgaccagttcatgaagaagtgcgaggacggcagctggaagagactgcccagctacaagagaacccccaccgagtggatccaggacttcaagacccacttcctggaccccaagctgatgaaggaggagcagatgagccaggcccagctgttcaccagaagcttcgacgacggcctgggcttcgagtacgtgatgttctacaacgacatcgagaagagaatggtgtgcctgttccagggcggcccctacctggagggcccccccggcttcatccacggcggcgccatcgccaccatgatcgacgccaccgtgggcatgtgcgccatgatggccggcggcatcgtgatgaccgccaacctgaacatcaactacaagagacccatccccctgtgcagcgtggtgatgatcaacagccagctggacaaggtggagggcagaaagttcttcgtgagctgcaacgtgcagagcgtggacgagaagaccctgtacagcgaggccaccagcctgttcatcaagctgaaccccgccaagagcctgacctag

SEQ ID NO: 22849 - DNA, 744 bp, Artificial Sequence
  Description of Artificial Sequence: Synthetic coding sequence
atgatcagaagatgcttccaggtggccgccagactgggccaccacagaggcctgctggaggcccccagaatcctgcccagactgaaccccgccagcgccttcggcagcagcaccgacagcatgttcagcagattcctgcccgagaagaccgacctgaaggactacgccctgcccaacgccagctggtgcagcgacatgctgagcctgtaccaggagttcctggagaagaccaagagcagcggctggatcaagctgcccagcttcaagagcaacagagaccacatcagaggcctgaagctgcccagcggcctggccgtgagcagcgacaagggcgactgcagaatcttcaccagatgcatccaggtggagggccagggcttcgagtacgtgatcttcttccagcccacccagaagaagagcgtgtgcctgttccagcccggcagctacctggagggcccccccggcttcgcccacggcggcagcctggccgccatgatggacgagaccttcagcaagaccgccttcctggccggcgagggcctgttcaccctgagcctgaacatcagattcaagaacctgatccccgtggacagcctggtggtgatggacgtggagctggacaagatcgaggaccagaagctgtacatgagctgcatcgcccacagcagagaccagcagaccgtgtacgccaagagcagcggcgtgttcctgcagctgcagctggaggaggagagcccccagtag

SEQ ID NO: 22850 - DNA, 5883 bp, Artificial Sequence
  Description of Artificial Sequence: Synthetic coding sequence
atggcccagcaggccgccgacaagtacctgtacgtggacaagaacttcatcaacaaccccctggcccaggccgactgggccgccaagaagctggtgtgggtgcccagcgacaagagcggcttcgagcccgccagcctgaaggaggaggtgggcgaggaggccatcgtggagctggtggagaacggcaagaaggtgaaggtgaacaaggacgacatccagaagatgaacccccccaagttcagcaaggtggaggacatggccgagctgacctgcctgaacgaggccagcgtgctgcacaacctgaaggagagatactacagcggcctgatctacacctacagcggcctgttctgcgtggtgatcaacccctacaagaacctgcccatctacagcgaggagatcgtggagatgtacaagggcaagaagagacacgagatgcccccccacatctacgccatcaccgacaccgcctacagaagcatgatgcaggacagagaggaccagagcatcctgtgcaccggcgagagcggcgccggcaagaccgagaacaccaagaaggtgatccagtacctggcctacgtggccagcagccacaagagcaagaaggaccagggcgagctggagagacagctgctgcaggccaaccccatcctggaggccttcggcaacgccaagaccgtgaagaacgacaacagcagcagattcggcaagttcatcagaatcaacttcgacgtgaacggctacatcgtgggcgccaacatcgagacctacctgctggagaagagcagagccatcagacaggccaaggaggagagaaccttccacatcttctactacctgctgagcggcgccggcgagcacctgaagaccgacctgctgctggagccctacaacaagtacagattcctgagcaacggccacgtgaccatccccggccagcaggacaaggacatgttccaggagaccatggaggccatgagaatcatgggcatccccgaggaggagcagatgggcctgctgagagtgatcagcggcgtgctgcagctgggcaacatcgtgttcaagaaggagagaaacaccgaccaggccagcatgcccgacaacaccgccgcccagaaggtgagccacctgctgggcatcaacgtgaccgacttcaccagaggcatcctgacccccagaatcaaggtgggcagagactacgtgcagaaggcccagaccaaggagcaggccgacttcgccatcgaggccctggccaaggccacctacgagagaatgttcagatggctggtgctgagaatcaacaaggccctggacaagaccaagagacagggcgccagcttcatcggcatcctggacatcgccggcttcgagatcttcgacctgaacagcttcgagcagctgtgcatcaactacaccaacgagaagctgcagcagctgttcaaccacaccatgttcatcctggagcaggaggagtaccagagagagggcatcgagtggaacttcatcgacttcggcctggacctgcagccctgcatcgacctgatcgagaagcccgccggcccccccggcatcctggccctgctggacgaggagtgctggttccccaaggccaccgacaagagcttcgtggagaaggtgatgcaggagcagggcacccaccccaagttccagaagcccaagcagctgaaggacaaggccgacttctgcatcatccactacgccggcaaggtggactacaaggccgacgagtggctgatgaagaacatggaccccctgaacgacaacatcgccaccctgctgcaccagagcagcgacaagttcgtgagcgagctgtggaaggacgtggacagaatcatcggcctggaccaggtggccggcatgagcgagaccgccctgcccggcgccttcaagaccagaaagggcatgttcagaaccgtgggccagctgtacaaggagcagctggccaagctgatggccaccctgagaaacaccaaccccaacttcgtgagatgcatcatccccaaccacgagaagaaggccggcaagctggacccccacctggtgctggaccagctgagatgcaacggcgtgctggagggcatcagaatctgcagacagggcttccccaacagagtggtgttccaggagttcagacagagatacgagatcctgacccccaacagcatccccaagggcttcatggacggcaagcaggcctgcgtgctgatgatcaaggccctggagctggacagcaacctgtacagaatcggccagagcaaggtgttcttcagagccggcgtgctggcccacctggaggaggagagagacctgaagatcaccgacgtgatcatcggcttccaggcctgctgcagaggctacctggccagaaaggccttcgccaagagacagcagcagctgaccgccatgaaggtgctgcagagaaactgcgccgcctacctgaagctgagaaactggcagtggtggagactgttcaccaaggtgaagcccctgctgcaggtgagcagacaggaggaggagatgatggccaaggaggaggagctggtgaaggtgagagagaagcagctggccgccgagaacagactgaccgagatggagaccctgcagagccagctgatggccgagaagctgcagctgcaggagcagctgcaggccgagaccgagctgtgcgccgaggccgaggagctgagagccagactgaccgccaagaagcaggagctggaggagatctgccacgacctggaggccagagtggaggaggaggaggagagatgccagcacctgcaggccgagaagaagaagatgcagcagaacatccaggagctggaggagcagctggaggaggaggagagcgccagacagaagctgcagctggagaaggtgaccaccgaggccaagctgaagaagctggaggaggagcagatcatcctggaggaccagaactgcaagctggccaaggagaagaagctgctggaggacagaatcgccgagttcaccaccaacctgaccgaggaggaggagaagagcaagagcctggccaagctgaagaacaagcacgaggccatgatcaccgacctggaggagagactgagaagagaggagaagcagagacaggagctggagaagaccagaagaaagctggagggcgacagcaccgacctgagcgaccagatcgccgagctgcaggcccagatcgccgagctgaagatgcagctggccaagaaggaggaggagctgcaggccgccctggccagagtggaggaggaggccgcccagaagaacatggccctgaagaagatcagagagctggagagccagatcagcgagctgcaggaggacctggagagcgagagagccagcagaaacaaggccgagaagcagaagagagacctgggcgaggagctggaggccctgaagaccgagctggaggacaccctggacagcaccgccgcccagcaggagctgagaagcaagagagagcaggaggtgaacatcctgaagaagaccctggaggaggaggccaagacccacgaggcccagatccaggagatgagacagaagcacagccaggccgtggaggagctggccgagcagctggagcagaccaagagagtgaaggccaacctggagaaggccaagcagaccctggagaacgagagaggcgagctggccaacgaggtgaaggtgctgctgcagggcaagggcgacagcgagcacaagagaaagaaggtggaggcccagctgcaggagctgcaggtgaagttcaacgagggcgagagagtgagaaccgagctggccgacaaggtgaccaagctgcaggtggagctggacaacgtgaccggcctgctgagccagagcgacagcaagagcagcaagctgaccaaggacttcagcgccctggagagccagctgcaggacacccaggagctgctgcaggaggagaacagacagaagctgagcctgagcaccaagctgaagcaggtggaggacgagaagaacagcttcagagagcagctggaggaggaggaggaggccaagcacaacctggagaagcagatcgccaccctgcacgcccaggtggccgacatgaagaagaagatggaggacagcgtgggctgcctggagaccgccgaggaggtgaagagaaagctgcagaaggacctggagggcctgagccagagacacgaggagaaggtggccgcctacgacaagctggagaagaccaagaccagactgcagcaggagctggacgacctgctggtggacctggaccaccagagacagagcgcctgcaacctggagaagaagcagaagaagttcgaccagctgctggccgaggagaagaccatcagcgccaagtacgccgaggagagagacagagccgaggccgaggccagagagaaggagaccaaggccctgagcctggccagagccctggaggaggccatggagcagaaggccgagctggagagactgaacaagcagttcagaaccgagatggaggacctgatgagcagcaaggacgacgtgggcaagagcgtgcacgagctggagaagagcaagagagccctggagcagcaggtggaggagatgaagacccagctggaggagctggaggacgagctgcaggccaccgaggacgccaagctgagactggaggtgaacctgcaggccatgaaggcccagttcgagagagacctgcagggcagagacgagcagagcgaggagaagaagaagcagctggtgagacaggtgagagagatggaggccgagctggaggacgagagaaagcagagaagcatggccgtggccgccagaaagaagctggagatggacctgaaggacctggaggcccacatcgacagcgccaacaagaacagagacgaggccatcaagcagctgagaaagctgcaggcccagatgaaggactgcatgagagagctggacgacaccagagccagcagagaggagatcctggcccaggccaaggagaacgagaagaagctgaagagcatggaggccgagatgatccagctgcaggaggagctggccgccgccgagagagccaagagacaggcccagcaggagagagacgagctggccgacgagatcgccaacagcagcggcaagggcgccctggccctggaggagaagagaagactggaggccagaatcgcccagctggaggaggagctggaggaggagcagggcaacaccgagctgatcaacgacagactgaagaaggccaacctgcagatcgaccagatcaacaccgacctgaacctggagagaagccacgcccagaagaacgagaacgccagacagcagctggagagacagaacaaggagctgaaggtgaagctgcaggagatggagggcaccgtgaagagcaagtacaaggccagcatcaccgccctggaggccaagatcgcccagctggaggagcagctggacaacgagaccaaggagagacaggccgcctgcaagcaggtgagaagaaccgagaagaagctgaaggacgtgctgctgcaggtggacgacgagagaagaaacgccgagcagtacaaggaccaggccgacaaggccagcaccagactgaagcagctgaagagacagctggaggaggccgaggaggaggcccagagagccaacgccagcagaagaaagctgcagagagagctggaggacgccaccgagaccgccgacgccatgaacagagaggtgagcagcctgaagaacaagctgagaagaggcgacctgcccttcgtggtgcccagaagaatggccagaaagggcgccggcgacggcagcgacgaggaggtggacggcaaggccgacggcgccgaggccaagcccgccgagtag

SEQ ID NO: 22851 - DNA, 501 bp, Artificial Sequence
  Description of Artificial Sequence: Synthetic coding sequence
atggcccagagactgctgctgagaagattcctggccagcgtgatcagcagaaagcccagccagggccagtggccccccctgaccagcagagccctgcagaccccccagtgcagccccggcggcctgaccgtgacccccaaccccgccagaaccatctacaccaccagaatcagcctgaccaccttcaacatccaggacggccccgacttccaggacagagtggtgaacagcgagacccccgtggtggtggacttccacgcccagtggtgcggcccctgcaagatcctgggccccagactggagaagatggtggccaagcagcacggcaaggtggtgatggccaaggtggacatcgacgaccacaccgacctggccatcgagtacgaggtgagcgccgtgcccaccgtgctggccatgaagaacggcgacgtggtggacaagttcgtgggcatcaaggacgaggaccagctggaggccttcctgaagaagctgatcggctag

SEQ ID NO: 22852 - DNA, 2877 bp, Artificial Sequence
  Description of Artificial Sequence: Synthetic coding sequence
atgagcgagtgcggcggcagaggcggcggcagcagcagcagcgaggacgccgaggacgagggcggcggcggcggcggccccgccggcagcgactgcctgagcagcagccccaccctggccaccgccagcagcgccggcagactgagaagaggcctgagaggcgccttcctgatggccagacagagacccgagctgctgtgcggcgccgtggccctgggctgcgccctgctgctggccctgaagttcacctgcagcagagccaaggacgtgatcatccccgccaagccccccgtgagcttcttcagcctgagaagccccgtgctggacctgttccagggccagctggactacgccgagtacgtgagaagagacagcgaggtggtgctgctgttcttctacgccccctggtgcggccagagcatcgccgccagagccgagatcgagcaggccgccagcagactgagcgaccaggtgctgttcgtggccatcaactgctggtggaaccagggcaagtgcagaaagcagaagcacttcttctacttccccgtgatctacctgtaccacagaagcttcggccccatcgagtacaagggccccatgagcgccgtgtacatcgagaagttcgtgagaagagtgatgaagcccctgctgtacatccccagccagagcgagctgctggacttcctgagcaactacgagcccggcgtgctgggctacttcgagttcagcggcagcccccagccccccggctacctgaccttcttcaccagcgccctgcacagcctgaagaaggactacctgggcaccgtgagattcggcgtgatcaccaacaagcacctggccaagctggtgagcctggtgcacagcggcagcgtgtacctgcacagacacttcaacaccagcctggtgttccccagagaggtgctgaactacaccgccgagaacatctgcaagtgggccctggagaaccaggagaccctgttcagatggctgagaccccacggcggcaagagcctgctgctgaacaacgagctgaagaagggccccgccctgttcctgttcatccccttcaaccccctggccgagagccaccccctgatcgacgagatcaccgaggtggccctggagtacaacaactgccacggcgaccaggtggtggagagactgctgcagcacctgagaagagtggacgcccccgtgctggagagcctggccctggaggtgcccgcccagctgcccgacccccccaccatcaccgccagcccctgctgcaacaccgtggtgctgccccagtggcacagcttcagcagaacccacaacgtgtgcgagctgtgcgtgaaccagaccagcggcggcatgaagcccagcagcgtgagcgtgccccagtgcagcttcttcgagatggccgccgccctggacagcttctacctgaaggagcagaccttctaccacgtggccagcgacagcatcgagtgcagcaacttcctgaccagctacagccccttcagctactacaccgcctgctgcagaaccatcagcagaggcgtgagcggcttcatcgacagcgagcagggcgtgttcgaggcccccaccgtggccttcagcagcctggagaagaagtgcgaggtggacgcccccagcagcgtgccccacatcgaggagaacagatacctgttccccgaggtggacatgaccagcaccaacttcaccggcctgagctgcagaaccaacaagaccctgaacatctacctgctggacagcaacctgttctggctgtacgccgagagactgggcgcccccagcagcacccaggtgaaggagttcgccgccatcgtggacgtgaaggaggagagccactacatcctggaccccaagcaggccctgatgaagctgaccctggagagcttcatccagaacttcagcgtgctgtacagccccctgaagagacacctgatcggcagcggcagcgcccagttccccagccagcacctgatcaccgaggtgaccaccgacaccttctgggaggtggtgctgcagaagcaggacgtgctgctgctgtactacgccccctggtgcggcttctgccccagcctgaaccacatcttcatccagctggccagaaacctgcccatggacaccttcaccgtggccagaatcgacgtgagccagaacgacctgccctgggagttcatggtggacagactgcccaccgtgctgttcttcccctgcaacagaaaggacctgagcgtgaagtaccccgaggacgtgcccatcaccctgcccaacctgctgagattcatcctgcaccacagcgaccccgccagcagcccccagaacgtggccaacagccccaccaaggagtgcctgcagagcgaggccgtgctgcagagaggccacatcagccacctggagagagagatccagaagctgagagccgagatcagcagcctgcagagagcccaggtgcaggtggagagccagctgagcagcgccagaagagacgagcacagactgagacagcagcagagagccctggaggagcagcacagcctgctgcacgcccacagcgagcagctgcaggccctgtacgagcagaagaccagagagctgcaggagctggccagaaagctgcaggagctggccgacgccagcgagaacctgctgaccgagaacacctggctgaagatcctggtggccaccatggagagaaagctggagggcagagacggcgccgagagcctggccgcccagagagaggtgcaccccaagcagcccgagcccagcgccaccccccagctgcccggcagcagccccccccccgccaacgtgagcgccaccctggtgagcgagagaaacaaggagaacagaaccgactag

SEQ ID NO: 22853 - DNA, 2958 bp, Artificial Sequence
  Description of Artificial Sequence: Synthetic coding sequence
atgagcgagtgcggcggcagaggcggcggcagcagcagcagcgaggacgccgaggacgagggcggcggcggcggcggccccgccggcagcgactgcctgagcagcagccccaccctggccaccgccagcagcgccggcagactgagaagaggcctgagaggcgccttcctgatggccagacagagacccgagctgctgtgcggcgccgtggccctgggctgcgccctgctgctggccctgaagttcacctgcagcagagccaaggacgtgatcatccccgccaagccccccgtgagcttcttcagcctgagaagccccgtgctggacctgttccagggccagctggactacgccgagtacgtgagaagagacagcgaggtggtgctgctgttcttctacgccccctggtgcggccagagcatcgccgccagagccgagatcgagcaggccgccagcagactgagcgaccaggtgctgttcgtggccatcaactgctggtggaaccagggcaagtgcagaaagcagaagcacttcttctacttccccgtgatctacctgtaccacagaagcttcggccccatcgagtacaagggccccatgagcgccgtgtacatcgagaagttcgtgagaagagtgatgaagcccctgctgtacatccccagccagagcgagctgctggacttcctgagcaactacgagcccggcgtgctgggctacttcgagttcagcggcagcccccagccccccggctacctgaccttcttcaccagcgccctgcacagcctgaagaaggccctggagagcaccagcagccccagagccctggtgagcttcaccggcgagtggcacctggagaccaagatctacgtgctggactacctgggcaccgtgagattcggcgtgatcaccaacaagcacctggccaagctggtgagcctggtgcacagcggcagcgtgtacctgcacagacacttcaacaccagcctggtgttccccagagaggtgctgaactacaccgccgagaacatctgcaagtgggccctggagaaccaggagaccctgttcagatggctgagaccccacggcggcaagagcctgctgctgaacaacgagctgaagaagggccccgccctgttcctgttcatccccttcaaccccctggccgagagccaccccctgatcgacgagatcaccgaggtggccctggagtacaacaactgccacggcgaccaggtggtggagagactgctgcagcacctgagaagagtggacgcccccgtgctggagagcctggccctggaggtgcccgcccagctgcccgacccccccaccatcaccgccagcccctgctgcaacaccgtggtgctgccccagtggcacagcttcagcagaacccacaacgtgtgcgagctgtgcgtgaaccagaccagcggcggcatgaagcccagcagcgtgagcgtgccccagtgcagcttcttcgagatggccgccgccctggacagcttctacctgaaggagcagaccttctaccacgtggccagcgacagcatcgagtgcagcaacttcctgaccagctacagccccttcagctactacaccgcctgctgcagaaccatcagcagaggcgtgagcggcttcatcgacagcgagcagggcgtgttcgaggcccccaccgtggccttcagcagcctggagaagaagtgcgaggtggacgcccccagcagcgtgccccacatcgaggagaacagatacctgttccccgaggtggacatgaccagcaccaacttcaccggcctgagctgcagaaccaacaagaccctgaacatctacctgctggacagcaacctgttctggctgtacgccgagagactgggcgcccccagcagcacccaggtgaaggagttcgccgccatcgtggacgtgaaggaggagagccactacatcctggaccccaagcaggccctgatgaagctgaccctggagagcttcatccagaacttcagcgtgctgtacagccccctgaagagacacctgatcggcagcggcagcgcccagttccccagccagcacctgatcaccgaggtgaccaccgacaccttctgggaggtggtgctgcagaagcaggacgtgctgctgctgtactacgccccctggtgcggcttctgccccagcctgaaccacatcttcatccagctggccagaaacctgcccatggacaccttcaccgtggccagaatcgacgtgagccagaacgacctgccctgggagttcatggtggacagactgcccaccgtgctgttcttcccctgcaacagaaaggacctgagcgtgaagtaccccgaggacgtgcccatcaccctgcccaacctgctgagattcatcctgcaccacagcgaccccgccagcagcccccagaacgtggccaacagccccaccaaggagtgcctgcagagcgaggccgtgctgcagagaggccacatcagccacctggagagagagatccagaagctgagagccgagatcagcagcctgcagagagcccaggtgcaggtggagagccagctgagcagcgccagaagagacgagcacagactgagacagcagcagagagccctggaggagcagcacagcctgctgcacgcccacagcgagcagctgcaggccctgtacgagcagaagaccagagagctgcaggagctggccagaaagctgcaggagctggccgacgccagcgagaacctgctgaccgagaacacctggctgaagatcctggtggccaccatggagagaaagctggagggcagagacggcgccgagagcctggccgcccagagagaggtgcaccccaagcagcccgagcccagcgccaccccccagctgcccggcagcagccccccccccgccaacgtgagcgccaccctggtgagcgagagaaacaaggagaacagaaccgactag

SEQ ID NO: 22854 - DNA, 666 bp, Artificial Sequence
  Description of Artificial Sequence: Synthetic coding sequence
atggccagacagagacccgagctgctgtgcggcgccgtggccctgggctgcgccctgctgctggccctgaagttcacctgcagcagagccaaggacgtgatcatccccgccaagccccccgtgagcttcttcagcctgagaagccccgtgctggacctgttccagggccagctggactacgccgagtacgtgagaagagacagcgaggtggtgctgctgttcttctacgccccctggtgcggccagagcatcgccgccagagccgagatcgagcaggccgccagcagactgagcgaccaggtgctgttcgtggccatcaactgctggtggaaccagggcaagtgcagaaagcagaagcacttcttctacttccccgtgatctacctgtaccacagaagcttcggccccatcgagtacaagggccccatgagcgccgtgtacatcgagaagttcgtgagaagagtgatgaagcccctgctgtacatccccagccagagcgagctgctggacttcctgagcaactacgagcccggcgtgctgggctacttcgagttcagcggcagcccccagccccccggctacctgaccttcttcaccagcgccctgcacagcctgaagaaggacggcgtgagcccctgcagacccggctggagcgccgtggcctag

SEQ ID NO: 22855 - DNA, 1083 bp, Artificial Sequence
  Description of Artificial Sequence: Synthetic coding sequence
atggtgcccgccgccggcagaagaccccccagagtgatgagactgctgggctggtggcaggtgctgctgtgggtgctgggcctgcccgtgagaggcgtggaggtggccgaggagagcggcagactgtggagcgaggagcagcccgcccaccccctgcaggtgggcgccgtgtacctgggcgaggaggagctgctgcacgaccccatgggccaggacagagccgccgaggaggccaacgccgtgctgggcctggacacccagggcgaccacatggtgatgctgagcgtgatccccggcgaggccgaggacaaggtgagcagcgagcccagcggcgtgacctgcggcgccggcggcgccgaggacagcagatgcaacgtgagagagagcctgttcagcctggacggcgccggcgcccacttccccgacagagaggaggagtactacaccgagcccgaggtggccgagagcgacgccgcccccaccgaggacagcaacaacaccgagagcctgaagagccccaaggtgaactgcgaggagagaaacatcaccggcctggagaacttcaccctgaagatcctgaacatgagccaggacctgatggacttcctgaaccccaacggcagcgactgcaccctggtgctgttctacaccccctggtgcagattcagcgccagcctggccccccacttcaacagcctgcccagagccttccccgccctgcacttcctggccctggacgccagccagcacagcagcctgagcaccagattcggcaccgtggccgtgcccaacatcctgctgttccagggcgccaagcccatggccagattcaaccacaccgacagaaccctggagaccctgaagatcttcatcttcaaccagaccggcatcgaggccaagaagaacgtggtggtgacccaggccgaccagatcggccccctgcccagcaccctgatcaagagcgtggactggctgctggtgttcagcctgttcttcctgatcagcttcatcatgtacgccaccatcagaaccgagagcatcagatggctgatccccggccaggagcaggagcacgtggagtag

SEQ ID NO: 22856 - DNA, 1035 bp, Artificial Sequence
  Description of Artificial Sequence: Synthetic coding sequence
atggtgcccgccgccggcagaagaccccccagagtgatgagactgctgggctggtggcaggtgctgctgtgggtgctgggcctgcccgtgagaggcgtggaggtggccgaggagagcggcagactgtggagcgaggaggagctgctgcacgaccccatgggccaggacagagccgccgaggaggccaacgccgtgctgggcctggacacccagggcgaccacatggtgatgctgagcgtgatccccggcgaggccgaggacaaggtgagcagcgagcccagcggcgtgacctgcggcgccggcggcgccgaggacagcagatgcaacgtgagagagagcctgttcagcctggacggcgccggcgcccacttccccgacagagaggaggagtactacaccgagcccgaggtggccgagagcgacgccgcccccaccgaggacagcaacaacaccgagagcctgaagagccccaaggtgaactgcgaggagagaaacatcaccggcctggagaacttcaccctgaagatcctgaacatgagccaggacctgatggacttcctgaaccccaacggcagcgactgcaccctggtgctgttctacaccccctggtgcagattcagcgccagcctggccccccacttcaacagcctgcccagagccttccccgccctgcacttcctggccctggacgccagccagcacagcagcctgagcaccagattcggcaccgtggccgtgcccaacatcctgctgttccagggcgccaagcccatggccagattcaaccacaccgacagaaccctggagaccctgaagatcttcatcttcaaccagaccggcatcgaggccaagaagaacgtggtggtgacccaggccgaccagatcggccccctgcccagcaccctgatcaagagcgtggactggctgctggtgttcagcctgttcttcctgatcagcttcatcatgtacgccaccatcagaaccgagagcatcagatggctgatccccggccaggagcaggagcacgtggagtag

SEQ ID NO: 22857 - DNA, 1014 bp, Artificial Sequence
  Description of Artificial Sequence: Synthetic coding sequence
atggaggccggccagcagagagtggtggagaaggtggccgaggagagcggcagactgtggagcgaggagcagcccgcccaccccctgcaggtgggcgccgtgtacctgggcgaggaggagctgctgcacgaccccatgggccaggacagagccgccgaggaggccaacgccgtgctgggcctggacacccagggcgaccacatggtgatgctgagcgtgatccccggcgaggccgaggacaaggtgagcagcgagcccagcggcgtgacctgcggcgccggcggcgccgaggacagcagatgcaacgtgagagagagcctgttcagcctggacggcgccggcgcccacttccccgacagagaggaggagtactacaccgagcccgaggtggccgagagcgacgccgcccccaccgaggacagcaacaacaccgagagcctgaagagccccaaggtgaactgcgaggagagaaacatcaccggcctggagaacttcaccctgaagatcctgaacatgagccaggacctgatggacttcctgaaccccaacggcagcgactgcaccctggtgctgttctacaccccctggtgcagattcagcgccagcctggccccccacttcaacagcctgcccagagccttccccgccctgcacttcctggccctggacgccagccagcacagcagcctgagcaccagattcggcaccgtggccgtgcccaacatcctgctgttccagggcgccaagcccatggccagattcaaccacaccgacagaaccctggagaccctgaagatcttcatcttcaaccagaccggcatcgaggccaagaagaacgtggtggtgacccaggccgaccagatcggccccctgcccagcaccctgatcaagagcgtggactggctgctggtgttcagcctgttcttcctgatcagcttcatcatgtacgccaccatcagaaccgagagcatcagatggctgatccccggccaggagcaggagcacgtggagtag

SEQ ID NO: 22858 - DNA, 1299 bp, Artificial Sequence
  Description of Artificial Sequence: Synthetic coding sequence
atgcccgccagacccggcagactgctgcccctgctggccagacccgccgccctgaccgccctgctgctgctgctgctgggccacggcggcggcggcagatggggcgccagagcccaggaggccgccgccgccgccgccgacggcccccccgccgccgacggcgaggacggccaggacccccacagcaagcacctgtacaccgccgacatgttcacccacggcatccagagcgccgcccacttcgtgatgttcttcgccccctggtgcggccactgccagagactgcagcccacctggaacgacctgggcgacaagtacaacagcatggaggacgccaaggtgtacgtggccaaggtggactgcaccgcccacagcgacgtgtgcagcgcccagggcgtgagaggctaccccaccctgaagctgttcaagcccggccaggaggccgtgaagtaccagggccccagagacttccagaccctggagaactggatgctgcagaccctgaacgaggagcccgtgacccccgagcccgaggtggagccccccagcgcccccgagctgaagcagggcctgtacgagctgagcgccagcaacttcgagctgcacgtggcccagggcgaccacttcatcaagttcttcgccccctggtgcggccactgcaaggccctggcccccacctgggagcagctggccctgggcctggagcacagcgagaccgtgaagatcggcaaggtggactgcacccagcactacgagctgtgcagcggcaaccaggtgagaggctaccccaccctgctgtggttcagagacggcaagaaggtggaccagtacaagggcaagagagacctggagagcctgagagagtacgtggagagccagctgcagagaaccgagaccggcgccaccgagaccgtgacccccagcgaggcccccgtgctggccgccgagcccgaggccgacaagggcaccgtgctggccctgaccgagaacaacttcgacgacaccatcgccgagggcatcaccttcatcaagttctacgccccctggtgcggccactgcaagaccctggcccccacctgggaggagctgagcaagaaggagttccccggcctggccggcgtgaagatcgccgaggtggactgcaccgccgagagaaacatctgcagcaagtacagcgtgagaggctaccccaccctgctgctgttcagaggcggcaagaaggtgagcgagcacagcggcggcagagacctggacagcctgcacagattcgtgctgagccaggccaaggacgagctgtag

SEQ ID NO: 22859 - DNA, 975 bp, Artificial Sequence
  Description of Artificial Sequence: Synthetic coding sequence
atggaggacgccaaggtgtacgtggccaaggtggactgcaccgcccacagcgacgtgtgcagcgcccagggcgtgagaggctaccccaccctgaagctgttcaagcccggccaggaggccgtgaagtaccagggccccagagacttccagaccctggagaactggatgctgcagaccctgaacgaggagcccgtgacccccgagcccgaggtggagccccccagcgcccccgagctgaagcagggcctgtacgagctgagcgccagcaacttcgagctgcacgtggcccagggcgaccacttcatcaagttcttcgccccctggtgcggccactgcaaggccctggcccccacctgggagcagctggccctgggcctggagcacagcgagaccgtgaagatcggcaaggtggactgcacccagcactacgagctgtgcagcggcaaccaggtgagaggctaccccaccctgctgtggttcagagacggcaagaaggtggaccagtacaagggcaagagagacctggagagcctgagagagtacgtggagagccagctgcagagaaccgagaccggcgccaccgagaccgtgacccccagcgaggcccccgtgctggccgccgagcccgaggccgacaagggcaccgtgctggccctgaccgagaacaacttcgacgacaccatcgccgagggcatcaccttcatcaagttctacgccccctggtgcggccactgcaagaccctggcccccacctgggaggagctgagcaagaaggagttccccggcctggccggcgtgaagatcgccgaggtggactgcaccgccgagagaaacatctgcagcaagtacagcgtgagaggctaccccaccctgctgctgttcagaggcggcaagaaggtgagcgagcacagcggcggcagagacctggacagcctgcacagattcgtgctgagccaggccaaggacgagctgtag

SEQ ID NO: 22860 - DNA, 1083 bp, Artificial Sequence
  Description of Artificial Sequence: Synthetic coding sequence
atgacccagagcgtggacagcaacagaggcaacagaaacgagaagagatgcggccactgccagagactgcagcccacctggaacgacctgggcgacaagtacaacagcatggaggacgccaaggtgtacgtggccaaggtggactgcaccgcccacagcgacgtgtgcagcgcccagggcgtgagaggctaccccaccctgaagctgttcaagcccggccaggaggccgtgaagtaccagggccccagagacttccagaccctggagaactggatgctgcagaccctgaacgaggagcccgtgacccccgagcccgaggtggagccccccagcgcccccgagctgaagcagggcctgtacgagctgagcgccagcaacttcgagctgcacgtggcccagggcgaccacttcatcaagttcttcgccccctggtgcggccactgcaaggccctggcccccacctgggagcagctggccctgggcctggagcacagcgagaccgtgaagatcggcaaggtggactgcacccagcactacgagctgtgcagcggcaaccaggtgagaggctaccccaccctgctgtggttcagagacggcaagaaggtggaccagtacaagggcaagagagacctggagagcctgagagagtacgtggagagccagctgcagagaaccgagaccggcgccaccgagaccgtgacccccagcgaggcccccgtgctggccgccgagcccgaggccgacaagggcaccgtgctggccctgaccgagaacaacttcgacgacaccatcgccgagggcatcaccttcatcaagttctacgccccctggtgcggccactgcaagaccctggcccccacctgggaggagctgagcaagaaggagttccccggcctggccggcgtgaagatcgccgaggtggactgcaccgccgagagaaacatctgcagcaagtacagcgtgagaggctaccccaccctgctgctgttcagaggcggcaagaaggtgagcgagcacagcggcggcagagacctggacagcctgcacagattcgtgctgagccaggccaaggacgagctgtag

SEQ ID NO: 22861 - DNA, 843 bp, Artificial Sequence
  Description of Artificial Sequence: Synthetic coding sequence
atggcccccagcggcagcctggccgtgcccctggccgtgctggtgctgctgctgtggggcgccccctggacccacggcagaagaagcaacgtgagagtgatcaccgacgagaactggagagagctgctggagggcgactggatgatcgagttctacgccccctggtgccccgcctgccagaacctgcagcccgagtgggagagcttcgccgagtggggcgaggacctggaggtgaacatcgccaaggtggacgtgaccgagcagcccggcctgagcggcagattcatcatcaccgccctgcccaccatctaccactgcaaggacggcgagttcagaagataccagggccccagaaccaagaaggacttcatcaacttcatcagcgacaaggagtggaagagcatcgagcccgtgagcagctggttcggccccggcagcgtgctgatgagcagcatgagcgccctgttccagctgagcatgtggatcagaacctgccacaactacttcatcgaggacctgggcctgcccgtgtggggcagctacaccgtgttcgccctggccaccctgttcagcggcctgctgctgggcctgtgcatgatcttcgtggccgactgcctgtgccccagcaagagaagaagaccccagccctacccctaccccagcaagaagctgctgagcgagagcgcccagcccctgaagaaggtggaggaggagcaggaggccgacgaggaggacgtgagcgaggaggaggccgagagcaaggagggcaccaacaaggacttcccccagaacgccatcagacagagaagcctgggccccagcctggccaccgacaagagctag

SEQ ID NO: 22862 - DNA, 891 bp, Artificial Sequence
  Description of Artificial Sequence: Synthetic coding sequence
atggccgtgctggcccccctgatcgccctggtgtacagcgtgcccagactgagcagatggctggcccagccctactacctgctgagcgccctgctgagcgccgccttcctgctggtgagaaagctgccccccctgtgccacggcctgcccacccagagagaggacggcaacccctgcgacttcgactggagagaggtggagatcctgatgttcctgagcgccatcgtgatgatgaagaacagaagaagcatcaccgtggagcagcacatcggcaacatcttcatgttcagcaaggtggccaacaccatcctgttcttcagactggacatcagaatgggcctgctgtacatcaccctgtgcatcgtgttcctgatgacctgcaagccccccctgtacatgggccccgagtacatcaagtacttcaacgacaagaccatcgacgaggagctggagagagacaagagagtgacctggatcgtggagttcttcgccaactggagcaacgactgccagagcttcgcccccatctacgccgacctgagcctgaagtacaactgcaccggcctgaacttcggcaaggtggacgtgggcagatacaccgacgtgagcaccagatacaaggtgagcaccagccccctgaccaagcagctgcccaccctgatcctgttccagggcggcaaggaggccatgagaagaccccagatcgacaagaagggcagagccgtgagctggaccttcagcgaggagaacgtgatcagagagttcaacctgaacgagctgtaccagagagccaagaagctgagcaaggccggcgacaacatccccgaggagcagcccgtggccagcacccccaccaccgtgagcgacggcgagaacaagaaggacaagtag

SEQ ID NO: 22863 - DNA, 777 bp, Artificial Sequence
  Description of Artificial Sequence: Synthetic coding sequence
atggccgtgctggcccccctgatcgccctggtgtacagcgtgcccagactgagcagatggctggcccagccctactacctgctgagcgccctgctgagcgccgccttcctgctggtgagaaagctgccccccctgtgccacggcctgcccacccagagagaggacggcaacccctgcgacttcgactggagagaggtggagatcctgatgttcctgagcgccatcgtgatgatgaagaacagaagaagcatgttcctgatgacctgcaagccccccctgtacatgggccccgagtacatcaagtacttcaacgacaagaccatcgacgaggagctggagagagacaagagagtgacctggatcgtggagttcttcgccaactggagcaacgactgccagagcttcgcccccatctacgccgacctgagcctgaagtacaactgcaccggcctgaacttcggcaaggtggacgtgggcagatacaccgacgtgagcaccagatacaaggtgagcaccagccccctgaccaagcagctgcccaccctgatcctgttccagggcggcaaggaggccatgagaagaccccagatcgacaagaagggcagagccgtgagctggaccttcagcgaggagaacgtgatcagagagttcaacctgaacgagctgtaccagagagccaagaagctgagcaaggccggcgacaacatccccgaggagcagcccgtggccagcacccccaccaccgtgagcgacggcgagaacaagaaggacaagtag

SEQ ID NO: 22864 - DNA, 1365 bp, Artificial Sequence
  Description of Artificial Sequence: Synthetic coding sequence
atggccgcctggaagagctggaccgccctgagactgtgcgccaccgtggtggtgctggacatggtggtgtgcaagggcttcgtggaggacctggacgagagcttcaaggagaacagaaacgacgacatctggctggtggacttctacgccccctggtgcggccactgcaagaagctggagcccatctggaacgaggtgggcctggagatgaagagcatcggcagccccgtgaaggtgggcaagatggacgccaccagctacagcagcatcgccagcgagttcggcgtgagaggctaccccaccatcaagctgctgaagggcgacctggcctacaactacagaggccccagaaccaaggacgacatcatcgagttcgcccacagagtgagcggcgccctgatcagacccctgcccagccagcagatgttcgagcacatgcagaagagacacagagtgttcttcgtgtacgtgggcggcgagagccccctgaaggagaagtacatcgacgccgccagcgagctgatcgtgtacacctacttcttcagcgccagcgaggaggtggtgcccgagtacgtgaccctgaaggagatgcccgccgtgctggtgttcaaggacgagacctacttcgtgtacgacgagtacgaggacggcgacctgagcagctggatcaacagagagagattccagaactacctggccatggacggcttcctgctgtacgagctgggcgacaccggcaagctggtggccctggccgtgatcgacgagaagaacaccagcgtggagcacaccagactgaagagcatcatccaggaggtggccagagactacagagacctgttccacagagacttccagttcggccacatggacggcaacgactacatcaacaccctgctgatggacgagctgaccgtgcccaccgtggtggtgctgaacaccagcaaccagcagtacttcctgctggacagacagatcaagaacgtggaggacatggtgcagttcatcaacaacatcctggacggcaccgtggaggcccagggcggcgacagcatcctgcagagactgaagagaatcgtgttcgacgccaagagcaccatcgtgagcatcttcaagagcagccccctgatgggctgcttcctgttcggcctgcccctgggcgtgatcagcatcatgtgctacggcatctacaccgccgacaccgacggcggctacatcgaggagagatacgaggtgagcaagagcgagaacgagaaccaggagcagatcgaggagagcaaggagcagcaggagcccagcagcggcggcagcgtggtgcccaccgtgcaggagcccaaggacgtgctggagaagaagaaggactag

SEQ ID NO: 22865 - DNA, 594 bp, Artificial Sequence
  Description of Artificial Sequence: Synthetic coding sequence
atggccgcctggaagagctggaccgccctgagactgtgcgccaccgtggtggtgctggacatggtggtgtgcaagggcttcgtggaggacctggacgagagcttcaaggagaacagaaacgacgacatctggctggtggacttctacgccccctggtgcggccactgcaagaagctggagcccatctggaacgaggtgggcctggagatgaagagcatcggcagccccgtgaaggtgggcaagatggacgccaccagctacagcagcatcgccagcgagttcggcgtgagaggctaccccaccatcaagctggccctgatcagacccctgcccagccagcagatgttcgagcacatgcagaagagacacagagtgttcttcgtgtacgtgggcggcgagagccccctgaaggagaagtacatcgacgccgccagcgagctgatcgtgtacacctacttcttcagcgccagcgaggaggtggtgcccgagtacgtgaccctgaaggagatgcccgccgtgctggtgttcaaggacgagacctacttcgtgtacgacggcaagttccagatcttcaacagctgcaagaccttctag

SEQ ID NO: 22866 - DNA, 1257 bp, Artificial Sequence
  Description of Artificial Sequence: Synthetic coding sequence
atggccgcctggaagagctggaccgccctgagactgtgcgccaccgtggtggtgctggacatggtggtgtgcaagggcttcgtggaggacctggacgagagcttcaaggagaacagaaacgacgacatctggctggtggacttctacgccccctggtgcggccactgcaagaagctggagcccatctggaacgaggtgggcctggagatgaagagcatcggcagccccgtgaaggtgggcaagatggacgccaccagctacagcagcatcgccagcgagttcggcgtgagaggctaccccaccatcaagctgctgaagggcgacctggcctacaactacagaggccccagaaccaaggacgacatcatcgagttcgcccacagagtgagcggcgccctgatcagacccctgcccagccagcagatgttcgagcacatgcagaagagacacagagtgttcttcgtgtacgtgggcggcgagagccccctgaaggagaagtacatcgacgccgccagcgagctgatcgtgtacacctacttcttcagcgccagcgaggaggtggtgcccgagtacgtgaccctgaaggagatgcccgccgtgctggtgttcaaggacgagacctacttcgtgtacgacgagtacgaggacggcgacctgagcagctggatcaacagagagagattccagaactacctggccatggacggcttcctgctgtacgagctgggcgacaccggcaagctggtggccctggccgtgatcgacgagaagaacaccagcgtggagcacaccagactgaagagcatcatccaggaggtggccagagactacagagacctgttccacagagacttccagttcggccacatggacggcaacgactacatcaacaccctgctgatggacgagctgaccgtgcccaccgtggtggtgctgaacaccagcaaccagcagtacttcctgctggacagacagatcaagaacgtggaggacatggtgcagttcatcaacaacatcctggacggcaccgtggaggcccagggcggcgacagcatcctgcagagactgaagagaatcgtgttcgacgccaagagcaccatcgtgagcatcttcaagagcagccccctgatgggctgcttcctgttcggcctgcccctgggcgtgatcagcatcatgtgctacggcatctacaccgccgacaccgacggcggctacatcgaggagagatacgaggtgagcaagaagaagaagaagtag

SEQ ID NO: 22867 - DNA, 1050 bp, Artificial Sequence
  Description of Artificial Sequence: Synthetic coding sequence
atggccggcggcagatgcggcccccagctgaccgccctgctggccgcctggatcgccgccgtggccgccaccgccggccccgaggaggccgccctgccccccgagcagagcagagtgcagcccatgaccgccagcaactggaccctggtgatggagggcgagtggatgctgaagttctacgccccctggtgccccagctgccagcagaccgacagcgagtgggaggccttcgccaagaacggcgagatcctgcagatcagcgtgggcaaggtggacgtgatccaggagcccggcctgagcggcagattcttcgtgaccaccctgcccgccttcttccacgccaaggacggcatcttcagaagatacagaggccccggcatcttcgaggacctgcagaactacatcctggagaagaagtggcagagcgtggagcccctgaccggctggaagagccccgccagcctgaccatgagcggcatggccggcctgttcagcatcagcggcaagatctggcacctgcacaactacttcaccgtgaccctgggcatccccgcctggtgcagctacgtgttcttcgtgatcgccaccctggtgttcggcctgttcatgggcctggtgctggtggtgatcagcgagtgcttctacgtgcccctgcccagacacctgagcgagagaagcgagcagaacagaagaagcgaggaggcccacagagccgagcagctgcaggacgccgaggaggagaaggacgacagcaacgaggaggagaacaaggacagcctggtggacgacgaggaggagaaggaggacctgggcgacgaggacgaggccgaggaggaggaggaggaggacaacctggccgccggcgtggacgaggagagaagcgaggccaacgaccagggcccccccggcgaggacggcgtgaccagagaggaggtggagcccgaggaggccgaggagggcatcagcgagcagccctgccccgccgacaccgaggtggtggaggacagcctgagacagagaaagagccagcacgccgacaagggcctgtag

SEQ ID NO: 22868 - DNA, 1806 bp, Artificial Sequence
  Description of Artificial Sequence: Synthetic coding sequence
atggactggggcaccgagctgtgggaccagttcgaggtgctggagagacacacccagtggggcctggacctgctggacagatacgtgaagttcgtgaaggagagaaccgaggtggagcaggcctacgccaagcagctgagaagcctggtgaagaagtacctgcccaagagacccgccaaggacgaccccgagagcaagttcagccagcagcagagcttcgtgcagatcctgcaggaggtgaacgacttcgccggccagagagagctggtggccgagaacctgagcgtgagagtgtgcctggagctgaccaagtacagccaggagatgaagcaggagagaaagatgcacttccaggagggcagaagagcccagcagcagctggagaacggcttcaagcagctggagaacagcaagagaaagttcgagagagactgcagagaggccgagaaggccgcccagaccgccgagagactggaccaggacatcaacgccaccaaggccgacgtggagaaggccaagcagcaggcccacctgagaagccacatggccgaggagagcaagaacgagtacgccgcccagctgcagagattcaacagagaccaggcccacttctacttcagccagatgccccagatcttcgacaagctgcaggacatggacgagagaagagccaccagactgggcgccggctacggcctgctgagcgaggccgagctggaggtggtgcccatcatcgccaagtgcctggagggcatgaaggtggccgccaacgccgtggaccccaagaacgacagccacgtgctgatcgagctgcacaagagcggcttcgccagacccggcgacgtggagttcgaggacttcagccagcccatgaacagagcccccagcgacagcagcctgggcacccccagcgacggcagacccgagctgagaggccccggcagaagcagaaccaagagatggcccttcggcaagaagaacaagcccagacccccccccctgagccccctgggcggccccgtgcccagcgccctgcccaacggcccccccagccccagaagcggcagagaccccctggccatcctgagcgagatcagcaagagcgtgaagcccagactggccagcttcagaagcctgagaggcagcagaggcaccgtggtgaccgaggacttcagccacctgccccccgagcagcagagaaagagactgcagcagcagctggaggagagaagcagagagctgcagaaggaggtggaccagagagaggccctgaagaagatgaaggacgtgtacgagaagaccccccagatgggcgaccccgccagcctggagccccagatcgccgagaccctgagcaacatcgagagactgaagctggaggtgcagaagtacgaggcctggctggccgaggccgagagcagagtgctgagcaacagaggcgacagcctgagcagacacgccagaccccccgacccccccgccagcgccccccccgacagcagcagcaacagcgccagccaggacaccaaggagagcagcgaggagccccccagcgaggagagccaggacacccccatctacaccgagttcgacgaggacttcgaggaggagcccaccagccccatcggccactgcgtggccatctaccacttcgagggcagcagcgagggcaccatcagcatggccgagggcgaggacctgagcctgatggaggaggacaagggcgacggctggaccagagtgagaagaaaggagggcggcgagggctacgtgcccaccagctacctgagagtgaccctgaactag

SEQ ID NO: 22869 - DNA, 1638 bp, Artificial Sequence
  Description of Artificial Sequence: Synthetic coding sequence
atggactggggcaccgagctgtgggaccagttcgaggtgctggagagacacacccagtggggcctggacctgctggacagatacgtgaagttcgtgaaggagagaaccgaggtggagcaggcctacgccaagcagctgagaagcctggtgaagaagtacctgcccaagagacccgccaaggacgaccccgagagcaagttcagccagcagcagagcttcgtgcagatcctgcaggaggtgaacgacttcgccggccagagagagctggtggccgagaacctgagcgtgagagtgtgcctggagctgaccaagtacagccaggagatgaagcaggagagaaagatgcacttccaggagggcagaagagcccagcagcagctggagaacggcttcaagcagctggagaacagcaagagaaagttcgagagagactgcagagaggccgagaaggccgcccagaccgccgagagactggaccaggacatcaacgccaccaaggccgacgtggagaaggccaagcagcaggcccacctgagaagccacatggccgaggagagcaagaacgagtacgccgcccagctgcagagattcaacagagaccaggcccacttctacttcagccagatgccccagatcttcgacaagctgcaggacatggacgagagaagagccaccagactgggcgccggctacggcctgctgagcgaggccgagctggaggtggtgcccatcatcgccaagtgcctggagggcatgaaggtggccgccaacgccgtggaccccaagaacgacagccacgtgctgatcgagctgcacaagagcggcttcgccagacccggcgacgtggagttcgaggacttcagccagcccatgaacagagcccccagcgacagcagcctgggcacccccagcgacggcagacccgagctgagaggccccggcagaagcagaaccaagagatggcccttcggcaagaagaacaagaccgtggtgaccgaggacttcagccacctgccccccgagcagcagagaaagagactgcagcagcagctggaggagagaagcagagagctgcagaaggaggtggaccagagagaggccctgaagaagatgaaggacgtgtacgagaagaccccccagatgggcgaccccgccagcctggagccccagatcgccgagaccctgagcaacatcgagagactgaagctggaggtgcagaagtacgaggcctggctggccgaggccgagagcagagtgctgagcaacagaggcgacagcctgagcagacacgccagaccccccgacccccccgccagcgccccccccgacagcagcagcaacagcgccagccaggacaccaaggagagcagcgaggagccccccagcgaggagagccaggacacccccatctacaccgagttcgacgaggacttcgaggaggagcccaccagccccatcggccactgcgtggccatctaccacttcgagggcagcagcgagggcaccatcagcatggccgagggcgaggacctgagcctgatggaggaggacaagggcgacggctggaccagagtgagaagaaaggagggcggcgagggctacgtgcccaccagctacctgagagtgaccctgaactag

SEQ ID NO: 22870 - DNA, 1782 bp, Artificial Sequence
  Description of Artificial Sequence: Synthetic coding sequence
atggactggggcaccgagctgtgggaccagttcgaggtgctggagagacacacccagtggggcctggacctgctggacagatacgtgaagttcgtgaaggagagaaccgaggtggagcaggcctacgccaagcagctgagaagcctggtgaagaagtacctgcccaagagacccgccaaggacgaccccgagagcaagttcagccagcagcagagcttcgtgcagatcctgcaggaggtgaacgacttcgccggccagagagagctggtggccgagaacctgagcgtgagagtgtgcctggagctgaccaagtacagccaggagatgaagcaggagagaaagatgcacttccaggagggcagaagagcccagcagcagctggagaacggcttcaagcagctggagaacagcaagagaaagttcgagagagactgcagagaggccgagaaggccgcccagaccgccgagagactggaccaggacatcaacgccaccaaggccgacgtggagaaggccaagcagcaggcccacctgagaagccacatggccgaggagagcaagaacgagtacgccgcccagctgcagagattcaacagagaccaggcccacttctacttcagccagatgccccagatcttcgacaagctgcaggacatggacgagagaagagccaccagactgggcgccggctacggcctgctgagcgaggccgagctggaggtggtgcccatcatcgccaagtgcctggagggcatgaaggtggccgccaacgccgtggaccccaagaacgacagccacgtgctgatcgagctgcacaagagcggcttcgccagacccggcgacgtggagttcgaggacttcagccagcccatgaacagagcccccagcgacagcagcctgggcacccccagcgacggcagacccgagctgagaggccccggcagaagcagaaccaagagatggcccttcggcaagaagaacaagaccgtggtgaccgaggacttcagccacctgccccccgagcagcagagaaagagactgcagcagcagctggaggagagaagcagagagctgcagaaggaggtggaccagagagaggccctgaagaagatgaaggacgtgtacgagaagaccccccagatgggcgaccccgccagcctggagccccagatcgccgagaccctgagcaacatcgagagactgaagctggaggtgcagaagtacgaggcctggctggccgaggccgagagcagagtgctgagcaacagaggcgacagcctgagcagacacgccagaccccccgacccccccgccagcgccccccccgacagcagcagcaacagcgccagccaggacaccaaggagagcagcgaggagccccccagcgaggagagccaggacacccccatctacaccgagttcgacgaggacttcgaggaggagcccaccagccccatcggccactgcgtggccatctaccacttcgaggacctgggccccccccccccccccagccagggccccgccagagccctgagcctgtggcccagagtgaagaccagcgtgctgtggaagaagaccaagggcaccgccggccccggcagcggcggcaagagagaggccagagccacctgccccccccccaccagcgagagcagaagcatcgagccctgccagagaagagaggagggcggctgcagactgctgctgctgggccacggcgagccccaggacctgtgcaccctgttcctgaccccctggctgagactgagacccgtgtag

SEQ ID NO: 22871 - DNA, 1299 bp, Artificial Sequence
  Description of Artificial Sequence: Synthetic coding sequence
atggacgaggccgtgggcgacctgaagcaggccctgccctgcgtggccgagagccccaccgtgcacgtggaggtgcaccagagaggcagcagcaccgccaagaaggaggacatcaacctgagcgtgagaaagctgctgaacagacacaacatcgtgttcggcgactacacctggaccgagttcgacgagcccttcctgaccagaaacgtgcagagcgtgagcatcatcgacaccgagctgaaggtgaaggacagccagcccatcgacctgagcgcctgcaccgtggccctgcacatcttccagctgaacgaggacggccccagcagcgagaacctggaggaggagaccgagaacatcatcgccgccaaccactgggtgctgcccgccgccgagttccacggcctgtgggacagcctggtgtacgacgtggaggtgaagagccacctgctggactacgtgatgaccaccctgctgttcagcgacaagaacgtgaacagcaacctgatcacctggaacagagtggtgctgctgcacggcccccccggcaccggcaagaccagcctgtgcaaggccctggcccagaagctgaccatcagactgagcagcagatacagatacggccagctgatcgagatcaacagccacagcctgttcagcaagtggttcagcgagagcggcaagctggtgaccaagatgttccagaagatccaggacctgatcgacgacaaggacgccctggtgttcgtgctgatcgacgaggtggagagcctgaccgccgccagaaacgcctgcagagccggcaccgagcccagcgacgccatcagagtggtgaacgccgtgctgacccagatcgaccagatcaagagacacagcaacgtggtgatcctgaccaccagcaacatcaccgagaagatcgacgtggccttcgtggacagagccgacatcaagcagtacatcggcccccccagcgccgccgccatcttcaagatctacctgagctgcctggaggagctgatgaagtgccagatcatctaccccagacagcagctgctgaccctgagagagctggagatgatcggcttcatcgagaacaacgtgagcaagctgagcctgctgctgaacgacatcagcagaaagagcgagggcctgagcggcagagtgctgagaaagctgcccttcctggcccacgccctgtacgtgcaggcccccaccgtgaccatcgagggcttcctgcaggccctgagcctggccgtggacaagcagttcgaggagagaaagaagctggccgcctacatctag

SEQ ID NO: 22872 - DNA, 591 bp, Artificial Sequence
  Description of Artificial Sequence: Synthetic coding sequence
atggacgaggccgtgggcgacctgaagcaggccctgccctgcgtggccgagagccccaccgtgcacgtggaggtgcaccagagaggcagcagcaccgccaagaaggaggacatcaacctgagcgtgagaaagctgctgaacagacacaacatcgtgttcggcgactacacctggaccgagttcgacgagcccttcctgaccagaaacgtgcagagcgtgagcatcatcgacaccgagctgaaggtgaaggacagccagcccatcgacctgagcgcctgcaccgtggccctgcacatcttccagctgaacgaggacggccccagcagcgagaacctggaggaggagaccgagaacatcatcgccgccaaccactgggtgctgcccgccgccgagttccacggcctgtgggacagcctggtgtacgacgtggaggtgaagagccacctgctggactacgtgatgaccaccctgctgttcagcgacaagaacgtgaacagcaacctgatcaccatcgagggcttcctgcaggccctgagcctggccgtggacaagcagttcgaggagagaaagaagctggccgcctacatctag

SEQ ID NO: 22873 - DNA, 744 bp, Artificial Sequence
  Description of Artificial Sequence: Synthetic coding sequence
atgcccagactgctgcaccccgccctgcccctgctgctgggcgccaccctgaccttcagagccctgagaagagccctgtgcagactgcccctgcccgtgcacgtgagagccgaccccctgagaacctggagatggcacaacctgctggtgagcttcgcccacagcatcgtgagcggcatctgggccctgctgtgcgtgtggcagacccccgacatgctggtggagatcgagaccgcctggagcctgagcggctacctgctggtgtgcttcagcgccggctacttcatccacgacaccgtggacatcgtggccagcggccagaccagagccagctgggagtacctggtgcaccacgtgatggccatgggcgccttcttcagcggcatcttctggagcagcttcgtgggcggcggcgtgctgaccctgctggtggaggtgagcaacatcttcctgaccatcagaatgatgatgaagatcagcaacgcccaggaccacctgctgtacagagtgaacaagtacgtgaacctggtgatgtacttcctgttcagactggccccccaggcctacctgacccacttcttcctgagatacgtgaaccagagaaccctgggcaccttcctgctgggcatcctgctgatgctggacgtgatgatcatcatctacttcagcagactgctgagaagcgacttctgccccgagcacgtgcccaagaagcagcacaaggacaagttcctgaccgagtag

SEQ ID NO: 22874 - DNA, 603 bp, Artificial Sequence
  Description of Artificial Sequence: Synthetic coding sequence
atgggctacagcgccgtgcccaagtgcccccccagaggcagaggcagagacagcgtgtggcagacccccgacatgctggtggagatcgagaccgcctggagcctgagcggctacctgctggtgtgcttcagcgccggctacttcatccacgacaccgtggacatcgtggccagcggccagaccagagccagctgggagtacctggtgcaccacgtgatggccatgggcgccttcttcagcggcatcttctggagcagcttcgtgggcggcggcgtgctgaccctgctggtggaggtgagcaacatcttcctgaccatcagaatgatgatgaagatcagcaacgcccaggaccacctgctgtacagagtgaacaagtacgtgaacctggtgatgtacttcctgttcagactggccccccaggcctacctgacccacttcttcctgagatacgtgaaccagagaaccctgggcaccttcctgctgggcatcctgctgatgctggacgtgatgatcatcatctacttcagcagactgctgagaagcgacttctgccccgagcacgtgcccaagaagcagcacaaggacaagttcctgaccgagtag

SEQ ID NO: 22875 - DNA, 624 bp, Artificial Sequence
  Description of Artificial Sequence: Synthetic coding sequence
atggccgccgcctggcccagcggccccagcgcccccgaggccgtgaccgccagactggtgggcgtgctgtggttcgtgagcgtgaccaccggcccctggggcgccgtggccaccagcgccggcggcgaggagagcctgaagtgcgaggacctgaaggtgggccagtacatctgcaaggaccccaagatcaacgacgccacccaggagcccgtgaactgcaccaactacaccgcccacgtgagctgcttccccgcccccaacatcacctgcaaggacagcagcggcaacgagacccacttcaccggcaacgaggtgggcttcttcaagcccatcagctgcagaaacgtgaacggctacagctacaaggtggccgtggccctgagcctgttcctgggctggctgggcgccgacagattctacctgggctaccccgccctgggcctgctgaagttctgcaccgtgggcttctgcggcatcggcagcctgatcgacttcatcctgatcagcatgcagatcgtgggccccagcgacggcagcagctacatcatcgactactacggcaccagactgaccagactgagcatcaccaacgagaccttcagaaagacccagctgtacccctag

SEQ ID NO: 22876 - DNA, 561 bp, Artificial Sequence
  Description of Artificial Sequence: Synthetic coding sequence
atggccgccgcctggcccagcggccccagcgcccccgaggccgtgaccgccagactggtgggcgtgctgtggttcgtgagcgtgaccaccggcccctggggcgccgtggccaccagcgccggcggcgaggagagcctgaagtgcgaggacctgaaggtgggccagtacatctgcaaggaccccaagatcaacgacgccacccaggagcccgtgaactgcaccaactacaccgcccacgtgagctgcttccccgcccccaacatcacctgcaaggacagcagcggcaacgagacccacttcaccggcaacgaggtgggcttcttcaagcccatcagctgcagaaacgtgaacggctacagctacaaggtggccgtggccctgagcctgttcctgggctggctgggcgccgacagattctacctgggctaccccgccctgggcaaggagaccgtgaccagagaggtgaagggcttcaccgagagcagaggcttccccctgttctgcgacatcttcgtggtgatcatcttcgtgctgtggatcggcaagctgagcagagactag

SEQ ID NO: 22877 - DNA, 531 bp, Artificial Sequence
  Description of Artificial Sequence: Synthetic coding sequence
atggccgccgcctggcccagcggccccagcgcccccgaggccgtgaccgccagactggtgggcgtgctgtggttcgtgagcgtgaccaccggcccctggggcgccgtggccaccagcgccggcggcgaggagagcctgaagtgcgaggacctgaaggtgggccagtacatctgcaaggaccccaagatcaacgacgccacccaggagcccgtgaactgcaccaactacaccgcccacgtgagctgcttccccgcccccaacatcacctgcaaggacagcagcggcaacgagacccacttcaccggcaacgaggtgggcttcttcaagcccatcagctgcagaaacgtgaacggctacagctacaaggtggccgtggccctgagcctgttcctgggctggctgggcgccgacagattctacctgggctaccccgccctgggcctgctgaagttctgcaccgtgggcttctgcggcatcggcagcctgatcgacttcatcctgatcagcatgcaggtgagcttcagcatctag

SEQ ID NO: 22878 - DNA, 810 bp, Artificial Sequence
  Description of Artificial Sequence: Synthetic coding sequence
atgcacatcctgaagggcagccccaacgtgatccccagagcccacggccagaagaacaccagaagagacggcaccggcctgtaccccatgagaggccccttcaagaacctggccctgctgcccttcagcctgcccctgctgggcggcggcggcagcggcagcggcgagaaggtgagcgtgagcaagatggccgccgcctggcccagcggccccagcgcccccgaggccgtgaccgccagactggtgggcgtgctgtggttcgtgagcgtgaccaccggcccctggggcgccgtggccaccagcgccggcggcgaggagagcctgaagtgcgaggacctgaaggtgggccagtacatctgcaaggaccccaagatcaacgacgccacccaggagcccgtgaactgcaccaactacaccgcccacgtgagctgcttccccgcccccaacatcacctgcaaggacagcagcggcaacgagacccacttcaccggcaacgaggtgggcttcttcaagcccatcagctgcagaaacgtgaacggctacagctacaaggtggccgtggccctgagcctgttcctgggctggctgggcgccgacagattctacctgggctaccccgccctgggcctgctgaagttctgcaccgtgggcttctgcggcatcggcagcctgatcgacttcatcctgatcagcatgcagatcgtgggccccagcgacggcagcagctacatcatcgactactacggcaccagactgaccagactgagcatcaccaacgagaccttcagaaagacccagctgtacccctag

SEQ ID NO: 22879 - DNA, 516 bp, Artificial Sequence
  Description of Artificial Sequence: Synthetic coding sequence
atgaagaagtgcctgctgcccgtgctgatcacctgcatgcagaccgccatctgcaaggacagaatgatgatgatcatgatcctgctggtgaactacagacccgacgagttcatcgagtgcgaggaccccgtggaccacgtgggcaacgccaccgccagccaggagctgggctacggctgcctgaagttcggcggccaggcctacagcgacgtggagcacaccagcgtgcagtgccacgccctggacggcatcgagtgcgccagccccagaaccttcctgagagagaacaagccctgcatcaagtacaccggccactacttcatcaccaccctgctgtacagcttcttcctgggctgcttcggcgtggacagattctgcctgggccacaccggcaccgccgtgggcaagctgctgaccctgggcggcctgggcatctggtggttcgtggacctgatcctgctgatcaccggcggcctgatgcccagcgacggcagcaactggtgcaccgtgtactag

SEQ ID NO: 22880 - DNA, 516 bp, Artificial Sequence; identical to SEQ ID NO: 22879
  Description of Artificial Sequence: Synthetic coding sequence

SEQ ID NO: 22881 - DNA, 645 bp, Artificial Sequence
  Description of Artificial Sequence: Synthetic coding sequence
atggtgctgggcggctgccccgtgagctacctgctgctgtgcggccaggccgccctgctgctgggcaacctgctgctgctgcactgcgtgagcagaagccacagccagaacgccaccgccgagcccgagctgaccagcgccggcgccgcccagcccgagggccccggcggcgccgccagctgggagtacggcgacccccacagccccgtgatcctgtgcagctacctgcccgacgagttcatcgagtgcgaggaccccgtggaccacgtgggcaacgccaccgccagccaggagctgggctacggctgcctgaagttcggcggccaggcctacagcgacgtggagcacaccagcgtgcagtgccacgccctggacggcatcgagtgcgccagccccagaaccttcctgagagagaacaagccctgcatcaagtacaccggccactacttcatcaccaccctgctgtacagcttcttcctgggctgcttcggcgtggacagattctgcctgggccacaccggcaccgccgtgggcaagctgctgaccctgggcggcctgggcatctggtggttcgtggacctgatcctgctgatcaccggcggcctgatgcccagcgacggcagcaactggtgcaccgtgtactag

SEQ ID NO: 22882 - DNA, 516 bp, Artificial Sequence; identical to SEQ ID NO: 22879
  Description of Artificial Sequence: Synthetic coding sequence

SEQ ID NO: 22883 - DNA, 192 bp, Artificial Sequence
  Description of Artificial Sequence: Synthetic coding sequence
atgaagaagtgcctgctgcccgtgctgatcacctgcatgcagaccgccatctgcaaggacagaatgatgatgatcatgatcctgctggtgaactacagacccgacgagttcatcgagtgcgaggaccccgtggaccacgtgggcaacgccaccgccagccaggagctgggctacggctgcctgaaggtgtag

SEQ ID NO: 22884 - DNA, 138 bp, Artificial Sequence
  Description of Artificial Sequence: Synthetic coding sequence
atgaagaagtgcctgctgcccgtgctgatcacctgcatgcagaccgccatctgcaaggacagaatgatgatgatcatgatcctgctggtgaactacagacccgacgagttcatcgagtgcgaggaccccgtggactag

SEQ ID NO: 22885 - DNA, 366 bp, Artificial Sequence
  Description of Artificial Sequence: Synthetic coding sequence
atgaagaagtgcctgctgcccgtgctgatcacctgcatgcagaccgccatctgcaaggacagaatgatgatgatcatgatcctgctggtgaactacagacccgacgagttcatcgagtgcgaggaccccgtggaccacgtgggcaacgccaccgccagccaggagctgggctacggctgcctgaagttcggcggccaggcctacagcgacgtggagcacaccagcgtgcagtgccacgccctggacggcatcgagtgcgccagccccagaaccttcctgagagagaacaagccctgcatcaagtacaccggccactacttcatcaccaccctgctgtacagcttcttcctgggctgcttcggctag

SEQ ID NO: 22886 - DNA, 1215 bp, Artificial Sequence
  Description of Artificial Sequence: Synthetic coding sequence
atgcccagacccggcagcgcccagagatgggccgccgtggccggcagatggggctgcagactgctggccctgctgctgctggtgcccggccccggcggcgccagcgagatcaccttcgagctgcccgacaacgccaagcagtgcttctacgaggacatcgcccagggcaccaagtgcaccctggagttccaggtgatcaccggcggccactacgacgtggactgcagactggaggaccccgacggcaaggtgctgtacaaggagatgaagaagcagtacgacagcttcaccttcaccgccagcaagaacggcacctacaagttctgcttcagcaacgagttcagcaccttcacccacaagaccgtgtacttcgacttccaggtgggcgaggacccccccctgttccccagcgagaacagagtgagcgccctgacccagatggagagcgcctgcgtgagcatccacgaggccctgaagagcgtgatcgactaccagacccacttcagactgagagaggcccagggcagaagcagagccgaggacctgaacaccagagtggcctactggcacagcgtggacaccagccccggctaccacgagagcgacagcaagaagagcgaggacctgagcctgtgcaacgtggccgagcacagcaacaccaccgagggccccaccggcaagcaggagggcgcccagagcgtggaggagatgttcgaggaggaggccgaggaggaggtgttcctgaagttcgtgatcctgcacgccgaggacgacaccgacgaggccctgagagtgcagaacctgctgcaggacgacttcggcatcaagcccggcatcatcttcgccgagatgccctgcggcagacagcacctgcagaacctggacgacgccgtgaacggcagcgcctggaccatcctgctgctgaccgagaacttcctgagagacacctggtgcaacttccagttctacaccagcctgatgaacagcgtgaacagacagcacaagtacaacagcgtgatccccatgagacccctgaacaaccccctgcccagagagagaacccccttcgccctgcagaccatcaacgccctggaggaggagagcagaggcttccccacccaggtggagagaatcttccaggagagcgtgtacaagacccagcagaccatctggaaggagaccagaaacatggtgcagagacagttcatcgcctag

SEQ ID NO: 22887 - DNA, 567 bp, Artificial Sequence
  Description of Artificial Sequence: Synthetic coding sequence
atgcccagacccggcagcgcccagagatgggccgccgtggccggcagatggggctgcagactgctggccctgctgctgctggtgcccggccccggcggcgccagcgagatcaccttcgagctgcccgacaacgccaagcagtgcttctacgaggacatcgcccagggcaccaagtgcaccctggagttccaggtgatcaccggcggccactacgacgtggactgcagactggaggaccccgacggcaaggtgctgtacaaggagatgaagaagcagtacgacagcttcaccttcaccgccagcaagaacggcacctacaagttctgcttcagcaacgagttcagcaccttcacccacaagaccgtgtacttcgacttccaggtgggcgaggacccccccctgttccccagcgagaacagagtgagcgccctgacccagatggagagcgcctgcgtgagcatccacgaggccctgaagagcgtgatcgactaccagacccacttcagactgagagaggcccagggcagaagcagagccgaggacctgaacaccagagtggcctactag

SEQ ID NO: 22888 - DNA, 375 bp, Artificial Sequence
  Description of Artificial Sequence: Synthetic coding sequence
atgcccgtgagaggccccgacgtggaggcctactgcctgagatgcgagtgcaagtacgaggagagaagcagcgtgaccatcaaggtgaccatcatcatctacctgagcatcctgggcctgctgctgctgtacatggtgtacctgaccctggtggagcccatcctgaagagaagactgttcggccacgcccagctgatccagagcgacgacgacatcggcgaccaccagcccttcgccaacgcccacgacgtgctggccagaagcagaagcagagccaacgtgctgaacaaggtggagtacgcccagcagagatggaagctgcaggtgcaggagcagagaaagagcgtgttcgacagacacgtggtgctgagctag

SEQ ID NO: 22889 - DNA, 375 bp, Artificial Sequence; identical to SEQ ID NO: 22888
  Description of Artificial Sequence: Synthetic coding sequence

SEQ ID NO: 22890 - DNA, 597 bp, Artificial Sequence
  Description of Artificial Sequence: Synthetic coding sequence
atggccaccctgtggggcggcctgctgagactgggcagcctgctgagcctgagctgcctggccctgagcgtgctgctgctggcccagctgagcgacgccgccaagaacttcgaggacgtgagatgcaagtgcatctgccccccctacaaggagaacagcggccacatctacaacaagaacatcagccagaaggactgcgactgcctgcacgtggtggagcccatgcccgtgagaggccccgacgtggaggcctactgcctgagatgcgagtgcaagtacgaggagagaagcagcgtgaccatcaaggtgaccatcatcatctacctgagcatcctgggcctgctgctgctgtacatggtgtacctgaccctggtggagcccatcctgaagagaagactgttcggccacgcccagctgatccagagcgacgacgacatcggcgaccaccagcccttcgccaacgcccacgacgtgctggccagaagcagaagcagagccaacgtgctgaacaaggtggagtacgcccagcagagatggaagctgcaggtgcaggagcagagaaagagcgtgttcgacagacacgtggtgctgagctag

SEQ ID NO: 22891 - DNA, 318 bp, Artificial Sequence
  Description of Artificial Sequence: Synthetic coding sequence
atgtacagacccgtgatggccagctgcaccagcgtgagcctgtggatgatcgccctgctggtgttcggcgtgctggccatcttcggcatcaccatcggcctgctggtgcacttcctggccgtggccaacagaatctacttctaccagggcagcttcaagatgctggacatcccctacaacagcaactacgagagagagaccagccccgagaacaactacctgagccagatcctggagaccagatggctgatgcacttcaaggtgctggccttcaccgacaacatcagcttcctgaagagcagccactggtgcaagtag

SEQ ID NO: 22892 - DNA, 1413 bp, Artificial Sequence
  Description of Artificial Sequence: Synthetic coding sequence
atgcccggcttcgactacaagttcctggagaagcccaagagaagactgctgtgccccctgtgcggcaagcccatgagagagcccgtgcaggtgagcacctgcggccacagattctgcgacacctgcctgcaggagttcctgagcgagggcgtgttcaagtgccccgaggaccagctgcccctggactacgccaagatctaccccgaccccgagctggaggtgcaggtgctgggcctgcccatcagatgcatccacagcgaggagggctgcagatggagcggccccctgagacacctgcagggccacctgaacacctgcagcttcaacgtgatcccctgccccaacagatgccccatgaagctgagcagaagagacctgcccgcccacctgcagcacgactgccccaagagaagactgaagtgcgagttctgcggctgcgacttcagcggcgaggcctacgagagccacgagggcatgtgcccccaggagagcgtgtactgcgagaacaagtgcggcgccagaatgatgagaagactgctggcccagcacgccaccagcgagtgccccaagagaacccagccctgcacctactgcaccaaggagttcgtgttcgacaccatccagagccaccagtaccagtgccccagactgcccgtggcctgccccaaccagtgcggcgtgggcaccgtggccagagaggacctgcccggccacctgaaggacagctgcaacaccgccctggtgctgtgccccttcaaggacagcggctgcaagcacagatgccccaagctggccatggccagacacgtggaggagagcgtgaagccccacctggccatgatgtgcgccctggtgagcagacagagacaggagctgcaggagctgagaagagagctggaggagctgagcgtgggcagcgacggcgtgctgatctggaagatcggcagctacggcagaagactgcaggaggccaaggccaagcccaacctggagtgcttcagccccgccttctacacccacaagtacggctacaagctgcaggtgagcgccttcctgaacggcaacggcagcggcgagggcacccacctgagcctgtacatcagagtgctgcccggcgccttcgacaacctgctggagtggcccttcgccagaagagtgaccttcagcctgctggaccagagcgaccccggcctggccaagccccagcacgtgaccgagaccttccaccccgaccccaactggaagaacttccagaagcccggcacctggagaggcagcctggacgagagcagcctgggcttcggctaccccaagttcatcagccaccaggacatcagaaagagaaactacgtgagagacgacgccgtgttcatcagagccgccgtggagctgcccagaaagatcctgagctag

SEQ ID NO: 22893 - DNA, 588 bp, Artificial Sequence
  Description of Artificial Sequence: Synthetic coding sequence
atgcccggcttcgactacaagttcctggagaagcccaagagaagactgctgtgccccctgtgcggcaagcccatgagagagcccgtgcaggtgagcacctgcggccacagattctgcgacacctgcctgcaggagttcctgagcgagggcgtgttcaagtgccccgaggaccagctgcccctggactacgccaagatctaccccgaccccgagctggaggtgcaggtgctgggcctgcccatcagatgcatccacagcgaggagggctgcagatggagcggccccctgagacacctgcagggccacctgaacacctgcagcttcaacgtgatcccctgccccaacagatgccccatgaagctgagcagaagagacctgcccgcccacctgcagcacgactgccccaagagaagactgaagtgcgagttctgcggctgcgacttcagcggcgaggcctacgagagcagcctgggcttcggctaccccaagttcatcagccaccaggacatcagaaagagaaactacgtgagagacgacgccgtgttcatcagagccgccgtggagctgcccagaaagatcctgagctag

SEQ ID NO: 22894 - DNA, 504 bp, Artificial Sequence
  Description of Artificial Sequence: Synthetic coding sequence
atgcccggcttcgactacaagttcctggagaagcccaagagaagactgctgtgccccctgtgcggcaagcccatgagagagcccgtgcaggtgagcacctgcggccacagattctgcgacacctgcctgcaggtgagcgccttcctgaacggcaacggcagcggcgagggcacccacctgagcctgtacatcagagtgctgcccggcgccttcgacaacctgctggagtggcccttcgccagaagagtgaccttcagcctgctggaccagagcgaccccggcctggccaagccccagcacgtgaccgagaccttccaccccgaccccaactggaagaacttccagaagcccggcacctggagaggcagcctggacgagagcagcctgggcttcggctaccccaagttcatcagccaccaggacatcagaaagagaaactacgtgagagacgacgccgtgttcatcagagccgccgtggagctgcccagaaagatcctgagctag

SEQ ID NO: 22895 - DNA, 435 bp, Artificial Sequence
  Description of Artificial Sequence: Synthetic coding sequence
atgcccggcttcgactacaagttcctggagaagcccaagagaagactgctgtgccccctgtgcggcaagcccatgagagagcccgtgcaggtgagcacctgcggccacagattctgcgacacctgcctgcaggagttcctgagcgagggcgtgttcaagtggcccttcgccagaagagtgaccttcagcctgctggaccagagcgaccccggcctggccaagccccagcacgtgaccgagaccttccaccccgaccccaactggaagaacttccagaagcccggcacctggagaggcagcctggacgagagcagcctgggcttcggctaccccaagttcatcagccaccaggacatcagaaagagaaactacgtgagagacgacgccgtgttcatcagagccgccgtggagctgcccagaaagatcctgagctag

SEQ ID NO: 22896 - DNA, 549 bp, Artificial Sequence
  Description of Artificial Sequence: Synthetic coding sequence
atgcccggcttcgactacaagttcctggagaagcccaagagaagactgctgtgccccctgtgcggcaagcccatgagagagcccgtgcaggtgagcacctgcggccacagattctgcgacacctgcctgcaggagttcctgagcgagggcgtgttcaagtgccccgaggaccagctgcccctggactacgccaagttcccccacccctacccccagatctaccccgaccccgagctggaggtgcaggtgctgggcctgcccatcagatgcatccacagcgaggagggctgcagatggagcggccccctgagacacctgcagggccacctgaacacctgcagcttcaacgtgatcccctgccccaacagatgccccatgaagctgagcagaagagacctgcccgcccacctgcagcacgactgccccaagagaagactgaagtgcgagttctgcggctgcgacttcagcggcgaggcctacgagagccacgagggcatgtgcccccaggagagcgtgtactgcgagaacaagtgcggcgccagaatgtag

SEQ ID NO: 22897 - DNA, 1179 bp, Artificial Sequence
  Description of Artificial Sequence: Synthetic coding sequence
atgcccggcttcgactacaagttcctggagaagcccaagagaagactgctgtgccccctgtgcggcaagcccatgagagagcccgtgcaggtgagcacctgcggccacagattctgcgacacctgcctgcaggagttcctgagcgagggcgtgttcaagtgccccgaggaccagctgcccctggactacgccaagatctaccccgaccccgagctggaggtgcaggtgctgggcctgcccatcagatgcatccacagcgaggagggctgcagatggagcggccccctgagacacctgcagggccacctgaacacctgcagcttcaacgtgatcccctgccccaacagatgccccatgaagctgagcagaagagacctgcccgcccacctgcagcacgactgccccaagagaagactgaagtgcgagttctgcggctgcgacttcagcggcgaggcctacgagagccacgagggcatgtgcccccaggagagcgtgtactgcgagaacaagtgcggcgccagaatgatgagaagactgctggcccagcacgccaccagcgagtgccccaagagaacccagccctgcacctactgcaccaaggagttcgtgttcgacaccatccagagccaccagtaccagtgccccagactgcccgtggcctgccccaaccagtgcggcgtgggcaccgtggccagagaggacctgcccggccacctgaaggacagctgcaacaccgccctggtgctgtgccccttcaaggacagcggctgcaagcacagatgccccaagctggccatggccagacacgtggaggagagcgtgaagccccacctggccatgatgtgcgccctggtgagcagacagagacaggagctgcaggagctgagaagagagctggaggagctgagcgtgggcagcgacggcgtgctgatctggaagatcggcagctacggcagaagactgcaggaggccaaggccaagcccaacctggagtgcttcagccccgccttctacacccacaagtacggctacaagctgcaggtgagcgccttcctgaacggcaacggcagcggcgagggcacccacctgagcctgtacatcagagtgctgcccggcgccttcgacaacctgctggagtggcccttcgccagaagagtgaccttcagcctgctgggctag

SEQ ID NO: 22898 - DNA, 597 bp, Artificial Sequence
  Description of Artificial Sequence: Synthetic coding sequence
atgcccggcttcgactacaagttcctggagaagcccaagagaagactgctgtgccccctgtgcggcaagcccatgagagagcccgtgcaggtgagcacctgcggccacagattctgcgacacctgcctgcaggagttcctgagcgagggcgtgttcaagtgccccgaggaccagctgcccctggactacgccaagatctaccccgaccccgagctggaggtgcaggtgctgggcctgcccatcagatgcatccacagcgaggagggctgcagatggagcggccccctgagacacctgcagggccacctgaacacctgcagcttcaacgtgatcccctgccccaacagatgccccatgaagctgagcagaagagacctgcccgcccacctgcagcacgactgccccaagagaagactgaagtgcgagttctgcggctgcgacttcagcggcgaggcctacgagagccacgagagcagcctgggcttcggctaccccaagttcatcagccaccaggacatcagaaagagaaactacgtgagagacgacgccgtgttcatcagagccgccgtggagctgcccagaaagatcctgagctag

SEQ ID NO: 22899 - DNA, 2436 bp, Artificial Sequence
  Description of Artificial Sequence: Synthetic coding sequence
atgagactgatcagaaacatctacatcttctgcagcatcgtgatgaccgccgagggcgacgcccccgagctgcccgaggagagagagctgatgaccaactgcagcaacatgagcctgagaaaggtgcccgccgacctgacccccgccaccaccaccctggacctgagctacaacctgctgttccagctgcagagcagcgacttccacagcgtgagcaagctgagagtgctgatcctgtgccacaacagaatccagcagctggacctgaagaccttcgagttcaacaaggagctgagatacctggacctgagcaacaacagactgaagagcgtgacctggtacctgctggccggcctgagatacctggacctgagcttcaacgacttcgacaccatgcccatctgcgaggaggccggcaacatgagccacctggagatcctgggcctgagcggcgccaagatccagaagagcgacttccagaagatcgcccacctgcacctgaacaccgtgttcctgggcttcagaaccctgccccactacgaggagggcagcctgcccatcctgaacaccaccaagctgcacatcgtgctgcccatggacaccaacttctgggtgctgctgagagacggcatcaagaccagcaagatcctggagatgaccaacatcgacggcaagagccagttcgtgagctacgagatgcagagaaacctgagcctggagaacgccaagaccagcgtgctgctgctgaacaaggtggacctgctgtgggacgacctgttcctgatcctgcagttcgtgtggcacaccagcgtggagcacttccagatcagaaacgtgaccttcggcggcaaggcctacctggaccacaacagcttcgactacagcaacaccgtgatgagaaccatcaagctggagcacgtgcacttcagagtgttctacatccagcaggacaagatctacctgctgctgaccaagatggacatcgagaacctgaccatcagcaacgcccagatgccccacatgctgttccccaactaccccaccaagttccagtacctgaacttcgccaacaacatcctgaccgacgagctgttcaagagaaccatccagctgccccacctgaagaccctgatcctgaacggcaacaagctggagaccctgagcctggtgagctgcttcgccaacaacacccccctggagcacctggacctgagccagaacctgctgcagcacaagaacgacgagaactgcagctggcccgagaccgtggtgaacatgaacctgagctacaacaagctgagcgacagcgtgttcagatgcctgcccaagagcatccagatcctggacctgaacaacaaccagatccagaccgtgcccaaggagaccatccacctgatggccctgagagagctgaacatcgccttcaacttcctgaccgacctgcccggctgcagccacttcagcagactgagcgtgctgaacatcgagatgaacttcatcctgagccccagcctggacttcgtgcagagctgccaggaggtgaagaccctgaacgccggcagaaaccccttcagatgcacctgcgagctgaagaacttcatccagctggagacctacagcgaggtgatgatggtgggctggagcgacagctacacctgcgagtaccccctgaacctgagaggcaccagactgaaggacgtgcacctgcacgagctgagctgcaacaccgccctgctgatcgtgaccatcgtggtgatcatgctggtgctgggcctggccgtggccttctgctgcctgcacttcgacctgccctggtacctgagaatgctgggccagtgcacccagacctggcacagagtgagaaagaccacccaggagcagctgaagagaaacgtgagattccacgccttcatcagctacagcgagcacgacagcctgtgggtgaagaacgagctgatccccaacctggagaaggaggacggcagcatcctgatctgcctgtacgagagctacttcgaccccggcaagagcatcagcgagaacatcgtgagcttcatcgagaagagctacaagagcatcttcgtgctgagccccaacttcgtgcagaacgagtggtgccactacgagttctacttcgcccaccacaacctgttccacgagaacagcgaccacatcatcctgatcctgctggagcccatccccttctactgcatccccaccagataccacaagctgaaggccctgctggagaagaaggcctacctggagtggcccaaggacagaagaaagtgcggcctgttctgggccaacctgagagccgccatcaacgtgaacgtgctggccaccagagagatgtacgagctgcagaccttcaccgagctgaacgaggagagcagaggcagcaccatcagcctgatgagaaccgactgcctgtag

SEQ ID NO: 22900 - DNA, 2436 bp, Artificial Sequence; identical to SEQ ID NO: 22899
  Description of Artificial Sequence: Synthetic coding sequence

SEQ ID NO: 22901 - DNA, 2436 bp, Artificial Sequence; identical to SEQ ID NO: 22899
  Description of Artificial Sequence: Synthetic coding sequence

SEQ ID NO: 22902 - DNA, 2436 bp, Artificial Sequence; identical to SEQ ID NO: 22899
  Description of Artificial Sequence: Synthetic coding sequence

SEQ ID NO: 22903 - DNA, 1215 bp, Artificial Sequence; identical to SEQ ID NO: 22886
  Description of Artificial Sequence: Synthetic coding sequence

SEQ ID NO: 22904 - DNA, 708 bp, Artificial Sequence
  Description of Artificial Sequence: Synthetic coding sequence
atgggcatcggcaagagcaagatcaacagctgccccctgagcctgagctggggcaagagacacagcgtggacaccagccccggctaccacgagagcgacagcaagaagagcgaggacctgagcctgtgcaacgtggccgagcacagcaacaccaccgagggccccaccggcaagcaggagggcgcccagagcgtggaggagatgttcgaggaggaggccgaggaggaggtgttcctgaagttcgtgatcctgcacgccgaggacgacaccgacgaggccctgagagtgcagaacctgctgcaggacgacttcggcatcaagcccggcatcatcttcgccgagatgccctgcggcagacagcacctgcagaacctggacgacgccgtgaacggcagcgcctggaccatcctgctgctgaccgagaacttcctgagagacacctggtgcaacttccagttctacaccagcctgatgaacagcgtgaacagacagcacaagtacaacagcgtgatccccatgagacccctgaacaaccccctgcccagagagagaacccccttcgccctgcagaccatcaacgccctggaggaggagagcagaggcttccccacccaggtggagagaatcttccaggagagcgtgtacaagacccagcagaccatctggaaggagaccagaaacatggtgcagagacagttcatcgcctag

SEQ ID NO: 22905 - DNA, 1137 bp, Artificial Sequence
  Description of Artificial Sequence: Synthetic coding sequence
atggccggcgacggcagaagagccgaggccgtgagagagggctggggcgtgtacgtgacccccagagcccccatcagagagggcagaggcagactggccccccagaacggcggcagcagcgacgcccccgcctacagaaccccccccagcagacagggcagaagagaggtgagattcagcgacgagccccccgaggtgtacggcgacttcgagcccctggtggccaaggagagaagccccgtgggcaagagaaccagactggaggagttcagaagcgacagcgccaaggaggaggtgagagagagcgcctactacctgagaagcagacagagaagacagcccagaccccaggagaccgaggagatgaagaccagaagaaccaccagactgcagcagcagcacagcgagcagccccccctgcagcccagccccgtgatgaccagaagaggcctgagagacagccacagcagcgaggaggacgaggccagcagccagaccgacctgagccagaccatcagcaagaagaccgtgagaagcatccaggaggcccccgtgagcgaggacctggtgatcagactgagaagaccccccctgagataccccagatacgaggccaccagcgtgcagcagaaggtgaacttcagcgaggagggcgagaccgaggaggacgaccaggacagcagccacagcagcgtgaccaccgtgaaggccagaagcagagacagcgacgagagcggcgacaagaccaccagaagcagcagccagtacatcgagagcttctggcagagcagccagagccagaacttcaccgcccacgacaagcagcccagcgtgctgagcaagggcagcaccctgatcttctacaagtactgcgaccacgagaacgccgccttcaaggacgtggccctggtgctgaccgtgctgctggaggaggagaccctgggcaccagcctgggcctgaaggaggtggaggagaaggtgagagacttcctgaaggtgaagttcaccaacagcaacacccccaacagctacaaccacatggaccccgacaagctgaacggcctgtggagcagaatcagccacctggtgctgcccgtgcagcccgagaacgccctgaagagaggcatctgcctgtag

SEQ ID NO: 22906 - DNA, 1752 bp, Artificial Sequence
  Description of Artificial Sequence: Synthetic coding sequence
atggccggcgacggcagaagagccgaggccgtgagagagggctggggcgtgtacgtgacccccagagcccccatcagagagggcagaggcagactggccccccagaacggcggcagcagcgacgcccccgcctacagaaccccccccagcagacagggcagaagagaggtgagattcagcgacgagccccccgaggtgtacggcgacttcgagcccctggtggccaaggagagaagccccgtgggcaagagaaccagactggaggagttcagaagcgacagcgccaaggaggaggtgagagagagcgcctactacctgagaagcagacagagaagacagcccagaccccaggagaccgaggagatgaagaccagaagaaccaccagactgcagcagcagcacagcgagcagccccccctgcagcccagccccgtgatgaccagaagaggcctgagagacagccacagcagcgaggaggacgaggccagcagccagaccgacctgagccagaccatcagcaagaagaccgtgagaagcatccaggaggcccccgtgagcgaggacctggtgatcagactgagaagaccccccctgagataccccagatacgaggccaccagcgtgcagcagaaggtgaacttcagcgaggagggcgagaccgaggaggacgaccaggacagcagccacagcagcgtgaccaccgtgaaggccagaagcagagacagcgacgagagcggcgacaagaccaccagaagcagcagccagtacatcgagagcttctggcagagcagccagagccagaacttcaccgcccacgacaagcagcccagcgtgctgagcagcggctaccagaagaccccccaggagtgggccccccagaccgccagaatcagaaccagaatgcagaacgacagcatcctgaagagcgagctgggcaaccagagccccagcaccagcagcagacaggtgaccggccagccccagaacgccagcttcgtgaagagaaacagatggtggctgctgcccctgatcgccgccctggccagcggcagcttctggttcttcagcacccccgaggtggagaccaccgccgtgcaggagttccagaaccagatgaaccagctgaagaacaagtaccagggccaggacgagaagctgtggaagagaagccagaccttcctggagaagcacctgaacagcagccaccccagaagccagcccgccatcctgctgctgaccgccgccagagacgccgaggaggccctgagatgcctgagcgagcagatcgccgacgcctacagcagcttcagaagcgtgagagccatcagaatcgacggcaccgacaaggccacccaggacagcgacaccgtgaagctggaggtggaccaggagctgagcaacggcttcaagaacggccagaacgccgccgtggtgcacagattcgagagcttccccgccggcagcaccctgatcttctacaagtactgcgaccacgagaacgccgccttcaaggacgtggccctggtgctgaccgtgctgctggaggaggagaccctgggcaccagcctgggcctgaaggaggtggaggagaaggtgagagacttcctgaaggtgaagttcaccaacagcaacacccccaacagctacaaccacatggaccccgacaagctgaacggcctgtggagcagaatcagccacctggtgctgcccgtgcagcccgagaacgccctgaagagaggcatctgcctgtag

SEQ ID NO: 22907 - DNA, 1413 bp, Artificial Sequence
  Description of Artificial Sequence: Synthetic coding sequence
atggccgacagcggcctgagagagccccaggaggacagccagaaggacctggagaacgaccccagcgtgaacagccaggcccaggagaccaccatcatcgccagcaacgccgaggaggccgagatcctgcacagcgcctgcggcctgagcaaggaccaccaggaggtggagaccgagggccccgagagcgccgacaccggcgacaagagcgagagccccgacgaggccaacgtgggcaagcaccccaaggacaagaccgaggacgagaacaagcagagcttcctggacggcggcaagggccaccacctgcccagcgagaacctgggcaaggagcccctggaccccgaccccagccacagccccagcgacaaggtgggcagagccgacgcccacctgggcagcagcagcgtggccctgcccaaggaggccagcgacggcaccggcgccagccaggagccccccaccaccgacagccaggaggcccagagccccggccacagcagcgccggccaggagggcgaggacaccctgagaagaagactgctggcccccgaggccggcagccacccccagcagacccagaagctggaggagatcaaggagaacgcccaggacaccatgagacagatcaacaagaagggcttctggagctacggccccgtgatcctggtggtgctggtggtggccgtggtggccagcagcgtgaacagctactacagcagccccgcccagcaggtgcccaagaaccccgccctggaggccttcctggcccagttcagccagctggaggacaagttccccggccagagcagcttcctgtggcagagaggcagaaagttcctgcagaagcacctgaacgccagcaaccccaccgagcccgccaccatcatcttcaccgccgccagagagggcagagagaccctgaagtgcctgagccaccacgtggccgacgcctacaccagcagccagaaggtgagccccatccagatcgacggcgccggcagaacctggcaggacagcgacaccgtgaagctgctggtggacctggagctgagctacggcttcgagaacggccagaaggccgccgtggtgcaccacttcgagagcttccccgccggcagcaccctgatcttctacaagtactgcgaccacgagaacgccgccttcaaggacgtggccctggtgctgaccgtgctgctggaggaggagaccctggaggccagcgtgggccccagagagaccgaggagaaggtgagagacctgctgtgggccaagttcaccaacagcgacacccccaccagcttcaaccacatggacagcgacaagctgagcggcctgtggagcagaatcagccacctggtgctgcccgtgcagcccgtgagcagcatcgaggagcagggctgcctgttctag

SEQ ID NO: 22908 - DNA, 1014 bp, Artificial Sequence
  Description of Artificial Sequence: Synthetic coding sequence
atgagagccgtgttcatccagggcgccgaggagcaccccgccgccttctgctaccaggtgaacggcagctgccccagaaccgtgcacaccctgggcatccagctggtgatctacctggcctgcgccgccggcatgctgatcatcgtgctgggcaacgtgttcgtggccttcgccgtgagctacttcaaggccctgcacacccccaccaacttcctgctgctgagcctggccctggccgacatgttcctgggcctgctggtgctgcccctgagcaccatcagaagcgtggagagctgctggttcttcggcgacttcctgtgcagactgcacacctacctggacaccctgttctgcctgaccagcatcttccacctgtgcttcatcagcatcgacagacactgcgccatctgcgaccccctgctgtaccccagcaagttcaccgtgagagtggccctgagatacatcctggccggctggggcgtgcccgccgcctacaccagcctgttcctgtacaccgacgtggtggagaccagactgagccagtggctggaggagatgccctgcgtgggcagctgccagctgctgctgaacaagttctggggctggctgaacttccccctgttcttcgtgccctgcctgatcatgatcagcctgtacgtgaagatcttcgtggtggccaccagacaggcccagcagatcaccaccctgagcaagagcctggccggcgccgccaagcacgagagaaaggccgccaagaccctgggcatcgccgtgggcatctacctgctgtgctggctgcccttcaccatcgacaccatggtggacagcctgctgcacttcatcaccccccccctggtgttcgacatcttcatctggttcgcctacttcaacagcgcctgcaaccccatcatctacgtgttcagctaccagtggttcagaaaggccctgaagctgaccctgagccagaaggtgttcagcccccagaccagaaccgtggacctgtaccaggagtag

SEQ ID NO: 22909 - DNA, 1029 bp, Artificial Sequence
  Description of Artificial Sequence: Synthetic coding sequence
atgaccagcaacttcagccagcccgtggtgcagctgtgctacgaggacgtgaacggcagctgcatcgagaccccctacagccccggcagcagagtgatcctgtacaccgccttcagcttcggcagcctgctggccgtgttcggcaacctgctggtgatgaccagcgtgctgcacttcaagcagctgcacagccccaccaacttcctgatcgccagcctggcctgcgccgacttcctggtgggcgtgaccgtgatgctgttcagcatggtgagaaccgtggagagctgctggtacttcggcgccaagttctgcaccctgcacagctgctgcgacgtggccttctgctacagcagcgtgctgcacctgtgcttcatctgcatcgacagatacatcgtggtgaccgaccccctggtgtacgccaccaagttcaccgtgagcgtgagcggcatctgcatcagcgtgagctggatcctgcccctgacctacagcggcgccgtgttctacaccggcgtgaacgacgacggcctggaggagctggtgagcgccctgaactgcgtgggcggctgccagatcatcgtgagccagggctgggtgctgatcgacttcctgctgttcttcatccccaccctggtgatgatcatcctgtacagcaagatcttcctgatcgccaagcagcaggccatcaagatcgagaccaccagcagcaaggtggagagcagcagcgagagctacaagatcagagtggccaagagagagagaaaggccgccaagaccctgggcgtgaccgtgctggccttcgtgatcagctggctgccctacaccgtggacatcctgatcgacgccttcatgggcttcctgacccccgcctacatctacgagatctgctgctggagcgcctactacaacagcgccatgaaccccctgatctacgccctgttctacccctggttcagaaaggccatcaagctgatcctgagcggcgacgtgctgaaggccagcagcagcaccatcagcctgttcctggagtag

SEQ ID NO: 22910 - DNA, 3780 bp, Artificial Sequence
  Description of Artificial Sequence: Synthetic coding sequence
atggacgccagcgaggagcccctgccccccgtgatctacaccatggagaacaagcccatcgtgacctgcgccggcgaccagaacctgttcaccagcgtgtaccccaccctgagccagcagctgcccagagagcccatggagtggagaagaagctacggcagagcccccaagatgatccacctggagagcaacttcgtgcagttcaaggaggagctgctgcccaaggagggcaacaaggccctgctgaccttccccttcctgcacatctactggaccgagtgctgcgacaccgaggtgtacaaggccaccgtgaaggacgacctgaccaagtggcagaacgtgctgaaggcccacagcagcgtggactggctgatcgtgatcgtggagaacgacgccaagaagaagaacaagaccaacatcctgcccagaaccagcatcgtggacaagatcagaaacgacttctgcaacaagcagagcgacagatgcgtggtgctgagcgaccccctgaaggacagcagcagaacccaggagagctggaacgccttcctgaccaagctgagaaccctgctgctgatgagcttcaccaagaacctgggcaagttcgaggacgacatgagaaccctgagagagaagagaaccgagcccggctggagcttctgcgagtacttcatggtgcaggaggagctggccttcgtgttcgagatgctgcagcagttcgaggacgccctggtgcagtacgacgagctggacgccctgttcagccagtacgtggtgaacttcggcgccggcgacggcgccaactggctgaccttcttctgccagcccgtgaagagctggaacggcctgatcctgagaaagcccatcgacatggagaagagagagagcatccagagaagagaggccaccctgctggacctgagaagctacctgttcagcagacagtgcaccctgctgctgttcctgcagagaccctgggaggtggcccagagagccctggagctgctgcacaactgcgtgcaggagctgaagctgctggaggtgagcgtgccccccggcgccctggactgctgggtgttcctgagctgcctggaggtgctgcagagaatcgagggctgctgcgacagagcccagatcgacagcaacatcgcccacaccgtgggcctgtggagctacgccaccgagaagctgaagagcctgggctacctgtgcggcctggtgagcgagaagggccccaacagcgaggacctgaacagaaccgtggacctgctggccggcctgggcgccgagagacccgagaccgccaacaccgcccagagcccctacaagaagctgaaggaggccctgagcagcgtggaggccttcgagaagcactacctggacctgagccacgccaccatcgagatgtacaccagcatcggcagaatcagaagcgccaagttcgtgggcaaggacctggccgagttctacatgagaaagaaggccccccagaaggccgagatctacctgcagggcgccctgaagaactacctggccgagggctgggccctgcccatcacccacaccagaaagcagctggccgagtgccagaagcacctgggccagatcgagaactacctgcagaccagcagcctgctggccagcgaccaccacctgaccgaggaggagagaaagcacttctgccaggagatcctggacttcgccagccagcccagcgacagccccggccacaagatcgtgctgcccatgcacagcttcgcccagctgagagacctgcacttcgaccccagcaacgccgtggtgcacgtgggcggcgtgctgtgcgtggagatcaccatgtacagccagatgcccgtgcccgtgcacgtggagcagatcgtggtgaacgtgcacttcagcatcgagaagaacagctacagaaagaccgccgagtggctgaccaagcacaagaccagcaacggcatcatcaacttcccccccgagaccgcccccttccccgtgagccagaacagcctgcccgccctggagctgtacgagatgttcgagagaagccccagcgacaacagcctgaacaccaccggcatcatctgcagaaacgtgcacatgctgctgagaagacaggagagcagcagcagcctggagatgcccagcggcgtggccctggaggagggcgcccacgtgctgagatgcagccacgtgaccctggagcccggcgccaaccagatcaccttcagaacccaggccaaggagcccggcacctacaccctgagacagctgtgcgccagcgtgggcagcgtgtggttcgtgctgccccacatctaccccatcgtgcagtacgacgtgtacagccaggagccccagctgcacgtggagcccctggccgacagcctgctggccggcatcccccagagagtgaagttcaccgtgaccaccggccactacaccatcaagaacggcgacagcctgcagctgagcaacgccgaggccatgctgatcctgtgccaggccgagagcagagccgtggtgtacagcaacaccagagagcagagcagcgaggccgccctgagaatccagagcagcgacaaggtgaccagcatcagcctgcccgtggcccccgcctaccacgtgatcgagttcgagctggaggtgctgagcctgcccagcgcccccgccctgggcggcgagagcgacatgctgggcatggccgagccccacagaaagcacaaggacaagcagagaaccggcagatgcatggtgaccaccgaccacaaggtgagcatcgactgcccctggagcatctacagcaccgtgatcgccctgaccttcagcgtgcccttcagaaccacccacagcctgctgagcagcggcaccagaaagtacgtgcaggtgtgcgtgcagaacctgagcgagctggacttccagctgagcgacagctacctggtggacaccggcgacagcaccgacctgcagctggtgcccctgaacacccagagccagcagcccatctacagcaagcagagcgtgttcttcgtgtgggagctgaagtggaccgaggagcccccccccagcctgcactgcagattcagcgtgggcttcagccccgccagcgaggagcagctgagcatcagcctgaagccctacacctacgagttcaaggtggagaacttcttcaccctgtacaacgtgaaggccgagatcttcccccccagcggcatggagtactgcagaaccggcagcctgtgcagcctggaggtgctgatcaccagactgagcgacctgctggaggtggacaaggacgaggccctgaccgagagcgacgagcacttcagcaccaagctgatgtacgaggtggtggacaacagcagcaactgggccgtgtgcggcaagagctgcggcgtgatcagcatgcccgtggccgccagagccacccacagagtgcacatggaggtgatgcccctgttcgccggctacctgcccctgcccgacgtgagactgttcaagtacctgccccaccacagcgcccacagcagccagctggacgccgacagctggatcgagaacgacagcctgagcgtggacaagcacggcgacgaccagcccgacagcagcagcctgaagagcagaggcagcgtgcacagcgcctgcagcagcgagcacaagggcctgcccatgcccagactgcaggccctgcccgccggccaggtgttcaacagcagcagcggcacccaggtgctggtgatccccagccaggacgaccacgtgctggaggtgagcgtgacctag

SEQ ID NO: 22911 - DNA, 1173 bp, Artificial Sequence
  Description of Artificial Sequence: Synthetic coding sequence
atgctgatcctgtgccaggccgagagcagagccgtggtgtacagcaacaccagagcccccgccctgggcggcgagagcgacatgctgggcatggccgagccccacagaaagcacaaggacaagcagagaaccggcagatgcatggtgaccaccgaccacaaggtgagcatcgactgcccctggagcatctacagcaccgtgatcgccctgaccttcagcgtgcccttcagaaccacccacagcctgctgagcagcggcaccagaaagtacgtgcaggtgtgcgtgcagaacctgagcgagctggacttccagctgagcgacagctacctggtggacaccggcgacagcaccgacctgcagctggtgcccctgaacacccagagccagcagcccatctacagcaagcagagcgtgttcttcgtgtgggagctgaagtggaccgaggagcccccccccagcctgcactgcagattcagcgtgggcttcagccccgccagcgaggagcagctgagcatcagcctgaagccctacacctacgagttcaaggtggagaacttcttcaccctgtacaacgtgaaggccgagatcttcccccccagcggcatggagtactgcagaaccggcagcctgtgcagcctggaggtgctgatcaccagactgagcgacctgctggaggtggacaaggacgaggccctgaccgagagcgacgagcacttcagcaccaagctgatgtacgaggtggtggacaacagcagcaactgggccgtgtgcggcaagagctgcggcgtgatcagcatgcccgtggccgccagagccacccacagagtgcacatggaggtgatgcccctgttcgccggctacctgcccctgcccgacgtgagactgttcaagtacctgccccaccacagcgcccacagcagccagctggacgccgacagctggatcgagaacgacagcctgagcgtggacaagcacggcgacgaccagcccgacagcagcagcctgaagagcagaggcagcgtgcacagcgcctgcagcagcgagcacaagggcctgcccatgcccagactgcaggccctgcccgccggccaggtgttcaacagcagcagcggcacccaggtgctggtgatccccagccaggacgaccacgtgctggaggtgagcgtgacctag

SEQ ID NO: 22912 - DNA, 423 bp, Artificial Sequence
  Description of Artificial Sequence: Synthetic coding sequence
atgagcggcagcttctacttcgtgatcgtgggccaccacgacaaccccgtgttcgagatggagttcctgcccgccggcaaggccgagagcaaggacgaccacagacacctgaaccagttcatcgcccacgccgccctggacctggtggacgagaacatgtggctgagcaacaacatgtacctgaagaccgtggacaagttcaacgagtggttcgtgagcgccttcgtgaccgccggccacatgagattcatcatgctgcacgacatcagacaggaggacggcatcaagaacttcttcaccgacgtgtacgacctgtacatcaagttcagcatgaaccccttctacgagcccaacagccccatcagaagcagcgccttcgacagaaaggtgcagttcctgggcaagaagcacctgctgagctag

SEQ ID NO: 22913 - DNA, 567 bp, Artificial Sequence
  Description of Artificial Sequence: Synthetic coding sequence
atggaggccagattcaccagaggcaagagcgccctgctggagagagccctggccagacccagaaccgaggtgagcctgagcgccttcgccctgctgttcagcgagctggtgcagcactgccagagcagagtgttcagcgtggccgagctgcagagcagactggccgccctgggcagacaggtgggcgccagagtgctggacgccctggtggccagagagaagggcgccagaagagagaccaaggtgctgggcgccctgctgttcgtgaagggcgccgtgtggaaggccctgttcggcaaggaggccgacaagctggagcaggccaacgacgacgccagaaccttctacatcatcgagagagagcccctgatcaacacctacatcagcgtgcccaaggagaacagcaccctgaactgcgccagcttcaccgccggcatcgtggaggccgtgctgacccacagcggcttccccgccaaggtgaccgcccactggcacaagggcaccaccctgatgatcaagttcgaggaggccgtgatcgccagagacagagccctggagggcagatag

SEQ ID NO: 22914 - DNA, 567 bp, Artificial Sequence; identical to SEQ ID NO: 22913
  Description of Artificial Sequence: Synthetic coding sequence

SEQ ID NO: 22915 - DNA, 567 bp, Artificial Sequence; identical to SEQ ID NO: 22913
  Description of Artificial Sequence: Synthetic coding sequence

SEQ ID NO: 22916 - DNA, 522 bp, Artificial Sequence
  Description of Artificial Sequence: Synthetic coding sequence
atggccgacaccgtgctgttcgagttcctgcacaccgagatggtggccgagctgtgggcccacgaccccgaccccggccccggcgtgagcgccggcctgagaggcgaggaggccggcgccaccaagggccagaagatgagcctgagcgtgctggagggcatgggcttcagagtgggccaggccctgggcgagagactgcccagagagaccctggccttcagagaggagctggacgtgctgaagttcctgtgcaaggacctgtgggtggccgtgttccagaagcagatggacagcctgagaaccaaccaccagggcacctacgtgctgcaggacaacagcttccccctgctgctgcccatggccagcggcctgcagtacctggaggaggcccccaagttcctggccttcacctgcggcctgctgagaggcgccctgtacaccctgggcatcgagagcgtggtgaccgccagcgtggccgccctgcccgtgtgcaagttccaggtggtgatccccaagagctag

SEQ ID NO: 22917 - DNA, 480 bp, Artificial Sequence
  Description of Artificial Sequence: Synthetic coding sequence
atggccgacaccgtgctgttcgagttcctgcacaccgagatggtggccgagctgtgggcccacgaccccgaccccggccccggcggccagaagatgagcctgagcgtgctggagggcatgggcttcagagtgggccaggccctgggcgagagactgcccagagagaccctggccttcagagaggagctggacgtgctgaagttcctgtgcaaggacctgtgggtggccgtgttccagaagcagatggacagcctgagaaccaaccaccagggcacctacgtgctgcaggacaacagcttccccctgctgctgcccatggccagcggcctgcagtacctggaggaggcccccaagttcctggccttcacctgcggcctgctgagaggcgccctgtacaccctgggcatcgagagcgtggtgaccgccagcgtggccgccctgcccgtgtgcaagttccaggtggtgatccccaagagctag

SEQ ID NO: 22918 - DNA, 342 bp, Artificial Sequence
  Description of Artificial Sequence: Synthetic coding sequence
atggccgacaccgtgctgttcgagttcctgcacaccgagatggtggccgagctgtgggcccacgaccccgaccccggccccggcgccgcccccggcgacgccggcctgcagggcggcgccggctgcccccaggtgctggtgcagagacccgtgggcggcggcgtgcccgaggccgacggccagcccgcccaccagagccccggcgacctgagacccgccagacagcagctgcccccccccccccccgacggcctgtggcccgccgtgagcggcggcagcacccaggtgcccggcctgcacctgagaccccccgccagaagacccctgtaccccggccactag

SEQ ID NO: 22919 - DNA, 477 bp, Artificial Sequence
  Description of Artificial Sequence: Synthetic coding sequence
atggccgacgaggccctgttcctgctgctgcacaacgagatggtgagcggcgtgtacaagagcgccgagcagggcgaggtggagaacggcagatgcatcaccaagctggagaacatgggcttcagagtgggccagggcctgatcgagagattcaccaaggacaccgccagattcaaggacgagctggacatcatgaagttcatctgcaaggacttctggaccaccgtgttcaagaagcagatcgacaacctgagaaccaaccaccagggcatctacgtgctgcaggacaacaagttcagactgctgacccagatgagcgccggcaagcagtacctggagcacgccagcaagtacctggccttcacctgcggcctgatcagaggcggcctgagcaacctgggcatcaagagcatcgtgaccgccgaggtgagcagcatgcccgcctgcaagttccaggtgatgatccagaagctgtag

SEQ ID NO: 22920 - DNA, 393 bp, Artificial Sequence
  Description of Artificial Sequence: Synthetic coding sequence
atggccgacgaggccctgttcctgctgctgcacaacgagatggtgagcggcgtgtacaagagcgccgagcagggcgaggtggagaacggcagatgcatcaccaagctggagaacatgggcttcagagtgggccagggcctgatcgagagattcaccaaggacaccgccagattcaaggacgagctggacatcatgaagttcatctgcaaggacttctggaccaccgtgttcaagaagcagatcgacaacctgagaaccaaccaccagtacctggccttcacctgcggcctgatcagaggcggcctgagcaacctgggcatcaagagcatcgtgaccgccgaggtgagcagcatgcccgcctgcaagttccaggtgatgatccagaagctgtag

SEQ ID NO: 22921 - DNA, 1092 bp, Artificial Sequence
  Description of Artificial Sequence: Synthetic coding sequence
atgttcaagagacacaagagcctggccagcgagagaaagagagccctgctgagccagagagccaccagattcatcctgaaggacgacatgagaaacttccacttcctgagcaagctggtgctgagcgccggccccctgagacccacccccgccgtgaagcacagcaagaccacccacttcgagatcgagatcttcgacgcccagaccagaaagcagatctgcatcctggacaaggtgacccagagcagcaccatccacgacgtgaagcagaagttccacaaggcctgccccaagtggtaccccagcagagtgggcctgcagctggagtgcggcggccccttcctgaaggactacatcaccatccagagcatcgccgccagcagcatcgtgaccctgtacgccaccgacctgggccagcaggtgagctggaccaccgtgttcctggccgagtacaccggccccctgctgatctacctgctgttctacctgagaatcccctgcatctacgacggcaaggagagcgccagaagactgagacaccccgtggtgcacctggcctgcttctgccactgcatccactacatcagatacctgctggagaccctgttcgtgcacaaggtgagcgccggccacacccccctgaagaacctgatcatgagctgcgccttctactggggcttcaccagctggatcgcctactacatcaaccaccccctgtacaccccccccagcttcggcaacagacagatcaccgtgagcgccatcaacttcctgatctgcgaggccggcaaccacttcatcaacgtgatgctgagccaccccaaccacaccggcaacaacgcctgcttccccagccccaactacaaccccttcacctggatgttcttcctggtgagctgccccaactacacctacgagatcggcagctggatcagcttcaccgtgatgacccagaccctgcccgtgggcatcttcaccctgctgatgagcatccagatgagcctgtgggcccagaagaagcacaagatctacctgagaaagttcaacagctacatccacagaaagagcgccatgatccccttcatcctgtag

SEQ ID NO: 22922 - DNA, 2262 bp, Artificial Sequence
  Description of Artificial Sequence: Synthetic coding sequence
atggccgccggcagcaccaccctgcacgccgtggagaagctgcaggtgagactggccaccaagaccgagcccaagaagctggagaagtacctgcagaagctgagcgccctgcccatgaccgccgacatcctggccgagaccggcatcagaaagaccgtgaagagactgagaaagcaccagcacgtgggcgacttcgccagagacctggccgccagatggaagaagctggtgctggtggacagaaacaccagacccggcccccaggaccccgaggagagcgccagcagacagagattcggcgaggccctgcaggaccaggagaaggcctggggcttccccgagaacgccaccgcccccagaagccccagccacagccccgagcacagaagaaccgccagaagaaccccccccggccagcagagaccccaccccagaagccacagcagagagcccagagccgagagaaagtgccccagaatcgcccccgccgacagcggcagatacagagccagccccaccagaaccgcccccctgagaatgcccgagggccccgagcccgccgcccccggcaagcagcccggcagaggccacacccacgccgcccagggcggccccctgctgtgccccggctgccagggccagccccagggcaaggccgtggtgagccacagcaagggccacaagagcagcagacaggagaagagacccctgtgcgcccagggcgactggcacagccccaccctgatcagagagaagagctgcggcgcctgcctgagagaggagacccccagaatgcccagctgggccagcgccagagacagacagcccagcgacttcaagaccgacaaggagggcggccaggccggcagcggccagagagtgcccgccctggaggaggcccccgacagccaccagaagagaccccagcacagccacagcaacaagaagagacccagcctggacggcagagaccccggcaacggcacccacggcctgagccccgaggagaaggagcagctgagcaacgacagagagacccaggagggcaagccccccaccgcccacctggacagaaccagcgtgagcagcctgagcgaggtggaggaggtggacatggccgaggagttcgagcagcccaccctgagctgcgagaagtacctgacctacgaccagctgagaaagcagaagaagaagaccggcaagagcgccaccaccgccctgggcgacaagcagagaaaggccaacgagagcaagggcaccagagagagctgggacagcgccaagaagctgccccccgtgcaggagagccagagcgagagactgcaggccgccggcgccgacagcgccggccccaagaccgtgcccagccacgtgttcagcgagctgtgggacctgagcgaggcctggatgcaggccaactacgaccccctgagcgacagcgacagcatgaccagccaggccaagcccgaggccctgagcagccccaagttcagagaggaggccgccttccccggcagaagagtgaacgccaagatgcccgtgtacagcggcagcagacccgcctgccagctgcaggtgcccaccctgagacagcagtgcgcccaggtgctgagaaacaaccccgacgccctgagcgacgtgggcgaggtgccctactgggtgctggagcccgtgctggagggctggagacccgaccagctgtacagaagaaagaaggacaaccacgccctggtgagagagaccgacgagctgagaagaaaccactgcttccaggacttcaaggaggagaagccccaggagaacaagacctggagagagcagtacctgagactgcccgacgcccccgagcagagactgagagtgatgaccaccaacatcagaagcgccagaggcaacaaccccaacggcagagaggccaagatgatctgcttcaagagcgtggccaagaccccctacgacaccagcagaagacaggagaagagcgccggcgacgccgaccccgagaacggcgagatcaagcccgccagcaagcccgccggcagcagccacacccccagcagccagagcagcagcggcggcggcagagacagcagcagcagcatcctgagatggctgcccgagaagagagccaacccctgcctgagcagcagcaacgagcacgccgcccccgccgccaagaccagaaagcaggccgccaagaaggtggcccccctgatggccaaggccatcagagactacaagagaagattcagcagaagatag

SEQ ID NO: 22923 - DNA, 1641 bp, Artificial Sequence
  Description of Artificial Sequence: Synthetic coding sequence
atggccgccggcagcaccaccctgagagccgtgggcaagctgcaggtgagactggccaccaagaccgagcccaagaagctggagaagtacctgcagaagctgagcgccctgcccatgaccgccgacatcctggccgagaccggcatcagaaagaccgtgaagagactgagaaagcaccagcacgtgggcgacttcgccagagacctggccgccagatggaagaagctggtgctggtggacagaaacaccggccccgacccccaggaccccgaggagagcgccagcagacagagattcggcgaggccctgcaggagagagagaaggcctggggcttccccgagaacgccaccgcccccagaagccccagccacagccccgagcacagaagaaccgccagaagaaccccccccggccagcagagaccccaccccagaagccccagcagagagcccagagccgagagaaagagacccagaatggcccccgccgacagcggcccccacagagacccccccaccagaaccgcccccctgcccatgcccgagggccccgagcccgccgtgcccggcgagcagcccggcagaggccacgcccacgccgcccagggcggccccctgctgggccagggctgccagggccagccccagggcgaggccgtgggcagccacagcaagggccacaagagcagcagaggcgccagcgcccagaagagcccccccgtgcaggagagccagagcgagagactgcaggccgccggcgccgacagcgccggccccaagaccgtgcccagccacgtgttcagcgagctgtgggaccccagcgaggcctggatgcaggccaactacgacctgctgagcgccttcgaggccatgaccagccaggccaaccccgaggccctgagcgcccccgccctgcaggaggaggccgccttccccggcagaagagtgaacgccaagatgcccgtgtacagcggcagcagacccgcctgccagctgcaggtgcccaccctgagacagcagtgcctgagagtgcccagaaacaaccccgacgccctgggcgacgtggagggcgtgccctacagcgtgctggagcccgtgctggagggctggacccccgaccagctgtacagaaccgagaaggacaacgccgccctggccagagagaccgacgagctgtggagaatccactgcctgcaggacttcaaggaggagaagccccaggagcacgagagctggagagagctgtacctgagactgagagacgccagagagcagagactgagagtggtgaccaccaagatcagaagcgccagagagaacaagcccagcggcagacagaccaagatgatctgcttcaacagcgtggccaagaccccctacgacgccagcagaagacaggagaagagcgccggcgccgccgaccccggcaacggcgagatggagcccgcccccaagcccgccggcagcagccaggcccccagcggcctgggcgacggcgacggcggcagcgtgagcggcggcggcagcagcaacagacacgccgcccccgccgacaagaccagaaagcaggccgccaagaaggtggcccccctgatggccaaggccatcagagactacaagggcagattcagcagaagatag

SEQ ID NO: 22924 - DNA, 1641 bp, Artificial Sequence
  Description of Artificial Sequence: Synthetic coding sequence
atggccgccggcagcaccaccctgagagccgtgggcaagctgcaggtgagactggccaccaagaccgagcccaagaagctggagaagtacctgcagaagctgagcgccctgcccatgaccgccgacatcctggccgagaccggcatcagaaagaccgtgaagagactgagaaagcaccagcacgtgggcgacttcgccagagacctggccgccagatggaagaagctggtgctggtggacagaaacaccggccccgacccccaggaccccgaggagagcgccagcagacagagattcggcgaggccctgcaggagagagagaaggcctggggcttccccgagaacgccaccgcccccagaagccccagccacagccccgagcacagaagaaccgccagaagaaccccccccggccagcagagaccccaccccagaagccccagcagagagcccagagccgagagaaagagacccagaatggcccccgccgacagcggcccccacagagacccccccaccagaaccgcccccctgcccatgcccgagggccccgagcccgccgtgcccggcgagcagcccggcagaggccacgcccacgccgcccagggcggccccctgctgggccagggctgccagggccagccccagggcgaggccgtgggcagccacagcaagggccacaagagcagcagaggcgccagcgcccagaagagcccccccgtgcaggagagccagagcgagagactgcaggccgccggcgccgacagcgccggccccaagaccgtgcccagccacgtgttcagcgagctgtgggaccccagcgaggcctggatgcaggccaactacgacctgctgagcgccttcgaggccatgaccagccaggccaaccccgaggccctgagcgcccccaccctgcaggaggaggccgccttccccggcagaagagtgaacgccaagatgcccgtgtacagcggcagcagacccgcctgccagctgcaggtgcccaccctgagacagcagtgcctgagagtgcccagaaacaaccccgacgccctgggcgacgtggagggcgtgccctacagcgtgctggagcccgtgctggagggctggacccccgaccagccctacagaaccgagaaggacaacgccgccctggccagagagaccgacgagctgtggagaatccactgcctgcaggacttcaaggaggagaagccccaggagcacgagagctggagagagctgtacctgagactgagagacgccagagagcagagactgagagtggtgaccaccaagatcagaagcgccagagagaacaagcccagcggcagacagaccaagatgatctgcttcaacagcgtggccaagaccccctacgacgccagcagaagacaggagaagagcgccggcgccgccgaccccggcaacggcgagatggagcccgcccccaagcccgccggcagcagccaggcccccagcggcctgggcgacggcgacggcggcagcgtgagcggcggcggcagcagcaacagacacgccgcccccgccgacaagaccagaaagcaggccgccaagaaggtggcccccctgatggccaaggccatcagagactacaagggcagattcagcagaagatag

SEQ ID NO: 22925 - DNA, 1083 bp, Artificial Sequence
  Description of Artificial Sequence: Synthetic coding sequence
atgagcggcagcgtgctgttcaccgccggcgagagatggagatgcttcctgacccccagcagaagcagcctgtactgggccctgcacaacttctgctgcagaaagaagagcaccacccccaagaagatcacccccaacgtgaccttctgcgacgagaacgccaaggagcccgagaacgccctggacaagctgttcagcagcgagcagcaggccagcatcctgcacgtgctgaacaccgccagcaccaaggagctggaggccttcagactgctgagaggcagaagaagcatcaacatcgtggagcacagagagaacttcggccccttccagaacctggagagcctgatgaacgtgcccctgttcaagtacaagagcaccgtgcaggtgtgcaacagcatcctgtgccccaagaccggcagagagaagagaaagagccccgagaacagattcctgagaaagctgctgaagcccgacatcgagagagagagactgaaggccgtgaacagcatcatcagcatcgtgttcggcaccagaagaatcgcctgggcccacctggacagaaagctgaccgtgctggactggcagcagagcgacagatggagcctgatgagaggcatctacagcagcagcgtgtacctggaggagatcagcagcatcatcagcaagatgcccaaggccgacttctacgtgctggagaagaccggcctgagcatccagaacagcagcctgttccccatcctgctgcacttccacatcatggaggccatgctgtacgccctgctgaacaagaccttcgcccaggacggccagcaccaggtgctgagcatgaacagaaacgccgtgggcaagcacttcgagctgatgatcggcgacagcagaaccagcggcaaggagctggtgaagcagttcctgttcgacagcatcctgaaggccgaccccagagtgttcttccccagcgacaagatcgtgcactacagacagatgttcctgagcaccgagctgcagagagtggaggagctgtacgacagcctgctgcaggccatcgccttctacgagctggccgtgttcgacagccagccctag

SEQ ID NO: 22926 - DNA, 1083 bp, Artificial Sequence; identical to SEQ ID NO: 22925
  Description of Artificial Sequence: Synthetic coding sequence

SEQ ID NO: 22927 - DNA, 546 bp, Artificial Sequence
  Description of Artificial Sequence: Synthetic coding sequence
atgagcggcagcgtgctgttcaccgccggcgagagatggagatgcttcctgacccccagcagaagcagcctgtactgggccctgcacaacttctgctgcagaaagaagagcaccacccccaagaagatcacccccaacgtgaccttctgcgacgagaacgccaaggagcccgagaacgccctggacaagctgttcagcagcgagcagcaggccagcatcctgcacgtgctgaacaccgccagcaccaaggagctggaggccttcagactgctgagaggcagaagaagcatcaacatcgtggagcacagagagaacttcggccccttccagaacctggagagcctgatgaacgtgcccctgttcaagtacaagagcaccgtgcaggtgtgcaacagcatcctgtgccccaagaccggcagagagaagagaaagagccccgagaacagattcctgagaaagctgctgaagcccgacatcgagagagagagactgaaggtgtacagcagctgcctgctgtactgcctgatcttcgagaacctgctgtag

SEQ ID NO: 22928 - DNA, 1191 bp, Artificial Sequence
  Description of Artificial Sequence: Synthetic coding sequence
atgtggatccccgtggtgggcctgcccagaagactgagactgagcgccctggccggcgccggcagattctgcatcctgggcagcgaggccgccaccagaaagcacctgcccgccagaaaccactgcggcctgagcgacagcagcccccagctgtggcccgagcccgacttcagaaacccccccagaaaggccagcaaggccagcctggacttcaagagatacgtgaccgacagaagactggccgagaccctggcccagatctacctgggcaagcccagcagacccccccacctgctgctggagtgcaaccccggccccggcatcctgacccaggccctgctggaggccggcgccaaggtggtggccctggagagcgacaagaccttcatcccccacctggagagcctgggcaagaacctggacggcaagctgagagtgatccactgcgacttcttcaagctggaccccagaagcggcggcgtgatcaagccccccgccatgagcagcagaggcctgttcaagaacctgggcatcgaggccgtgccctggaccgccgacatccccctgaaggtggtgggcatgttccccagcagaggcgagaagagagccctgtggaagctggcctacgacctgtacagctgcaccagcatctacaagttcggcagaatcgaggtgaacatgttcatcggcgagaaggagttccagaagctgatggccgaccccggcaaccccgacctgtaccacgtgctgagcgtgatctggcagctggcctgcgagatcaaggtgctgcacatggagccctggagcagcttcgacatctacaccagaaagggccccctggagaaccccaagagaagagagctgctggaccagctgcagcagaagctgtacctgatccagatgatccccagacagaacctgttcaccaagaacctgacccccatgaactacaacatcttcttccacctgctgaagcactgcttcggcagaagaagcgccaccgtgatcgaccacctgagaagcctgacccccctggacgccagagacatcctgatgcagatcggcaagcaggaggacgagaaggtggtgaacatgcacccccaggacttcaagaccctgttcgagaccatcgagagaagcaaggactgcgcctacaagtggctgtacgacgagaccctggaggacagatag

SEQ ID NO: 22929 - DNA, 414 bp, Artificial Sequence
  Description of Artificial Sequence: Synthetic coding sequence
atgtggatccccgtggtgggcctgcccagaagactgagactgagcgccctggccggcgccggcagattctgcatcctgggcagcgaggccgccaccagaaagcacctgcccgccagaaaccactgcggcctgagcgacagcagcccccagctgtggcccgagcccgacttcagaaacccccccagaaaggccagcaaggccagcctggacttcaagagatacgtgaccgacagaagactggccgagaccctggcccagatctacctgggcaagcccagcagacccccccacctgctgctggagtgcaaccccggccccggcatcctgacccaggccctgctggaggccggcgccaaggtggtggccctggagagcgacaagaccttcatcccccacctggagaccagcctgtag

SEQ ID NO: 22930 - DNA, 1896 bp, Artificial Sequence
  Description of Artificial Sequence: Synthetic coding sequence
atggccgcccacctggtgaagagatgcacctgcctgctgagagaggccgccagacaggcccccgccatggcccccgtgggcagactgagactggcctgggtggcccacaagaccctgaccagcagcgccaccagccccatcagccacctgcccggcagcctgatggagcccgtggagaaggagagagccagcaccccctacatcgagaagcaggtggaccacctgatcaagaaggccaccagacccgaggagctgctggagctgctgggcggcagccacgacctggacagcaaccaggccgccatggtgctgatcagactgagccacctgctgagcgagaagcccgaggacaagggcctgctgatccaggacgcccacttccaccagctgctgtgcctgctgaacagccagatcgccagcgtgtggcacggcaccctgagcaagctgctgggcagcctgtacgccctgggcatccccaaggccagcaaggagctgcagagcgtggagcaggaggtgagatggagaatgagaaagctgaagtacaagcacctggccttcctggccgagagctgcgccaccctgagccaggagcagcacagccaggagctgctggccgagctgctgacccacctggagagaagatggaccgagatcgaggacagccacaccctggtgaccgtgatgatgaaggtgggccacctgagcgagcccctgatgaacagactggaggacaagtgcctggagctggtggagcacttcggccccaacgagctgagaaaggtgctggtgatgctggccgcccagagcagaagaagcgtgcccctgctgagagccatcagctaccacctggtgcagaagcccttcagcctgaccaaggacgtgctgctggacgtggcctacgcctacggcaagctgagcttccaccagacccaggtgagccagagactggccaccgacctgctgagcctgatgcccagcctgaccagcggcgaggtggcccactgcgccaagagcttcgccctgctgaagtggctgagcctgcccctgttcgaggccttcgcccagcacgtgctgaacagagcccaggacatcaccctgccccacctgtgcagcgtgctgctggccttcgccagactgaacttccaccccgaccaggaggaccagttcttcagcctggtgcacgagaagctgggcagcgagctgcccggcctggagcccgccctgcaggtggacctggtgtgggccctgtgcgtgctgcagcaggccagagaggccgagctgcaggccgtgctgcaccccgagttccacatccagttcctgggcggcaagagccagaaggaccagaacaccttccagaagctgctgcacatcaacgccaccgccctgctggagtaccccgagtacagcggccccctgctgcccgccagcgccgtggcccccggccccagcgccctggacagaaaggtgacccccctgcagaaggagctgcaggagaccctgaagggcctgctgggcagcgccgacaagggcagcctggaggtggccacccagtacggctgggtgctggacgccgaggtgctgctggacagcgacggcgagttcctgcccgtgagagacttcgtggccccccacctggcccagcccaccggcagccagagccccccccccggcagcaagagactggccttcctgagatgggagttccccaacttcaacagcagaagcaaggacctgctgggcagattcgtgctggccagaagacacatcgtggccgccggcttcctgatcgtggacgtgcccttctacgagtggctggagctgaagagcgagtggcagaagggcgcctacctgaaggacaagatgagaaaggccgtggccgaggagctggccaagtag

SEQ ID NO: 22931 - DNA, 1566 bp, Artificial Sequence
  Description of Artificial Sequence: Synthetic coding sequence
atggccgcccacctggtgaagagatgcacctgcctgctgagagaggccgccagacaggcccccgccatggcccccgtgggcagactgagactggcctgggtggcccacaagaccctgaccagcagcgccaccagccccatcagccacctgcccggcagcctgatggagcccgtggagaaggagagagccagcaccccctacatcgagaagcaggtggaccacctgatcaagaaggccaccagacccgaggagctgctggagctgctgggcggcagccacgacctggacagcaaccaggccgccatggtgctgatcagactgagccacctgctgagcgagaagcccgaggacaagggcctgctgatccaggacgcccacttccaccagctgctgtgcctgctgaacagccagatcgccagcgtgtggcacggcaccctgagcaagctgctgggcagcctgtacgccctgggcatccccaaggccagcaaggagctgcagagcgtggagcaggaggtgagatggagaatgagaaagctgaagtacaagcacctggccttcctggccgagagctgcgccaccctgagccaggagcagcacagccaggagctgctggccgagctgctgacccacctggagagaagatggaccgagatcgaggacagccacaccctggtgaccgtgatgatgaaggtgggccacctgagcgagcccctgatgaacagactggaggacaagcacgtgctgaacagagcccaggacatcaccctgccccacctgtgcagcgtgctgctggccttcgccagactgaacttccaccccgaccaggaggaccagttcttcagcctggtgcacgagaagctgggcagcgagctgcccggcctggagcccgccctgcaggtggacctggtgtgggccctgtgcgtgctgcagcaggccagagaggccgagctgcaggccgtgctgcaccccgagttccacatccagttcctgggcggcaagagccagaaggaccagaacaccttccagaagctgctgcacatcaacgccaccgccctgctggagtaccccgagtacagcggccccctgctgcccgccagcgccgtggcccccggccccagcgccctggacagaaaggtgacccccctgcagaaggagctgcaggagaccctgaagggcctgctgggcagcgccgacaagggcagcctggaggtggccacccagtacggctgggtgctggacgccgaggtgctgctggacagcgacggcgagttcctgcccgtgagagacttcgtggccccccacctggcccagcccaccggcagccagagccccccccccggcagcaagagactggccttcctgagatgggagttccccaacttcaacagcagaagcaaggacctgctgggcagattcgtgctggccagaagacacatcgtggccgccggcttcctgatcgtggacgtgcccttctacgagtggctggagctgaagagcgagtggcagaagggcgcctacctgaaggacaagatgagaaaggccgtggccgaggagctggccaagtag

SEQ ID NO: 22932 - DNA, 1566 bp, Artificial Sequence; identical to SEQ ID NO: 22931
  Description of Artificial Sequence: Synthetic coding sequence

SEQ ID NO: 22933 - DNA, 387 bp, Artificial Sequence
  Description of Artificial Sequence: Synthetic coding sequence
atggccgcccacctggtgaagagatgcacctgcctgctgagagaggccgccagacaggcccccgccatggcccccgtgggcagactgagactggcctgggtggcccacaagaccctgaccagcagcgccaccagccccatcagccacctgcccggcagcctgatggagcccgtggagaaggagagagccagcaccccctacatcgagaagcaggtggaccacctgatcaagaaggccaccagacccgaggagctgctggagctgctgggcggcagccacgacctggacagcaaccaggccgccatggtgctgatcagactgagccacctgctgagcgagaagcccgaggacaagggcctgctgatccaggacgcccacttccactag

SEQ ID NO: 22934 - DNA, 357 bp, Artificial Sequence
  Description of Artificial Sequence: Synthetic coding sequence
atggccgcccacctggtgaagagatgcacctgcctgctgagagaggccgccagacaggcccccgccatggcccccgtgggcagactgagactggcctgggtggcccacaagaccctgaccagcagcgccaccagccccatcagccacctgcccggcagcctgatggagcccgtggagaaggagagagccagcaccccctacatcgagaagcaggtggaccacctgatcaagaaggccaccagacccgaggagctgctggagctgctgggcggcagccacgacctggacagcaaccaggccgccatggtgctgatcagactgagccacctgctgagcgagaagcccgaggacaagtag

SEQ ID NO: 22935 - DNA, 1896 bp, Artificial Sequence; identical to SEQ ID NO: 22930
  Description of Artificial Sequence: Synthetic coding sequence

SEQ ID NO: 22936 - DNA, 312 bp, Artificial Sequence
  Description of Artificial Sequence: Synthetic coding sequence
atggccgcccacctggtgaagagatgcacctgcctgctgagagaggccgccagacaggcccccgccatggcccccgtgggcagactgagactggcctgggtggcccacaagaccctgaccagcagcgccaccagccccatcagccacctgcccggcagcctgatggagcccgtggagaaggagagagccagcaccccctacatcgagaagcaggtggaccacctgatcaagaaggccaccagacccgaggagctgctggagctgctgggcggcagccacgacctggacagcaaccaggccgccatggtgtag

SEQ ID NO: 22937 - DNA, 2547 bp, Artificial Sequence
  Description of Artificial Sequence: Synthetic coding sequence
atggagggcagccccagcctgagaagaatgaccgtgatgagagagaagggcagaagacaggccgtgagaggccccgccttcatgttcaacgacagaggcaccagcctgaccgccgaggaggagagattcctggacgccgccgagtacggcaacatccccgtggtgagaaagatgctggaggagagcaagaccctgaacgtgaactgcgtggactacatgggccagaacgccctgcagctggccgtgggcaacgagcacctggaggtgaccgagctgctgctgaagaaggagaacctggccagaatcggcgacgccctgctgctggccatcagcaagggctacgtgagaatcgtggaggccatcctgaaccaccccggcttcgccgccagcaagagactgaccctgagcccctgcgagcaggagctgcaggacgacgacttctacgcctacgacgaggacggcaccagattcagccccgacatcacccccatcatcctggccgcccactgccagaagtacgaggtggtgcacatgctgctgatgaagggcgccagaatcgagagaccccacgactacttctgcaagtgcggcgactgcatggagaagcagagacacgacagcttcagccacagcagaagcagaatcaacgcctacaagggcctggccagccccgcctacctgagcctgagcagcgaggaccccgtgctgaccgccctggagctgagcaacgagctggccaagctggccaacatcgagaaggagttcaagaacgactacagaaagctgagcatgcagtgcaaggacttcgtggtgggcgtgctggacctgtgcagagacagcgaggaggtggaggccatcctgaacggcgacctggagagcgccgagcccctggaggtgcacagacacaaggccagcctgagcagagtgaagctggccatcaagtacgaggtgaagaagttcgtggcccaccccaactgccagcagcagctgctgaccatctggtacgagaacctgagcggcctgagagagcagaccatcgccatcaagtgcctggtggtgctggtggtggccctgggcctgcccttcctggccatcggctactggatcgccccctgcagcagactgggcaagatcctgagaagccccttcatgaagttcgtggcccacgccgccagcttcatcatcttcctgggcctgctggtgttcaacgccagcgacagattcgagggcatcaccaccctgcccaacatcaccgtgaccgactaccccaagcagatcttcagagtgaagaccacccagttcacctggaccgagatgctgatcatggtgtgggtgctgggcatgatgtggagcgagtgcaaggagctgtggctggagggccccagagagtacatcctgcagctgtggaacgtgctggacttcggcatgctgagcatcttcatcgccgccttcaccgccagattcctggccttcctgcaggccaccaaggcccagcagtacgtggacagctacgtgcaggagagcgacctgagcgaggtgaccctgccccccgagatccagtacttcacctacgccagagacaagtggctgcccagcgacccccagatcatcagcgagggcctgtacgccatcgccgtggtgctgagcttcagcagaatcgcctacatcctgcccgccaacgagagcttcggccccctgcagatcagcctgggcagaaccgtgaaggacatcttcaagttcatggtgctgttcatcatggtgttcttcgccttcatgatcggcatgttcatcctgtacagctactacctgggcgccaaggtgaacgccgccttcaccaccgtggaggagagcttcaagaccctgttctggagcatcttcggcctgagcgaggtgaccagcgtggtgctgaagtacgaccacaagttcatcgagaacatcggctacgtgctgtacggcatctacaacgtgaccatggtggtggtgctgctgaacatgctgatcgccatgatcaacagcagctaccaggagatcgaggacgacagcgacgtggagtggaagttcgccagaagcaagctgtggctgagctacttcgacgacggcaagaccctgcccccccccttcagcctggtgcccagccccaagagcttcgtgtacttcatcatgagaatcgtgaacttccccaagtgcagaagaagaagactgcagaaggacatcgagatgggcatgggcaacagcaagagcagactgaacctgttcacccagagcaacagcagagtgttcgagagccacagcttcaacagcatcctgaaccagcccaccagataccagcagatcatgaagagactgatcaagagatacgtgctgaaggcccaggtggacaaggagaacgacgaggtgaacgagggcgagctgaaggagatcaagcaggacatcagcagcctgagatacgagctgctggaggacaagagccaggccaccgaggagctggccatcctgatccacaagctgagcgagaagctgaaccccagcatgctgagatgcgagtag

SEQ ID NO: 22938 - DNA, 2766 bp, Artificial Sequence
  Description of Artificial Sequence: Synthetic coding sequence
atgagcaccaaggtgagaaagtgcaaggagcaggccagagtgaccttccccgcccccgaggaggaggaggacgagggcgaggacgagggcgccgagccccagagaagaagaagaggctggagaggcgtgaacggcggcctggagcccagaagcgcccccagccagagagagccccacggctactgccccccccccttcagccacggccccgacctgagcatggagggcagccccagcctgagaagaatgaccgtgatgagagagaagggcagaagacaggccgtgagaggccccgccttcatgttcaacgacagaggcaccagcctgaccgccgaggaggagagattcctggacgccgccgagtacggcaacatccccgtggtgagaaagatgctggaggagagcaagaccctgaacgtgaactgcgtggactacatgggccagaacgccctgcagctggccgtgggcaacgagcacctggaggtgaccgagctgctgctgaagaaggagaacctggccagaatcggcgacgccctgctgctggccatcagcaagggctacgtgagaatcgtggaggccatcctgaaccaccccggcttcgccgccagcaagagactgaccctgagcccctgcgagcaggagctgcaggacgacgacttctacgcctacgacgaggacggcaccagattcagccccgacatcacccccatcatcctggccgcccactgccagaagtacgaggtggtgcacatgctgctgatgaagggcgccagaatcgagagaccccacgactacttctgcaagtgcggcgactgcatggagaagcagagacacgacagcttcagccacagcagaagcagaatcaacgcctacaagggcctggccagccccgcctacctgagcctgagcagcgaggaccccgtgctgaccgccctggagctgagcaacgagctggccaagctggccaacatcgagaaggagttcaagaacgactacagaaagctgagcatgcagtgcaaggacttcgtggtgggcgtgctggacctgtgcagagacagcgaggaggtggaggccatcctgaacggcgacctggagagcgccgagcccctggaggtgcacagacacaaggccagcctgagcagagtgaagctggccatcaagtacgaggtgaagaagttcgtggcccaccccaactgccagcagcagctgctgaccatctggtacgagaacctgagcggcctgagagagcagaccatcgccatcaagtgcctggtggtgctggtggtggccctgggcctgcccttcctggccatcggctactggatcgccccctgcagcagactgggcaagatcctgagaagccccttcatgaagttcgtggcccacgccgccagcttcatcatcttcctgggcctgctggtgttcaacgccagcgacagattcgagggcatcaccaccctgcccaacatcaccgtgaccgactaccccaagcagatcttcagagtgaagaccacccagttcacctggaccgagatgctgatcatggtgtgggtgctgggcatgatgtggagcgagtgcaaggagctgtggctggagggccccagagagtacatcctgcagctgtggaacgtgctggacttcggcatgctgagcatcttcatcgccgccttcaccgccagattcctggccttcctgcaggccaccaaggcccagcagtacgtggacagctacgtgcaggagagcgacctgagcgaggtgaccctgccccccgagatccagtacttcacctacgccagagacaagtggctgcccagcgacccccagatcatcagcgagggcctgtacgccatcgccgtggtgctgagcttcagcagaatcgcctacatcctgcccgccaacgagagcttcggccccctgcagatcagcctgggcagaaccgtgaaggacatcttcaagttcatggtgctgttcatcatggtgttcttcgccttcatgatcggcatgttcatcctgtacagctactacctgggcgccaaggtgaacgccgccttcaccaccgtggaggagagcttcaagaccctgttctggagcatcttcggcctgagcgaggtgaccagcgtggtgctgaagtacgaccacaagttcatcgagaacatcggctacgtgctgtacggcatctacaacgtgaccatggtggtggtgctgctgaacatgctgatcgccatgatcaacagcagctaccaggagatcgaggacgacagcgacgtggagtggaagttcgccagaagcaagctgtggctgagctacttcgacgacggcaagaccctgcccccccccttcagcctggtgcccagccccaagagcttcgtgtacttcatcatgagaatcgtgaacttccccaagtgcagaagaagaagactgcagaaggacatcgagatgggcatgggcaacagcaagagcagactgaacctgttcacccagagcaacagcagagtgttcgagagccacagcttcaacagcatcctgaaccagcccaccagataccagcagatcatgaagagactgatcaagagatacgtgctgaaggcccaggtggacaaggagaacgacgaggtgaacgagggcgagctgaaggagatcaagcaggacatcagcagcctgagatacgagctgctggaggacaagagccaggccaccgaggagctggccatcctgatccacaagctgagcgagaagctgaaccccagcatgctgagatgcgagtag

SEQ ID NO: 22939 - DNA, 282 bp, Artificial Sequence
  Description of Artificial Sequence: Synthetic coding sequence
atggagggcagccccagcctgagaagaatgaccgtgatgagagagaagggcagaagacaggccgtgagaggccccgccttcatgttcaacgacagaggcaccagcctgaccgccgaggaggagagattcctggacgccgccgagtacggcaacatccccgtggtgagaaagatgctggaggagagcaagaccctgaacgtgaactgcgtggactacatgggccagaacgccctgcagctggccgtgggcaacgagcacctggaggtgaccgagctgctgtag

SEQ ID NO: 22940 - DNA, 2382 bp, Artificial Sequence
  Description of Artificial Sequence: Synthetic coding sequence
atggagggcagccccagcctgagaagaatgaccgtgatgagagagaagggcagaagacaggccgtgagaggccccgccttcatgttcaacgacagaggcaccagcctgaccgccgaggaggagagattcctggacgccgccgagtacggcaacatccccgtggtgagaaagatgctggaggagagcaagaccctgaacgtgaactgcgtggactacatgggccagaacgccctgcagctggccgtgggcaacgagcacctggaggtgaccgagctgctgctgaagaaggagaacctggccagaatcggcgacgccctgctgctggccatcagcaagggctacgtgagaatcgtggaggccatcctgaaccaccccggcttcgccgccagcaagagactgaccctgagcccctgcgagcaggagctgcaggacgacgacttctacgcctacgacgaggacggcaccagattcagccccgacatcacccccatcatcctggccgcccactgccagaagtacgaggtggtgcacatgctgctgatgaagggcgccagaatcgagagaccccacgactacttctgcaagtgcggcgactgcatggagaagcagagacacgacagcttcagccacagcagaagcagaatcaacgcctacaagggcctggccagccccgcctacctgagcctgagcagcgaggaccccgtgctgaccgccctggagctgagcaacgagctggccaagctggccaacatcgagaaggagttcaagaacgactacagaaagctgagcatgcagtgcaaggacttcgtggtgggcgtgctggacctgtgcagagacagcgaggaggtggaggccatcctgaacggcgacctggagagcgccgagcccctggaggtgcacagacacaaggccagcctgagcagagtgaagctggccatcaagtacgaggtgaagaagctgggcaagatcctgagaagccccttcatgaagttcgtggcccacgccgccagcttcatcatcttcctgggcctgctggtgttcaacgccagcgacagattcgagggcatcaccaccctgcccaacatcaccgtgaccgactaccccaagcagatcttcagagtgaagaccacccagttcacctggaccgagatgctgatcatggtgtgggtgctgggcatgatgtggagcgagtgcaaggagctgtggctggagggccccagagagtacatcctgcagctgtggaacgtgctggacttcggcatgctgagcatcttcatcgccgccttcaccgccagattcctggccttcctgcaggccaccaaggcccagcagtacgtggacagctacgtgcaggagagcgacctgagcgaggtgaccctgccccccgagatccagtacttcacctacgccagagacaagtggctgcccagcgacccccagatcatcagcgagggcctgtacgccatcgccgtggtgctgagcttcagcagaatcgcctacatcctgcccgccaacgagagcttcggccccctgcagatcagcctgggcagaaccgtgaaggacatcttcaagttcatggtgctgttcatcatggtgttcttcgccttcatgatcggcatgttcatcctgtacagctactacctgggcgccaaggtgaacgccgccttcaccaccgtggaggagagcttcaagaccctgttctggagcatcttcggcctgagcgaggtgaccagcgtggtgctgaagtacgaccacaagttcatcgagaacatcggctacgtgctgtacggcatctacaacgtgaccatggtggtggtgctgctgaacatgctgatcgccatgatcaacagcagctaccaggagatcgaggacgacagcgacgtggagtggaagttcgccagaagcaagctgtggctgagctacttcgacgacggcaagaccctgcccccccccttcagcctggtgcccagccccaagagcttcgtgtacttcatcatgagaatcgtgaacttccccaagtgcagaagaagaagactgcagaaggacatcgagatgggcatgggcaacagcaagagcagactgaacctgttcacccagagcaacagcagagtgttcgagagccacagcttcaacagcatcctgaaccagcccaccagataccagcagatcatgaagagactgatcaagagatacgtgctgaaggcccaggtggacaaggagaacgacgaggtgaacgagggcgagctgaaggagatcaagcaggacatcagcagcctgagatacgagctgctggaggacaagagccaggccaccgaggagctggccatcctgatccacaagctgagcgagaagctgaaccccagcatgctgagatgcgagtag

SEQ ID NO: 22941 - DNA, 747 bp, Artificial Sequence
  Description of Artificial Sequence: Synthetic coding sequence
atgatctgcaccttcctgagagccgtgcagtacaccgagaagctgcacagaagcagcgccaagagactgctgctgccctacatcgtgctgaacaaggcctgcctgaagaccgagcccagcctgagatgcggcctgcagtaccagaagaagaccctgagacccagatgcatcctgggcgtgacccagaagaccatctggacccagggccccagccccagaaaggccaaggaggacggcagcaagcaggtgagcgtgcacagaagccagagaggcggcaccgccgtgcccaccagccagaaggtgaaggaggccggcagagacttcacctacctgatcgtggtgctgttcggcatcagcatcaccggcggcctgttctacaccatcttcaaggagctgttcagcagcagcagccccagcaagatctacggcagagccctggagaagtgcagaagccaccccgaggtgatcggcgtgttcggcgagagcgtgaagggctacggcgaggtgaccagaagaggcagaagacagcacgtgagattcaccgagtacgtgaaggacggcctgaagcacacctgcgtgaagttctacatcgagggcagcgagcccggcaagcagggcaccgtgtacgcccaggtgaaggagaaccccggcagcggcgagtacgacttcagatacatcttcgtggagatcgagagctaccccagaagaaccatcatcatcgaggacaacagaagccaggacgactag

SEQ ID NO: 22942 - DNA, 405 bp, Artificial Sequence
  Description of Artificial Sequence: Synthetic coding sequence
atggagggcggcggcggcagcggcaacaagaccaccggcggcctggccggcttcttcggcgccggcggcgccggctacagccacgccgacctggccggcgtgcccctgaccggcatgaaccccctgagcccctacctgaacgtggaccccagatacctggtgcaggacaccgacgagttcatcctgcccaccggcgccaacaagaccagaggcagattcgagctggccttcttcaccatcggcggctgctgcatgaccggcgccctgtgggccaacaccctgggcagcctggccctgctgtacagcgccttcggcgtgatcatcgagaagaccagaggcgccgaggacgacctgaacaccgtggccgccggcaccatgaccggcatgctgtacaagtgcacctag

SEQ ID NO: 22943 - DNA, 516 bp, Artificial Sequence
  Description of Artificial Sequence: Synthetic coding sequence
atggagggcggcggcggcagcggcaacaagaccaccggcggcctggccggcttcttcggcgccggcggcgccggctacagccacgccgacctggccggcgtgcccctgaccggcatgaaccccctgagcccctacctgaacgtggaccccagatacctggtgcaggacaccgacgagttcatcctgcccaccggcgccaacaagaccagaggcagattcgagctggccttcttcaccatcggcggctgctgcatgaccggcgccgccttcggcgccatgaacggcctgagactgggcctgaaggagacccagaacatggcctggagcaagcccagaaacgtgcagatcctgaacatggtgaccagacagggcgccctgtgggccaacaccctgggcagcctggccctgctgtacagcgccttcggcgtgatcatcgagaagaccagaggcgccgaggacgacctgaacaccgtggccgccggcaccatgaccggcatgctgtacaagtgcacctag

SEQ ID NO: 22944 - DNA, 450 bp, Artificial Sequence
  Description of Artificial Sequence: Synthetic coding sequence
atgaccggcgccgccttcggcgccatgaacggcctgagactgggcctgaaggagacccagaacatggcctggagcaagcccagaaacgtgcagatcctgaacatggtgaccagacagggcgccctgtgggccaacaccctgggcagcctggccctgctgtacagcgccttcggcgtgatcatcgagaagaccagaggcgccgaggacgacctgaacaccgtggccgccggcaccatgaccggcatgctgtacaagtgcaccgccagcgccagccagggcgccggcatcgccgacggcgtgagcttcacccagtgcagcatgctgcccagactggagtgcagcggcgtgatcagcgccagctacaacctgcacctgcccgccgcctgcctgggcctgcccaagtgcagagactgcagcctgtgccccgccgccacccccagcggcaagtag

SEQ ID NO: 22945 - DNA, 372 bp, Artificial Sequence
  Description of Artificial Sequence: Synthetic coding sequence
atggagggcggcggcggcagcggcaacaagaccaccggcggcctggccggcttcttcggcgccggcggcgccggctacagccacgccgacctggccggcgtgcccctgaccggcatgaaccccctgagcccctacctgaacgtggaccccagatacctggtgcaggacaccgacgagttcatcctgcccaccggcgccaacaagaccagaggcagattcgagctggccttcttcaccatcggcggctgctgcatgaccgccctgctgtacagcgccttcggcgtgatcatcgagaagaccagaggcgccgaggacgacctgaacaccgtggccgccggcaccatgaccggcatgctgtacaagtgcacctag

SEQ ID NO: 22946 - DNA, 1371 bp, Artificial Sequence
  Description of Artificial Sequence: Synthetic coding sequence
atggccagcgccctgagcctgggcaacaagtgcgaccccttcctgagatgcgtgctgtgcagaggcggcggcgccctgcagggccccagaggcagaggccccgacgacttcgagagccagctgagcccccccggcagcgccagaagactggtgagaagcaagagagcctgcggcaacccccccgacgccttcggcctgagcagagccagcgtgcacccccccctgcccagagtgagcatcggctgcagcagcggccccggcagagccaagagagagagagtgggcggcgccgcctggagacagagaaagatggccgccagcgccgccgtgttcagcagactgagaagcggcctgagactgggcagcagaggcctgtgcaccagactggccaccccccccagaagagcccccgaccaggccgccgagatcggcagcagaggcagcaccaaggcccagggcccccagcagcagcccggcagcgagggccccagctacgccaagaaggtggccctgtggctggccggcctgctgggcgccggcggcaccgtgagcgtggtgtacatcttcggcaacaaccccgtggacgagaacggcgccaagatccccgacgagttcgacaacgaccccatcctggtgcagcagctgagaagaacctacaagtacttcaaggactacagacagatgatcatcgagcccaccagcccctgcctgctgcccgaccccctgcaggagccctactaccagcccccctacaccctggtgctggagctgaccggcgtgctgctgcaccccgagtggagcctggccaccggctggagattcaagaagagacccggcatcgagaccctgttccagcagctggcccccctgtacgagatcgtgatcttcaccagcgagaccggcatgaccgccttccccctgatcgacagcgtggacccccacggcttcatcagctacagactgttcagagacgccaccagatacatggacggccaccacgtgaaggacatcagctgcctgaacagagaccccgccagagtggtggtggtggactgcaagaaggaggccttcagactgcagccctacaacggcgtggccctgagaccctgggacggcaacagcgacgacagagtgctgctggacctgagcgccttcctgaagaccatcgccctgaacggcgtggaggacgtgagaaccgtgctggagcactacgccctggaggacgaccccctggccgccttcaagcagagacagagcagactggagcaggaggagcagcagagactggccgagctgagcaagagcaacaagcagaacctgttcctgggcagcctgaccagcagactgtggcccagaagcaagcagccctag

SEQ ID NO: 22947 - DNA, 723 bp, Artificial Sequence
  Description of Artificial Sequence: Synthetic coding sequence
atggtgcccagattcctgatgagcagcaccatgatgatcatcgagcccaccagcccctgcctgctgcccgaccccctgcaggagccctactaccagcccccctacaccctggtgctggagctgaccggcgtgctgctgcaccccgagtggagcctggccaccggctggagattcaagaagagacccggcatcgagaccctgttccagcagctggcccccctgtacgagatcgtgatcttcaccagcgagaccggcatgaccgccttccccctgatcgacagcgtggacccccacggcttcatcagctacagactgttcagagacgccaccagatacatggacggccaccacgtgaaggacatcagctgcctgaacagagaccccgccagagtggtggtggtggactgcaagaaggaggccttcagactgcagccctacaacggcgtggccctgagaccctgggacggcaacagcgacgacagagtgctgctggacctgagcgccttcctgaagaccatcgccctgaacggcgtggaggacgtgagaaccgtgctggagcactacgccctggaggacgaccccctggccgccttcaagcagagacagagcagactggagcaggaggagcagcagagactggccgagctgagcaagagcaacaagcagaacctgttcctgggcagcctgaccagcagactgtggcccagaagcaagcagccctag

SEQ ID NO: 22948 - DNA, 252 bp, Artificial Sequence
  Description of Artificial Sequence: Synthetic coding sequence
atggccgagctgggcgaggccgacgaggccgagctgcagagactggtggccgccgagcagcagaaggcccagttcaccgcccaggtgcaccacttcatggagctgtgctgggacaagtgcgtggagaagcccggcaacagactggacagcagaaccgagaactgcctgagcagctgcgtggacagattcatcgacaccaccctggccatcaccagcagattcgcccagatcgtgcagaagggcggccagtag

SEQ ID NO: 22949 - DNA, 297 bp, Artificial Sequence
  Description of Artificial Sequence: Synthetic coding sequence
atgagaaagcacagctgcagaaaggtggccagcctgagaagaaccatggccgagctgggcgaggccgacgaggccgagctgcagagactggtggccgccgagcagcagaaggcccagttcaccgcccaggtgcaccacttcatggagctgtgctgggacaagtgcgtggagaagcccggcaacagactggacagcagaaccgagaactgcctgagcagctgcgtggacagattcatcgacaccaccctggccatcaccagcagattcgcccagatcgtgcagaagggcggccagtag

SEQ ID NO: 22950 - DNA, 858 bp, Artificial Sequence
  Description of Artificial Sequence: Synthetic coding sequence
atggaggtgcccccccccgcccccagaagcttcctgtgcagagccctgtgcctgttccccagagtgttcgccgccgaggccgtgaccgccgacagcgaggtgctggaggagagacagaagagactgccctacgtgcccgagccctactaccccgagagcggctgggacagactgagagagctgttcggcaaggacgagcagcagagaatcagcaaggacctggccaacatctgcaagaccgccgccaccgccggcatcatcggctgggtgtacggcggcatccccgccttcatccacgccaagcagcagtacatcgagcagagccaggccgagatctaccacaacagattcgacgccgtgcagagcgcccacagagccgccaccagaggcttcatcagatacggctggagatggggctggagaaccgccgtgttcgtgaccatcttcaacaccgtgaacaccagcctgaacgtgtacagaaacaaggacgccctgagccacttcgtgatcgccggcgccgtgaccggcagcctgttcagaatcaacgtgggcctgagaggcctggtggccggcggcatcatcggcgccctgctgggcacccccgtgggcggcctgctgatggccttccagaagtacagcggcgagaccgtgcaggagagaaagcagaaggacagaaaggccctgcacgagctgaagctggaggagtggaagggcagactgcaggtgaccgagcacctgcccgagaagatcgagagcagcctgcaggaggacgagcccgagaacgacgccaagaagatcgaggccctgctgaacctgcccagaaaccccagcgtgatcgacaagcaggacaaggactag

SEQ ID NO: 22951 - DNA, 438 bp, Artificial Sequence
  Description of Artificial Sequence: Synthetic coding sequence
atggtgggcagaaacagcgccatcgccgccggcgtgtgcggcgccctgttcatcggctactgcatctacttcgacagaaagagaagaagcgaccccaacttcaagaacagactgagagagagaagaaagaagcagaagctggccaaggagagagccggcctgagcaagctgcccgacctgaaggacgccgaggccgtgcagaagttcttcctggaggagatccagctgggcgaggagctgctggcccagggcgagtacgagaagggcgtggaccacctgaccaacgccatcgccgtgtgcggccagccccagcagctgctgcaggtgctgcagcagaccctgcccccccccgtgttccagatgctgctgaccaagctgcccaccatcagccagagaatcgtgagcgcccagagcctggccgaggacgacgtggagtag

SEQ ID NO: 22952 - DNA, 459 bp, Artificial Sequence
  Description of Artificial Sequence: Synthetic coding sequence
atgcccagcgtgagaagcctgctgagactgctggccgccgccgccgcctgcggcgccttcgccttcctgggctactgcatctacctgaacagaaagagaagaggcgaccccgccttcaagagaagactgagagacaagagaagagccgagccccagaaggccgaggagcagggcacccagctgtgggaccccaccaagaacaagaagctgcaggagctgttcctgcaggaggtgagaatgggcgagctgtggctgagcagaggcgagcacagaatgggcatccagcacctgggcaacgccctgctggtgtgcgagcagcccagagagctgctgaaggtgttcaagcacaccctgccccccaaggtgttcgagatgctgctgcacaagatccccctgatctgccagcagttcgaggccgacatgaacgagcaggactgcctggaggacgaccccgactag

SEQ ID NO: 22953 - DNA, 930 bp, Artificial Sequence
  Description of Artificial Sequence: Synthetic coding sequence
atggcccccaagttccccgacagcgtggaggagctgagagccgccggcaacgagagcttcagaaacggccagtacgccgaggccagcgccctgtacggcagagccctgagagtgctgcaggcccagggcagcagcgaccccgaggaggagagcgtgctgtacagcaacagagccgcctgccacctgaaggacggcaactgcagagactgcatcaaggactgcaccagcgccctggccctggtgcccttcagcatcaagcccctgctgagaagagccagcgcctacgaggccctggagaagtaccccatggcctacgtggactacaagaccgtgctgcagatcgacgacaacgtgaccagcgccgtggagggcatcaacagaatgaccagagccctgatggacagcctgggccccgagtggagactgaagctgcccagcatccccctggtgcccgtgagcgcccagaagagatggaacagcctgcccagcgagaaccacaaggagatggccaagagcaagagcaaggagaccaccgccaccaagaacagagtgcccagcgccggcgacgtggagaaggccagagtgctgaaggaggagggcaacgagctggtgaagaagggcaaccacaagaaggccatcgagaagtacagcgagagcctgctgtgcagcaacctggagagcgccacctacagcaacagagccctgtgctacctggtgctgaagcagtacaccgaggccgtgaaggactgcaccgaggccctgaagctggacggcaagaacgtgaaggccttctacagaagagcccaggcccacaaggccctgaaggactacaagagcagcttcgccgacatcagcaacctgctgcagatcgagcccagaaacggccccgcccagaagctgagacaggaggtgaagcagaacctgcactag

SEQ ID NO: 22954 - DNA, 927 bp, Artificial Sequence
  Description of Artificial Sequence: Synthetic coding sequence
atgggcaacaccctgggcctggcccccatgggcaccctgcccagaagaagccccagaagagaggagcccctgcccaaccccggcagcttcgacgagctgcacagactgtgcaaggacgtgttccccgcccagatggagggcgtgaagctggtggtgaacaaggtgctgagcagccacttccaggtggcccacaccatccacatgagcgccctgggcctgcccggctaccacctgcacgccgcctacgccggcgactggcagctgagccccaccgaggtgttccccaccgtggtgggcgacatggacagcagcggcagcctgaacgcccaggtgctgctgctgctggccgagagactgagagccaaggccgtgttccagacccagcaggccaagttcctgacctggcagttcgacggcgagtacagaggcgacgactacaccgccaccctgaccctgggcaaccccgacctgatcggcgagagcgtgatcatggtggcccacttcctgcagagcctgacccacagactggtgctgggcggcgagctggtgtaccacagaagacccggcgaggagggcgccatcctgaccctggccggcaagtacagcgccgtgcactgggtggccaccctgaacgtgggcagcggcggcgcccacgccagctactaccacagagccaacgagcaggtgcaggtgggcgtggagttcgaggccaacaccagactgcaggacaccaccttcagcttcggctaccacctgaccctgccccaggccaacatggtgttcagaggcctggtggacagcaactggtgcgtgggcgccgtgctggagaagaagatgccccccctgcccgtgaccctggccctgggcgccttcctgaaccactggagaaacagattccactgcggcttcagcatcaccgtgggctag
